United States Patent 11,001,841 (CCCTC-BINDING FACTOR (CTCF) RNA INTERACTOME) - sequence listing, part 19

SEQ ID NO: 48068 - DNA, 1031 bp, Homo sapiens
tgggtagttaaacttcagagatattttgttgcctgtatttaaatttcagaagataaataaatatcattgcatttaaaatagcttaacagtgaccttcagaagacttctgaaaaagacagtctgagaacatgaacacggatcgatataatgtacttcatgggttgaagagacctttctctataaaggatgatgcagtattcagttagtggttttttactcttcatttgattaaaggtggtgacgttttggagagactgattttgaatgtacttaagtctattataataacaaaattcaaaacccctgtgtatctaaagggaaggaagtgtcatattttaggaatttttcttaaccttagcaatgagagcctaaaatacatacatggattatttttcttctaggaagtaaatttcctgctgctttaaatgatatgtaaaatatcaataatttttacacttaagatgttggtaagacctagttttctaatctctctagcactgtgatgtctccttgtagataatctggaccttgcttagtcctttagttgggaaacagaatcagggcatagagcagaagagagcttgacactccatatggtcctggttctgctacccattagcgattagtgaggagacctttagggagtccactgtgccctgtgtgtcaccacattttcttctgtgaaatcaagattaaagaacagatgactttcaaggtctttttcagttttataactgtgagtctatgtattaggtatttattttcaacaaatgactttaaaatgtcgaatgcaaaccattcccacttggagtgttttatttttcaatcatcatcattgcccccaactccccacatgtatgtgttgtggcatccagagtgagaaaagacaatttatgagttgatgaatctgggccttatttctatttccattttgaagaataacttgtcatagaagcctctgcagtttaacagaaggagccacatattgggagtcacgagttcatctctgtgggttaatagttccatgacac

SEQ ID NO: 48069 - DNA, 1056 bp, Homo sapiens
cttgagggggatgctatgctgatgagcctcttgcaaaaaatgctggagtgctttttttttttttttttttttgagacagagtctcgctctgttgccagactggaatgcagtggcgcgatctcagctcactgcaacctccgcagtggttgggattacaggtgtgagccaccatgcccagctaatttttgtattttgagtagagacggggtttcaccatgttggccaggctggtctggagctcctgacctcgtgatccacccacctcggcctcccaaagtgctgggattacaggcgtgagccaccgcacctggctatactgggctgtttttaaattgccttgctcatcattccggtctggttggacaggtatggtgagccaatttccagttcatgtggtaggtgtgggtagctactttaggttcttaatctgaggaggcagaatgatgagcatctgttttaggaagagaagagtaacctgagagtggtatcccagtgtgtctgatgtgtgctggagtttgagaaccatggagtcaaagcagtagtaggaaggcattcttggagagcatttcagaattcagatctgaagtgatgagagtctcaattaatgtgatggcagtggaaatgaagaggaacacgtgtgtccgagagatacttgacagaagtcttggccatggtgaaagttgctctcctggtcattccttacagaacccatggtagccctagtgtgctggagaggggtgttaattccaggtgagcatcatcgtaaaccactcagaagagctgagtttatgtgctcggaggtgctgagctcccactttgtgtatctaagtgggggtgtgtatagtgtatcctcccaggtgacagtgtggccagctgagatgcagaggtggatgtttggcaagaggactagtatctgttcacagtctgtttcctggtaatgaaggatgaggtgtaaccttagcgagaattggcaggagttaaaatgggaacacctaatattcgaagggaacggatgttgagaaaaagagtgaggatttcagagctgatgtattttct

SEQ ID NO: 48070 - DNA, 1067 bp, Homo sapiens
ttaacctccggcaaggtaataaaaccataatcttaccacacagaaattatttgcatatctaccagattaaaaaatctacaagttaacataattttacagagtataggttttaatagtaaatagcaagccaaacaagatatatactccctagggaattaaatgttccttgggtgggcctgtcagacagtgctccaaggtgaccttgagaggacatgcagtcttccttttgccttgtttccaagctcttataacaagtagatgagttatttcttgcttatccatgcaggaaagaattaaatgtagctcagactgtacacaaaaatggattctagattatatttgtgtgtttgcaatagtattttctctactttatgtatttgaagcatttcttattaatgaaatgagaaaatgcattcttaaaacactagacagtactttcaataaatgggttatgtctatatctaaaaaaatcctgtttaataaaaaaattagtttgtggcatgatatgcttattgtgatattaacataaatctagaaatactgtagaatttccatgaattcgtgtacatgtgtatacaaacataaagaacttgaagaatctgaatctaatcttttatacctcagaaaagatgaataaaatgtaacattattttgttaataattattatattctgctaaagtcaagtctgttgtgccaggtaaagatacaataattttagcttttattaacagattaatttaggcacagtaatattttaactagtttgtttgagcataagtgattcctgaattgaatatcattagaacacaagcagttcagtgttctacttaaggagtgggagggggaaacttatgaagtatttaaagaagcaagacaaataaaatacttgactggaacaagtgggaagttcttagttagaggtgagttggcggtttctgattggctaagcttaagttttgtttttactgtttacggtgagttgagtttccatttgctcgtataggaaccatctttgctgaaggcctcccaattcattattactgtttttattttttgagatggagtg

SEQ ID NO: 48071 - DNA, 1050 bp, Homo sapiens
aaatccctaatgggctttatataaattgcattgtattttaagcataatcaagtgaacttgcttgagttgtttatgtttaatgctcattaattatttgatggtgtcaaattttagtacacttgctgaaagctggatgctttcccatttcagacaaatcccttggttaaacataaggaaaagcaggtgtttggggactggagagcagaggagttatcatatgcagactatttattttaggaaaaacgcagccaagtggtggttttgtgcttttacactgcatgttgcttttctcaaccactaaaaatggcaataagtacttattcttagttaagctattgtgcatatctttgagcttcttagtaaagattactaagaacattttttttttaagtccactaattcattatacttagcctgtatatagaaatactggttttggaaaaactgttcactgtttttcacatattttaatttgtagaaacatcaatggattctcgacttcaaaggatacatgctgagattaaaaattcactcaaaattgataatcttgtaagtgtttaacttcatttaatacttcagtactgcatttatagcttcatcttttattttctcacatgatcttatgagtatgtaaatttaagggataattactggtcattttgcactacctctttttttttggaaacgatctttagaaacagattgtttaagtgttaagataattaacagctatgaaattactgttttgtcatgaaggatgtgaacagatgcattgaggccttggatgaacttgcttcacttcaggtcacaatgcaacaagctcagaaacacacagagatgattactacactgaaaaaagtaagtgatttcaagtcatgtggattctttgaattttgtcattacttcatttaaaaattgtttaaaaaatcaattaggaaaacaattatgatgaatgtatattgttttctcagatacggcgattcaaagttagtcaggtaatcatggaaaagtctacaatgttgtataacaagtttaagaacatgttcttgg

SEQ ID NO: 48072 - DNA, 1160 bp, Homo sapiens
taattcaaagactatttttaggttgctaatttgagtattcatcccttttttaaaaactagctgctgcttttcccccaagattataattccataagcactagtcactgactttatagttaaataaaaccatcctaattctcaaaacagaagagaaaaggtgggaggaactttcagactgctcacagaaggaatatgctgaaaggccaacatgagaaagaagcagcagatcgaaaacgcaagcaagaggaacaaatggaaactgagcagtaagtatttttttttttctaaattttgggttctttttaaaggctagcatggaatttttaaataatagactttcattttccagactttatgaagccttttgaagaagtgacttttcccatgtgttagaaaaatcttcaatatatgatgatgatcttatttcaggcttcattctcttctgagaggatgaaattgactgaggcagtcactctgtgaattatttttgaatttaaacgaagtgcagataggatttaattgatactggctttgcaagaagtgtactcatcctcaaccatttgtttgtataatataatacatatagatagaggggcgataatatactggtagacaaagaatgcaggaaatgcccttattcatcacaccaccaagcaggcctcaccctaaagaccagcaaaagtaacaaaagcacatttggaaacccaggaagccagtaaaagtaaatctaaaggctgacagggtgtacattattatgtatgtgcaatataaatcaaattcaaagctgttttctcttaaattttgatacttatagagacaggacttgccatggggaatttctttccccttactatataattttattactagaaggaaaagtaatagcaatgataataatgaacagacttcgtgtctttattacatttgctttcctagttacctttagactgtcacttctgagttctttctctgacatgcttttcttttctcgtgaagcgtcttacattctgactaaattttgtttttttgttgttgttttagtgaggtgatttttaaaacatgctctaggtcaataagacaaagttaatgatgagcagtaaaacaattcttgaacaattttgtactttttttctttatataatatatccgtaagccaaagt

SEQ ID NO: 48073 - DNA, 1031 bp, Homo sapiens
aatagcatttgattaaagtcattaatattttaaatttgtgcgttctttattgatagggattttgatttttacagtttgcagctctcttcagcattgcctatttaaaagtattttcttaatttggcaaattggaaatattttggaaaaatcttcgtaaaacaaaaccaaaattgagtgaattttttttctactttttaataggattcttactgaaaatggggggtaagatgagtaatacccagaaaagaaaaaagatttttatttatatattttggagtttaatattgcagtggataaaattaatagtgctagggaaactcagtgaattttgatatgaacttccaaagatatgtaactgcataagtaatataatatgtatatgaatattaaatataagtgctgtttcctattctaaaagttgaattttgtgacattactgttaaaacgatagtgaaaaatgttttaagccctctcagtcataataaggacaaattgaggattactctgtttacctctttataaattttttgttgttgctcattttaaccatggtgggggaggtattattttttcaatttagcaataattgtatctgtaataagctactaatattcttaaatagtatgtatcatttctaatatttatatctgagatttgtatcttaaatagaaactagtagttactgattttttttccatgtgtatattagctacagaagtcaagattccaaaaccaagaggcagacccaaaatggtaaaacagccctgtccttcagagagtgacatgtgagtttatttttaatgtataattatgcaataaatgagacatttgactttaaacaagcacatatctctgcgattttatcagttttctcttacaggatgtttgttattattttgatctttcttaaaattacaggaaaaactgggaaaattttgtaaagtaaaaattggtaaggaatggctatttatcatttcattaattaagactcttgggtatatcaatttatatagatacttagataatacaac

SEQ ID NO: 48074 - DNA, 1027 bp, Homo sapiens
tcccattgattattaagattgccttgcatggtcctttttaagaactgctttttttgaggttaagaaaaatgattcatgtaaaaaaatttatcttttatacagtaactttgtggtagatcagtcttctgtggcttttagacttagagccatatctttaaaaaaaaataaatatttgaggttttaaaacattttcctgtaattatttttgaggtcttttcctactcctgaagttcctggtcaccccaattttgagccctttggggattttaaattgtaaatgagggtgcttaagattcaacttctttagttgtctttttagcttccaaattttatttttgccttgtttggttttaagagtttatacttttaaaataatctctttactgttgtttttctggtttttcaggagggagaatttgtgttgaattgggtttgttctgaccagaaatacgttttcatggaggtttaactcaagtcatttacttggaatttgaaacctgttacataagaggaatgttatactgttagagctaaatgtgttaatttttctaatttgagattatggacaggaattaatgatgtctagtaaaatcttcagtttttgatggaatgagatgatttcagtttaactccaaagtaaatttggtaaattattggtttgccttaatcctagcataataatattactttgaaaatgggatgtgcagttaaaatacatggatacaatgaatgttacagaatttaaataataaagctgacttttatataccctgattttttatatatgtgtgtgtgtgtattttttttttttttttttttttttttttgagatgcagttttgctcttgttgcccaggctggagtgcaatggtgtgatcttggctcaccacaacctccgcctcccgggttcaagcgattctattgcctcagcctcccaagtagctgggattacaggtgtgtgccaccacgcctggctaattttgtatttttagtagagacggcattttgccacattggccaggctggtt

SEQ ID NO: 48075 - DNA, 1032 bp, Homo sapiens
ttatgagtttagctacaccaaataaccagtgatgccattggggtgcctgcctcttcctgcagctcagcagagtgaactgtgaaacataattgtattcctgttttagccttttattgttattttgtcaatgaatgtcaacctgtgatttaatctcattattcacaaagcctcttggattacatctctgatctgtctcttagacttaccttctcctgtctcttcacttttactttgttagtcacgagaaccccaggaattttatctccttggtttttcccttttaatttgctgtgaagctaagacaagttttcttacctttttcttgagccaacagaccttctcaaacagaaaccctcctttgtctttaatcctgctgtcctcaggcccatttctttcctctccccagagtctcagtttcatccatccttgactccacaatgtcttccttgtgcaaataaagcattagaggggattttgagtgggggctgaagtgtgcagggctatagggtttctaggattcctgtcataaagctaacagaattgccctcttccttctgtttacgaaagcagacttcttcatgattcgaacaccttggaggagttttacacaggtctgcctgggcttctcccaaagtggttatacatgaggtagttgcatttttggtctccagataggcatgttagtaagatggaaagcagaaagatgttaaatagtgtcttttaggtttggcagttaattagcaaagatttccaggtctttgtttatggtccttctagattttataagatcaagttgaagatttttcaaaagcaagaatgctctttgtgtaaagtgacacagaggaaggggagagacacatgcaagatttgttagggctgaagattccaagcaacagtgtcaaagctattcttttctatatagttgtaaatgagtgtgtgtttaacaaattcagaagccaagaggaccattccacactgacaaagagcaagctaatacacacaaaatctgattcatctttgttactaggtagc

SEQ ID NO: 48076 - DNA, 1108 bp, Homo sapiens
gtatgtttcattctgcctacaaatattacagttgttccagctggcctcctagaaacattagcccgaagttctggaaaagcacagtcacataaaagagctttgtgtgaatagagaatggtgtaattttgtttacttacacaagcaaagtgctctgatgtatattgtgtatgctagcggtgcatcttcctccgtcagtgcccagcaagaaatatgtgtttaatgtaaatctgctaaaacaaataaacatgccaagttctttttccacgattttaagtgtttctcagaaattatcaaaacattgcttgaaaaatttccctaaatgcttcccagaatctattgttttcaatgagaattttttttgtgtggccatttttattcttctccccatcttgcctgctcatacttacacacttgcaggcacatagacacacaacattgatccatgcacactttggaaagccaagtcttataaattagagagataaacataatctaacaaaaaagggaaaaaatgactctgaaatagtagggagcagtcagatcagttaaactttttgactgagggtttaaatactggctttagaatgacaatttaaggttgaaatatctgcttattacatatggacccatctcagttacaaaacaggtaaatagcgggagaatgagagagaagaggactgcacatattatgtataagtgttttcttcagaactgtttgtaatgctcaaaggtttctcttccacagaatatctccctgaaactcctgctttcagcactcagagccacctctttccaacccacatgtgggatctaggagttttccatttgctgacccctagctagaagtttgttgaatgcccctgttcatattacctgagataatggtctgagcctatcactcactcctgaggtgatccagaagttagatggtatatctcctaatttctgggtcacattctgatacatgtccacctaaccaagaggtcagcacaccggcaggtgtaggcaagcaaaggcggattatcagtgtcttgcagagtgtctgcgaaggtgtgtgtgcatagcacatacctgctatatattggtgttagctctgtagggaggtagt

SEQ ID NO: 48077 - DNA, 1061 bp, Homo sapiens
ttttccatctttctgctctctctaaacacgccatgctttcctccactctctgtgcctttctacttactgctgcatctatttagatggttcatcttcacctgtttggctcttcaggcatggctcagaagtcacctctgctagaaggactgccttagccccctgctgtgcaagtagagtaccctttcccagcatgggagcaacctgaatgccttacttttatccttttgcctagctcttccattaaaccacataagctccttgagggtcttatttggatttgtagtctcagtctgcacatagcacagtataggcatgtcttaaatgtttattaactggagaaaggagggacagaggccagcatagaactggaagattatttcaggatttcatccatccttagtctacctagtctacctaccatgttgccacgtttattacagtaggtgctcaagacagctctgaatgaatgagttgtttgttccctcttacacatacccacccctaattaaaaattcaaatcatttttgtatcaatattgtactttgaaaagatcttctgaattgatggcttctaacttcaggttgttggccagatctggatgtggtcagataaggtagatgtaactgtttcctgagtctaaaacctatcaggatgcactggttgggaaatggatagagcaccttagtgtattttctgagaaacacagatcagtggttttgcttacctgtgtgttgataatgagtgctttttctgcgtgcgtactttatttcttcgaaataggacttacgtgaaaacaaagtggcttaatcattcaattacagtttcctctatgaaatttttcaataaaaatgaaataaagcaggggagctctaagtctgtttcatactctgcagtatggatgatcaccaggaaacattttcttaatggcatcataatattctgaatgttatttatactaatgatcacgaatttcatcttagtgatgcctgtaaaaaacttaacctacatgttaagttgacttaagacacaacgtttcagactacccagactgaagacacacc

SEQ ID NO: 48078 - DNA, 1046 bp, Homo sapiens
aatttcttatttattaagaaccttttcggcctggcgcggtggctcatgcctgtgatcccagcacttgggaggccgaggcgggaggatcacgaggtcaggaaatcgagaccatcctggctaatatggtgaaacccgtctccactaaaaatacaaaaaattagcggggcatggtggcaggcacctgtagccccagctactcgggaggctgaggcaggagaatggtgtgaacccaggaggcagagcttgcagtgagccgagatcgtgccactgcactccagcctgggcaacagagcgagactctgtctcaaaaaaaaaaaaaaaaaaaaaaaaagaaccttttctcatgtcttagacccgtgtcttcataaaagctatttactttaataaagttttcacattttgaggggaaaatagtaataaataacattctatacctttcatttgcatgaacactttatttcattattatgtttttcttttcttttcttttttatttcatttgagacagagtctcattctgtcacccaggctggagtgcactggtgtgatctcagctccctgcaacctctgcaggttcaagcgattctcatgtctcagcctcccaagtagctgggattacaaacatgcgccaaaatacccagctaatttttctatttttagtggagacgggtttcaccatgttggccaggctggtctcgaaatcctggcctcaagtgatcttcccccctcagcctcccaaagtgtttggatttcaggcatgagccaccacgcccagccatatctcattattttttaaaagtttattttgtatgaagaaagttatgctttatgccagtgctacccttctccagtaaaacaactaattgatggttgagatgattgttttatttgatgaaaaatgatacttttatatcaaaaagattcttactagttttttatagaaaccccttaaaacatcaaagttttatagtgtacataaaagatgtgtttgtccacatactaacctcgcaaataaatgtataaagtaaaacaacaaagtagtttta

SEQ ID NO: 48079 - DNA, 1025 bp, Homo sapiens
tctgctaatgttttgtccttgtagaacattatgcttcctctttgcttatgagctgtggttttcctgactcagactaggttccagctccagctggaatggctgttgctcttcccctctcctcctgccccccttttcagggagtgctgggagctaaggaggagtagtggggcctgcacaatggagctctttattaaaatacctgacatctgcatgcaatgcaccaaaatcatctcagctcaagcagaggaatgtgctgggcattactagtcactttttgtctagtgctgtgtgcttgtttgatttatataatgagtgagtgcctctggcaaaagaggatgttgagcatattattggaggaagggagctttttaattttttccaagaacattgtcacagacaggcctaatactcatacaaaaatatgagtatttaaaaacggttgcagctatcccatggatttcttgctgtggcttaaaaaatgttacacccccctctgctccatttaaggtaaaattagaactcagtaatccaatttaacatgatatggagttttaatgttggtgactactgttagtaggaagtagcacttttaaggaatctcacgttacaaagaatctctggaaggaaaacgtaaaatacatgtcaaaaaaccataaaggcacacacatagaaagaattattggtgagtctttaattcccgtcccctccctcagaagagtacattactcttttcatactgcaggaaataggtatatgtgcgcaaattatattttcttctctaatgatgtaaaccattcacgttttacctatttatggccagtatatgacgaatactgccatgctaacacgttatatcataaagcactgaagtgtcatgacattgctgctcacattgccaaatcagcaacattgtccccattcccacttagaccttttatttccggtggaaatttaacttaagatttcagttgggttgtgggtacattcggagcaccagacaggggaggtagagggagatagagctt

SEQ ID NO: 48080 - DNA, 1056 bp, Homo sapiens
taaatttccttagggaacttgtcagaagtgcttacctagaaatcttgcctgtttgcactctggcgtctccttaccacctaggatgttctcttactctgaaactcctaacgacctaggcaaatgagagacctgagctgaagccccattcactctcaggttaaatctggtgtctactagtagctcatactgtacttcattacagtttcatcagtcattaacactggtagcagtttcaaaggggtcacagtcaactctgttgctactggtttccttgtcattttatttaacttttttgtctttattataattcgcttcttttaccatgcatggtgttctcaccccaagtgctcattaggtagtaaagaggaaaaggtggagattgaagaagcagcttatttcacagcataatctcatatggtggtgttttgtttttttgggtgaagctaaaatctgttagagttgtaaaatagaacagttattaaaatattcttttttgagatggaattgttgtccaggctggagtgcagtagcacaatctcagctcactgcaatctctgcctcctggacgatctcagttcactgcaatctctgcctcctgggttcaagcgattctcctgcctcagcctcccaagtagctgggattacaggcgtctgccaccatgcctggctaattttttgtatttttagtagagacagggtttcaccatgttggccaggctggtctcgaactattgacctcaggtgatccgcccgcctcggcctctggtgttgggattataggtgtgagccaccgcgctgggccaaaagattcttttaatctttttttgtattctttttccagaaagtttatacctttcttctctttagtcatactttgaagagggtttaacaagattcaccttcacagttgtttttcaaggcagcgttaggacctgacattaattgtttttttttgttttgttttttttttttgttttgagacggggtcttgctatttcgtccaggctggagtgcagtggcgctatctcggctcactgcaagctccgcctcccgggt

SEQ ID NO: 48081 - DNA, 1045 bp, Homo sapiens
agaccaaacctctatcgtttctttgtcatgatttttcttctcattttgtcattctaaccccacagctcttcaatctttcctcacttccaagtccattttactgttgataatacaagatgcatttggcatctgttctgttgttaaagccctcaggaaaaattataaagctgttcttgcaaattcatcattattgttaagaaccgtaatttacctcatggttatctcatcctttttccacctcttacctgagctccaggatgacattgccttcctgggtgaggcagcgttgcagcatctcatctctcccaccttaatttgtagcgatgcgttgcatttgggtgacaggcagttgttcgtgcttgaataactcaggatttgaattctacagtttgtggcatccgtgtaatgcttagcagtaggtacagctgttaactattcgcttataaataatcttttttgcctctcaacctgtctcccaggtagtgtacctgtcaccattaataactctttagccgctccctagtgatttgacctatcagttgtcgttcacagaaaagtggtgctctggcctgctattgaagcttatgcaggttctttcagctcctcagtcaccccagcagccatatacttgtaggaagttgtgttggtgggcttcacaagcaggcagctgaacacttcgtacagtttgataaaggtggcattacattttgaacaatagatgataagactcccatttagaccgcaaaacagtgccacaggggtagacaggggtctgggggagataagatgggtggtgaagatgaccaacagcaaataaactttcctgtctctttgatgctaattatctctttgcacctaattatcatggcatcatcatcatcctctgatgtttgcaaactaagagttgatgtgtttgatcaggttagtgaatctgtcaggtatggcattctgcctgtttctgaagcttaagaatgagaagccagtagctatcatgcggaagatgtgaactgccccccagtccttgtcctttagcagtgtgtcattc

SEQ ID NO: 48082 - DNA, 1070 bp, Homo sapiens
ctcaagccatctgcccaccttggcctgccaaagtgttggggttaggggttacagacgtgagccaacacgcccagtcgtatttatttttccccacaaatattctatttgtttttttccccctgttttgaggattcaggaaaatgtatttattcaagagataactggtatattacaagtagtaaacagacagacaacatgcccctctgttacagctttcaatttagtggaagtggtatattataagtggtaaacacacacacaccatggtatattacaagtggtaaacagacagacaccatgcccctctgttacagctttcagtttagtggaagttggtgactcaggctaaattaagggaaaggggagatcactgggtatgttttctaatgaaaacgtaagtatgatctataattattgcagtcattaattatatgtaaatagactctttggacatactaccaatttacttgaaaagtcaatgctttaaggaattttaaacatttttcaactgtcttggttgtattttaataatattaattcaaactctgcaattaaatgactgactaacgtaaatttcaacctggcccccactttttgaattaaaaacatttatattagtttcagttactgagattttgctgtccattatggaaaacccacttatttattagattatagaaggtaagcagcaaaagatatatttccttcccattccttaaaatgtttcgacaagttaatgaaaacttattttaaaatttccttttagtgagaaatcaaagatgatcatttttagccccatcaggatcattttagaaaaactgcctgtgaagtcactcatttagaacgagacgatctctgtggaattgctgttgccagtgccacgtggggagtaattgggccaattaaaatgtagatgttttatattaagttgtggtgcctgttaaagtagagtaccagatttagaattagtctgtattccctttgttagtttccttcactcagtacatagaattttagttcatctgatagcttgactgataagtaatatatgtatataattaagaaggtga

SEQ ID NO: 48083 - DNA, 1038 bp, Homo sapiens
actagatggtttttatgtcaagatgcttttccttatatttgttcaaacccaaacattggacacgatggtaggccacggaaatcagttaataagtatttgccaaatgattgttcataccagccctctcagttgcagaatgaaaaactttgaatgcttctttaataataaatcttcttgactattggctgtgattctaagtcccttgttataggagtatggttattaacctagttatttctgccatgtttcaatgtggataagcgtatttaacagattcgctctgttgcattgatcctgtgatggtgttatatactactccagtgccctggactgtgcgctacagggcagcctctagactttgggattaagtaatggtgattcggtgggggtatgggttcttattttatgggagtgttttggcaattaagtgctatttaaaggtattatttttgttagaaagataaggatttagatctgtggttcattaattatgtaaaagttgaattagcaaaggctagtttttggctcaaattatgaaagaatactcttgggaaactgggtatcggggagaggataagtaagtttggttatttgtcttgagattttatagagaacacacacgtaccccataaatgtagttttaaagaattgttcaaagtaaatcaatttttgattttaagaaaagctccaggccggacatggtggctcatgcctataatctcaccaccttgggaagcctaggtgggctgatcacctgagatcaggagttcgagaccagcctgaccaacgtggagaaaccccgtctctactaaaaatacaaaattagctgggcgtggtggcgcatgcctgtaatcccagctactcgagaggctgaggcaggagaatcgcttgaacccgggaggcggaggttgcagtgagccgagatcgcaccgttgccctccagcctgggcaacaagagtgaaactctgtttcaaaaaaagaaacgctccacatttttaaataatacacaggttttgcagtgtaactactggtgaggac

SEQ ID NO: 48084 - DNA, 1041 bp, Homo sapiens
agttgcattttagatgttttctttgggtggttcttgtagccatcacagaaataaacataccttagtttgcaaaccgctatttacttggatctgaataggaaacattgtcacgatgttacgatatactgtatttccggataccttaacaattattagataaacacgatgaagatggaaaatattgaagaaataatgatattataaaaacttttgaatggttttagttgaaaacaaaccaagaatatattggtatagacataattgcaaagtagagctaccgcactaccaaaaaaagttatttgaggtagttgctggaagcagaattttcacggttagaaatgcttaaaaagaggctcttttaagtagaaaagaatgtgagactttagttattgtaacagtaggcttcagagtagccataaatgaagtttagctggagtaagactaacagggttttaatctgttgtttttctagttaaggcttattaataacatttatgtatggccttgttcatttgtgcactgggacagaactagaaccttgggctccccattttgttctttggtacagggccatcgtatttcagtaaatagagagttttttctcttcttagacgtctaaacaatggcaataatttataactaactgctcttcgttatgttgcagaggcaaattgcgcagaaaattatggataattttaaaaagatgaaatacaggtggctcatctaaaacagactccaattaaaaccacattgtattaaatagagcctgctttagataggctcctcttcatgctaaatatgaatgaagcaacaattttagatataatagctggtatctggattttaatatgatcagttctcatgcttcggggcccaaatattgccagctggtattaagaaacctaccctcctataaaactcgattatattgttttccctaagagtattgctttaggaattattgagaaagtggtttttacagggtatagacttttgcataaaagttggtgctaaaatttgactcatcaaaatttgcatcac

SEQ ID NO: 48085 - DNA, 1030 bp, Homo sapiens
ggagtagtccaaggaacattcctaagattattttgccatatgctttgtgcagattttgagtctttttcaatcttaagtttaaattgtttccagtttctgaatattaataaaacaaacaaaccaaccctcttaatgtatcccctgttctacacattcccttactttttgggaactcttttgtcccctgccctcaccaccatcctaccctttgccatatggagtgtgggatgtattgtttgttaggttttaaataagcaaatttgccttctctgtgttgaagaaacctttacttttaaaaactgattatggcctctaggcaccaaatcttaaacatttctgtagcttatctgttgagtttattatagatcgtatctagaaatttatttagcttgtttgagttgccaacaaaagttggccaagaaatctgtataatagaattgtctgtccaattttgaaatatgacttctaattatatcttttgcatacacacaaaaatctgcagtattaatttgagctctgtcctaatcacaattattttttgttactttccagtaaaatagctttttcttgtaaatttttgacataaacaccagaccacatttattaaaatgaaaaaatacttgctgttatcaaggtattcaaaagtattataaaatattaaataaagttagagtttgtggcacattgactaacaaattttatctgacagagaccaagaaaaaaatacataaaattataaagtaaataaacaaaatcagtaatttccacaaacaagtatgtttatgcaggagcactgttaacctactagtgttcagagtaatttctgaatcaagataatttctgatggtgcttttaaagagtctagttatcttgtaactaatatgacatgggattaaagttaatctctttttaactacagtgagaaaatttaaaagccttggcttcatagactaaatacctgaacagacaaattgctgaaataatgcagctaagactgcaagagaaactgcaaaagataccccaagttatg

SEQ ID NO: 48086 - DNA, 1030 bp, Homo sapiens
ttttgcttttttttaaataaatattttggccagcctcagaaatttagtaatggctttgaacacttggaattagcatgataaagccagagtttattatatactgttgtgatttaaatcacacactggttattttggggagttagagcaatctacttgacacagacaggtcttccctggcggaggcttgcccctgcatgttctggatagatggctttgatgttgggtgaacatcacaacttgaactgctgtgtttacactgtaagaatgcttgctgaatctctcactgcatctctcacataattccaacttcactttagttctgaatacatgaacagtaaagggggcagtttgcttttaaattttgcttgtcagttaggcactttaagagtcttatttctttatgtgatttcctgtaagagctcatatatggggattgttattgagtaattttgaacacaaaattaattctataccctttgatgtggctaataaaagccataagggtatggtaggaaaagaagataagaagatagagaaaaaaaaattgcctctttctatatggcaagaagaagaaaaaaaaaattaagagcagttgtctttgaaccacagcagggtttactcttaagggtcttctagcttgtttttcccattagctaggaaagcactatgtgagctttaaaaaaaaaatacatatatatatatatttaaatcatggaataatataggacaaatgatttaaattgaatctagattttgcatgaacactcttctagtttattggttaaataaatgctgtagtttcaaataacatcccacctgtttgccttgtttgaggatctggtgagatgtagaattccagtagcttggctaaaaaaggaagaaataaaagatagaataacctggaagttctccacttcccttcaggtattttcttgttgttctttagatttggaatctgttactggattcttctttcatccatgcttcatggcatatagatatgtaggcattatacaaaaagcttatctag

SEQ ID NO: 48087 - DNA, 1024 bp, Homo sapiens
cccagaatttggaaggataagagaattgttaagaatttgacattggaactgttccctctaattgtggcttagaccatttgatgggaaaaaaaatattaaggaatccaggaggtgatatgctgaacaatatggggactattcacggtgaaaacaagcatttacccaagcatttgaccagggtaatgtgtgttttagtttcaggtagtagaaactgaagtggctttgtttcacagtgacatttaggaacattgactaaaatatactgggctgtttaaagttttgttttcttttttccccctctcccttacagtactccccctgactccaaattctccagccttatagctgtttccatgttttgagattactgcaaaaacacttaatggcacacatatgaaaatttttgtaaatgtctaaatagtttaacaatgaaaattttcactcattctacatgtattactgatttggagaatttctaaattgctgcacagttttattgcaatgtagagatgtccccattcccttgcaaattagtaaattaggatctccttctacctctgagtgctatggatgccatcccttctcttgtcccgaaattccggtctattattgaacttctgtttattctacttagggggttgattcctttaaaagtgtattattacatatattaaacataagaattttagaaaatcagagattacaaaaagcaggaacatcatctgtaaccctaactggcctgccctaagatcaacacacctatgtatcccaagtagcccccacaaattatgcttcaggtgacatcatagtatgatatataatattgatatgatgtaatgtcattgatgcatttgtgtatttgtatgtctgatattatgaacagccttctatcatctttaagagtctgcacattattccattatatggataaaacagttctcctagagtttatttctaattctttcctattattaatacacgataagcctctttctggtccaagcacattcccttcagcctactg

SEQ ID NO: 48088 - DNA, 1054 bp, Homo sapiens
tttttaagaaatgaaatgcctacttagtaaggatcatgtttgtaatgatactaactccagagtgcctagatccgtgcagttccagggcttggtttcagaggaaataaattttgttctgattagaaaattaacttgcattatgcattttcatatctctgaatcagtcttgactataaattcatgatgctagtcaaatattaaacacactttcatgcttagtagcataaaatagtgtcaaatggtaaaataagatggtaagaactgctcaacctcaaagaatttacaggtctagtttaggaaatttgctgtgatttctctctctctctttctttctttctttctttctttctttctttctttctttctttctttctttcttttctttcctttctttcctttcttttctctctttctctctctctctctctttttttttttttttttgagacagaggttcactcttattgcccaggctggagtacagtggcacggtcttagcttactgcaacctccacctcctaggttcaagcagttctcctgcctcagcctctggagtagctgggattacaggcatgcaccaccatgcctggctaattttttctatttttagtagaaacaggatttcaccttgtttttcaggctggtctcaaactcctgacctcaggtgatccacccgtcttggacttccaaagtgctgggattacaggcgtgagccactgcacccggctgaaagttgctatgatttctaaggtacttccttaatttataaagaagttacaggtctagtttaggatagttgctgtgatatctaaggcacttccctgcttctgccatgaagcattgtgctaatgctgcctataacctgcctattctgaatttaagattcactatattctgaatctaagaataggcagggtgtaggcagcatcagcacaatgcttatggtataggtgaagcattctggtgctcacatttcacgtggacatgaattctgagagtttattccagagcagaacagcgttttcagctgaggacaacaaaaccttctccttat

SEQ ID NO: 48089 - DNA, 1032 bp, Homo sapiens
catataagtctatgtctaatacatgcaagcatcattcattatcttttatatgagaatgcactcctgtcacctaaagagcagaaaacagatacactaagacaaaacaaaataaaaaacccccccaaaactaaacagggattccagctcgtaggaaaattgtcagcgtcattatttactatttgattcaggatttttgcttcgtgttgtttaccctgctttctttccttgtctctattcctttgactccgtgaagttggtttctttatgtccccaaatgagaactttgtttttggaaagttaaagatgtagattttatttaccttgctcttagattgcttcactactccatggtgttctcttactctttagcagaatttggcgacagtgtccaataaagtaactaataaattgtaggaaaaaaatgtcacatgtaatctctcttgtaaaaccttttatgaatggagcctgatggctggagtttgttgttcctacttaatctcataaagagaatggatttagaacaatgttcttttaggattatgcatagggtgattatgagtgtgatacgataaaatcgtaattatgatttcattttgtcctgaacagttaggattttttgctctggattggtctatagttgatgttaaacattttctttttttttgagatggatcttgctctgtcgcccaggctggagtgcagtggcacgatctctgctcactgcaaactctgcctcccgggttcacgccattctcctgcctcagcctcctgagtagctggggctacaggtgcccgccaccatgcccagctaattttttgtatttttagtagagacggggtttcaccgtgttagccaggaccgtctggatctcctgacctcgtgatccgcccgcctcggcctcccaaagtgctgggattacaggcatgagccaccgcgtccggccaatgttaaacattttcaatttgacatgtcagatatttggatgtattattttaaagatcttttgtctcatcttcataggagtgccccag

SEQ ID NO: 48090 - DNA, 1033 bp, Homo sapiens
gtttcagattctaatgctgctacatgttagctttgtgactttggataagtgactttatccctgacctttattttctttgcttttaaaatggggaaaaggacatttagcttacagattgtcaggaaaatgaaatgagacaacacacttgaagttccagtacatagtagatacttaataaaccttaggtcatcctcctttgacctgctctgtggcttattctccagtttttatcccttgggaagcttgaatttttggaaatagtagtgtaggatggtaggggaataagtttaaataaaatgttttaggttcttcatttatctctaggaaaggcgatattaggccatcagcagatgtcttttttttttttttttttaagtaaagaaactctggcgttatttattagtctacatttttaccactctgcaaaattttcattaggttgatctttgtggatgtcagagtgatgctatcatttctgtgttaccagttttggtacaggtagtttacaagtaaagttggccgattctgttggatcctgtttacttttgtataatcttttctaatcatttgcttgaattaaagcttcctgccttatagtcattagcatttgatagtggatcttgaaacttgattttgcaagttagactccagcgtctgtccctggttttgtgaaaatctacttataatcatggaactaagaccacactaaagcttcgagtgtttacacctctgtagaattaaacaaaacagcagcagtcaacatacatgtatctgggcaatactttatcttcatttagaatcttgcagaatgcctaaagggtagttaaggacttaggaactatttgttgagcaaaataatgtgcttctttttattgttttttagcccaggattatgttttcataaaaaataattgtgttcccatgtgaagtacattaatattattgtggttggtctttttttttttttttttttggagagtctcgttctgtcacccaggctggagtgcaatggcatgatcttggctcactgcag

SEQ ID NO: 48091 - DNA, 1068 bp, Homo sapiens
cattgcctttttttccccttcagttctccaatctattttaccattgtaaaatgcttttgagtttcttactttgtgtaagtatatttctacttatgtggtgtggtgtgggggaagtattcacattcacacaatgtctttaacttggatgcagtgaaacctagtttggtggacttcataatttccatggtccatctctcactatcagtaaatgtgggaaagccaacagatggcctttaagtacttctgattctttaacctgaaatactcagaatcagcagcaaaaagcaattattgtggaagtgatacttgtcttcttccttctagttttaaataattttcatataaatgattccagagagttattccataattgtcagactatgtagccagtgaaaaaaactcagaagacatatttgtgccttgtaggtgtatttttttgtacctgtgtctgtaaaacgatacagatgtcccacttgctagatagaaattatcctaatgtcaaatgttctacacagtatgttatatgtggaagttcagatcatgtatcttggggatttatagagggattaaatgttcttttcaaatatttattttaaaatgagtgttagagaaacttaaaatcttatttattattgagtctggattaattgttgtctctttttgtaacagagcttgtcctctttgtaaatttgtgttacaaagtagttaagattttgtttgagcaaatccatttagcaggtgcagtactgtatatttatgaaaaaatattttttaaaacttagaaagatatcctgctgcttttaaggctcgtgttgtggcagtaacatgttatattgcagacgtgtttcagccagggccacctcagtccatgatatctgaaggagctcagtttgcctatactgggtagcattttgtcagaagactgctggctgggcagactagatttggatgtattagctagtcagcctaataaccctgtacagactgtattgattttctaggagagagtttatgaactaaataaacttggggttggtgtcttaataaactgcttctctcagtctgtca

SEQ ID NO: 48092 - DNA, 1031 bp, Homo sapiens
tgagatgagggagatattcctggattttctaggtggacccagtctaatcacatgaatcattaaaagctgagaacttttcccagctgtggtcagagagagatgaccatggaagaatagtaagagagctctaacattgctggctttgaagatggagcatctgggccctaagctaaggaatgctggtggcggatagaagctgagaaatacaaggaagcagattctgcttttgagtctcttaaatggatggcagccctgctgatatcttgactttagcccagtgagacctgtcaggcttctgaccaatataactgtaagataagaactgtgtgttttaagccactaaattagtggtaattttttagggtagacatagaaaactaatataccttgctttgtgtttgtaatttcttgaataaaattatcaccaaactctctaaatactgtaaaggaacaaaaagctatttgcttgcatataaaattgtaatttataagactttattataatggattgttacaattaattttgcttttaaataacagaacgaacttgatgcgaccttgcaagtatgctttttttttttctttttaaaatcaagggttgctttgctaccattgtaccaggaatatagtaggcagtcaataattgttggaaacagtaaaattacatagtcaacattttcattagctattgttaatgttgttgttaacaatggagttttgagaaaggggcttaaggaaatgtaggaatgtaagtgtgttaggtcttaagaagtatctccaaacttttgacagatatttctcacatttcgatttctgtcatgttcgacagttgtcaagaaattgctcaagggtttattggactcaagcgccagggcatgagtgagtttatctctgtcttgataagctggacactgatggtagccagaaagtagtggtgatggggagttctgattcttcagataatcgtttcctatttagttagaaaatgacaggattcaagatgttgtaccatatagcaagagatttaagat

SEQ ID NO: 48093 - DNA, 1027 bp, Homo sapiens
accttggcctcccaaagtacatgagccactgtgcttggcctggcaggtgtaattcttacatgtcactatagaactattttatatataatgtttgacctataaacttttctacttgctattttagaaaaagaatttgttggttagaaagtcactgaagagagtttaataagagtactgtttgttttttaataaactatttactgtggttcttgtaaataaaacaaagcaacttagttaattctattcaggaaacttagctcaatttcctagtatgaagaagactgatttgatagcttggagtagtagagacctaatatggtttcaatcattgtgtggaggaggacattacattgatgagacaaaaccattttctaggttcttgaaactacttgaccaattacagtaatttgaagggggcacttcctaaataatattaagttcaattcatagtatgaacttttgagttcaaggcttctgtaatttttcttggcttaaaaaaatattcaaatttatagaatagtaatgatgttggaacgtttgattagattttagtgttccacatagttgactataataatttctgaactacaatagtttcagctagaatatttccatttattcaacaccacattaatctttacttacttgtcacacagcttttaaaaaaatctgatgtgaatttgctttattgcatttgacacgtttgggcaaatgacaacaactttggtgtttttaaaatgttccagttccagaaatcagccttcaataagcttcaggcagtttcccagtaagttgttaatggattgccatctttctgcctctcttttaaattttttccttaaaggccatactgggggaaactaactagttcactctagatggctgtactaaccctactttaaataccactgagagtttaaaaggctgcgtttttgcatctagactcacttggatttgaataactgatctctgaccgtgggcaagtctcttaacttctgtgtcttgatttcttctatttaaaaagaaa

SEQ ID NO: 48094 - DNA, 1035 bp, Homo sapiens
ggaggttttaagcagggtttgagttcacatgattttcttgaagggcttgcttagccacccgtcattccctttggagtggtcttccttctggagtcagggacaccatttgtcttaagtgcagtagtaataattccttatggcaagtggccaaataaccagcaattcccagcatgtgaggcccccataatgggcctgcaaggacagtaacacttgaaaaacatcagagagaaaaaaaaattgctctttgcccttagtgaagtaaggctaaaggaaccataaaggaatatagtcaaccattactgctctgaggctaatgacctcgaagctcttggcttcccaagctagttttttttctcttccttcttggcatttcattgcttgagaaaactgttccaggaaatggaaaaagaatggagttcagactcaaagtgggtctttactttttgacgatcctggtaaaatgcttacagggacagaaggttgaaattgtcaagaagagtgtttttggatttgttaatcttggtcctctttgaaggcagagtgcttctaagagaagatcttattcatcgtctgatgaataggtcagttgtcacttgggaggagggagcgaaattggtggtggcaagagaagggtggatttgtaggaagcatatcactttcctgagggttttgttctaattcttctccagatacaaataaacgcaacattgggtgaattgatttacttctgtaagactgattcctggactgtaataagaaggaatttgggtagggcgggggggcttacacctgtaatcccagcactttgggaggtcaaggcaggcggatcaccaggtcaagagattgagactatcctggccaacatggtgaaacctcgtctctactaaaaatagaaaaattagctggttatggtggtgcgtgcctgtagtcccagctactcggcaggctgaggcaggagaatcgcttgaacccagtgggcgggggttgcagtaagccgagatcgcgccactgcactccggcctggtgacagagcga

SEQ ID NO: 48095 - DNA, 1028 bp, Homo sapiens
atttctatgatgtatgtgatactctattaggtgccataggtattacagatgaagtagaagctgtcatcctaagagagagcacaaaattcactggtaaagggatattcattatcttaaaagaattaaccatagtccatggtcttcctctggcatatgaagccttaggaacctaattttgttaacataccattgagaaagatcaccttttcatggatgcattcagtttgttcaccagctgaggagtggagatcacacacacacacacacacgccatgtgaacatgtatgtatctgtataccatatgaggtggaatactcatgtactcatattgaaatgattagtacgtcttctccttggcaggcaaatttaaatggggagtcagattataatccaaatgttgttcatctctttatggggttggaatttcagcagagaatattaagggtgggatgggggcctgagggtcttctcctcctatagagaaattctttccagtgacctgtgatgttcacggtgcacactttggactcctttcctgggctgtgcttgtaagagtattgacagtgtttacccctcttgctttttttctgctaccattgcccttgtgatagacaaatttctctttctttagatacgttaatattctcaagcagatattaggcaactgtcctgggagctagttgttaaggtgactttgcctctctttggttttttatggatctaatgcagatggcagtctcatttcactcgtttcaaattttcttgggggatacctcatgctactgccttacacataacatgttttgtatacggataagtggaaatggtggaaaaaaagatatatattgcaagaaaaaaaagacttagaaactagttattaaatacctggtagagaaagtttcttttgttaaatgccttatagagaaatatcttgatctgaaattgactttatatacaggtggaataaactgctctagaaatcaagagggagtatgtgtatttaatctctgtatctgttttctgtgtct

SEQ ID NO: 48096 - DNA, 1100 bp, Homo sapiens
aataagagccttgatgcaaaagaaccaccgtctgacttgacaagatgaagacgtacccatttaatataactatgatgcacttaaattgaagctatgccacaggatagaaaatgaattacaacttaaatacatgttggaagtgtaacactgtttttcaaggtttaaaaaaattcctaatgccttttagccttctttaatatttttaggtaaggaaagtatgtttggattttttcctctttgtaggtatatgagattgaaatgtgaagtatttggacaacaaacgtcaagcaatgggaagccattttgatttcttgagtaatcttgtaagcattaagtgaatgacaaagtagtagtgtaacttatttcttatgttataacttcagtcaattaatataaggatagtttttgttgtatgttcactaaatggttaatataatagccattgaatatactaatctttcatcttagagaactatacaacttttattgtttcttaatggaacattctggctaaccagaaaaagtgagaaaagtagtaccttgggatgtgtagtcaagatgacaaattttaagactggaaaagctctaaacaggcttaatgattcttcaggtagaatgatcctgagaagtgatgtttgatggaataaagtgcatgtgatgattaagtgaagactggggcagaatgatttaaaaaaaggaaaaagatggaagatgagtagacacttgcaaggaacactgtcaaactataaatccattcagtgggttgtataacatttatatttagtctaatttagactttgataatttaatgctacttttatattttaacaaaaatataaattaaaattttcattagtctgttttgttgttgggtttttttgtgaggtactccctgttgggggaaaggaacaaggaacaaccatcagaatcccccagtccctacagaatagcctcacagtaacttgagaaaactgaacttggggttaaataacttgtcacacttgcagtctcctgcctcactccttcaggtgccctgcctagaaaaagacttgtgtctagcatccaagtgaacacatactattgccctctgtgaaccagga

SEQ ID NO: 48097 - DNA, 1063 bp, Homo sapiens
cttattatccttatcaggggttttgttgcattctaccaatgggcttggtaatctttgctttactttttcttttctgttttaggttgccagagcagttttatctgattcaccacagctctctgaaggaaaagaaataaaattagaggaactaattgactctctgggttctaaccccttcttaacaaggaatcagattccccgtactccagaaaacttgagtaagttaataatgctttctgttacttttttctttcatcgacataaccactgttagaaccatggcctgacagatctttttagctgagttgccaaaggctgtttatttatgctgttgtaatcgacgtactaagtgtgggcattctcacataacagtcttttagcagtattttgtgccttcagtgtactcaatatacagagatataaaattttgataatgtacaattttgtctttgttgttatactttgcttttatctagaaagatcttatttgagcatttaaaaaaaaaaatctcttgcctcctggtctgacctgtgatctacatatttatagagtacataggctgtgttctgccagtcatcaaccagaagcatcagccataaaccatgtgtgcggaggtctttacccctcccaaatgagtcaaactgcccaataccttttttcctataacctgtaatttgtgtaggcaaagttctgatattggtgtccttaggtaggcacatcatcttggttgagtaattaaataatttctgttttgctgctgatttaattcagtttgaactgagccacagcctaggtcagcaaactatagcctatgaaccaaatttggccccaccttgtgtgtttttgtatataaaattgtattgaacataagcatattcatttgttgacattgtttatggctactttcatgctatcatggcagagttaagtagttgacagaatggatggcctgcaaagcctaaaatattgctatctggcccttatagaaaatgtttgccaaactgtggcttagatggacaagaaaaggtctttttaatacatgtaattcatatgtgctgtgta

SEQ ID NO: 48098 - DNA, 1034 bp, Homo sapiens
cagcctcccttccccttccccctcccctcccccttttgagatggagtctcactctcccaggctggagtgcagtggcgtggtctcagctcactgcaacctccacctcctgggttcaagcaattctcctgcctcagcctccctagtaggtgggattacaggtgtgtgccaatatgtgcagctgatttttgtatttttgtagagatagggtttcgccatgttggccaagctggtcttgaactcctgacctcaggtgatctgcccgcctcagtctcccaaagtgctgggattacaggcatgagccactgcgcccggtcccctttctttttatagtactattactttttttttttttaaaactcataggttgtatatataaagatattgatagagtgcctctaaaacacttgaatataatggaaaaatgaacttatagttcataagcttaattatattcaaaagggtttttagacatgattaatttgaaattctccaccccagtacaaaaagctctgcttgattgtagtataacctagtcagtggtattaatttatctaaataaaatggattaactgaagggagatgttaagtatgaaaggaaaatgaggaatcaaaatgagtctggtttggcaggagggaggattctgacaaatgaaaatgatctgaggcctccagagtttggctttgatgtgagttaagtattttcttaggttttctttttttttttttttggataaaatctctctcaagctctttgttgtgattctgtgattgccatgccaagctgctgtgggtataaatttggcttccaaggcacattgtcacctgtaaaggttagcgccctcttcaggaaatatttttattcagtgaatgtattgatcatctgatatgtgctaggtatctcgtagacattagggctacaacaatgaggagaacaggcaaggcaaagtcacttccttcatggaattttccatttaatgaatctctgattgcaaattatataattaaaataatttgcagaacctattaaagttttc

SEQ ID NO: 48099 - DNA, 1501 bp, Homo sapiens
gtctctacaaaaaataataaaaaaaaaactagctgggcatggtggtgcgtgcttgtagtctcagctactctggaggctgaggtgagaggattgcttgaacccggaaggttgaggctgcagtgacctatgcttgtgccactgcactccagcctgggcaatagagtgagaccctgtctcaaaaaaacaacccaaaataccaaaacaaaacattagttgttatatgtttgtggtatactagcttttggggagttgttagttacgtgatgttaatttaatttcttaatattgaaattcaacatttttggtatttattagcttgtaagtctgttttcctttttttaaaagtcaatcagatttagcagtgggagattgtataccaccaacgttagtgacactaatgttcatttctgataacccactactatcagaccagcctgttttctataatcttatttgtgttctgtgtagattcttctcatcattttgtagagacatttaacataaaaccacaggacttgcacaaatgcattgccagatgccatttcgcacgtagcagatttttacaaattttgcaaagacaagattgtgttacccaaaaatatcaggaaaatgcacagtaagtagtaccttgatagttagaaaataatttctttcttttgaacagatgtcaccaatataatgtcaggagaaataatccatgcctacctgaaaaccttggcggttatctttctattttaaagtcagataacttcttcttctttttttttttccctatctgagacagggtctggttctgtcacccaggctcctaggctggaatgcagtggcgcgatgtcggctcactgcagcctctgcttcctaggcttaagtcatcctcccacctcagcctccagagtacctgggattattggcgcaggccaccatgcccagctaatttttgtatttttaatagagacggggtttcaccatgttgcctagactgatctcaaacttctgagctcacgtattctgcccatctcagcctcccaaagtgctgagattacagacatgagccactgtggctggctatagtcagataacttctgcctaaaatattttaaaactttagggaaaaagaaaagatcactttacttatttatttatttattttgggatggagtctcgctgtgttgcccaggcttgagtgcagtagtgcaatcttggctcactgcaacctccaccttctgggttcaaacgattctcctgcctcaggctcctgagtagctgagattacaggcgcctgccaccacgcctggctcatttttttttttttttgtatttatagtagcgaccgggttttgccatgttgaccatgctggtctcgaactcctgacctcaagtgatccgcctgccttggcctcccaaagtgctgggattgcaggcatgagccactgtgcccggcccactttagtttaaaaagttcagttttcttatgtgctttgtaaaatatggaaatatattt

SEQ ID NO: 48100 - DNA, 1049 bp, Homo sapiens
ccggaggttgtgaggccctttgaggcgaaatcgctctgggcgtgaaaggagcaggcgttggcaatggaaggaccaccgcgacctcaggctgaccgtagggagggatcttgagggccctccgagtcccctgggcttgcgctttctttctttgcagccaccgtgcctaccgcgaggatgagctcggcctcggtcaccgctttcgagaaggagcatctctggatgtatctgcaggcgctcggcttcgagccaggcccggcaaccattgcctgcggaaagatcgtgtcgcacacgcacctcggagtgtaaggaggccggggccggcggggcgagggagcctgaaccgggggacgccgggggactcccccttttgtagaccccggaggttgattaatcagaattggttgagcagttactctgtgccaggcattggctccaaagttcctactcccagttgctgccagcctaggggcagagacagacagtaaataatgcaagagtgccggaagcgctctgtaggggagtgcaaaagtctgcagatggggagagtgcaagactggaggagcagcttaactctgcctatgtggtggaggggtggtctgtgaagtagtgggagggatggcgggtggtagtggaagagcatgggaaccatatgtacaaaacaccttttggactcaagggagcctttgaaggtggttgtttaattttataatttttaattttttaattagtaaggcatgttggagttagcataaaacaacggagaagggtattaaaaacaaatacccttttaagaaaagtatggaaagtaaaagccccttccctactttttccacttctgttttatcaactttagccagtatctctatttaatcattcccactgtaggccaagaggaattcttttctttcatatggagtctccctctgttgccaggctggagtgcagtggcacgatctcggctcactgcaccctccaactccctggttcaagcgattctcctgcctcagcctcccgagtagctgggattacaggcacttgccaccacgccc

SEQ ID NO: 48101 - DNA, 1059 bp, Homo sapiens
gatcacaaggtcaggagatcgagaccatcctggctaatatggtgaaaccacatctctactaaaaatataaaaaattagccaggtgtggtggcaggcgcctgtagtcccagctactcgggaggctgaggcaggagaatggcgtgaacccaggaggcggaggttgcagtgagccgagatcgagccactgcactccagcctgggcgacagagcgagactccatctcaaaataaataaaattaaattaaaattaaaaaataaatattaaaattcaatgtaaaacaattaagttatgatgataaacatcatacgatatcaactcacacaagattcatggtccttttcaatgtcaggtaaattcatccttgatttcatgaaaatccagggattaaagcagagtagtttcatctaagtgcagctaatgtctattccattttcaggtatgtccgtggagaacatacctgaaaatgatatgttcatggagaatcaacttgcctttcattcacttcaacttgtctttcattcaaatattcagatatttcatttcagatatttcctgagccatatgttaggtgcatgccaaattcatgctggggatattgtgttgaacaaaccaggcatggttcctgccctcacggagtttacagcctagtgtggtcctagcataccgccatgccaataatgtgcagttgtttttctttttttccagaaggatctcactctgttgcctacgctagagtgcagtggtgcaatcatagctcactgcagcctccaactgctcgctcaagcaatcctcttacctcagcctcccaagtagctgggactacaggcatgtgccaccataatcagctgattttttaaaaatttttttgtagaaacaggacctcactttgttttctgggatggtcttttattattattattattattattgtttttttttttttttttgagatggagtcttgctctgttgccaggctggagtgcaatggcgtgatctcggctcactgcagtctccacctcctgggttcaagcgattcccctgcctcagcctcccaagta

SEQ ID NO: 48102 - DNA, 1050 bp, Homo sapiens
ttttttgagacggagttttgcccttgttgtccaaactgaagtgcaatggtgcgatctcggctcactgcaaattccgcctccaggttcaagtgattcttgtgcctcagcctcccaagtagctgggattacaagggtgcgccaccacgcctagctaattttttgtatttttagcagaaacggggttttaccatgttagccaggctgatctcgaactcctgaccttgggtgatctgcctgcctcggcctcccaaagtgctgggattacaggcgtgagccactgcgcccggcccatagctggcttttatgggctccctaaagtattttatgtgaatggaacagtcctctgccctcagtctttccccactattgggtattagtgtctgtgctgacttgactactactttagcatttacctccaaatatggccaatttccctaagtggcacttgtccacatccgtctacaatagttagctatgttcctgtttcccaccttagaggaccgttgtctgtactgactgagcttgattcttacctgcttccccgaaccactttttctgggcctcagttctgatgttcctcacatcatagcaaattgtcctgaccgtggatccagaaatatatgtgttatttcaaagattacacctggtgaagtagctcccacctgtaatcccaacacattgtgaggttgcagcaggaggattggttgagctcgggagttcaagaccagcctaggcaacatagcaagaccttgtttctactcaaaaaaaaaaataatccaaaagaaattagccatttgtagtgatgcacgcctgcagtcccagctacccgggaggctgaggcaggaggatcacttgagtctaagaggtcacggctgcagtaagctgagatcttgccactgtactcaagcctgggtgacagcgcaagattttgtctcaaaaacaacaacaaaaaaagattaaattttaaaaatactagcattcgttttggccaggcatagtggctcacgcctgtaatcccagcactttggtaggccgaggcgggtggatcac

SEQ ID NO: 48103 - DNA, 1031 bp, Homo sapiens
tttctaatacactgagtacttcaaaactgataggataactctaacaggatgaaatgataaaagactgtggcttcagtcttaaattctttgtctcatcctcttggattgcttgctcttggggaaactaggtaccatgccatcaggtttccttgtgattttgattagaagtggatcctccccaaactgagccttgagatgagcatggcctcagccaacatcttgattgcagcgtcctgagagaccgtgatccagatcacccagctaagccactcccggattctttagtcatagaaactgtgaggtaataaatgcttcttctttccagctgcaaaatttggggataatttgttacacgacaacacataactaatacagcagtacctggaaggtaacaagtgctcattaatggtagctcttcttttagtgaatatgattggattcattcagcatatgacttggcatcctgtaatgctgatccaagcttattttaataccataatgatagtgtttacaattgcagtaagaaaaagtaggaaaagtagaaagactgacttttggtttttgttttttgttttttgagacagagtctcgcgctgtcgcccaggctggagtgcagtggcgcgatctccgctcactgcaacccgcgcctcccgggttcacgccattctcctgcctcagcctcccgagtagctgggactacaggtcccgccaccacgcccagctaattttttgtatttttagtagagacaggtttcaccctgttagccaggaaggtctcgatctcctgacctcgtgatccacccacctcggcctcccaaagtgctaggattacagcgtgagccactgcacccagccggaaagactgactttatctcatctgttatttataaaccacctttgatagaagagaaatttgttaagagtgtgtttcatatgttgtctaggatttgcttcaaaataatccgtgggagatggggaggagtgcgggaaagagaagggagtaggtaggggttaggtaaaaaagattagac

SEQ ID NO: 48104 - DNA, 1027 bp, Homo sapiens
tagcattttcacaataaattcacactagaattctgcataggtcagattaaccctgaaatgttgaaagactggtacaataactataatttgtaaatggttacatcaggtagaagggagttaggttgttactgtaccatatggaagtaattttactgtgtcaactcatttagtcatctgcataattactgtaaacacacacaaaaccaatggctttttaaaccatgcagagagttaaggcaaacttactgttcctaagggatatttttaataaaaggcatgataaatgtcaaagtgaggcatgtgagatcatgattttcttaaacctactggcaacaagcttaataaatttacagttttaagacttaattgattcaacctaaaaacacagtatttacaaatgcacatttttactcacaagcatacaaatctaaatatacaagaataaaacttccgtgtgcagtgcaagtttatcccacaggttttaaaaagtcatcaataccaacaatgtatgtgcctgaaaaaagatttcatgttcaatgacatacactttagcattttaagcacattccaatgaattccataaattattaggcagctgatttaatttcattttaactatctgatgattgattcatttgttcccattttaaaactattgcaaattaacattgggaagaggatggaagtaactggataatcaagataaaacccattaagcaagataatacataatatgaaaggtgtattatgttggtacaaaaataattgcggtttttgccattaatagtggcaaaaactacaattaattttgtgccaacctaatacattaaagttagggaaggcagctgtcatcagattttcaggtaattttaagattaatgactacagacaagtttagtagtagtcatttatttaatagtcaatgagacccctttcagaaaaccgtattgcaacatgcaatctattttaataaatatacacttagaatatggctgtatatacacatacctacacagccctacacata

SEQ ID NO: 48105 - DNA, 1050 bp, Homo sapiens
aaaaagcattttagaatagttctgatttgattttaaaggcctcattataggttttcatagatgctgttaagcttacgtttatttctgatgtttttaaagtagatgtggattctaacaaaacaaatattgaaatgattgagtcctttgaatttttaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatgctaaacttttggccaagagaatgaaggttagtctaagatgatttgagggggtgggaggagttcgacctggctttggatttgcgtctttaacccagaaaggccttaactgtttgctgttttgttttgtttaggaggctaaggagaagcgccaggaacaaattgcgaagagacgcagactttcctctctgcgagcttctacttctaagtctgaatccagtcagaaataagattttttgagtaacaaataaataagatcagactctgatctctgttgacttttcattgctgatagaaaactacataaatgaagagagggaaagttaggtcatagaaaatggggatatgtatatatggtattccaatggtggataaagtcagacctattgtgtgtggtagtggaagacaaggtcagtgtacaggggttcctttcaggggatgggtggcacaggaagggattctgagcataagacacctgcctcttcagaatggcatggaacttaggggaaatgatgaggactattaatcttttttatatagtttatttttgaggaatatagctctttaaagcactatacacaatttaatacatgaaaattgaccttgtgaagatgaacatgtcttttttaaaaggtaacttttaaggcatagttttagtggatacctagttttagtggataccatccactaaatggtttttaagccatttcaaatttgttttaacaaagcttttcaactccagtgaattgttaggctgttcacaca

SEQ ID NO: 48106 - DNA, 1622 bp, Homo sapiens
ccactggctgccagaaactcattgaagtggacgatgaacgcaaacttcgtactttctatgagaagcgtatggccacagaagttgctgctgacgctctgggtgaagaatggaaggtaaaagttgacaaattgttgcaggtatttaagtcagagacggtaaacgccattggtaactggtatttggaatggggttcagactccgggttctggcttctgacctttggtaagttgcttccgaatgccactttataaagttagaggtattaccttggagggggggacgtagagtaagccataaaatatacgtaaagtttacatcaacataattcttgccctgcatcatgcatttggcaatatgtcacatagctgtcctcataatccccaaagtgccaaaaagggttgtatctgatttgtttgttgctgtttgatattttatcttcttagtgctgttatctctaataaaacatcggttagaaatgcgacttgaaagacatttgataattgaacttgacaagttgggaatatagacaaaactcactgaacagagaaaacgtgcttaagttcaaattggttttcataattatactttctcatataggtgtgttcacagaggtcacaatcctgtactgtataattttggaatagaaatagtaaatgtgtcattcattgtatgctcttgcagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggtgagggttacttgtgttcaattttcgttgaaattgatttaaagccagttgtccaaatgcttattcatttgcagtatccagacttacagaccaatggatttgtttctctaccatcaattcaacattaaacattctgatttaggattcttaaggaagttgttgaattaaaatctcttcaactgtttcttctaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaataaagaaggtaggagggattatgcaattagggcttgcttaattttggtaatttgtctatcattttgtgtgcatatcagaagataaatatgtgcctttggaaggccttagcactattcacttggagtttttacagaaaatatttgggggtggccagcatacccagttggtgttaatccttgcttattatatccagtgccttgtagagtgcagtaatttcgttgaaaatctgcttgtgaatctttgatgtatacattatccaaaaataacctgactttaaggtcattgctatctggtttaggagtcacatgtttgagaattctgggactattagcaccacacactttgtaattttatatcagatgttctaaattattaatattttttaagagatgaggtc

SEQ ID NO: 48107 - DNA, 1027 bp, Homo sapiens
aactcttcatttgttggaatgtattccctgggtgctaagcacctattaacatctcttttgaaagggacgctgttttaaataacacctcggtctagctaggacaggaaatagcattaaattaaaggtacacacgaatacggtccacaagcaatctaaataaaggtggactcccccaaaagcacatctatactaatgagaatgccaaatgaagcgcgcttagttcaaaggcggagacttcttaagggaagcttcttttattcaggaaacacgatgcccgacgatggcttttgagagacacaaatcattgccaactcacatctgaagacaggctgcttcatgaatatccctcagaattgttagatgtcgggagttttgactttgaatcagttgggggataaatcattgttttccaaattacaatacttatttgtttccatgtttattatctgtctcccccactagaacagaagcacctgagggcaagaagtttggtttgttcactgctgattccaggacctagaacaagtccaagacatacgagacacctctatttatcaaatgaaaatgtgggagcattttgtggaacatgaacctcttttgacatttcatgagaaatggttttgcgtttaagtttggaaaaattgcccagtatatgaccctcttggcaattcatgacgtactaaaatattaaatcttggaaagccacatgttccaccaatagtcaaacttgtttaactttatttaatgcaatatttcccaaacagtatgtaacacaatagtagttatgcaagataataatagctgtttggcatttaaaataatgtttctttatcaaaatagtttttattttattttattgtttttttatgagacggagtctggctcagtcacccaggctggagtgcagtggcgcgatctcggctcactgcaagtaccacctgccgtgttcacgccattctcctgcctcagcctcccaagtagctgggactacaggtgcccgccaccacgcctggctaattttttgttg

SEQ ID NO: 48108 - DNA, 1042 bp, Homo sapiens
ttctgaaagttggagccaatacaagaagaaatgaggtataactattccaaatgacaagacaaaggcatcctttctttttctagataatatttctatttaattgaataccttaaatatttaaaatctccccaaaatattcaggggaatcaagtgaacacaactaaaagtaataaatatgtttttatttttatgttaaagtataacaaagcattcaggtagatacattttcaccaagtgacaacatcttatgtaactagcacccaagtcaaacaacaaaacagttccagtactctagaaggctcccttgagccccctctggtcactatctgttaagggggtgggattgtagacagtttctttcttttcctttttttttttttttttttttgggagttcctgtattttccaaattattaacaattatataatgataaaggaaaatgattttatataggggtgtgtgtgtgtatgtgtttgtacttaagtaaaagtagttttgttatttctcggctggatttttcttatgtctattaagtataatcactgtctattgagtcagtaactaatttttaaaggagtcttgaaatgctatctccccctaactgctcactcacagttaaatattctgttcatgacttgaaagcagacatcagtttaaagggtatgaaaagcaagacaggttctcactgggaatttctaaggcttaatatacctttgacttatcaagttgactgagacagtttaatgctattcatggtatgggaccttgttgctataaatacgaatatttatcacttgattccatatttgatcgcccctccattactctctctttgccttttgatgtttgctgcgtattgcccaaactttctcttcttcactcctctagatcgtgaaccttatagaagaaactggacactttcatatcacaaacacaacatttgattttgatctttgctcgctggacaaaaccacagtccgtaaactacagagttacctggaaacatctggaacatcctgaggatataacaactggatgcat

SEQ ID NO: 48109 - DNA, 1065 bp, Homo sapiens
gagaagaatgtgtgttctaaattccagggcagacatgtagattgtttcgctgtttgaatttttttcttctttttttttttactactttcaaatgacttgacgttagtacttaatctaccccagctgtgtgtgggtttttttttttttttttaacatttaatggctggtggtcacatttatattctgtgtacatttttgcttacatctataaatatatactctcaaacttgccaagtttcctgactggcctgataagctttttaacccttgtagaattttagatttgaacaaaagactacagacctatgattcttaattgcagataagttgcatttcttgcagtttctttttagttagtatgggtaaggaagcaggacttaagtggcctaccatgagtggtggtctagtactttgctaatattcttcttaggcctcttttgaagaaccgaacgttgttttacctgtcattttccaaatatttggggctggcataatgctgattgcagatctattgcatgatctttctcgtctcttcccaaacaccagctctgaaccactgtggagcaattgtccaataaagctattaatgcccaagctgggcccaaatagtgagtctcataggagggtgggacagatgtttgtgcagggttgggacatcttcacaaagaaagccctatcagttagtcaaggatactaggccattgggcagatcttaccttggggtgtcattggcattcgcaatttaatgttgtcctttattttgaccttataagaattgcgaagaaaggtggcttactggagaactccatccaagtggattattttagtattctagagggagagagtaatatctgtgaatttttaacctggcataaaggcactccagggcacacagcatttcaccctaattgcattcccaggccggttgaaagctctcagtctttggccttttgccttgtaatgcagctgaggcttgtgattatgataccatgatgcatgtcctgtcacggtttactgcttaattaattccttttgtaaaacatagcactattgaggactaatgtt

SEQ ID NO: 48110 - DNA, 1029 bp, Homo sapiens
caatttcactggccccaaaataaacccataccctttagctatcaactctcaattctcttatctcccctagccctaggcaatcacaggcaaccagtaatctactttctatctgtacagttgcctgttctagacaattgatatgaatggaatcatataatatgtgatgttttgtgcttggcatctttcacttagtattgtatttccaggacttacttatgttgtaccatgtaccagaacttcattagtttttatgtctgagtaatattccattgtgtggatataccacaatttgcctttctgttcattggctgatggacacttggattgttttcaccttttggctgctgtgaataatgctgccgtgaatggctgaaaacaggtttttgtggattcagtgtttttttacataatatgttactgatgaaacattactttctgatcctactgcagcatttgcagtttctgacattcttgttcatgtaattttctatttctcttcagagcatcttgagaaggctgaaagaattctgatatatgttgagggagatggttgtttttctccccactggaatgtcacgttaggtcagttattaccaatattttcaccacacacaaaaaaacaagataaactatatggtctcacccacattcttattcttggtgacatcactctttttcccaatatgctggcatataactttcgtgagaaactgtcttgaaggatcccatcttttggaatcatggtggtttttttttcctttcttcctgtttattctttgtttttgacaattaccttattattgttttttaatgggagattcttttggagaatagttttgtttttttgagaccgagtctcactctgtcacccaggccatagtgcagtggcacgatctcggctcactgcaagctccgtctcccaggttcactccattctcctgcctcagcctcccgagtagctgggactataggcgcccaccaccacgcctgtctaatttttggtatttttagtagagacggggtttcacc

SEQ ID NO: 48111 - DNA, 1044 bp, Homo sapiens
ggtgatccaccctccttggcctcccaacgtgctgggattacagacatgagccaccacacccggccagaaggcattcttgataagaggaaacaacttggaaaaaaacacaaacaattgatgacaaattgtgtaaatagtttgtgttatcctctctgagaatgaagaagaatctcataaataaattcctgcagttaatttatcaaactggtttactgggaatgaaagaaaccttattgaactctactccctccatggtagacctgtgtgggactcttttattttatatcttcttacttaatctatacaataggtaagatagcttttgttctcatcttacaggtggaagtgacagagcaagaattcgaatccaggtctgaataatgccaaaattcatgcttcttgtattgtaccactgatgattaaaccttgttcagagggaagtcatgtcgaattaaaaccactgtgatattgactaaacacttttgagaaaataaaatttagtactgttaaccttcccatcatctgacatcctctgaccatctggtagtggtgccacattctggtgaaaagggaagagtaagaaataaaatgtagccacagtacttggaaacttgggtgtgagtaatggactctggcatgatttctaaaatgctgattgagtcttgctttatgtaacctaatatcattttctgagaagcagaattgcagaaagtactgaaaagctgtggtaccttagagtctatctgagggaacttttccctaatgttattaggttgtttcatatatctcatttctagggccaaggacatggccagtgttactacgagggctccaacctattgtattgatattatattgtattatctaaaggttgcactcatgcatctccgggtggattatgtcagaaaaaaattataataaaataaataaaggttgcgctcatggaggatctgaggaaggaaggtagggcttccttccttcctcaggaacatagccatacctggccagtcaattatctttgtgggctcaggaggagtggtccag

SEQ ID NO: 48112 - DNA, 1033 bp, Homo sapiens
ggcccaacttcaggggtgactgtgcacattgtcctagttgtgtgtctgcctctgagtaagtgtgattagatgacctgatctctctaaggtcctttccagctttattagttgaatatgagccagattcgtattcatttgtgggacatggggtgatgggtgattttagacataatgggcagagatcatggactttggaaacagaaaaaagacacaaataaatcagaagaatttgaagtataaggaaggctggggaaaatgattatttgtctagtatgtctataaagaaaacatctcgcctcagtataggtcttatagtttaaaaagatgaacattttaaagaaccttttctagaatcaaattctactcaggttttatataaaaatgtcagtagtattaagatgggttaggaagcttagattattaattgatatggtcctttttggtaggattttcatatcctttgtatgtgagaagagagaaagaagttggacatccatggtttgtatgtctggctggtgtttgagggatcgatcacttatttgttgataagtgaaaggtaggtagataggtaattagaattctgctgtctggtgtcagacaggctgtgtcttaaatttcagtgccactagggatcttgggcaaataatttaactttctctgtttcttagtttcctcttttataaaatggagatcataatagtatcttctttgtaggattattgttgaaaatttaataaatcaatgtgggtgaaacgttaacacactaataaaaaaaatgtaagttagctattgctatgtatgacttgacttctgggtacctatataacctgtagctttgaaagagattttttctctttcaaactcaagattttttctcttgcagaactctggtgtcctttttcaaggttgtgggtttatatgctgcaatatttggtactctaagccactttgttttgagttttgtcttttgtcactttgctctgaattttgtcgtcacaaggtgtatggtcttgatgttgatatggttctgcta

SEQ ID NO: 48113 - DNA, 1027 bp, Homo sapiens
tttctgtgcctccagagttttttttatatgaagtgctattttcattgttttcttttgatttatttgtctttaatttatttattttatttatttatttgagacagagtcttgctctattgcccaggctggagtgcagtggcgcaatcttggctcactgaaacctccacctcccaggtttaagtgattttcctgcctcagcctcccaaatagcttggattacaggccctcgccacctggcccggctaatttttgtatttttagtagagacagggtttcaccatgttggctaagctggtcttgaactcctgacctcaagtgatccacctgcctcagcctcccaaagtgctgggattacaggtgtgagccactgtgcctggcctaattttctaattttcttggagtagggtagccaatgtaatctatacaaacattttaaaaggggtgttttaaagcttatgttaccttatgattgatttttatcagtgttctatggatacatataaaacttctgaactttattcaaggatagcattaggagatacacctaatgtaaatgacaagttaatgggtgcagcacaccaacatggcgcatgtatacatatgtaacaaacctgcgcgttgtgcacatgtaccctagaacttcaagtataaaaaaaaacgagatagaaaaattctacgtataattattaaatgagcgtgtgggttgttttggtcaattatactgtgtctgtactcattgtgttttatgaggtctgtcaatttatgacaaagatatattgatttctcatttaactaagtatttttaaatcttcttattaaataccttttgctttatataatttagatttttacattttttatcctatttggtactctcaacgttgaattccacatgatctgatattaatctagcactcatactttcttttgggggcatttagctgatatttctttgcccattccattattttaaacttttttcaatcaattgatttaaagtatttcttgtaacagcctttatctgatc

SEQ ID NO: 48114 - DNA, 1026 bp, Homo sapiens
aatgcgttaatattaatgaaaagtataattttataaattaacacattaaaattctttttttttttctaaataaaaaacagttccagttttagcaatggctcggccagaagtagtacatggaagcctgggtaaaattttgatgccagagggctgtcccaaggtttgttttttctgctacctacagaaatcaaaaggcgattgttttaggaagtgatactcttcaatggttttttatatattttattttaaaaagccaccaagaagaactggggtttcagatgaccaacttttatgatgtagtagtacacactgaaatgaaaatgttcccaccaaatatgggaacagttcttagttactttcctagaagatcattttctgtgtagctagtgttgcttttccagatggactttctgaaatatgaatattttgcccaaggtttaactttaagaaaatgataataattcttggaatacaagtctcaagatttttccatttgtattattttcaataaaaaattaggtctgtttctaggttgaaccttctctgaagatacagtttttctatttcccatcatattagcctggacatctgtgtccactaggctaatcatttgaaacaattctgtatactgagttacattgaaggaacttgggggaagttgctaggagaagcactatcaattttagtgaaagatgtaagcctgagaaattatatttagtatttcctagcaattaataatattacctagttttgggaaacttctgaattttgctggcttatttgttatacgttccttgaagaaatgattgtgaaagcagtcctgttttaacatagctgttatattccctcaagatgaaatgtattgacttaacctcagctacatgggctttgctaactctaatgactaaactccttagaaagctgaaaatgttgtgcgtatgttaaagaaaatttctcctcccccccacccccttgaaagagaagccagggatatactgaatacataagtaaacattccaagttact

SEQ ID NO: 48115 - DNA, 1032 bp, Homo sapiens
tagattgccgaaagatgctcaattaacagattatatgaatttgtagattgtttgtaagcttcaaaacttaagaggtagatatcggtggaacttgatctggattcagctagtcccctttcccttcttttaaaggtcaattaactgctaaagtgatgttttaagaaacagttctctttcaaatgtagacaccgtcttgaaaatttactactcactttcgcattaagccagggcctacttgttaaaggttttagggggtgccttgcactcttcatactgccaattgaatagtaagtgttgatttggaacaaagagaattaattttacatgtttgagaaagattcgtttttaagtgatacccaccccctacttaaatagcaagtgattaactactactttaattttcaattaatcaaattaggtttctactggtagattttgattacatgcagttctaacagcttccagatacacttctctttcccatatgcttgccatatgctgactaaaatgaatgtagaataaattagtgtaaaagtaagaacactaagttcttttgtagagttcatcttgaatgacagaagacagctcagaatcattttagctatgaggcaccttttgaaaagtgatatggaaaaataacctatttatgtgtgccaaggtctgttttcataaatgtaaatttgaaagttcattaaaattttggcatgtgatttggaatgcataataactggaaatgagtcaacgccagaaatctgtatccttatactaacagcatgtttcactgaagactggctttgtatagttgtttaatatttaaaaggttaaaaaaaaaaagcatttacttgacggttatggctctggaattgtattcaggatggagaggctgcagaggaaagggagagccagcagtctaaccagtggtcccaggaagctcatcagccagttctcttgaaaaagcaggggccgggcacggtggctcacgcctgtaatcccagcacttcgggaggctgaggtgggcggatctcctgagct

SEQ ID NO: 48116 - DNA, 1067 bp, Homo sapiens
tgacagctaccctgtgccacagtaatttttatttactatttttatttaaaaatgttatttctgggagaattgctagagcccaggagtttgagttcacctggtaacacaatgagagcccgagagcctgtcattttttttaaaaaaagttatttttcgttagtcaccgttattccttttctctgctttaaaaagtatggaagatgattttgattacagtacatttcatctggtggaaacatttcaatattctattgtactatgcagtagttttatagaagtttttgcagagattgttataccagaactgagataaggatcttaattttgtatcttgatacaaatagtattttaagaagcaaaacacttactttttaaaaatttagaggaattttaggtttacagcaaagccaagcagaaggtacagagatttcctatgtaacccccaaccccacacatgcacagcttcgtccattatcaacatcccctaccagagtggtatattcttgctgttgtatactttatgggttaggataagtgtataatgacatctatccaccattatagaatcacatagagcagtttcactgtccaaaaaatccactgtgctctacctattcatcccttctccctgccacttcccctgacccctgacaaccattgatctctctgtgtgtgtctgtggctttttttttttttgagatgggttctggctctgttgcctaggctggagagcagtggcatgatcttggctcactgtaacctccacctcctgaactcaagcgaacttcccatttcagccttctaagtagctgggactataggcacactccacaatgcctggcaaatttttgtattttttttgtagagatggggtttctccatgttgcccaggctggtcttgaactcctgagctcaagcgattgccctcatcagcctcccaaagtgctgggattacaggcatgagccaccccatccggcccattgatctttttactgtctctataattttgccctatcctaaatgtcatatagttggaatcatacagatgtagtcttttcagactggc

SEQ ID NO: 48117 - DNA, 1048 bp, Homo sapiens
aaacctctggaaaagatatactattctagatgccattatgaacatttgtgattcatgggagggggtcaaaatatcaacatgaacaggattttggaagaatttgatgactttgaggggttgaagacttcagtggaggaaatgactgcagatatggtaggtgtactaaaagaggtagaatttgaagtagaacctgaagatatgactgaatttcggcaatctcatgataaaacttgaacagatgaggagttgcttctaatggatgaacaacaaaagtggtttctttgagatggaagctacttgatagggtttggctctatgtcctcacccaaatctcatgtcaaattgtaattcccacatgtcaggggagggacctggtgggtgttgattggatcatgggggcggatttcccctatgcgggccttatgatagtgagttctcatgagatctgaagttttaaaagtgtggcaggtcctcctttgtgctgtctctcctgctgccatgtgagatgtgccttgcttctctctctgccatgattgtaagtttcctgagtcctcttcaaccatgcagaactgtgagtcagttaaatttcttttctttataaattatccagactcaggtagttcttcattgcagtgcaaaaacagactaacatagaaaattggtactggtagtgtggcactgctgtaaagatacctgaaaatgtggaagtaactttggaacggggtaccaggcagaggttggaacagttcagaggactcagaagaatacaggaagatgttgaagtttgtgagttcctcaagacttattgtatggttttgacaaaaatgttgatagtgatatggacagtgaagtccagacaggtggtctcagatggagaagaggaacttattgggaactggagtaaaggtcactcttgctataatttagcaaaaaggctggtggcattttacccctgccctagagatttgtggaactttgaacttgagagaggtgatttagggtatatggtggaagaaatttctaagcaaagagcattcaagatttgact

SEQ ID NO: 48118 - DNA, 1035 bp, Homo sapiens
gttgtagttaattaattagaaaggaataattaaaattaagattaaaattattgtttcttacagacttaaattctctttccaccgttcattaggcagttattaatttagccacttccgtttgagtatctgcaaagtagttaatttagtttttcaaaagtagtcatttttcaccctcattttattggttaacaaaataataaattacttaagtacaagagcaaatggtcaagaacaaaagcaaaaagccaggtttcggaacaaacaagatgccttgtactaagtatattatgggagaggtacttaatagctatatacatttgctctttggagggtgtcacccatgtattttacagagggaaagtaggtatccttgtcagattgagaggtaagtgaagtcagttaaaagtttaaagtatatataatcagctttgttttgctgaactttgttttattgagagttttgtgcaatttataatattgtttcattgattttctttcttattgcatcttatatggactgttgtaacattctgtgagtatattttgttcatgtcatccatttttggtgttcagtaattttaaaaatgaattttaagtagggacaggagcttgaatatgtaatttggttttatgtaccagaagatccatcagaaactgagtagccaaacttgtaacaacctgtattggtgcatattctgccagactatgaattttcttaagtaatagagaacagaggtctttaaaaaattgtgaactgagatttttttaaaggtgaaatgaaagcagtactgtacaggaaattaagtttttgggtaaggaagtggaattggtttgattgaaattgttaatgtctctttaatgaggggttatatgaaaaatgttaggcagaaagtgtgatccagttaaaaatcctaaatatgaaattgattcagtttgaacaaacagtatttggaactgaacagagaggaaaaggaaaattcttatgtggaagaaactagtcattatcaagggtatgaaaagctgctggaccattac

SEQ ID NO: 48119 - DNA, 1079 bp, Homo sapiens
tgatttgcagttagtccgggcattatcacctaggaacttgttagaaatgcaaattattggacattatcttgaacttactgaatcagagaccctggatgtagtgtccagaacccggcaatctgcattttaacaagccctataggtgattttgattttcaagtttaagaactttgatatgaagtgatttactattctccttaataggagtaaccagtcaccagttcttctatttctatactttctcaaacccaaaaaatgaaaccaaacagcaaaaatgcaacagaattttatttttgagcaagtaacttgatctgtcttgtacctcagtttctcacctgtaagatggaaaaatttatagttttgggttttgatgaggattaaatgcaatagatggtttatgtaatgtgcaaagaacagctcaataattagttactgttaacactgtttttattatgttccagtttttcaaagcctttttggaggtagcaacatgattccattttaccaaggggagacgtatacccaacctggtttggttttagttctcttaaattgcttcagatcttataattcagacatcttttaacttattaaagctttttaacatctactttaaacattaactttatttgcattttctttaacttttctggtcttcattcatttccattttagttttttatttgtattatgtcttagtggtttttaaaatcttcctcgtggctggccacagtggttcatgcctgtaatcccagcactttgggaggctgaggtgggtggattccttgagcttaggagttcgagactagtctgggcaacatggtgaaacccatctttatgaaaaatacagaaaattagccaggcacagtggcatgtgcctatagttccagctatttgtggggccgaggcaggaggatcacttcagccctggaatttgaggttgcagtgagcagtaatttcgccactacactcagcctgggtgaccaagtgagactgtctcaaaaaaaaaaaacaaaacaaaaaaaaacaaacaaaaacaggaacaaaaacaaaacacaacagcgaaaaaaaaaaaaagt

SEQ ID NO: 48120 - DNA, 1030 bp, Homo sapiens
tctccctcaattatagcagtctgtttagtgtttggtattcttgactgtattagaaaggtcttaatatattgttactggttggagcccaatcttctgcatttctaataagcagtcctggtgatcatgctccaagatgaccatgagaccacactgggaaatagaacagtgaaaagagtattttgcgacaccttgccaaagaaaatgtacagatggcaaataagtgatgaaaagatgctcaatatcacgtcattagagaattgcaaattaacaaaaacaatgataccactacataccattagaatggtgaagatttagaatcaagtgctgggaaggatgtggatccacagggactcacattcactgctggtgggagtgcacagtgacacagccacttttgaagatggtttcacggttctttacaaaactaaacacactattactgtacgttgtggactgactgtttttgtgcccctaccaaattcatacgttgaaaccctacccttctacgactgtatttgtagatagagcctttgtggaggttaaagggtgggaccctgatctgatggaattagtgtctttataagaagggacaggatgttgtgtaccataaatatgtacagtttttgtcagttgaaaaataagagactgaaaagaggcctgcctgccccccggttgtttgaggacacggtgagaagttggccatctacaagtcagaaagagagtcctcaccggaaacagaatcagttggcccctttattttggactttccagcctccaaaactgtgagaaacaaattactaagccaccaagtttatggtattttgttaaggcaacctgaacagattaatgcatcatgtgattcagaaatcatgctccaaagtatttactcaaatgagttgaaaacttatgtccacacagaaacctgcccatgaatgtttataacagctttatttataactgcccaaaatttgaagcaatcaagatgtccttcaataggtaaatggaggagctggtgcatccacacaatgga

SEQ ID NO: 48121 - DNA, 1178 bp, Homo sapiens
agatggtttttaacatatctgtttataagttcattttgtgggccaggctgagtcgttctgtggctgcatttgctgaatacacctctgagaatgccccctacagtcgagtcatattttgttaaaaatgcttcctccacactatctgagacctattgactgggaaccttttcagagtgaaatctgggaatgtgaatttttaaatgcacccccagtgcccaaattgcagcacctctgctgtacagtagtggcaggaacttactcttcttcctaagtgtcaggcccccagtaaactagaaaaaaacatactaaataaattggagagaacaataaaactagattcaaaaaataggtccaataaattcagaatgccactaggtatatactaaaattgatttgggattgtgggttaatgtgactaaatgtcccttgtgttctttttaaaaactgtcaaggctaggtacagtgggtcacaactttaatcccagcactttgggaggttgacgtggaaggattgcctgaggccagtagttcaagaccagactaggcaatgtaggaagaccccatctctacagtcaaataataaaaaaaaaaaaattagctaagtatggtgatgcatgtccatcatccatcccaactactcaggaggctgaggtcagaggattgcttgagcccaggaattcgaggctgcagtgcatgatgatcaggccactgcactcaagcctggataacagagcaagacaatgccactaaggaaaaaaaagaagacggcaattgtattagttcattttcacactgctatgaagaactgcctgagactgggtaatttataaagaaaagaggtttaattgactcagagctccacatggctggagaggcctcaggaaacttacaatcatggcagaaggggaagcaggcatgtcttacatggtggcaggcaggtgagagagtgacagagagagagacagacagacaatgaacacgagagaatgaacaagtgaagcgccacactttaaaatcataaattcccgtgagaactcactatcatgagaacagcgtgggggaaactgcccccatggtctaatcacctccgactggggccctgcctccgcatgtggagattcatagggattacaattcaagatgacataggggacacatgcaacccatatcagcagtaa

SEQ ID NO: 48122 - DNA, 1031 bp, Homo sapiens
atctcagataagactttcttgatgctaagcccaacaacgggtttctgccctcaaatatctataagtttgtgtacattcctctcctctcgaggtcccaggataacttggggtttctgggcctgtcagaaagtgaacacacccattaatttttaaatgttgagatctgaggagagaggaggtggttccaagggaagaaacggatttgagtcagacgtttatggccatttaaatttacaatattgaagcccttgtttttttattttaaatatgcttgtggcttctgaagagtcatgctatctcagaagaaatttctgctatagtaaatttagctacagtacagaaaaatttgagcttttattaagttctgggcatggtcatcaaaaatgccataataatacttaacagctttggtagcaagtgttggaatgtcactatataaactccacctgcccttgccttctctttcattgcttctttagttttatcagtggggatggatgagaaaggaacttgtctgaaattttgttgctcataggaagtggcttaaaattcccaggatagttttggaactgattcttgatcttggaatgttggaatagacctcctggtaatcgtatggctgaagtgcacctgcattctaggagggatctggttagacctgagtgtgtttttctctttgcttgtgagtatttatttaggactttttcaaagtttttgaagtaatgattactttaagttataaaaattatagccagttataatgttatgtgccaaattatgtgccccctacccatgcaccacaaattcgtatgttgaagttctaagaatgactatttggaggtagaatccttaaagaagtaattaaggtaaaatgaggtcattggggtaggacctaatctaatatgacttgtgtccttataagaagagaagattaggacagacacaccaagaaaagaccatgtgaaggcacagagaaaggatagccatctgtaagccaaggagaagcctcagaagaaatcagccctgctgat

SEQ ID NO: 48123 - DNA, 1113 bp, Homo sapiens
tcaggctggagtgcagtggtatgtatgaagacgattcactgctgcctcagtctcctgggatcaagcgatcctcctgtctcagcctcttgtgtagctggatccacaggcacacacctccatgcctggctaattttttcttttcttcttctttttgtagagatggagatctcactttgttgcctaggctggtcttgaactccttggctcaaatagtcctcccgaattggcctctcaaagtgctgggatgacagttgtgagccacggcaccctgcaacccccatgcccagtaattttttttttaagtgaaagtaagtttattagagaagtaaagaaacaaaagaatggctactccataggcagagcagcagtatgagctgctgtttggacatttttatggttatttcttgattatatgctaaacaaggggtggattattcatgagttttatgggaaggggctgggcaattcctggaactgagggttcctctcctttttggaccatacaggggaacttcctgacattgctgtggcatttgtaaactatcttggcattggtgggagtgtcttttaccatgctaatgcgttataattagcatatagtgagcagtgaggatgaccaaaggtcactttcatcgccttcttggttttggtgggttttggcgggttttggctgacttctttacctcagtctgttttgtaagcagggtctttatgacctatgtcttgtgccaaccttttgtcttatcctgtgactaagactgccttaatcttctgggaatgtagcccagtaattctcagccttattttacccagcccctattcaacatggacttgctctggttcaaacacctctgacatattgcccccctcccttttataagagaacccttaatcctaagggttgaagagggatgaagatccatcttctgtaacttcttcaggctgaatagaggtgataatattcctgcctattagggtctcttgtattcagggtagagaggagctcagtcagaaagcattagtatgtcgaggagcactcataactcttgagttccaacgaaaggtgatatctagaagattaataaatgtttaatttaagagaacattggttgg

SEQ ID NO: 48124 - DNA, 1880 bp, Homo sapiens
tatcatctttaccctttaccacaaatacttcattaatatgaataatgaaagctaaataattacgaccttttttatattgaagaaacattcttctatttcacatagtattttccttcattttacttatttctctgtttctctataataagcagctgttttatagagtcaatgaaacatgggggatttgggctgttgagatttagttgcattgagtggaacacgttatttgaaaatgttgacccagttcaagattgtctgatgcttgttgtatgactttttctctgtatgcacagaaatagtaactagtgggctggaagctaacttccctcattttatggagcaccaaagcagcacgtgttatgtgttacatgctttcattagaccaacactcccttctctttgtatatgttatctctttttcctcctgtgttgcattagagttacacatcagaaaggatgggacctatgttatcactgtagatactacttatagctccatcaatgtaatgtcttgaccctggaattttttggcaaccgtataaaggcaggtattgcaagtcagaaaaagggttttagaatccctggctttactttccactcctgtaagttataaattattactcagatttctgaaactcatttcttctgcacctctaataattgactttgtgtaaacagaaccaccacttgaatttagcaggaaacattgtgtctgctgagaatcacattttctagaatgtgttctagcatttgtaataggcaaaaatgaatttttctcttttctcttttttcccttattctttcttcacttactttggatgcttaaaaagaaaagctagacacaaacttgaaggacttggccagctctatcatttttttactacctaatccatgaaatacaaccagccttttagctttaaaaataagagtctaatgtaattccagtaactggtaggagcagtatttagcagtgtggcaggaaaggccctggcctgggaggtagaaaggatgtgtttggactgaataagctgtgtgggcttttgcagctctgaaaatactgtttttcctttagttttaaaaaggataaattctgcaattgtcattgatctagtgtttttataacaatgaaataataactaccctttattaaatagctatattggttatcatgctagacaatagacatgtggagtatttaatttctgactcttcctaagtagtagttcggagaatgatattcttgagaaaataaaataccaatatatgaacatcagtgtattggaattttatcctttcttatggtgaatggacagtgaaatgggtgaaagacttgctgcagtaatagggaagtagaagataacatgagtaattcaccaaataagggattaagttacacttgtaaaagttaatttctgatcatatcggtgccattcacctcaaccatcaactattacttgtagattggagcatttcaagaactcagaagaccacccagtgttgataggaaacttcttcctcaattatggctcttgaccatgccattagatcgttgggtttttcatgcttttttgtcttttacataaaatagaccttgaaattgtgtcacttaatttgcttttctgaagtatcacttaccagatattacttgtgtttttattatcaatagagtaataattgaggactgcccatgtaagctaattgagggctgtctgtattatcatgtgaacagattagaagaaagtatatgaaatttttgatcatccaacatacttgcatacatacatataagaataaatagggttttctatttaataattcaaatgctgaattgaagttgttttgaaaagcaagtacttttctactcttcagttgtaacatgc

SEQ ID NO: 48125 - DNA, 1035 bp, Homo sapiens
tgcctcatttttttcttttatcttgatttatggtatctttttgccatatgcaagcttttaattttgtcaaactgatgtgctttattttgttttgttttcctctctgggcttagggtcttatttaagaatttagttcgtggccatagtaatgtgcttaaccaaaaggcaatatatatgtaggatacagtgaaagactgagggagatacaaataagagtaagaggaggtccctgccttcagtgtgctgtgtctttttagagctggaaaggacacttgagattcttcatcttcgattaccctttcattttacttttaatcagaagcctagaaatgtggagcaatcttgcatgtagacacaatgagtcacaagtatgcctgtgcaaagataactagtaataaatggtggtcaatgtttacttttaaaacattgagtaataattcacttatattagcagacaaatgttcagcaatagctgcttttgtagacatgatctaggatttaattaagtggtggtaaccatggtagatgctgtttaaaaggaaaaagttctatagctactttcagacaaaatcaaattctctatatgaattaaagttttcctttgagattaaatcattagaaaaaattgttgctgggtggtagttatctcctgatattttgtccccaattcacccagtggtaagaattgcaattacatgaaggatgcagggtgttgttttaagaagtaatgttgcatgacttaatccttttgacttaagtgtggtaagtttgcagtggttgacgactgaagaaggctattacgatagaatttctaaaaagataaggccagcatttgggtgtgatttagttggtatgtagcagttaacaattaactttttggataaaatcaagtcaccattttttttattaaagaaaattatggcttatctttaaaatagtgttcattagtgattataaatataattagttacctttaattagttacacatattagaaggttgatattctcaaagccaagttaatttttttctattt

SEQ ID NO: 48126 - DNA, 1083 bp, Homo sapiens
gcctcgatctcccaaattgctgagattacaggcatgagccattgtgcccggcctatcactgtccattctgtgatgcattacctgaattatgcagaagtcttttatattcattattgtaggtgcccctctgtagaactacctatctttatgaagtaggccaggcagggatatcacttggtttgataattttgccttaaaggtcctttgttccttctcttggttctttgaagtttctttctcatgggtcttccatggaccaaccttggcccctttcttgcctttctagtcatttattacaggtaatccccactacataacatcacttttacagttctaagatatagaacttttcttgttttgaatcttcaaaagagatgtcatagaagctgggaaattacatggcacaattttgtggtgtagcttttatgaagaaccttgttcatttttttaaacaaatgaaatgttttttttttctaatttgtagatatttgttcattgtagaaaagtcaaaccatggacgagttatctgaaattttcatatataactatagttaatatttgttagacatctttatatatatacacatacacatcaatattaactattaacattcattcattcaacaagtgtgtgcttttttttagctcctactatgtgcgtgcctgcctacctccctccctccctccctccctcctttccttccttccttctttcattttgggacagggtttccctcttgtcacccaggctggagtgcagtggcatgatcttggctcactgcaacttctgcctcccgggttcaactaattctcctgcctcagcctcccgagtagctgggattataggcatgcgccaccacgcccggctaattttgtatttttagtagagacagggtttcaccatgttggccaggctggtctcaaactcctgacctcaggtgatcctcccgccttggccttccaaagtgctgagattacaggcatgaggcaccgcgcccggccctagcacccttcttagagctggagataaagcacagaggaacattcctacccttgtggcatatcatcttttaaaattgttgg

SEQ ID NO: 48127 - DNA, 1048 bp, Homo sapiens
tcccagcgctgcgcaccacggccgcagcaaggcgccagaatgggttttcctgatgcccaggatttgggaaccgcgggtttgagtttcggggcgtcccgcagccccagggaaacgtcgtcgcggcttatcgcgccaactttgtgcagcttcgacctgagtaaaaaaatctcttttgctgctcaggaggcagctccgccgtggtctcccttgagacatcttcctcaggtagccagcagggcaccttttattttcgggattttcccctgggtttggggcttttatttcccatagagacttcagcgagacttgtttttacagagggacccgttgattccgggacttgagggctcgagatcgcacgggtttaatcttggggattccgtttgtgtgggggcgcagggcggggacgtcttggggaaggggacacgctggaccctggggcgagcggacgggtcctgggagcgcccggggctggggacgccgcgcaccgggccaggagcagagaggcgcccgtgcctgccccagggtgtgccaggagctaagctttcagcttcagacgccagtgtcgctgaaaccataattcaggtatgttaaaactcaacagcattattttaaatactttataccaaaacaagaatgttgtgatcttacttccctagctttaaaggaagcaaactcagcaatgctttcaagatccctactttgttttatctgggagaagtgccatgtctgacatttccagtgactcagtgacactgagataattttatttaactttggtttactgaaagcccttcctcaagaccccaccttgacttgtgttgctgaaaagagaaatgagcagtgttgcctacaaagagtagaggagcaggtcagaactttttattttctagggtaagaattttatagcctgagtggagtttgccataatttgttacactggcccctctcctttgtaagaccctcagggtcatcttacatttcctgcctttacttaattaaaattttgatatttgcctcatcatggatgtttaggcattaatttcca

SEQ ID NO: 48128 - DNA, 1042 bp, Homo sapiens
gggaacaatacacctggtctgagtaatgtattgctgatcatacattatcagaccactagataccattaatttgtgatatcttaccaacagcaaagtttatcccaggctctaagtaattgatattatgctgccatcctttggttgaatttaaaatgcctcgtttactaactggaactgtttttgtgtgttttaaacagagggtatcacaattttaattacattttttagattgacagtaatgataaataatttatggagacaagtgaataaataaaacttgatacttatgtaataaatttaaaagtcattgaaaagcccattctagctaaagatgaactaccagtcgtttgtttaatttattttagagacttcgtcatactgactgatacttaagatttagcccttttttcatcatcatgacactttccattgtctttctctaagcaatgtaagcatgcagtgaatttccttaataccatccttagattcagacaagagtgacctatgctctactctaggtcttgcccttttgagaaacctgaatatcagacatgattcaatttatacaacacatgtgtatgcacacacggaagtgcacatacacacacatgcatagacacacacaacattttaaaaaagcatctagtacccacatcacttaggatctggtactcagtgctcacatatggcccaataactctaaatatacatgctcattagtaattccatttggtacccagggagatatttctccacatctcttgctttcagtcccctacaaaaaattgactgtacctgatgccatgaaggagacgttgccttggaatgtaggggatttgagctgcagaggaaagagaagacacattaattgcctagtaaacccttcctcaaggacagcaggaacgcaatagattcttacaaaatgaaataccatgtctcaatagtccccagtgtccattctcttgcttgtctttacgtaacaattagtgattcagctgtttggtggtctcttcacacggacgcgcatgaaatttggtgcctt

SEQ ID NO: 48129 - DNA, 1071 bp, Homo sapiens
ttcacagtgccttatccattcgttatattaatggtaatttgttgcagggtcaattggccaggacatacagtttattacaagaactggtttatttattttacctataacttagttttaaaaacttgtttcatcagtttatttgggcttcttttgccttttgcagagttccatgtaccctcatctacatcagttacagacatatccagtgcccccttgacctcaatgtagttgatgagctgggttccatgtgtggaaatgaacattgcttgccaagcgccatcctccatagctgaaacgtgttttactctaattactaaacacctgaagcttcttttttgattcgaagtgaacaatgtttgtggggagaaacccaaacccctaaaacttcagatttaggaacatcagtgtaagagactaaaataataattaatattctgaagtgtccaataacttcttgaagtcagtggtttttaaacttcattgttgtattatcacctagagagcttgtttaaaaatgcagattcccaaaccattccctagacattctatttaatgcatcttgactgagacttcaaatcttcatttttaataagcatcctcctattgattctgatccagcttgacaactgtgctttgaggccgggtgtggtggctcacgcctgtaatcccagcactttgggaggctgaggcaggtggatcacctgaggtcaggagttcgagaccagccaggccaacacagtgaaaccccgtctctactaaaaatagaaaaattagccaggtgcaatggcacgcgcctgtaatcccagctacttgggaggctgaggcaggagaattgcttgagccagtgaggtggaggttgcggtgagctgagatcacgccactgtactctagcgtgggtgacagagcgagactccatctcaagaatatgtatatatatatgtatacatattctctagaatatatatatgtgtgtgtgtgtatatatatactgtcctaagtcttatacaattcccagtatagaacttggtcgtggtcttaaatgcagcctgctttccgactgtatctgtgctt

SEQ ID NO: 48130 - DNA, 1051 bp, Homo sapiens
tctgaacaaaagaatattctaaagcagtttgaaaagaggaagccattgtctctttttgtgtctggaaatgaaaaacagggactacatttaaattcatctgaaacataaggtttcgaaagaaaaaaagacaaacaagtttgtcatcagaaatagagttagtggaacctatggaattctagaaaatgacactagtttatgcatagtcatgtatgagagtgaacaatgaggaaatgagcagatgttgcttatcagttaccacggcctgttcaatctaagcagtacctgggttaagagggttgctgaggacagaagagtcttagcatacaccttggtttctccctccctgaccccaagattacagatgccatgcagagtcatgaaatgggtatggactttaatggattaaaagaaaggataacctatatgtacactggctattcttccagagtaaaagattccagttatacaatttaaaatatcttaaggttgtaatatgaagaaatcgtgccctggacaatacgaggcatactcatttcactttgtatcccagaaaagtacatctctgtcatgcatggaggattcaggccaaacttttaccagtgcactcagggaggaagagtatagtgaatgacaaatagtacacataccctgcagtttaaataccttcctggcccctgtcaatgatggctgaacaataaggtggtataaaacacttacttggaaacccaaacgaaaagataaatgtttatatttcatttttaaattttattttgtattttgctgttgtgcatttgacttatcaaaaatggcaataactgagatgactctgctcccattggtctttgtttaaactgtcagcactcacgggatgtctgatatatgtgcattttcctccccaaatagagttttagttccttgaggtagcaatcctttcttgccgtattctgtgctgattttatttagcacctaaaagataattgaggagataatactggtctacactttaggtagttgagatttttaaaaaattgcaccatattgttctttgcta

SEQ ID NO: 48131 - DNA, 1069 bp, Homo sapiens
ttttggtaagagtctagatgaaggggaaaaatcgattgtatatatgtgtgctggtttgcagtatggaggggagtaaaaagagtctgagaacaaaacttactttcggacttcctagaagtttctgctttattatgtaattgaatttttttgtcaggatgtagttattggttgtactaaaatacagcagacaacagaaaaaataaatctcatttgaaaatccttaatcatggctttatcgaatacacagcttactctattttgtctaaataccagcttccaagctgtcagcattaatttagaagccaatttctaaattaaatgtgttattaagtaatttccatttaagagcaatgtccaaatagcactgattctttaagtaaaataataattatattaataaaaattatacttttgggcaaatggcaggggaaaaatgccatttttattggccttggaaacatttatgctaagcagtttgtggcccagtttccatttctgtgattgtgctgcctctgacaaaggatcgactactgagcggtgaaagattgtatagggaaaattaataaaacctgctacgtgggttgatcatagttctgcctgataagcctgagtccatatgaatctgagccagttaagaagttctgagtcttaattccccacagctctttcacattgattcctgtgagttagcagtagtgaaggagtccccttctctgccatttgcaaagccaacttcatgatccgcagcaaatcaaacccacgaaatgttttggtcttgtccaattcagctttacttccttgccaggggcataacagttgaagttaaaagacttagacccaaatgggaaaattagtgccatttgtgtataggcagtagccttgttcatactactttcaacctaattagaaagaaataaagtatgatttgattgtaagtccgccagggtaggtagcatataggggagtgtggctcaagaatctaagtttttcacttattttgaattattaagagtttgcgttatagttctcttttttgttttacttctatagagtgcttctacaatttgga

SEQ ID NO: 48132 - DNA, 1044 bp, Homo sapiens
ggcatgcgtagggaagctacgggattccgccgaggagcgccagagcctgaggcgccctttggttatcgcaagctggctggctcactccgcaccaggtgcaaaagatgcctggggatgcgggaagggaaaggccacatcttcacgccttcgcgcctggcattgtgagcaaccactgagactcattatataacactcgttttcttcttgcaaccctgcgggccgcgcggtcgcgctttctctgccctccgccgggtggacctggagcgcttgagcggtcggcgcgcctggagcagccaggcgggcagtggactagctgctggaccagggaggtgtgggagagcggtggcggcgggtacatgcacgtgaagccattgcgagaactttatccataagtatttcaatgccggtagggacggcaagagaggagggcgggatgtgccacacatctttgacctcaggtttctaacgcctgttttctttctgccctctgcagacatccccgattgaaagaaccagagaggctctgagaaacctcgggaaacttagatcatcagtcaccgaaggtcctacagggccacaactgcccccgccacaacccaccccgctttcgtagttttcatttagaaaatagagcttttaaaaatgtcctgccttttaacgtagatatatgccttcccccactaccgtaaatgtccatttatatcattttttatatattcttataaaaatgtaaaaaagaaaaacaccgcttctgccttttcactgtgttggagttttctggagtgagcactcacgccctaagcgcacattcatgtgggcatttcttgcgagcctcgcagcctccggaagctgtcgacttcatgacaagcattttgtgaactagggaagctcaggggggttactggcttctcttgagtcacactgctagcaaatggcagaaccaaagctcaaataaaaataaaataattttcattcattcactcatttattgtcaacatttattgagcacctattacaacaatttcatcgcatggaagacagcat

SEQ ID NO: 48133 - DNA, 1022 bp, Homo sapiens
gatatattatcaaatgggtttaagcatcctacacattttaattcaattgattcattttctttttgctttggatttctatcatgatttaaatatttacatatgggttactttttagatttttcatactatgaaatataagaaaaacctttaaggctagttttatgaccaagacgaaggacttcattgaatacacaaaacaataaatatactgcaacattttgtctttctttttgtagctgcaatttggtttgcttatactttctctttgtctctttgaaaactgagtcagtttcactttctcaggacaggatttaataaccataatataatttagtataattccttgatttaggcaaattatgcaatttgtgtttagtatgaaatgtacctaaaaataagtaactcctctttaacaccaccatcctcaaactaatataacaaataacagttatcctaaaataaattgtctacttccaccatgcagcactcaaattttaaggttgctatgactgcagacagtattttaaaattcctctctggaaatggctttgtttccaagatgatttaggaaccaaagaggtgaccatctcttgtttaatgaactctcaaatcataaacctgggaagtgttttagtttcctactgctgctgttacaaattatcacaaatgtgttagctaaaacaaacacaaaattattattttacagttctagagatcagaagtcaaaaatgggtccacaaggtttcattccttttggaaactctaaggggcaatctgtttccttgtcttttccagcttctagtgaccatcaaattccttggctcatggtctctgtattttctctgtggcctgtgcttccattcttgtatcttctctctgactgtgaccctctaataaaaacacttggggttatgttgggcccaccctgaaaattctggataatctccctcaagaccattaattaaatcacatctgcaaagcctcttttgccacataagttaatgtattaaaagtttttgagg

SEQ ID NO: 48134 - DNA, 1024 bp, Homo sapiens
aacttctatgcctttgcacatcctcttacctctgcctagaatatctttctccttcttttccatctttaaactctcacatcattcttcaagactgggatcagctctcagcatccggaagcctttgcctactagagacaaatgagaatgagtttggtcaccttttcattttcttgtatcattctgtgctttattttgctcttctaagagcgttacatgcttcatttaatccctaaacaactgtttgaggcaagtacagttattatcctaatcatgcaaatgagaaaacagaggcccagacatgttgagtaactttgataaaagttaaagaaccaataagtggaacagttgaggtttgaaccctggcagtctgactgtagagatactatgtttgacctactcccctctgcccccaccccatgtctgcccttagtttctgagcttgttgaatgaatgaacaggtggtagtctttttttgttataagactgatcagaattaagacaggtttaaatttcacgtgtagaattttcaaaactgcaaaggcagtgcaaatctaaaaaaagaatggcattctcaggaaagaggaaaagtaagtgtgagaataataataacaataaccaacaaactttagtaaatttagtaaatgtagtaaatttttacattaaaagcttttggacatacattatcatattttatggccacatgaaatatattataatcccattttgcacataggaaatctgagactggcataaggagcacagagatccaggactttatattttcattcttctaggattttgcacctcaggtcgatatgtatgagtaaactgggagtataatgggctctttaacagaaaaactaggaaagttttcccactattattaattatttacataatatttttttaattttattattatttatactttaagttttagagtacatgtgcacaatgtgcaggtttgttacatatgtatacatgtgccatgttggtgtgctgcacccatcaactcatcatttag

SEQ ID NO: 48135 - DNA, 1141 bp, Homo sapiens
atggacatagtacaaaattcaaacaatataaatcatggaatgtgaaaagtaagtcacatgcccatcccagttcttcatttccttacctcacaggtaacagcttttcctgtatctccccagagatattctatgtatattttgtttttaacaccaagctatatttaaaacaattatctttaataataatgttaatattgaaactggtaaagaaatatgtgtgtattatctcacctcaagcgtaaacaatagaacaagagagagcccattttgaaaattatggacaatgaatctagaaataatctcaaaagattttgcagtcaaaaaatagttcattagatacatgagaactgtcacttggtctcagtgtagagctattgcctcaactccctttattttcctaacaaaatcatcttgcttatcccatgaaatacgtgcatattgccaatcctacaatgccgcatcagaaccagaacccaactctggaacactaccttctcaagtatctttctgtctctttatggtaatatgttgaattaatattcacatctattatgactagtctttgatttgtagggttgctgaagtagtagcaccactgcagggctttctttagtttaaagaaagtaatcaggtgtccctactgtgtcatgatctccaccctcagctgggttctccagtctggttttaaagaacaaaacaaaaggcttctctgtctgagtcttactcaacccatcctctctactcataagaggtattccaaacctttacgattctcaaacttcctaaccgaccatcttattttcactctgcaaacaagctaacctcctcattcatagaaggaagtgcctcaacttcctccccgttctgaccttttctccctcccaaatctatgtatctcttgtgacaaaatctataaccaccgctgtactttgagttctatttcttcattatttttgagggacctcaagtcctcaaaaatatcctatcttgcctgtgtacttaacttttcttttattcttttctaactttcccttctcttcacttggcacttgcccttccaggtatatgtgtgctcaggtctcctccaccttccatctgcctcacttcatggcatagggccttgaactatcacaaccaagct

SEQ ID NO: 48136 - DNA, 1057 bp, Homo sapiens
caccatgctttattgcaacaactagttacattgtctaggcccaagaaaccctcaccgctcccactccattcctccagtatctttaaatgacactatgctggcatccgacatcgtttttcttccaggatgaactaaccctttctaaagcgcccttcctctgtgggacagaaaacctaatgcccccctacagaggcggaggccggctgaaggtggtggtaggaggggaatgctgggggcgtggcataggtgcagaggaagacccataaaaggatctggttcccatagagctgacattctacacaacaaacaagtaaacaagtacataagtaaaataatctcttcgtcctaagtgctataaagaaaaaaatcacggtggtatgagggtgcctgaaaagggaagcatttctgaggaagggctacttacttcagaagagacctgaaggaaaaagagctatatttgcgaagagggagaaagagcagccatactagacagaaaggtggcatgtggccccagcacaaagcacggtgttgggtaaattctgagtgaaatctacctaccggggaggtgcatttgtaaatatctagatagatatttagagtggctacgtaagagtgatcgctaaatctcactttttccaaagggccccgttttgtcttgggtttgtaccgaggtccggcagcaacgtcaagtgatggggcgggggatggggaaagagaagtctgccgctcctctaggctaccgcaccgccttaagtgggtggctcggccagtgcaggcctcactttcctcccctgtaaggtctggggggcttgacgtctgatctgtaaggccctgtcggctcacgctgtggttccacttcttcaactaggccactaggcccaagcgcatgaacaggaagccactgagaagcgggccacatttccaggttcccggagctgggcctagtcccgaatcctctggcacacacccacccactcaggccgcgggtccagcccgcgaggtttaggacggatccaggcagaccgcaggctccgggtcggggcaccgggtcagcgcg

SEQ ID NO: 48137 - DNA, 1052 bp, Homo sapiens
atgtatacataaatacaattatttgttaattaaaaattaaattttaaaaagcatatattaaaaataacattttaaagataagtaaatattaaaaagagggttgaagggtaatatcattggccatagccaccatatgcagacatggaatgagcagtcgtccatggactacagggagaataggaaggcctaaaagaaacagtcatgaaaggcaaaggaataatcactgtgactctgagatgatgtgggcaggcagaaagaaagcaggggaggctgggagcaatgaactctcccataaataccagttaaaaaatattggtagcagagaggtctgaagttaatatggaacaccagcactaattggaaataactgagggactgttataattatttaaatcctagtttggtcttgtggggggtggtggtagatttgctttattagtcagcttagaatgtgttatcccatggtaacaaacagccccatatctcagtggcttatggcaacgcaagataactttcttacctgtattttggctacggcaggttagctcgaatctgcttcacatctttttgctgtccaggctcaagaagcatctcctatccagagcatgcctgtctcagggtggaggaaaaaaaaaattgatggaagcacatgataagtctcaaggtttttgttgggagttgtacgtgtccctttcgctcatattttatttttatttcatgagtcaaagtacgtcacatcattaagcctgatgtctatggggacaaaaattatactcctcccataaaaagaggcaccaggaaagggtcactaagaaggggcagtggatatttttgaataaatagtgtaatcagccacagttgcattttttctatttatattacacagatatgaaaaatcatcatagaaaatacagaaaagcacatggcaagtatttccaatcacccccaaaatttctctcactagaaataactcctgctattagtatgttgatgtaaatatcttcagacatttttccctgggtaatgtttataacagaatcaaatgatatgta

SEQ ID NO: 48138 - DNA, 1033 bp, Homo sapiens
caccttctgaatccttccctgttggtctaaaatctgttgtagtgcctgtatcatggttagtgggtcacacttctgacacgttgaccacatatgtcttgattatttgtgcctgtttttctcattatacctagtagtttctcaataaaagcatgcacagatgtttattagaattaaaccacccaggattaaatctgtcctgtttacttcttggcactgttacctggaacaacttaatttacatctttgagcctcaacttgctcatttgtaaaatgaacatgataaaacctaccttagaaatttgttgtgaaggggtagataatgatgcatatccagtacttagtgtcatgtttggcacatgacagatgccattattgagagttattataatagcaatgtgtggatattgggttacaaggagcccttcccataagaatttctcataaatcacaaaggacacctatactaatggatgtcccagagtgtatggatgaggggacatggaaatgatacattctaatgatttttctctacttctggaggtgctggcagatacctaaatcatatcaacaagaagtttatggaaaagagaactacaatcatcataaacccaatcatgttttacttggtgttgaaggacattaaaaaatacctcccaccttaatttactaaattatcaaacaaatcctgttccccgatctcagaagaccacctggctcagtatcacaaagcaccctgatttctccctcatcttgagatgtcaggatccctcagaaaacttcgtagaggtgccctagtaagtaatatgcctccaaaaggagcaagtctgatagtgaatgaattcatgtgtatttgcttcacttaaagactgtttagctctacttatttctcacatttatgctgaatctttaaaaaaaaaaaaaaaaaaaaaaagacgaggtcttgctctgtcatccaagctggggtgctgggttgcagtggcatgatcatagctcattgcagccttgaactcctgggtgctcaagcaatcctcct

SEQ ID NO: 48139 - DNA, 1069 bp, Homo sapiens
ttcgagggtgtgtcagggttgaaaataatgcctaaattataaaacagtgactccaggaaaagtagggaaaaggaattactatgtttcaaaagaaagtgcaagtgtacacactcagtaaactttgttgtgtgttgtttctgttctccttggataagaacatcttgtaagtgtgaatgtttcttatataaagttagtgatataaacagttaattataacgtcttccatcttggacaatatataaactggtcctgtgtctgaagtgtgtgtgtgtgtgtgtgtgtctctctctctctgtgtgtgtgtgtgtgtgtgtgtatcagaaaaatcagacgaatgtaaagaaacgttgaaatgtctgatgttctatttcttaagagaccaggtgagtggtatttagcgtacacttataaatacaagacttcataactttcctctttttgatggtaatattatggtgttaatagccaaaaggtaacctgacctgcttgaatttactattagtagtagaatatcctctacttagagttgatagcttgactaatgccacttattcaccaaaagccaaatcctaagagacatacaacaatatcaggaggttacatgcatgtggagttcttgggtgtacttgggcagatatttctctgacttagtatcagactcttatataaaactgtcttgtcattattgctttcctttgctgaatgtagaccatgacctgattactaattttcgtaattctgaaagatacatattccctaatggaataaggggttaggggttagggtttagcttctttcatcgtcacagaataagatggaaagatgagttatctgtttctaggtaagtgagtgaaaaagacgaaagcatgtatcctgactaaagcatggtcagagtcagactttttggagtagaacccagattatttcccttttgtcttgcggtatgtgagcctctaacaggtaagaaagcttgcaagctttaatggaacccagttcagattaaaatctttgattaaaatctttatttttctgtcttcagagacaaaacatttgttcttttggtggcaag

SEQ ID NO: 48140 - DNA, 1058 bp, Homo sapiens
cacacgtacaaccacttctaggccaagcagcacaccagggcttatgtgtgggaagctctgatttaaatagtttacttttttaaaatttcctttctttcactaagtgtacatcaagcatctacgctgtaccagtcactatgctgtaagatttaggctgaagacttaatctatgttctatttctcagtctggttttgagttggaagacacttcagtggtcttgttcagcacaccttattttgcagatgtatgagccagacccagagagattaaggttctccaagattttttgctaacctgagacctggcactgaaacccagccctcccccactcttggagctctgtccttcctaccatcaaagtactaaaacacaagctgaattaactttaataagctgtgtccttttaggaggtcagatttttgaaatccttcaggatatgtatggcatctagaagttgaacataggtaagtgcatatagtattttttgatgtgctcaatatcgtttacctcccttaagaataatttcagtcaataatagtatagtcactgtcgaaaatgcataaagtacaaaaaaattcaggtcaaaatttactcagtcctttcatggaaagaaaacattttttagtacattttgtcgctgcctctttatttttaatcctttctacaacatttttaaacgttcagatttgcttttttctttaataaagtttttttgcttttttaattgtgttctatgcgtatatgaataatattttttgagataaaataacgtatttctgatttttaagacatgtcaaagctgttgtctgttttttgttacattgattgttgctgacattatgtcagggaggtgtaaaaatcaggagttctatgtggtttcctattacaactgtatttctccaggctttttttttttttttttgagacggagtcccgccctatcgcccaggctggaaggctggagtgcagtggcaccatctctgctcactgcaacctccgcctcctgggttcaagagattgttctgccttagcctcttgaatagctgggattacaggc

SEQ ID NO: 48141 - DNA, 1047 bp, Homo sapiens
cttgaatacttttcctctttcttagaggacagatgataccatctaattgaataaggcagtaaggcagtaagaagatgatcttgttgtagataatttccaagcagttctcggttggcgctttggagagattttgataatcattatttgtgggattccgagtatattttcttacccatcaataacttatcttcctatttttatttctgactttaatcgggttcacatttccccttacttacatgtaggccttcccatagtccatcagctaatttttttagaaattaggcaggtactttatttttattttctacttatgaacacctagctttaaaataggaatgatctgatacatggttctgttcaaaattttgacaggttataattggagctttggtcctgttgatagaaaaatgtttatacacatctctctcctatgtgcctttttcataaattacatatgtacatgggcgtgtgctattcattaaattataaactctaatcaaacataaaaaaggataaagatgagacaatctgtattaaatgtcttgctaattactatactggttggcttcattttccatgtacctaatatcttaataaatgtcttttaaagcaagaccataaaataatttcagatatctcatctgacttcatgtgatgcatgttggattatcttgtgtctaaccttataatgtagcttgtactaagagtaggagaaataatcggctctccctttccttatttacttgtatttcccttactggtaccattctttactctgatttacatttgtagtaatctttttttaagttactttttctttaaatggaggtcattttaattaaagcaggttatccagtctaatcctccatatctgcttgctgtgttatttgtaaaatggattttgttcaggctaaagagcaggagagagtgccactcgccgcctctccccttcgatgattgctcagtcttcccccagggaggcaggtgatacacaggactgagaaggtactgggttcagtgcatctattaaatataagtaaaaaa

SEQ ID NO: 48142 - DNA, 1047 bp, Homo sapiens
cacagaatgtctgctggtgtctgtgcagctctgagactctaggcactctgtacttagagaacatgtagaggttaagtgttcatcaggagacctgcgatgtttgtgttggaaatactaagagatgtgaggtttaggatgttttgtgttgtgttgctctgtgtgctcgtccagagcagacatcctcaagtcagaacttaatgaggtatgcggaaaatcaccaggggaaccgtaatatataaaacataaaattaaagctctgggatgaatggctaatgcctagttacattagatagtcagtttatagttatttgctccagcctaatttggctgtctattcaaggtaatcagcagagagtcaaacctttaactttttcttgagggactgcagtgagccttttagctttctttacgttgagctttatggtgacagatgagatgaaggatactatttcacttccttcaagtttttagtgtggcctcattatatttgaaagtgaattcccagagcagccgatatgcctgtaactaatcctaagtagaaaatctattccaaagcagaaaatatattttggctttacctgtgcagtcacagactgggaaagcgggtattggggtgtctaataatgtggatttaaatggtttggttagaatatctactctcctttcatccaaccaggcatttccatatatttttgtattccctctctttttttctaccacagaagtttaatttcaagattttctgtctcatctctctctggtattcattacacctgttacatctgttttgtttccagtacaaaacagcactcggacctgcctcttttacattggtcctctaaccaaagaatgatttaggagaaaatttgtcatttgttgaaaggttgttttttttttttccccttttttaccatcaacctgtcattttgtgtatcttaatggattattcaagcatttatagccctttgaaaactttggtttcaggcattagaaattaatgtaatttaggaacatggttaccccttaccttacctctgagtgtcctac

SEQ ID NO: 48143 - DNA, 1045 bp, Homo sapiens
tttcatcttgcactgggacccacagattacgtagcttttcctggttagttgccttcccacttgttagtatttagctgtcagtattgctgctttgttgatatattatagaactgtttgaaggctttatgtctagtgatgccacacctgactatcaaattcactatggaggacataaaatgcataaaattttttcttgctttggccattttcattttacaggtgtagaagtcttcaccggttctggttacgcacagagcccacatattgtagttcagtgccaaatccacacttttgtatgttctaatttgggaagaacatttattgtatatttatttggttcgagatactagacggtttatagtgctagttaattatttaaggatttcacataacgtaaatttgccaagtggaaacagaagacacttaagcttgaaaggcagtgcttattttaaggcttttacatattaaaagataagtgttttattatgatttaaatgataacttttggagtctgaattaaaagtcaaagtttgcgtaataaaatcttagatttttgtggggtacttaggacatttttcactagtaaatttaacagatttggctttcagcttgtgtgatgtgtatcatatgtttcattttagtaaggctagaagaattttttatttcaagggaagaattttttttatctctaagcttgtattccattgtgcaaaacaaaacaaaaggtaactcttgtgtgagcaacgctgtgctaaatgcattctcatagacatcttcatctttaatatcaatgttaagtttctagagattggtcttaataaaaataactatttttgcaacgagcattcttttctcagagctttgagttaggctctcaatgcgtgaactgaattgatatgcttaatgacatggtacctttttgaatattgctgaatagttctgtgtgacaacagatacaggttttcgttgtaagaaatctttatgaagagaaggatgggggctttgaggagtaaaataggtaaaataacccagaaagtcataagaa

SEQ ID NO: 48144 - DNA, 1025 bp, Homo sapiens
cctccttgttatccttcagggccagagcgtaaaaccatgcctctagatgcgagctatgagcatgcagttgtagctgcccagatggtcatttagaattgtgtgcatttttaaagaccatctttatgacaaagattttcaagtcctatcgtctctacattttctgaaaacatgggaaaaggatttgctacgagttgtccactctcctttattccctccctcaaagaacggttcttagaagtgccaaaatgtaataccttcggcaaggacaaaagcgcttttaaaacttaattttctagtggccctattcctaataattcttcataaaaatttagctcagcctcaaaacttacggcgaatcagtccatttaaaaccattcgaatatcaattgctgtgtaatgtccccattccctcaagtaaaatctgtttgtttgaaatattgttttgttgcccttgaagagttttctcaagaatcgtttcgccagagtcgcttgaatttcccatttcttgtggaagctgacctggagtttccattttggtgagcgggtggaaaagctgtcctgcatctaccttgtcttagtaacctttgggtatatataaatggtgactgtattgctgagtggacccgaatgttactgcatttgtggtaggggccttctttataggaggtttgtagggatgctaaggtaacaacacttaaggttgtggggaggatatacttacgggaagttcgcttgcaaactatggggagagaaagaagaggaagaaaacatctggaagataaaggccagaatggggtaggaaaaattagaatatgaagaaacatgttacattaaattttctgtgattcctcctttgtaattttcctttttgagagagtatttttatttttgtgtggttaaaaccagccccttgttgcctgttatttgggtaactttgtgctgccacctttcagggagttagttgtttttttcttcctttgaaagacaactttaggtgttaagcccctccctcttccttatctgta

SEQ ID NO: 48145 - DNA, 1034 bp, Homo sapiens
gggaggctgaggcgggcagatcacctgaggtcaggagtttgagaccagcctggccaacatggcggaactccatctctactaaaaaaaaaccaaaaattagccaggtgtgatggtgcatgcctgtaatcccagctacttgggaggctgaggcacgagaatcacttgaaccccagaggtaaaggttgcagcaagtcgagattgtgccactgcattccaacctgggggatagagcaagactctgtgtctcaaaaaaaaaaagttatgtgaatgtggtctctctctctctcaaatcatcttattgtactgtactcacctattttcaggtggtggttgtctatagataactaaaaccatgaaaagtgaaaccagggtctactgtgaatacagcctaagggtcagagtgagaaaatgcttaactcctttcctttcttaacctgatgtgttttcttcttatttgagtaaactgatttacatttcctttccctgaaataggtgatcctttcacagaccggaagaatgcggatggtcaacatgcttactcaaagagctgagtcataggccatagggcttagtggaaagaaagctaggatagttgtgagtatgcctaactgtgtgtgatcttgggaaacttatttaacatctctgagactatatcctcacctgtaaaatggagcaattaatatctttagggcagggttgttgttaggataagagaaaatacatgtaaacgtatgacatttagttgatgcttaataaatggtagctaattttccttttatgattgtaaggagttgagatgcaaattgcaatgccactgagaagggaaaccaattaaccaatgaggaatataaaaatagaagtaaaaccagaaagacgaaaccatgaactcacagaatctgtagatgtgctttggtgaaggaatagctttgtttacctgaagcagctaagctgtattttgttttgagaagaatagagtgatatcatgtaaaggggcccagatgagactggaaacatgggttctaggtccacttctt

SEQ ID NO: 48146 - DNA, 1050 bp, Homo sapiens
ttcatttctgttttgtcccaattctgctattaagcccatgtagcaatttaaaatttttttgatactattgtgttttttcaaataacatctccatttggtgttttttcaaataacatctccattggtgttttacatataaaatttatatttatatattatataaaatttatatttatatattatatattatatataatttatatacatataattatatataaatatataattatatataatatataatttatatacatataattatatataaatatataattatatataatatatattaggagacaggatcttgctctgtcacccaagctgtagtacagtggtgtgatcatggctcactgcagccccaaacttctgggtccaagcgattctcttgcctcagcctcctcagtagctaggactacaagtgcactctactgtgcccagctaatttttaaattttttttgtagatatgtggcctcactatgttgcccaggctggtcttgaactcctgagctcaagcagttttcctgccttgctcttctgaagtgttaggattataggcatgagccactgtgcctagcctaaaatatattttctttgcctgtgctaagatatttatctcttcattcatctggacattatttatttttactttattgaatgtagtcataataaatactttaacatctttgtctggtaattccaatatcagggttatctcagtttgcccttcatagattgtcttctcccttttgaataaatcaaatttcacattttcttgggtttacattttttgggcacttttggattcttttgaatagatagtgtgattattatgttgtggagaccctgaattctattatattcctttatgtaatagaatatgatttattttcttatattcctctgaagagtgttggcgttttgcttcaacaggcagcaagctcaattagactcaaatttcaaactgtaactgattgcagctcaaatcttagtttagttcctctagccttaaaaacaagttgctttgattctgccctacatatttc

SEQ ID NO: 48147 - DNA, 1050 bp, Homo sapiens
gtacctttgttgtattacactgtcgtctagcctgtatactttcactatttctcttgttttcctgctatcttcagtcctaccgacttgattcatatctcaaactccgcacccaagtactgaagattttttaaataaacgaatccatctaggcttagtgtctagacagcagaatgaaccagtcactgctcagattcatcactgacatataaataaatggaataatttttcagaacaaaacaaaaaaaatttatatgtttatgttattcagtgagccatagttgtgaatatgggataaaaccataaaggcaaaatatttggcagctaaatagaacagccaacactctaaacattttattagccaggagaaaaaataaacaacataagacccaatctctctaaaagtaatatactcctaatataaataaaaaggagtgtgccacataatagaaaaaactaaaatgtaataccactgtttttattatcatctataacaaacctcagtgcgtgagagctgtgggattctctaaattagataaaagtaaacacttgtggcataggtttgctttctgttgaaagttttaaatagaatatccaatgaaagtaaacaaacatataagaactattttttctttttttgagatggagtctcgctctgtcgcgcaggctggagtgcagtggtgtaatcttggctcactgcaagctccgcctcccgggttcacgccattctcctgcctcagcctcctgagtatctgggactacaggtgcctgccaccaggcccggctaattttttttgtattttttggtagagacggggcttcactgtgttagccagaatggtctccatctcttgacctcatgatccgcccatcttggcctcccaaagtgctgggttacaggcatgaaccaccacgcctggccacatataagaactgttaatcacatcacaaacattctgagttataaaaataaaaggaacttttaagttatgctaaagtatttaaaccttgataggacttataaatattcgagttgataataattcagcttat

SEQ ID NO: 48148 - DNA, 1023 bp, Homo sapiens
gggggatcacctgaaccggggaggcagaggttgcagtgagccgagatcgcgccattgcattactccagcctgggcaacagagcaagactccttctcagaaaaaaaaatatatgtatacacacacacacacacacacacacgtatatatgtgtgtatttatacgtgtgtgtgtgtgtgtgtatgtgtctatatacacacccctgagatctaggcgtcttgggaattacccacttaggaaattgacctgtgattcagacaacttagataaccactctggaatgcatcgattgttatgtaccagttacttatttgcttaactctacgtagagaaattttaacctacaaaaaagacagcagtaggatgaacccttgcatatttatcactcactgtgtcccttccatattattttaaacaacctcctcccagtttttctaatctgattactttgaagcaaatcttggtatagttacttttaaataggaagcagataggcacctttccagaatctatagaacttttccttagaatggcagggcatgagtttgtcagaagccccagatggggtcttcatttcaatcaggtgttatgcttggcaacggtttccctgtggggaactttgagggacttgggaagcattgttatctgtttttgtagctgcatctgcgttaaaaaaaaaaaaaaaaaaaagttattctttctattacagaaacctaacttttaaactgtatctattgtcatttttccatcagtcaatttactgcctcatcctgctgctcaagcactgggttagatgattagcaggtatttttccttttttctactctttctctatcacctttttaaaaaattgaagtttctcttaatcacttaactgatttgttttattaattgttcatttcatttgaaaaataaattcactaatgttcacagtgtcctaaattggttgttaataacttctctctaataatgcccatgtacctctcccaccatttaaactgttggcttaccaagagttactcatc

SEQ ID NO: 48149 - DNA, 1058 bp, Homo sapiens
gatctgcccgcctcggcctcccaaagttctgggattacaggcgtgagccaccgtacccggtgcaggtatctgtaaaattttttaaagagtgaaaaaaggcgaggaatggtattgtcaccttagggaaaagaaaatgagcaaatttatattttatttcgggttgtctaaaaactttagcatgtatagttttatagtgttttaaaactattaggaattgtgacaacatttgtaaaagttacagattaagataaaaccgcttaacaacgcaacaattttaagtaagtaggtaatatgaagtcttggaattagagtgttgtctttgatcggagatgggctgggaaaaaagctttattccagttaaaatagcactgaaaatgagaacaggtattagtttggcctgtaatgttagatgattatgttccaaagaatgtgcttataatgaaatttaagtcttgaatagcacaataaaataatcaggattgagatttcatatataaggaataaaagtatactgtagggaaatcttagcagttttaaaattgctttctctaaatatctttatgaattttaaatgaatgtgcttttattgagtgattttgagggagataccagtgaaaatggtgctgcattttcctacagataataaacagtgttgagatagtatcatggttgtagaagataaagaaattttaaaaatctcaagttctcaaaataagttaaaacacaaagtaggtactttttctttttgaggcagctgctcacttgtcaccctggctggagtgcattggctcaatcacgggtcactgctgaagtgataagtgatcctcccacctcagcctcctgaggagttgggaccacaggcatgagccatgacaaccagctaatttttaaattttttgtagagaccatgtgttgcccaggcttgtctcaaactccttggctcaagagatccttctgcctcagccacccaaagtgctaggattataggcatgagccactgcacccaatcaaagtagcttctatatgagtgttttggagctgttgtttctagccactac

SEQ ID NO: 48150 - DNA, 1031 bp, Homo sapiens
aagtgctgattcttttactttttcagtctaattatcatagtgttcattaaaactgacccattttaaaactgctttgtaaacaactatctgacctctgtggtcagggaagattttccagaggaaatgactgttgaattgtctgaagtatctgaatttgttaatcttgtgaatatagtgtgatagataaaggagggaggaaagactgtcataggaaaatggtatgcaaaagccctgcttctatgagctgaaggaaggagaataggttacagtcgagtaattcaaagaagattgtgtcctaaacacaaagaatgagcatgaaggccaggtaggccatattaccttaggagcaatgggaattcattgaagagttttaaacaagaaggatgagtacgtatacattttataaaatccattctgctaacagtgtacaaaacaaagagacctcagattagatgcagggagtcccattaaatggctattggtgtaacccaggcaaaaaattgtggtagtttggaacagaattatggcagtagatttggagagactggatagagttgggagacagaaagtaaaatggacagaaatatcttaaattactgaaattacttggttactttgattatgattataaagttttaaaaatgatgatagctcctggtacgtatgttacttttctgtataatatttgtgatttgtaacatctttacttcaatttatttatatgaatttaagtacagtgataatgcatacatagagcttttgggtgaatggccttttaggggaaaatcctaattcttcaaaagtctaaaattttaagaaattattcaatatttactatacttttgtttgtgtatcctaaatatctcttcccttatagctactccttgagttaattgcagtgtggagagaaaaatcaagtaatattaaacagatattctctcctatggttttgataaataattatgcaaagaatttgggaatttttgatgaagaagaatttattaaatgaaaacgtatgatgtcatgtacgt

SEQ ID NO: 48151 - DNA, 1029 bp, Homo sapiens
gggagagagtgtgagaactgaaattcctgggtcaaagtttatgctattaaaaacttatgaatgccaccaaatgctttccaaatgagactttacagatttatagtccaaacagtatatatataagaatacctatttctgagattcttaactagcttttgatgacattttgatggcattttttaaaaaaattgccagactagtgggtcaaattaatagtttgttttaatttttattttccttattagtgagattgaacattttaatatttttatttgccatttgatttcttcttatgtaattttctgtacatatcctctgctcattattctctttggtagagtagaaacagtttatgtagagattttatcaggtggttttctggcattctgttgagatgatcacatactttttctcctttagtcagataatgtaatttgttgataagttagttgatgttgaacagtctttggagtcttgggacaagtgctgtttggtttgttgagtttgttgtacttggctggaattcagtatttttactttcatgtatgtgtttctttttttttgttttttttgagacggagtctcgctctgttgcccaggccggagtgcagtggcgtgatcccggctcactgcaagctccgcctcccgggttcaggccattcccctgcctcagcctcccgagtagctgggactgcaggcgcccgccacgacgcccagctaattttttgtattttcagtagagacggggtttcaccgtgttagccaggatggtcttgatctcctgacctcgtgatccacccgtctcggcctcccaaagtgctgggattacaggcgtgagccaccgtgcccggccaacttttatgtatatgtttctaaattagatcagactgtagtttttatttttgtaatggattgaattaggaagctttgtgtttttttggtgtgttctagaatggtttatattttcttctcaaatatttgtcagaagtatctgggtctagtggagttttttagagtgattttttaaga

SEQ ID NO: 48152 - DNA, 1034 bp, Homo sapiens
ctttcattgcatcctgtacttttccatcagggaacttttcattatacttatttggatgatatttgattaatatttgcattcttaacacagctcctagactgtaatgaccaagaatgcaggcaatgtgtgtatggctcatttttatgtcaagaaaaatttattgtttataaacaattaattttgtacaccaatctcactaagtgtttcgtctttatctaccttcatccctttctattcctaatgtaatcagaatattaagataaatcttttattcatatttttgcacaatatcttaactgtacatttgaacaaaatagggtttaaattgattaagatttgaaatgtgagatgtaaattagatttaaattatactttagttgaaggtcactttatttattgaatattgctgaattttcatcatttgccagtttgttcatgatcagatactgagtttctgttaatataatagagacttaagatgtaaaaaaaagtataaaagactaggactcagacgggcctggtggctcacgcctgtaatctcagcactttgagaggctgaggtgagcggatcacctgagtcaggagttcgagaccagcccaaccaacatggtgaaaccccttctgtactaaaacaatgcaaaaattaggctgggcatggtggcttatgcctgtaatcccagcactttgggaggccaaggcaggtggatgacgaggtcaggagttcgagaccagcctggccaatgtggtgaaaccctgtctctactaaaaatacaaaaattagccgggcgtggtagctcatgcctgtaatcccaactattctggaggctgaggcaggagaattgcttgaactcaggaggtggagattgcagtgagccgagattacgccactgtactccagcctgggcaacagagcgtgactctgtctcaaaaaaacaaaagggctaggactcctcagcaaaccaccatggcatccatttacctatgtaacaaacttgcacatcctgcacatgtaccctggaacttaataaaatact

SEQ ID NO: 48153 - DNA, 1085 bp, Homo sapiens
cttctgatttttgctttttcctggagtggttgtgtagattccctcgtgacttttaaatagcatattattagaattcattgttttctccaggggtccttcccaccaggagagcagtatagttaagaatataggttttagagtcagacaaaccttggttcaaaattgggctctaccacttacttgctatgagaagttggcaagttacctaacctgtctgagcctattttttttatctgtgaaattagataataggggaacccaccaaccaagacacagcatgagtgctatcactggcgagatgctaccaatcacgagcagagaaggagccatgtgagccctgatattggatggagcagtacaatcaagaagtctccccaggcatattttgacttaacatggaaggagacattccacccaactacccaggagtagtcttcctaatctaagttattaatgtccttcttgaagcccttgaagtgttggtgtatctcttcaaaatgaatttatttaccaaggtatgcatgcctcagcatcaacactactggaaaaagtgccagagttggactttaaggcagctgaagaagtctctattttcagaatggcttttgatatcttgtataatgctgttgttggatcttcagacagagttcctcgacagtatactcagtttgggaagagatcatagcgtttaggtatccactggccttgcagactggtactgtgagctataaaaatgacaacctacagtcctctctaagtcatagagattggacaaacatacaacgttaggtcagcatcatgaagttgtggattgctgtccgtgagcttcctttttcctgtgaatttattgatggcccagatggaaatggttgtaccatgtgcattgataacaagtaaatgaaaataattaactatcacactaaatgctgttatggcacagtggctgttaaggaagtctttgataacataatgtgatttcaaatggtagtaaggatctgaagagtagataagatggctttctctctatcagcagttcagaaacagtgatgccctgaaacttaataccaagtgagaatccaaatcac

SEQ ID NO: 48154 - DNA, 1050 bp, Homo sapiens
ctcacacctgtaatcccagcactttgggagggtgagacaggcagatcacttgaggccaggagttcggaccagcctggaaaacattgcaaaaccccgcctctactaaaaatacaaaaattatccaggtgtggtgatgcccaccagtaatcccagctactcaggaggctgaagcacgagaatggctagaacctggcaggcagaggttacaatgagccgagatcctgccactgcactccagcctgggtgacagagtggagactgtctcaaaaaaaaaaaaaaaaaaaaaaagtaaagtgttcagtaataaaagaggctatataatttgaatatacttcatgagtctggtttttaactatttcatgcaatgaatgcatttattcagaaaactaaaagtatttaattgaagacccagagcagtgtgtttagggctctggtattattgaggagtatttaatatatttgaatattattttctgtgatttgtgtatattcctgattctgtgataattctggatttctgtgtggcttaacagttctttattgtagaatgacatgcttaatcggtgcagtaagtgtacttttttaaaaatataaatgaaatagtttggaacatgtttcataaacacttaaattcctttaaacaatttgtataatgtgccaggcaccatggctcatatgtgtaatcccaacactttgggaggctaagacgggaggattgctagaggcaaggagtttgagaccagcctgagcaacataggaagactccatctctacaaaaaattaaaaaattagctggacatggtggtgcatgcttgtagtcccagctactcagtaagttgaggtgagaaaattgctttagcccaggagttggaggctgcagtgagctgtgatcacaccaccacactccagcctgggtgatagagtgagaccctgtctctaaaaacaaaaaatttttttttttttttttttttttttgaggcagagtctcgctctgtcgcccaggctggaatgcagtggcgtgatctcggctcactgcaagctctgcctccc

SEQ ID NO: 48155 - DNA, 1058 bp, Homo sapiens
gggtaactgctactgtgccaagagcaggcattgatcaaaattaacctcaatttacaatccaagccttcccctagaagttgcaagctttcaaatgactgcaaagtttcataatagttacatcagacagattctgccagtgccatcgttgtctaggtgggaaaacagatgcctggtgcttccgactctgccgacttcccagaatattctctagttcttaagccctttgttggtaaattggttcttcggttgtcctgctgcctgctaggactcaggtctcctaaggcccttactacttttctgtaagctttaaatattcaaagttgtattcatgtattttttttttcattctccttggccttgtgggtttaattaagcctttattaaaaaacataagtatttattgtttttagtggaatttgggaaggaagtgaaaatagatgagtttgtttagtctttatctgggagtcttacctctttatgtacacttatcttcttcaactagactgcaaactctttgatttagctgagtcagggatataattctttttatccctctcagcaggtaatttattgctttccacatagtaaatcataatctgctggttgaacttgttaagtaaggcagtgatgctaagtgattgatacatgtcacaaactggtaatcattttaatcccagtgcaattattaatgtactgtgttcattgatatatataattatatataacattatatattatataatattactctagccatttatatatttctgtattaggtggggtttttttgtttatttgttttagcttatcagttatcattagtgttagtatattttatgcgtggctcaagacaattcttcttcttcagtgtggcccagggaaggcaaaagatttgacacccctgttctagctatgtagaaacacatgctgtactatactactgggctctaagtcaatgcttcataatgtgaaaaagtcctcagtatatttaggtcttcttaataataaatttcattatcttaattgcatgtatgtttcgtttaaccagggatttctta

SEQ ID NO: 48156 - DNA, 1048 bp, Homo sapiens
gtcctgtgggctgactttggcctgcaggcaccagtttctcatctctgcttgtgaatgtcaagttctagagagaccattgctttagtcacctctgtcctctccctcctcttcccactcctgcctcaccaagaccaaattccaaaagaccagttctcctcaaaagttgtgtttcataaggaccttaaaattggctactagtctaacagtaatttatttcagttgaggactttttaaactccatgactaaccattgagggtactttctggatgattaagttaataattttaaaggaattgccttggtttttgaggggtagagggtatattatttgggaagtggctgtttcaaagtgagtgggatctaggtttaaatccagcttcaccacctgtatcacttaagcaagtgatgcagcctctcttagtttctcattatttaaaaaaaaaaaaaaaatacttcagacagattaatggagtttattcaagcaaagaattattcatgaattgggcagccctgagaaccagaacaggttcaaagggactccagggctgctgtttggttggataacatttatcaacagaaaaagcaaagtacagaaaacggaagtgacgtatagaaacagctggatcggttacagctgggcatttgccttatttgaaccaggtttaaacagatgtctgtctgtggttcagctactgtgattggctaagactaggctacttgctgcaagagtaggatatagcctgtttactcatcaagttgggttcattaggtactgacaaacctttagaccagacttaaagtagaggaggcggcttttggccaaattcaatttaacagtattttttcatccacaaaatagggaaaacaactgcagagtttgttggttttttttgggataaggatatttacatggctggtgccattggatgcccaggaaataaaagtttctcttcggagccaatgtaattgagactttaaattgcaaatattatataatagtcacaaaaaacttttatgtattttattttggaacttaagaaatccttt

SEQ ID NO: 48157 - DNA, 1049 bp, Homo sapiens
gtcatcgttaatgagagttagttgaataaggcatttattcaacctggaaaatgcccagtggcttcagcccttatagtatggaattcctatctcttggcggggcgtggtggctcacacctgtgatcccagcactttgggaggccgaggcgggtggatcacgaggtcaagagatcgagaccatcctggccaacatggtgaaaacctgtctctactaaaaatacaaaaattagctgggtgtcatggcgggcgtctgtagtcccagctactcgggaggctgaggcggaggttgcagtgagccaagatcatgccactgcactccagcctggcgacagagtgagattctgtctaaaaaaaaaaaaaaaaaaaaaatcctatctctttttctgcacttggcccctccccagaactttgtgattggtcccaagagggaaaataaaacatatttggtggagaatgggtatgcactaaagttgcactgctagtgggggcccatagacctcgtggtgggtgaggatttagacacaacttgcaagatacaggggttgatccagcttttcccagaaaggcgtgggtgggttctgctgaactggcacatcaggagtttcactggggttaatgttttaaccgttgtgtcaatatacttaatgacactttgtttgaatattctataactgaatggaagcacttttaacgaacaagttttgttttatttttaggtgagcgaatagcagtaagatttacctaggtacactttgtactatattgaaaagtttacattttgaaaaaccaaatatgatatatttagaccaaagaaatagttagactttatgccttgagagctttgcaactctttcagtgcttataatcttttcaagatctgagggtctgtttcactctcctggtgcttcctggactgtgtagtttttatttgggagattaaccactgggggcttttgttcagaacctgccttggactgaatggctttggaccaggtctcacttggtgccttctgctcctatggtaaggagaaaagatctgcagccctcac

SEQ ID NO: 48158 - DNA, 1023 bp, Homo sapiens
ctcatgccaagcaaaaatgaaaacaaaacaaaacgtataacccctttccttcctatttggtgcttgtaactgagaaaattaggtttgagtaacactcaatgtacatgactttatttataccaagttaaacaaattaagagtgtgggctctggtatcaacacaggataggttggaatcccagttttgccacttcctggcttactaagtctctgtgtcctcataggtaaaatgggggataacagtagcacttacctcctaagatttactgagaggatgaaatgaaaccatatatttaaaggcttagctgtggtaagcactgtgtaaatattcaactcctcctgcttttccataaagaaacagagcaccctcctccttctgctgggtgaatcagggctatttcgtctaacgtctaatggataagtcagtttgccgtcactcttccttccttacctatgacttttccagtccctcatttcaggccctttgtggtttgattgatgaaaagatggtagaatgtaagcttgaaatacattgtttggaaataccttggggagggggatgctaggaaaagggaaaggaagagaaggctgacaaaagagcctcatgccttctaatgaacacactgaacccttgaccccttttagacataagcccactgcattggactttgggttataaatataggactacaatccattattctgaagtctagaaaaagcctgaaaaccatgagtgttttcatctgcatgaaactatttgtattctttatttatctaacttaatatgaacattcatgtttccctgaaaaggtattaatgtgcttgattccaaggtgctgccccaggctctgctgggggtgttatgtaatgggtactatatgtatcacagcaccattctgaattctgagaaatcctgaattttagaaacagatctgcccccagtgactttgtttttttgttgttgttgttttgttttttttttttttttgagacagttttgctcttgttgcccaggctggagtgc

SEQ ID NO: 48159 - DNA, 1050 bp, Homo sapiens
tttactttttcctctagtggtctctgagattctaagaggtcttaatgccaagaagggcacaactgtagcccatttcccacagagcaaataatttattttcttaaaaaacatagatcatattaactatctactttctaaagtgcagtatcttcccactacaaccagaataaaatcttaaatccttaccttggcctactggaccctttgtgaggaggcccctggctacttttgccatctcctctttcaggatttccccttgcctgctggacttcagccaccctaggcttttttatgcttctcaaaacacactccccccacccccaggtcttccccccactcccagctcttccccctactccctttccccgagcctttgcgcgttctgttccttgtgtctggaaagcttggccctggatttttgcatagctggctgctctttcttcatattcagatccccgctcaaatttctccttcctttgggaggactcctctaaccatccaatataatgtgacctagatcccttctgtttctattagataacccgcctaatttccttaatattattttcactctgaagttgtttgtcatgtatatttattcatttatattaatcataacagagataagaagatcaataattccttactaaaaagtcaaataaaatgcaaatcatcataacaagtctgaagcattgccattttctgtggacacaattgcctgcaagcagttgtctaattcaacttgtatttacttactatgtacccaacagtacagtagtaacttcgggaggccaatcagacagtcagcaaatatttgttgactgtttcacacatgccagacagtgagctaatgtgcgaaacactggaacacagtgggaaacaaaacgtgcatgaccttgtcctcatgaacttaaaagcaaatagtagagtaagacctacagaggatggaagctccatgagtgtaggaatctcttccactcagtgttgcaacccagtgcctagatagtgccaggcacatgaaagtgctttgtataagttgatgaatgaaca

SEQ ID NO: 48160 - DNA, 1058 bp, Homo sapiens
actaaagaatgtgtatcatacatatgccattcatgctcttcactgttctgaaaggataattattgacagcccaaggagaaggccagtcatgtgtacattggttttctgaagtctaacaactaccagggctaataaagctattggggcatgatcaggaagtatgctaaaaccaaaccaaaatgttaccttcttatcaaaaccctgatggtgagtcttgaaatcagagtgcccagcccttggggcaactcaaggtgggtgtatgagaatagaagacggtccagggtatggtctctaagatgattaagaaattgaaaagtaggggttcctgattggactaacttgaattcttcaggaagagggaaaaagtgaaaagctgtaaaatcataaagggaagatggcaaatatggttgggtattttccccaactaaatcctgatatttaagaatacctttcgcagtttgagaaggttcagtgatagaccagtaaaagaaaggaagaaatcgtttatgtatgtttggaaacttaaaaacttgttactttcagtgtggtatagactacaaataatagagtacaggatgaataatgtaatagagatctggactacagtcccagagtgagctattgggagagttgatgtatatttggtggcacgttcctgactgttgagcttggtgtcaaatacccttaagcttcaagatgcagtgggaagactagacataaggactggccctgctgcttttcagttgtgtcacgcagggcagtagttctcaaagtgggtcctagaccagcagcatcaggatcccttgggaacttattagaaatgcagttataggcttcaccctatatttagtgaatcaaaaattctggaagtggcccagaaatctgtgttttaaagctctgtaggtaattctgattcaagctagagtttgagacccacttgtctggggcgagcaaattctgcctgagccttatttttcagatatataaaataatgatactaacacttatcccacagggctgttactttgaaaaaattatttacttgagacattgtggtt

SEQ ID NO: 48161 - DNA, 1025 bp, Homo sapiens
ctcaactgcactacacacggtccaagcaagattcaaccagacccagttttcatcacttctcacccaatgccacatcactaatgcccaaccaaggctgagtcctgattccaaattcccaggagagacattcttattagccagcttggtgtgatagccaccccttttccatcatctgtatctagaaggatgggggaagtgtccccatgcctacttaataggagttgttggggggtggggctctaaaagctagcacacgtgggataggatcaggccattgatcaacatgttcatccttaacaccttggaaaggtccactaagcctatgatcacacaaagaagagccagtagagatttgacaaaggccatgaacaaaacaagtgtgatgccttttcttctttagttatttgcatggtttgcatcaacagtacagagtcacagggcagtggcttaacccccatgcccatatacctggatggagagtgggcacagccaagaacacaaggtggaaatcaggttgaagactgtcattttttaaaggcgaactgggcactcatgtgttcccttttctcttctacctttaggaaagaacatgaggttcccttggaaatcattcaagaggaagatggaaggggctgtttagaagagcttaaaagctacaggctgtaagactggggcctgagtgctggcagtggaaaacactgttgggctgtgatctctccctgaaaagttccaggtgccttttcgcttcctgcaaaagaaaggaagcgaaagagaagaccatgtccatagccctgaagcaggtattcaacaaggacaagaccttccgacccaagaggaaatttgaacctggcacacagaggtttgagctgcacaaacgggctcaggcatccctcaactcgggtgtggacctgaaggcggctgtgcagttgcccagtggggaggaccagaatgactgggtggcagtacatgtggtggacttcttcaatcggatcaacctcatctatggcaccatctgtgagttctgc

SEQ ID NO: 48162 - DNA, 1023 bp, Homo sapiens
acataaatgtttgcaaatggtttgtatcttgatcagttatgtaaagacgtgcatttgagatgcaccaaagtgacttttagatgcttctttttaaaaatgacagtcttaacttgtgtttgcggaactctgtatttttcagttttcacctacgttaagcctttcaatttttttgttgactaaagttggtagaagaaatgattatcagagtttttatggaatcctccaccacctttttccaaaaggaattagaatcatctggtgcttatataaaatcaaacactgtttaaactcagggagctctttttttttttttttttttttttttttagaataaagtgcagtttaaagagaatagagtgggagcttttaccagatacctgttttggtctcttgctgggctgatactattttcctaggaatggtgactgtgtgtttctgtttttcctcttcagatttcttagaccaaatagaggaaatccactggaggcttacctaacaagacgtattgatgaatgtagaatcttaaatgaaaaagaagtcagtggatgtggcttcctgtactgtcagcttggaccaaaaataaagcgagccctcgccgcaggggtttggctcagccctgcgcctgtggcagatgttgttttccatggctttgcttgaggagtacacttctctgggcaaaagttcctgaggcctttggagacttttaaagccttttttttttctgtagcttttattgtttttaagaaaagtggtgtcacccttacttgtcattaaaaaaaaaatagtgtgggaaaaacaaataaactacccaaagaataaaacaagaaaaaccaaaacaactcccctaaatgaatgaaaaaatttacacccttcactcttttgcaagataactatttccatgcaagttggattagaaactatgagaagatttttctctttgatttttggtttcttctatttttaacatttttgacaagtctacacattgtggttacataaaaacatcaggattaagatatttgg

SEQ ID NO: 48163 - DNA, 1062 bp, Homo sapiens
gcccttctttttctcacccctccaaaacttccagaacaggaagtagctatgtgtcttgcaacaggaatgatacgaaggttctaatcagcaggcacatgcatcatggtgactattctagggtatgatgacctggattatgccattaaaaaatgtcattgccttcacttgtgtgctgacatgggtaaggtttattcagccagccttgatgagaggaattaaaaagtaatctctggtataaggagtcagtttgggcccatgatgtctagggaagttccacttgaataatttcttctaaatcctcagaactcatgagcttctgggaggtcatacagtaatgaggtatacatttatttccttattagtcagaaagaaactttacttaaaaggacccatttgtgtttactagatatggttggaggaaatataaattattatcactattactttatctccttcccatacaaggctttataaaattaaatgcattgtaaacctagactataataaaaatgagatcgtgtaaatatctgtgtgtcttacaggctacctgtaacaagataccttagactgggtggcttataaacaacagaaaatctatttctcatagttctggaagctggaaatccaatatcagggtaccagcatgattgggttctggtgtgggccctcttgagggtagaaagctttctggggtcccttttataatggctaatctcattcattagggtagagccctcataaccaaactatcttccaaaggtcccaccttttaatgccatcacattggaggttagaatttgaacacatgtagtctattgcactgtggctgctatcaggttagatgccccatttgaaagattagactgtcttggcagcttcccaaatgaatgccaaggtgccttctttccccttctgcttgtgagcaaggtggggtgtgtgtggaactggggagagtgcatgacctctgatgaagctgagggaatgtcttgatggggtccatcaccaacatcccctgtttggggctgacctcttggttggagaaggtgctagattccttcccac

SEQ ID NO: 48164 - DNA, 1035 bp, Homo sapiens
taattaacatttgttttagatcaagaatggaaaaccaactcttctggaggaaaacataaatgtctgctggggaacatgtatttgctttgggaacccttgggaccaagaaaataaaatgcttaataacaacagcataatgaggctgtaggagtgctgaaagcattaattaatgaacaattttaaagttcttcagaagcccagggagagtttagagtggatggattcctttactgacaaagactaatatgttggactgcttaggctgacttgattaaaccagagctaaattttaaaacacacctaattacagtttccctattttaaatggaatgcctcatatttattggagtcctattattctattgagatgaaccacggttaaccacatccatattttttaatatttaggctgtagaactaaacttttacatgtacctggagaagtttagaagttgacattatactgtccttacatgtgacgtcccactttgcaacaaaagagccataggaaggcaggccctgaactgaccaatcgaataacctgagagtctgatcagaagaatgcatgctatgtaaatagatcacgtttgggcaagtgcttcctattgctgtccattgaaacttaacactttcagtggtccttctgagtttaacaggtttctatctcctggcaataaaaccagactttgctatagtggtttacttggcaaacttaatctccacttgttcctgcagtaggattaagcatgtaaacacagcatgagttaattgtaaaaatggacactgatgtgacaactcagttggaatacttgctgtattttgtcatacaagtaatgagagtttttttgctcgtttttagtgatattgcttacagaacctttaaagtgattagcatagagagataacgcttctatgtgccttagaagagaatctatgctaattataacagtatgctgccagcatgattgttttgtaaatgatgttgtcctagtgatatgctgggaactgtacttactgttcctccaggataggaga

SEQ ID NO: 48165 - DNA, 1047 bp, Homo sapiens
gaacaccatatatatttagacttgcagcatatgttagtatatgaaaagcctacaatatcttgcagcaaggcacctgttaaactggtctaacctataatataataaacttatttgactacatacttttaaaaagatcacacttactaatatcctgaggaattaatgttttggggaacatactttgtgtatcactgatctaaatagagcatacaaagaagacaatgttagaaaagaaatccaatatccaaattaagatggaatacagggaggactacagactggaagattgcacagttactcttggttaggtaatataagcagcaacaatgatcacatcataatttcagtgttttctctgattttaaacaaaacagaaatacgaaaaactcaaatgttttatattgtaaaatgccttttgtcctctttatttttgttgtcttccccctttctctttttctattaccacataagcttcttgattttcatcaaatgagtcactgaaagttggaacaactggagaaagatgtgttcaaatccattgaacagaaagttattagttaagtacatagtgttactcaaatctgttacataaatttgttggaggctgggtgcagtggctcatgcctataatcccagcactttaggagagcgaggtgggtggatcatctgaggtcaggacttcgagaccagcctgggcaatatggtgaaaccccatctctactaaaaatacaaaaattagccggacgcggtgctgcgcgcctgtaatcccagctactcaggggcctgaggcaggaggatcgcttgaacccaggaggtggaggttgcagtgagccgggattgtgccactgcactccagcctgggtgacagagtgagactcctctcaaaaaacctccaaaaaaacaaaaaacaggccaggcatggtggctcactcctgtaatctcagcactttgggaggctgaggcaggtggagcacttgaggtcaggagttcgagaccaacctggacaacatggtgaaaactcatctctactgaaaatacaaaaattag

SEQ ID NO: 48166 - DNA, 1023 bp, Homo sapiens
gatgcagggtatttcagaaagccaaaagctgtgagtccatgcactcactcactcactcactcacccaaatctattacataagagggagtgatccttcatgaaaatatattttttgtacctggtgctatagccaaacatcctgtctcattgagttaatcatagacattgaccaaatgactgtgattatttgattgctaggtcaccagagcacagtatagtttaggtttttccaattttgttaaattaagcttctatatttggatattttctctttttgatttttctggatctccaaaaagatgaagaatagagctggcacttactaagtaggagactaagttggcttggttttctgttgcattagaaaatgttgataatctctaaatatccttttcttcagttaaatccatcctggacttagccttccatatgcctctgatacctttcttaaaagtcctggagggggttttatatttgagaatatctttctgcctcattaacttctctcttgtagtatcattttcttttcttttcttttcttttttttttttggtgcagtttaggcagtatttttaaacttttgcttgattgcttgattattatatcttcttgcctggtggttctggattctgtaaaggcttttgtttgctcctgtgtttgttgtgcactgaggaggtatgtgagtaggaagtcacccatttagctaagtgaattcctagctggaccaatgttactgtggtaatgatggctatctattgtttatggtttttactttgtttgaccaaataaccttcctctgattatggttaaagcaaatggattcttttctccaggaaaataaaatggattgtcattttaaaaaggtagcttattatatcttctcaagaaaaaaaagatatacattaatttgcaattaagtcattgtaaaatggtaaatagccacagttccacaaacatggcagactttgattgaaaagttggcttaaaaagttcttgtctaaatcagttgactgcaccaaaggc

SEQ ID NO: 48167 - DNA, 1050 bp, Homo sapiens
aagcaagagaactattctcatcaaatctgcaacacgaaaagttcagacaaaattccaacaacttcacattctgaactaaatgaggactaattaccagttcgagcaatgagaatatatgaggtcctccgtttgcactttgccagggatctgaaaacgttgggagtaggtcggcttcaccctgaagccagaccatcgacagccagttttccctcccttctccacccacaggtcttaggccctcatccttcccagcctcagaactagtctccaaagaagaggaaagttagaggagagagtaaatcgttgaataggatgaaggagatgtgggaaaaagaaaaagagaggctgcaagagagagggtcccagggataactctgctcttggaagggtggccacagtcatgtggtcccaagaggcaacaacaagcttaggaagccagagaaaccagttacaatcactgctactcttttcgattctgtgttgtttaagaaatatcacccgccaggagttctccagaaacattttccctgattccatgtaagtgctcaaccagtgaatggtaatcccattttggtttagtctgtaccatcccctattccaaaataaagggaaaaatggtgggtttatatcttaaattttctactttactaaactcaagggaaatagccaagcaaaaacgaaagctgagactcttgctaattatcctttccatagaatgtttgctaaaattccttgtcaaggaaggaataacaaagctagtccacgctctgtatagggtgtttccaattagttatactttaaagtataagtatttaacaaaatctataaattttgttaattatttacttgtagtgaaaaatgagccattctcaagcaaatcactttttattacacattccagagaataaccataaaaggacatttattatagcaaaaataaccacatctggatggaacttcaatcaccagtatttactaaataaatgcccagaaaaaaaatagttcatctttaatttcagtcatcattaataaaagctgaagtacctcttc

SEQ ID NO: 48168 - DNA, 1084 bp, Homo sapiens
tgttcctagccatattatgcaacttctggattattccagaaagtagcctgccactgaggcgtagttatgttacatgggtatattgtgtggtggtaaattctgggcttttcgtgtactcattacccaaatagtatgcattgtgcccaatagacgttgaaggcctcactaccagcatggttttcctttatagccactagtcaggatttagattatttccttcactcattaagaaacatactagatgccaggttctgtgctaggtgtgtggtgtgtatcagagaaccagaaagaatgcagagcttatcctctagaaggaaaaaaagaaattgaaaaataaccataacaaataattatgagtatgacgattgtatcaagaacaattgcaaggtataataacagcatgcgactgtggattcttccctaacttcaggggagaggaagaaaagcctctctaaaaaatggggattgaaattgatatctgaaggatactgggggttagtgttcctataagaagaaacagcgtatctgtaaaccctgaagagaaaggagcatggcatttccaagaaaagaagaagacaagtttaagatcaggccaggttttccctgagtctgaaacctcatttacacatttccttttggacttccgtcttaaatttgcccaaccttggactgacgatttgctgtcgtatttaatctcctttcagatgctggtgtcaggtttaaattctattacacttctttgcacttacatttaagaaagtttaccatctctacatatggagcacacagagggcagggaaagttagcctgtcgttgaggcagggttgtataataataattagttcaagctctaaagtcagactgctaggttaaaatcacagatttacttacttcctggctttgtgaacttagcgtgttgctttgactttctgtgcctatttttctcatttgtaaaatgtaaataaaaaatcttacttatgaaagattaaatgtataaataatatgtggggcacttacaaaagtactggcacatagtaagaaaccaagtgttagctattagcattatacagtgtaattaggggct

SEQ ID NO: 48169 - DNA, 1023 bp, Homo sapiens
caggatacaaggaatttaactgtattaacagactgaggtctcagtgggtgcttatggcaagtcactttaactctctgatcttctgttgccttacctataaagtgaagactagaatgcccaacgtatctacatcgtagcattgttatgataatcgaagaagttgatgcgttgctaaataattcataaattattaaatgttgataaaatgtgagatattatcggtagcagcatgcccttaaagactcatgggttgtgttacatcctttgcttctgaaaactaacttccttacccaagatttccttatcatctagaaatttctagcattctaaaattcattgagagtgttaattttttaatccacaccctgtgtgccatgttttacagggaagaaactatcttccagaggcaaagtacatcgtccgaggtcacacagcttgccaaaggcacaactaggttctcaacacatgttcaactaactccagatatggaactcttccattaaagcacaaaaatctgaactttttgtttttaaatataattgtttttattttccatgaaatctagtttcccttattattgcattcaattccgaaagggtaatatctgatattttataaaatgctatactatctctaagttttggtaaatatgcaatattattattggcaactattttcaatgtacaatttaactattacctcttggtaattgttaatgggtgtcttcttaattaagattcacaggatacccatattgttgatatataattgttcacaaagatattttaaaagggctgttactgtgaaaatattttgtgcttgtaaatataaaaggtatgtgaccctgaatattttgaaactttgagtgctggcataaaataagaggaccagagttcatattccatatctgcagatattacttattaagcaaataacgaggtgagtagagaggcctaaattatatttaaatctctggatgaaggatggtgaggaggtgtagaattttataataggcttttgaat

SEQ ID NO: 48170 - DNA, 1059 bp, Homo sapiens
gcccagatggtggggcagctgggcagaggtgctccttacttcccagacggtggagcagcctggcagaggcgctcctcacttcccagacggtggagcagccgggcagaggcgctcctcacttcccagatggtgcaggcagagatgctcctcaggtctcaatctcttgacctcctgatccgcccgcctgggcctcccaaagtgcttgattacaggcgtgggccaccacgcctgccctaccatctcttctttctcctcctaagcagctctcttactctcctgaattttgatgttctacttaacaccctcatgttcttacacatgttgccctgctggaggcgtccttctctttgggaagcctgacccaccaacagtgcctcaggagatagacatggaagcttagccggtgggggcccctcgtctctatcccacctcagttgcaggggaggggtcggttgcagctgcagcggtggccccgacagttttcttttgtgggaactgtggccggcagctctgtgtggagaagacctacttgacccaagagctgcaggatccttgggctgcatgtcctcccccaccatcagcaagcctggagagctgggcaggtggtctttacccagcaccttcaaggccgccttctctggccacagggagcagcctggaactggggcagggagcactgttggaagtgggtcaggcttcccaaagggaaggatgcctccagcagggctgtgtgaactggcgactccatggccgttggagtagaaactcactgcaggcacctgggccttgtcagtctggttgttttctgtcaagctcttgaggtggacatttccctccaagggcctgggattgtaccaggaggaagtgaagtttccctgagtctccaggggcctagaggtggaagctgcttccccattgctacaggggccccttttattgtcctcctgcccctgggtctctacctggtctgtcacctccgttgcttctctgggctcttctgccctcacctccatcttcgggagcctggctgggatcacctgctcatctaatgaaggaagt

SEQ ID NO: 48171 - DNA, 1088 bp, Homo sapiens
taaattcctcttatgcatatattaaaggagattttagtcttttttctatcaatctcttactataatgaattatagttattgatttcctaatatgaaaacatctttgctattcaagaatgaaccactcttggtcataatatgttattattgcaatgtactgttgggtcttatttaggtttttctttaactcatcatagtaagtgaacttgtacagttttctctcgagtatttactttctcaggatttgttattagtgttactctggctttcaaaataatcaggaattgtccttaattttgttttattctgaaatactctaaaaggctttgcaattgtgtgtttctttaaggataaaagaatttaactttgaaattaagtttggcaatatttcaggaagtagctctctgacattcttaatatcctctatgattattgacctgtttaagatttttaccacttaggaagcgactaactatggcgaccgccacggagcagtgggttctcgtggagatggtacaggcgctttacgaggctcctgcttactatcttattttggaagggattctgatactctggataaatcagacttcttttctctaagacttacaaattacaagaatgatctgatcttacagtcgaggaaaaagaagaactgattgaagagtggcaaccagaacctcttgttcctcctgtcccaaaagaccatcctgctctcaactacaacatcgtttcaggacggaatcttgctctgtcaccaggctggagtgcagtggtgcgatctcggctcactgcaacctccacctcccgggttcaagccattctcctgcctcagcctcccgagtagctgggaccacaggcacaaaccgccatgccggcctaattcttgtattttcagtagagacggagtttcaccatgttggccagaatgatctcaatctccttttttttaattaaaaagtaaacttcaatgtcgaaaatgcaaacttggggagggcagaaagatcacacacaaggctgtcacttcacacttggaaggttgcacagcagccgggcagagatgctcctcacttcccagatggtgagggggc

SEQ ID NO: 48172 - DNA, 1066 bp, Homo sapiens
ttgttataatcatcttatattttaccacagtgtctagtatagcacactgtcagtgatctgtaaatatccaataagttactgaataaaagaacatgaatcctgggtttagctgtaccttcagatgtcaaaataatcacctctagttaggatgaaatgaacaacatagataggtaacagacacttcttaaaaattgtcaaagtgatgccattctattacagtttattattaatttattttcattacatgtaagccaaaaatagtttccaatatttagagaaaatttactcctgattaatttatatttttgactttagataaaattgcagacagaatcatttcctgaacaagtacaagctgtgacttatttacatcttgatcaatgttacaagccagggccaaaagatattttaattctgggctattgcagaagagtttctggttacatcatgaagttaaatcatttgaacaattgttattagagctttaactaagtccagtgaactgtaaataggcaagttggatctcgtttaggcagaaaattgggctgtagatgtggggtgtgtggtgatgcttattgaatcaaacagaccgtgtcatctgcaaaaaagaaaaagtaacttggcgtcataatctgtacttttgatttggttggtgagtctttgaccatgtattcttatttttatttatttttgcctttgtttaagagcaactaaaaaagtcattgaaaggagcagcatatggtagtatctatctactcattactcctaggccatgtgactcaattcttcctatcttacttcctttctaagttctatagattatttttgtatgcattttaggtatttttatcctttgaaaaattttaaactattggattgtttcaagtatttttaatatatattctaaaaataacaaagactttgcattcacattacattgctttcaagttatcagtgtctagttattactaacctcttggcatgctgttcatactcacacactcaacgtctgcctcagttttggctattcccactttcttaactctcattttactgcagattcgat

SEQ ID NO: 48173 - DNA, 1030 bp, Homo sapiens
gtagccacagcaggaaagtggtaggagatgctgggtttttttttttgtttttttttttttttttgagacggagtcttgctctgtcaccaggctggagtgcagtggcgtgatctcggctcactgcaagctctgcctcctgaacgccattctcctgcctcagcctcccaagtagctggaactacaggggcccgccaccacgcctggctaaatttttttggttttttgttttttttttcagtagagacggggtttcaccgtgttagccagcatggtgtccatctcctgacctcgtgatccgcctgcctcggcctcccaaagtgctgggattacaggcgcgagccaccacacccggcagagatgctgtttttattgagtttcagccaggatccagaggcccacattttgaccacaataaaaggtttagatgttggaattttggtgaaaaaaagatacattggtagctaaagtcccaatacatatttatatagtatgtaaatcccatggtgctagatttggggacttctgtccatgcccttaaggtgcttcatttttttagtgttcttgagagcttcccaagccctctgtgatgctaacaacttctctccccagtttgatggggttttagtattgatgaaggaccttgtggaagtgaccctttcaggtacagccctaccctgatcaagcattgttgtaattaaaactgttctggttgccaggacaaggacattaaagctaggtttagtaatgaatagattgtaaatgaagggtaccctaatactctgcttccctctgcaagtttgttccatgtccttccctgcagactgggtttttcagtttcttcatattctctacacccacctctccttccaatttcatgttgcagtcggttttcatttattgtggtagagattatggtcatgctgctgtaataacattcaactcattgtcccacagctaccaccagtgcttcaagaaccaaatactaaatttttggaaaataaaagatggttggccgaacttacattgaata

SEQ ID NO: 48174 - DNA, 1036 bp, Homo sapiens
cttccaattaggagtagcaaatgtatttttattatatatttactgcgtaaaacatgatgatttgaagtatacatacatgtgtaataattaaatttagctaattaacattcattatctcacaattatcatttttgtggtgagaacacttaatctcctctatctttgctttttttttttttttttttttttttttagacggggtctggctctgtcacccaggctggactgcagtggcgccatctccgctcactgcaagctccgcctcctgggttcacgccattctcctgcctcagcctccaagtagctgggaccttacaggcgcccgccaccacgcccggctaattttttctatttttattagagacggggtttcaccgtgttagcgaggatggtttcgatctcctgacctcgtgatccacccgcctcagcctcccaaagtgctgggattacaggcgtgagccaccgcatccggcctatctttgcatttttgaagaatgcaatatattgtcattaactatagtcaccatgctatacaatggatctcttgaatttattcctactaactgtaattacatatttgattgacatctttatttgacccagaatttttgtttgtttgggtttttttcctttgggctggaggtgttacttggttgttttgcttgcttgttttgcaatggagatacagatctggcatggacttagtggcatctacacctcaatttttctggagaccgatggtaggcatttctgatatatctggtgatttgatagatcagagctctagaatgtagggtctttgtagattggaacaatgtaaactgtcccatatgagaaatgaacttgtaaccaacacaccaaatgagtaagttagcaataaaggcatcctttttaaagttgatctgaaaaatctgaaaagttcaactctttttaagccgtattcagagcctttagtcaaaaacatttctaaataaatccaaataacactacttctaaaaaaatatccatagcagcattttattcttcatttggatct

SEQ ID NO: 48175 - DNA, 1049 bp, Homo sapiens
attgttttgatttttaagatctcacaaacaagtgagaatatgtgatgtttatttttctgtgcctagcttatttcattgaacacaatgacctctagttctgtccatgttgttgcaaatgacagaatctcattcttttttatggctgaatatgtactgtctatgtctcaaaaagttgtgttactgtttttgattgtttcatcatttagtctttctacttaagtcaggaaacgtatacacactacaattactgtgttaaactattccgcgtttttctttgtgcttactattagcagtgagttttgtgcctttagataatttattcttgctcattaacatttatttttcagattgaagaaatccctttagcatttcttgttggacaggtctggtgttgatgaaatctctcagcttttgtttgtctgggacagtctttatccttcatgcttaaagaatatttttaccaaatatactattctaatgtaaatttttttcatcacattaaaaatatgtcatttcactctctcatggcctgtaaggtttccactgaaacgtcagctgccagatgtactggagtgccattgtatgttatttgtttcttttctcttgctgcttttaggatcctttctttatccttgacctttgggagtttgattattacatgccttgaaatagtcttatttgggctaaatctgcatgttgttctgtttccctcttgtgtatttgaacgttcttacctttccctaggattaggaagtcctctgatattatctctttaaataaactctctacctctatctctttctctatctcctccttacggtcaataactcttacatttgccctttgagactgttttctagatcttgtaggtgtgcttcattgactttttttgtctcctctgactgtgcaatttcaaatagcctgttttcaaactcactaattctttctgcttgatcatttctgctattaagaaactttgatgcattcttcagcatgtcagtggcatttttcaactctagaattcctgcttgattctttttattacaatc

SEQ ID NO: 48176 - DNA, 1022 bp, Homo sapiens
tgcaagccagagactttcaatcctaaacttgcttgcttcatggttaatccccttctgactctaagtattagccttacggatacaacattttgctttagacaaataatttcctcagtataacacaccaaggcttttgtttatataagagctgtagaaagctgtgactttctctagaatctgcaaaacaaaggaagagccttagagcatttgtactgttaggtttcctggattgcttcgttaacctacctgtcttttcttatcaactattagtattttaggggtagcttttaatttctgttataataccatgcattatttctatcagcttctttacaaattatatgtctgatgattcctcctcagcctcttattctgatatatggtgatgttagccgtctaccttttaaagcaggtgatggtaattaattgtgattggttactgtcaggtgcccattatcctgccattgttctccgaacttatgtttgctttgatgctacgctctggagttatttacagcttattttgagactattttggatctgtttggcttgcttcttattttattgattgattgagacagagtctccctccattgcctaggctggagtgcaatgacgtgatctcagctcagtgcaacctctgcctcccaggttcaagtgattctcctgcctcagcctcccaattagctgggattacaggtgcgcaccaccacacctggctaatttttgtatttttagtagaggtggcatttcaccatgttggccaggctggtctagaactcctgacctcaagtgatccactcaccttggcctctcaaagtgttgggattacaggcgtgagccaccgcacccaggttgtttcttatattactttatcagagcaaatatagttatatcaaaaggcacagaatttgcctacagaatgtgagagctataggtaatccattaggcccacagattttaaactgtgaattttttgaagatccttttgaaattctacaagtttttctgtgcatatataa

SEQ ID NO: 48177 - DNA, 1038 bp, Homo sapiens
gtgttttaaaatttttgttctactgtttgaccaattgttaatgctaaatccaaaaaagacatgggtagtagatagagttttgtagttatgtgcaaggcagagaattcccacaacaaaaacagatgctgctccccaagtagatagtcaatcacacggtgtttttttttttgcaaactgtttcagtgaccttggctttattcttaaaagttatatgcttctgatagtacttgaaaactaacaaacaaatatccagaaagaaaatttaaaataccaaaataaatttcccccaagtaaaatttttttatcgcatagacagataaaggagaagaaaactctcctttaatttttttaatccatctttgttcctgaatgctttgttctttctcatactgtagctctatttaatactaatgtatgggttgcaatgtccaattctttattaatatatttgagaaaaacaaatgttaacatgtcatatagacaaactttcataatagccgtgacgtggtagaaattatctaaaccatttcctgtttgttcagttatgagaaatggtaagtaagtaatgtcaattattatatgacattgtatctatcattatgttgtactatatgtcagtgatgcccacaggaactatcaaaatatttagaattttttggccacatatgtctgttttaaaaatatttgttttctctgaatatgtagccttcccttggttaatcttcacccttcccgtcagtttattaactatcactgctgttttctattttctttattgtttgaaaatgttgatcactacttcaattttatgtttattattgtatttatgtcttttttccagctttattttttgccaaataaaaattataaatatttaaggtatacaatgttgattattaaatacatgcatatattgtgaaatgattaccacaatcaagcttattgacttagctgttacctcacatagttaccttttttgtctggtgagaatacttcagatagtagatatactcttaataaattttatttatacaatta

SEQ ID NO: 48178 - DNA, 1034 bp, Homo sapiens
ctatattcaacaagttattttaagcaagagtactgcaataacaccgctcttcttttaatgtgctaaagagatattgtgaactatgaacatgaaataattaggttttgctcaatggattatacaaagtgttaataggaatttggggggcatttttgtttagaattaaagtatgattttagtgcttcaaataaaatgagatgctctcaagtacatttgttaaagagagccaacaggtttttgaatgtgaaagaattgaacaatactgaatgtaaacagaataacaaaaatattttaattgctcagtgtgaacagtataaatactaaagtaagaaaaaagtttatcaaaattacttcagtgtgaatgagaagggcatgtgtctaaatctgtttttcgctactgtaacaaaacaccaaaaatggggtaatttatgtaaataatagaaacttatctgactcatggttctggagactgggaagtccaacagcatggcaatggaatctggcaaggagcatcccctggtggaaggcacatgggtgtactagaaagaattgaaatctggccaaatccatcctttctatcaagagcccacttccatgatctctcaccaatgtgtgattgataatgatgttaatccattcaatagggaagaaccttcatgacctaataaccttttaaagttatttaaaacttttgatactgctgcattggggattaagtttcaaaaacatgaactttgggggatgttttcaaaccatgtcagcatcaactactgttttagcagcattatgtagaatatgggcagaacagccaacatcttttatagaatcattcatattttgcttaatcatttaataaatattgtttgtaccttcagataaatatccaccaaaatgtttatttgtagtatgtccatcaattcataaaagaaaaatttttttctttattaacttcaatttgaataagagcatttctgaaaaaattgctattatttctgaagttttatcagaaacagttttgcttacagtagccttat

SEQ ID NO: 48179 - DNA, 1045 bp, Homo sapiens
ttgttttgagcattgtcgtattttctgcagctttctttagaataaactcctaataatggaagtactaaacagatgtaatgtttgaactctttcaaagtttttgacacatatatccaaataaatttttagacatttcttgcactttaccttccactggtttttataactttgattttaagttcagaggtacaagtgcaggcttgttacacaggtaaacttgtgtcatgggggtttgttgtacagattatttcatcacctaggtattaagcctcgtaaccattagttgtttttcctgatcctctccctcttcccaccctccaccctccgaaaggtcctagtgtgtgttgttcttctttgtgtatctatgtgttctcatcatttagctcccacttataacagagaacatgtggtgtttggttttctgttcatctgttagtttgctaaggataatggcctccagtcccatcctcttatatttttaactaagaattgcctagaactggtcatatatattatcatttctgtcttggctctctctgtccaataatagcccatctagcaaactgaggtcccggccttgaaaggtcactgatgtatatgacaaactgtgactgcttccttaggtcctctttaggaactaagtattgttgcacacattattttcaatataaattcctgtgtcttatgtattagatctgagtgatgatctgttacaaatgatctgaagtataaaaatgtttcaaactgaatggggcaaagaggataatgaaatcacatgctgaacagtgctagctgggaaaactgaatactttttaaaactattgttcaaactcttactttaactctgcttctgatgaacacactttgtctaaaacttagacaaataacacagtttacttacctctcttttccggtatttgagtcctagtcatctatcttgcagcttgaatcacctgggaagaaaacaatgcagagtatttacctcagttaggagaatgcagcacttagggctgttgaaaactgcaaactttctctgtggaaagac

SEQ ID NO: 48180 - DNA, 1029 bp, Homo sapiens
tgcttttacgaatggtaaactacttgggctctgggtatctccagagattcatccactaatcttaggagctggttaagtattacacactagcacttatgaaaagaggcattagctgataacacactttcagctattagtacaaaatcattacattaccggaggctcatcattgctgaggaagctaattgaaggaaataattttattgagacaaactttattgtacagaaataaaacattgtgcttagtttatgaaagcagaaatcaagagactaggtaccaaggggataaagtgggtaacatcaatccctgacacatccatttgttatcattctgtcattaaataccactcacacatcaaacaaatacaggtgttttgaattcctatctccctcttgcccccaaaataaaagccttggaaaatcagttacactataggacaggaaatatgagtttgcaaagtataaagtactgaggaaccttctctgtaaatcagcacactatacgcacccggcatagtgcacagaactgaaatacaaactgccaatgttttttctctgcaagtagcatttgttttactgttatgtgaatttattgtctgcaaactctgacacagcctcagaaactgaactcctgtatttatccatagaagaacatggtgataatcttaaccctgtcttcaaagatatattatatgcagctttctacaaaaggaaggaaatgtattactttttctatgctagttaagcttggatcttcctggtccataaaatgtcagtagctgtgaattgtactgaaatctgctgcatggttttgagatgattcttctgtacactggggatttggctttgaagacaacgttcttttttctgcttgggtgaccagcctgcatttttcataactccacaaataaaaactatgctacagccatgaagaatggtattattgagatagaaacagagagcagacaataatgattttgaccacacaagtaagcataggtaaaaacttttttctttctgccatagtta

SEQ ID NO: 48181 - DNA, 1020 bp, Homo sapiens
ctgtgcttttcagggcattaaagaatatatcttttcatatttctagatattaatgcctgcgaaacatgccttctaattatatgctgccttgatacttgttatggaatttggttattcttattgtcacataacatcacttctgccaatctttatttcattcaaagttccatttagtagacttagaattgtgaattttgtttacttgaaatagaggaagttaaaaaaatacactgagaacattttattaggtctttattcccaccttcttatttccatttattctattctacttaacagtgaatgagttcagtgtaatttcacttgcagtttttctgactgaggcatattctgacaggatcctgttttttgaatgtgtgttttaattgggcttccatgtggtgatagatgcaggactccctgcgagtccctttctggcttctataattctcagcacagatggtttttattacactacttcttcctcccacccttcaccaccccgacaataaatactgatacagccccctaaggtattcattcatgtcttaggcctccaaacagaccagacagcatctcatgattggggagagtgacagtgggaggacaggatcattacaagacagttgagcagacctagccaccacccttgggagtttgaaacagatagtgtgagacaaaaatgaatcagttttcactgtagctgaatttcaattctagtgctccttgaggtttatttcaggttttgttttgttttgaattccccagtgcagcgaatgagatggaaaagaatatataaattaacttcgaaagactctcagggatatatgcatttcaggaggatggatggagaaaatggaagaagctttggactgtcaggggaattcatttatctaatggtcaatggggaaacatttaccctgagaaaagttgtgagacctgactttaggtactttgcatcctacatgctgtgtctctctttattcccagccatatgtatgattctattagggccctcctagt

SEQ ID NO: 48182 - DNA, 1047 bp, Homo sapiens
cttgtttccctttctcagactgaagaaaggtactcatgaataacccttagtgatggctgatatctgggatagctttggtagaccaaacagtttcaataatttgttgaacacattcaatgtaaattacctatttagaagcctccacttgactgacaatacaaggtgttttatacttactaattattacttttttgaaagaaattatttatttcatttttaataattattcaaatgtttgctttgcttaaagaaatactctgatttgatttcatctatgctcagtatctgtttcataaaacaaattctttttttccagaaacaaaaacatttctatcagaataatatgctaatcaagaacatttataatattttattataattgtctatacagtaagtttcttgagtgtgggaagtctgacttattgatttgtataacctagcacatgacacactctaaataaatgtcttggatctatcagggaaagtggtagatgatggtgtttattggactgaatagccattcttaaagtggggtctgacccatgttttaccctcttctaatttttcttctatatttttgaataattctgatcattagaagctatattgctctccactctgagaacaaccatgactctgaactcagtactactggagcctcttggctatgggctattttcatcaagttaatttgcctggctgtactgtaagccacggacattttctttcttttttttttttctttttgagacagattcttgctctatcgcccaggctggagtgcagtggtgcgatctaggctcactgcaagctccgcctcccgggttcacgccattctcctgcctcagcctcccgagtagctgggactgcaggcgcctgtcaccatgcctggctaattttttgtatttttagtagagatggggtttcaccatgttagccaggatggtctcgatctcctgaccttgtgatccacccgcctcgtcctcccaaagttctgggattacaggtgtgagccaccgcacccggccaaaccacggttattttctt

SEQ ID NO: 48183 - DNA, 1084 bp, Homo sapiens
attatttgaataaggagctttaaaattttcagcgtgctatctttatggagcttctgcctgtcttcctcttcaccacaatttaatttcaaatgttgatgcataaaatcttatgatttgaatgcataccttggatactatatggtctaaccccccaaccctatctagaaatttcttctaaagtcctataagagcccggcatctggctgcactgcctgtatttgagcactgtcagttcacgcctttccagctcagatcatatgggcttgggatcaagagaaacaaattggttgtagtctcagcttcgtttctaactctgcctattacataatgtaaggccaaacccctctctgagcctcaaaaacctcatgtataaaatgataggactgaaatacaaggcttctaagattacttgtagatttagacattatgactctgtatataaacacacattttaaaatcttattagtattaccttacagattagatttttgaaaatatttttgttactgtaatttcctactctctccaaaatttcaaataaacgtcaactgattcactatccaatctggtctcatatatatttagtagcaatataatacacacacacacacacacacacacacacacacacacacacacattactaccaagatcatatatgaaaattccagccgctatgttaaggcgctcttgactatgtttgtgtgcattattattggtgaaatgtcccacatcacaggacccaggaacagtaaaactagaaagaaatgtacacagtttatctaattcccttaaaagtaatacacaatgataaaaagaaatctgaagctgttcacctgtaacttgtaataaaatcagggtaagaaagcaagtaggcctgtgatggatctggagaagaaagagctagacagaggcctttgaaaattttctcatcttcctcttccacattcctgacatgaagtcattttgttttcttttaaccagttgtggttgtggggagtagccacatagtgctaagctgttctaactgctaaatatttatttctaacatagactcaaaatatagattcctgtaaaccttatt

SEQ ID NO: 48184 - DNA, 1044 bp, Homo sapiens
gaaggaagtagagtatatggttaactgcaaaattatggttaaagaattcaaatttaagctaaatttagaatgataacaaagcagtcactgggaaaagtattctaagtaatattaaaacacaaggtagaaattagtatagtttggttgaggaatagaaaaaaagctagtattgctaaaaggaagtgagtgtgggtaaaaagtgtgaagaagattcataaatgaatgggaacagattattatacagggctttaaaactcaggattagaggtttgggttcacttcccagtttaataagaagatattcgataattttaagcaaggccactacaaggtttcattcatgttttgaaaataatcactgtaattaccacatagagatggatggagtcaagggaaccaaaatggattctgggaattaactagataagtggctctcgaagtaattcaaagagataattgtgactgggactagggtggtggtcatgtaataggaaagactggatggtttcaagatatgatttggagtcagaagaacttgttgatattgaatatgcgagatgggagaaagagaagaacgaagaaaaactctatattattggattgagataatgagattatgatcccatttacaaaaatgaggaagactgatacagaagtaggtttttgcataaaatcaagagttctgtgttgtccatattgaaattaagtttgaaatacttataagatttctatgtggtgacaaggagtagtcagctggaaataagaagctatagtggtcaaaaataaaatgtttaaagtcatgggatgaaatgaagtcacctaaggagaaagtgaagaacaaacacaaagccctggaggaatacaattagaggttcaccagaggatgtgactcacccccaagagacaaggatgacttcaatcttcagtaagattgaagaatactagagaacagaagaataccctagaagccagaaggaaaacaagtttcaactgttttgtatactactgagagatcagtaaatatttataacatggtgatagatg

SEQ ID NO: 48185 - DNA, 1048 bp, Homo sapiens
acttgaataattaaaataaaaactgacatccttggggggctttatagttacaaagttgtatcacaaccaacagccttcataaaccagttaataagggttggcaaattccaatcaaagtaatgccaaggtaaaattacctgaaaagtttggccaagtctaactcctgccttctaaattttgggttccagatcttagccattttatagagaagtgtttagtcaaaactttcttgaacagtggcttggtagttgtaatgaattagaagaaatagtttcttttttttttttttctttttttttttgagactgagtctctctctgtcatccaggctagagagtgcaatggtgtagtggcatgagctcagctcactgcaacctctgcctccccagttcaagtgattctcctccctcagcctcccaagtagatgagattacaggtgcccgccaccactcctgactaattttttgtatttttagtagagacgaggtttcaccatgctggccaggctgattttgaactcctgacctcaagtgatccgcccacctcggcctcccaaaggattacagtgtgagccaccaaatctggccagaaatagttttcttactagtagagaatgttgatctgtcatgtgataaaagtaaacaaaagattatctaattttggctactgaattttcatagatattaaatatggattatgtttaactgatttattttctttgtcattgcaaatggaatcctaatcctcaggtagaagaatcatcatttgattttcaattaaaatgatttttattgctcaacgatttttccagttaatgtaattgtcttatttctaccttttgggaaaatcttcctggttttgcatagatgttatcaagtagaaaacaaagtgcacctctctagtagcaagattgtaggtgcagaactttaagctacatagtgttagctatgaaatactcttaatacatctaagaactgttgatgaacaaagtacctatttaatcaaaacaatatggttatgatcacctgccagaaaatgtgttgtttgt

SEQ ID NO: 48186 - DNA, 1052 bp, Homo sapiens
caaataacctttatagcatatgatttacataaatagatattcaacaattttaatatagccacataatgaggaggttattcagtggggtctacttccttccccagccctagtagagattaaagagagaatgtcccattgtcctccaaactcctctgccatacaagtaactgactctgggtccatttggagaaacttctacactcaaccacataaacctcataattcagagtagttgaggctgtattcattgtggcattcttcttccacctcattaaataccaggcaggcccctttgatcaggtctccatggcagtgctgcccctggtacacaagtgtgtacccatttaggaaaagacagtaactgcttacctgcacaacctaattatatggagatatggtctcagtcctttaacagtgagacagaaacagaaatccaagctccagggacaggaaagtctactgagatcaaaaccccttcttttgccccacaaaaacaaaacaaaacaaaacaaaacaaaacaaaaaaccaagaaaacctgtagttaatttctgccaattcctagataggacttaaaaattaaacctcttcaataaagtatttacatactgcctcttacaagggcatatggtagtaaaataaatggatctatatgctattctgtaccaagcatgagtgcatgaaattttaccagctgggaacctttatggacagagaccctgtgtgtgaacaggcataattgcctatacacatgctttttatggggagaagagatagtggaatatttatttttttcatttgaacaaactaacataggcaaaattttctagagcttaaaatttcagaaaaactgcaaagactaacacctggtcttggaaaaatatttaccttgatgattaccaccttcctggtcaagaactgagcctgtcttcttagaacgttagagctagagtctgagatctaatggagacattaaagctgataaaaataagtttcaatgttaggagccattaaatgggcaaattaaccatttgtttttatatgagaaaaataa

SEQ ID NO: 48187 - DNA, 1064 bp, Homo sapiens
tcttcctcctttcctcccttcttccctttctcttttatttttttttgtggagagaaagagtgtgactggggcaaagacataaatatgagtgttccttttaagatacattagtcaattttctcttttcaggggcatttaaagcagaaagtacataaataaaattaattgcataactctctagactcctcaaaatcttgatgtgtttagtctctgtaattggtgttgtatattcaaagtaagttttgcaaacagcaggagcacaggctgcataagagctgcctattaaataggggcaatttgcagtaatgaaagtcctgtcagcaatccttcatagttatgggagtcactagttggagtttcacaaagctaccttctccatttctatttctcacacatatgcacatacaaagttttaatgtttgttataactgatttttattagccactgtagtcttattatcttgacatgaaccaaagtaaaacaaatgtgttagttaatataatactagattctgtaacaaataaacctcaaggtgtataatagctcaaacacaatagaattacagttctttgtcatttaaagttaaaaaaaacatatggggtgcatggacagctctcatttaagtagagattcaaagaacagtgctccttccatctgagggcttgctattttcaatatgtgtcttctaggatcaccctgattagctttataatctggtagaagggaaaaagatataaggagcacaagtaggcatttttgaaggccaggctgaggagtggggtaccataattttactcattttccactgggtagaactcacctgacagagcaacagagacagggagtcatagcctacctgcatgtctaagaggagaagacatcggcttggtgaacagctaaactgtcactgcccagcaacatgtaaggtttgggaaatgcaataatcagtaataagaggatgactaaagttggaggctgatgcaaggcaatgtagaaattataaaatgtaacagagtgcttcataaattatttttataattatattgatcttttcatgcagaat

SEQ ID NO: 48188 - DNA, 1055 bp, Homo sapiens
ataccattgtcatcatcacctctgtgctattactcttatttcccttcctttcttaatggcatatatgtcatttctctcagctccagctctattcttagttctctatgcagtcgtccatgaccaaagtgtctcttctgacttcctgcagccaagtacctggatctaaacactgccttctaatggtaaatgctgcttccacattgagcttgggtacttggccttctccctttcccaagcttttagaagcttaaaaatagggcttacctattaataaagtcatattctagagatctttagaagccaagcccatacttactgtatataaactacaaagcagtaatcctttcttggaaatatttccacttgataatgcaatcattatacctgggtatggattatacttgaagtaaaatgtattgagatttttgtgtctgtgtggttgataaaaaaaataactgccctacttttcatacttatgtataacagtactatgtggtatatcgtgtttggtttttgcctgtgcaattctgtccattagtccgttagttcttgtaccttggattccatactacatttctttgccaaggagatatatatgcccacccaagaagatgaatgtctaaatcattttgagcatatgttagccatttcagtgttttaccttaaacattcaggtgtaagtggaattttatattggatctcccattaaactgcaaacgggagtattcagcaaaacatttggctgctaaacatatgccttcagccatcacatgctatctttttctaaattttattattccttttatataggttgctgaaattgcaaattctttctccaggatttttatcatcccagcaaatccactgaaaatctccccactgagcattgttgcttaagtttgtagtttctttaaatatgattcgatctttgtactagagactgagcttttgtaactcataaggaatggaatagaaagatatctgataatcaatgcatagaaatatgtctgtatgccatttacaaaaaaaaaatattttcttgtattccagaaggc

SEQ ID NO: 48189 - DNA, 1067 bp, Homo sapiens
gcacctgcaatcccagctactcaggaggctgaggcagaagaattgcccgggaggcagatgttgcagtgagcagagattgtgccattgcggtgacagagtgaaactctgtctcaaaaaaaaaaaaaaaaaaatcactgctcttaattattcaactaacagcttccccaaagtaaatgctgaatctaacagtggtcaaagtagtaactgtggtatatgaaacctctgagacaagatttagcatatagagcgcactctgtaagttgtagctcaaatgatgaactcatatatcttatctgtgtctgagaagatacttatgtttggaaatacattaatgaatactgcaaggaagaagaattagtgtaatttaactaaaattatatttccttgcttattctttcaatttttttcaccttctcttactttcctagaagaacattaaataatcatagactttacgtagaaacattttcataaggaacttgcccaattttttaatattatcaagtgtggaattgagggtcagagtggataagccttacccaggtccaactcataatgcctgaactaagactaatgctcaggtttccagattttttttttgacagtatcacacaacctgtattaattaagaccaaaaaaaaccttgataaagagtaatatgtttcttataataaattgttcaatcataccaaaaatttagggctctatttcatagaaatttctaagataagtaattgaagagaaatatgcattctactcattaaattattattcttaattaactcttacatccctcacaagaggtcctcatgagaagaatatcaacagctatgttctctaaccatggaacttcagagtcttacatgtcctaaattatctgctttttgtctactttattgttttgtctcacacattttcctgctctccctatggtctaattaggaaatgaggaggtgagatgaaataggcatagcatcctttcccaccttttccactgagctttctttatatcttccagaaaaacaagcaagtacaagcctctgttgatccaacgggcacaaatgcac

SEQ ID NO: 48190 - DNA, 1028 bp, Homo sapiens
aaggataaataaataataaatttactaaaattctgactttagattccattaaatgttatataattacccatttctccccatccctgaaatttctgggttgttattttgggtggattaaataaatcataacaagaattggttttcttcattataattactaaaatatgttttctttatgatactttttaagatctcccatcttatgagaacatatgttgctaaattaattaattcattcagttttcagtaatttaggacttgatctgtgccaataactgtattaagcttttgagatacacaaatgaatcagaagaagtctcttaggagacttagagagatgacagggacagacatggatatagacaagtactaaatgacggttgctcagagggttcgtgaaaaggagaccctgcaagactgatgctgaaggggaactgaggaaggaatatttcagagaagaggaacatttgaacaggactttatactatatggagttgggtggtagaataatggcacttgaggacagatgagatgtcataatgaaaaagcatgatgtgtatcaggaatgatgaatatcattaaaatacattgtgatgcatgcaagcaggggttatattagcaaagatatgggagaagaatctctctatatatcaatcacaatatacattcaataaacaaagacctcccatatttcaataccactgtaatatataattaagttataatttaatatatctttagagtgtaatataataggttttgttacttttctgttttgtttcagtatgaaaagagggtgagaattatatgttattaactatttattcaacaaatatcaagaaccaccatgtgctagaacctgatataggtatgtagatatagcagtcaacaaaacagaaaattcctttttctcacggggtttacataccattccatgcaccaccataggaatcatcagataatgattgacattcatggaactagtttccttatgaaacttcttgtaagaagaccaagcagataaaaac

SEQ ID NO: 48191 - DNA, 1111 bp, Homo sapiens
ctggtgtcttatccttcttagtttgtaaaactagatcatattcagacatgttataataagttagtgcaagtattttaaggcaaaaaattgaaatccatgcatggtttattcatggtatgcgttttccatgaactttttgaagtttctttgtatttgcaagttatactttctcctttgacaattacgatactttgccactgacaatctgtttttaagagcttttactgctttccttcaaattctaatcctttacttactaaatgtgagatcttgggcaagtcacttaatgagagtggggtttgggatgatattagtatcttccttaaaggctttctgtgaatattaagtgggttaatacatagaaagattgtagcataatttctagtacagagtgaataatatatgagtgtgttttcttatcagctttcaatgttaaagactcctttcagccttatttacagtttgatatttatcatggagaggaatagagaaaatattcaattataatctcacaggaatagaagctgtggagatggggattattaattaggaatggagtagcatttttccagtatgtttttgacagttggcacttggatgttttgggttatgaatgtgccaagagtttgcagttttttattattttgtcatgtaatctaaaggtaaaacaagtggcacaactttttgaatagatgccttagggctgctgattttggtaggatgcagccagaaatccaacagctggagccaggagcaagtggtcacatgaattcttcattcttcatttattattcatggattgggaaggacagtagttctcagactctatgcattggaatcacctggaaagcccacaagagcagattcctgggccaggtccctagagtttcagattcagcaggtcttagctggagcccaaaaaattgcacttctgccaagttcacaagtgatgctcatgccgctggtcctagggtcacactttgatgaacccttgagtagcatgctcaagcttcttaattgctctgagcaattatgaaaaataattgagcatattttctctaaaaattagacatcattttgggagaagggatatatttcgtatttgattttc

SEQ ID NO: 48192 - DNA, 1037 bp, Homo sapiens
agtccctagttatcaccctcgcactttcccttcatgtcatttttaaacttcataaatatgaaaagtagattcagatcttaaaaagtggctcaccaaatgaagtctaacaccatatttttgtggttgggattcaaagttctctgcgatctgactccaacatgagtcctccttgattttcaaactttgttgttcctccacaagtagacactcaggaaatattttcttattggtttgttcatttattcatccgttcattcaacaacatttatttataacttgtgctgtgccaggcattgtgcttctgccatgtagccttccccaacctccaaaaactggtagagagctccttcttccacattcgcatagcatcctttctgtgctcatcatactcaattatagcttcttatttatatttttcttctacaaaatgtgagctccttgtggataaaaatggaccttttaatcattatttttatctgacaagccataattgctgaataaatgtttgactgaatagatgaataaactaagaaattaatcacgtatgatgtctgttccagagatgctcattgtttagtagatgatgatggtgaaaagaaattgttttggccttagcaaaatatatctcaagatttgggctggaaatatattaggaaaaaattggaacttttatttattttattttatttttgagacagagtcttgctctgttttccaggctagagtgcagtggcacgaactcagctcactgcaaccttccagtttcaagtgattctcatgcctcagcctcccaagtagctgggattacaggtgcacaccaccatgcccagctaatttttgtatttttagtagggacaggattttgccatgttggccaggctggtcttgaactcctggcctcaagtaatctgccaccttgacctcccaaaatgctgggattacaggtgtgaaacaccatgcctagccaattggagcttctataaattctgttaaccctgaggtagagaccactgaagtattttcttcactcagtttat

SEQ ID NO: 48193 - DNA, 1045 bp, Homo sapiens
gggacatggggaggaacagtttggggatgggagaagttaagtgtgggacctggttaagtttgagatgcctgtttgatagctaagtagagatgttgagtaaacagttggatatgtgaatctggagttctgtgaaagtttggagcttaagttaaaatttggggtatgacctatttcttattttcagaagaaactcttaacaccataattaacacagagttaacttttattacaggaaaaaccatatggcatagttgaaaagaagtccagaatattccctgtaagtcttaacacttctgatttttcttttgtttattgtttttctctttccttttcctccctttccaagcaattattagattaaaatgttctttccttctcactttcggtttaagtccctgttttgtgtattcttgtaaaaaacaaaacaaaacaaaaaaaaacaggaagaaataccgtgaggtaacaattacagttcaaatgggaagtgagcacatttattttcaacctggctgtaaaacgtgttttgtgaccttgattttcctaaagggagttgaaagtaccaaaagtttttcactgtgtcctgtttcatgttgggtaaagagcttagggcatgagcctaagcaaacatccatgcatggtgacagcaactgaatttctgttattaattccaaactctcatgtcctatggctttgtacctcattttcaagatttgaccttaagttctccatctgtgaatttaatatccactaatgggtgttttaaattttatactatgggccaggcacagtggctcatgcctgtaatcccagcactttgggaggccaagatgggtggatcgtgaggtcaggagatcgagaccattctggctaacacggtgaaaccccgtctctactgaaaatacaaaaaattagctgggcgtggtggcgggcgcctgtagtcccagctactcgagaggctgaggcaggagaatggcgtgaacctgggaggtggagcttgcagtgagccgaggttgcgccactgcactccagcctgggtgacagagcg

SEQ ID NO: 48194 - DNA, 1034 bp, Homo sapiens
aagatctattctttcagcaatgttgaaaatacaatacattattgttaactatggtcaccacactttacaatagatttggaaaacttactccttttgtctaactgaaactttgtacctatccaccaacatctcctcattcccttactccagcttctggtaaccacacttctactctctacttctataagttgaacttttttggattccacatatgagaccatgcctgaatcttttcacttagcgttgacatcctccaggttcatccatattgtcacaaatgacaaaatttccttctttttaaagtctgaatatttcattgtgtataatatacaatgctttctttatccattcaactgttagtgaagatttaggttcatatgttggctattgtgaatggtgatgcaataaatatgggagtgcagatatcacttcaacatactgatttcatatcgcttgtgtatatatccagtagtgggattgctggattatatggtaattctacttttagttttctgaggaagctcaatgactgtactaatttacattcccacccactgtgtgcaaagattcctttttctccacatcctctccagcacttgttatcttttgtctttttgataataaccattttaacaggtgtgaggtgatatcttattgtgactttaatttgtatttcttttatgattaattattttaagcattttatacctgttggtcatttggatgtcttctttggagaaatgtctattcaagtcatttgcccatttaaaaattggattgttttattgctattgagctgtttgagctcctgatacattttggatattaacctgtttatgtggtttggctctgtgtgcccacccaaatctcaccttgaactgtagtaatacccatgtgttgtgggatggacctgggggtggggaggtaattgaatcatgggggcaggttgttccggtgctgttcccatgatagtgaataagcctcacaagatgtgatggttttataaaggggagttcccctgcacatgctctctt

SEQ ID NO: 48195 - DNA, 1033 bp, Homo sapiens
gactcaggcagggcattctaggggcctaggaaccaactcccagtaccttagggtaaaagccagacttctttttgggtaaggttaattgtttactacacagccttatttcccattgctcttctgcaggacatctcctgccaaacaaggtaatactcaaacggtcccataccatgcagtttttttttcacctgtaatatttctccctttacttctaaaatgcagaagcactttgcattccatgaggctcagcttaagtcttacttacccctagaaactttgcccaaagcttttctaatcacccacttttctaactagttggtgtatgccttgtgtggctttgcaatgtggctggtattcatagacttccctgagccttatatctctctgagcctatgtgtccacccaaagtaattgcttagaaaatgcttattattgatgataattttccttgtgtctaaggcattcgataaatctcttgacatgaactgaactgtttcttcatgattgtaaattaggcatctttgttgggtgtatcttattctttctgatgatttgggctttaatttagatatgtcactaagtgaattattagatcctaaaacaatcaaattcaaattgaccttcagaatgtttgcaaatgaaaacaacaagtggtgggttaacataagtggtccccaagaggtcaaaaaatgtttccctggaaccaatgcactgagtgagactggcttggcagttatttttactgtgaccccttgtgggttagaccctataaaagttgggtaaatctcatccagagagctcttttgagaaataatgatgccttgttttagtatcccgagatcccaggattgagcacttagttaggaaggaccactgtctgcagggtagaaagatgggtttttgctactgctgggtagacaaacaagttccctcacccccaaaacagaacacctttaccaaggtgtctgaatgactggctccattcagacatggcctcaatgtccatgcctcagttgtcatgacaaccgtgtat

SEQ ID NO: 48196 - DNA, 1032 bp, Homo sapiens
tttatactttttgagacagggtctcagtctgtcttccagtctggagtgcagtggcctgatcacagctcacagcagccttgacctcccaggctctagctttcctcccacttcattctccagagtaagtgggaccacaggtgtgcaccatcatgcccagttaatctttaaaattttttttgtagagacagggtctcactatgttcctcaggctggtctcaaactcctgagttcaagcagtcctcctgccttggtctcccaaagtgttgggattacaggtgtgagccactgctcctggccagttttcttatttttaaaataaaaaaatggttactacattagtgagtccaaggggcagcacaagtagcatatctgaattgggaacagtcccccataagagcatgcatcatatgtgatctggaaaagcacactggattttatcatcaagttctgtatttgtaaaatgaacaaaaattgtacacattgattttggagttcaagctactgaaagtaaagctcaaccaaattttcttggctgatgggactaaggtcaaaagaggcagagaaacctgggactagatgatttacagattgatgattctgcaactctatttagaatattgacaaatcagtgtttgattgctacttttaaacactgcaccttattaggaggtgcaggaaaaacagctcataccaaagacctgtgtttcagcaaataaagaagctttaaacaaaataaatcccaacaaagatagtgtgccatacatgatgatgcccttggtaagccttcttcctgaactgcacacaagtagctgattgaggctcacttgttcaggtatggatttaccatagcattcagggcaaggctcagtggtgcaccccctcacagggagcactcagctggcttggttattagatcccaagcggataataattacaagcccagtagccccctactgaaattcccctgccttttaggagctttcaaagagtcagaaattaatacacagggagcaccgtgttcctatgaagtat

SEQ ID NO: 48197 - DNA, 1035 bp, Homo sapiens
tatagccaagctcacctaggccatatctttactgtctctgccaacagtggctctgctttcacaggagatgggaagatgtgtggatttttaatttgctctggatgagagattttacatcaaaatgagccatgtgtctttttgcagctgctgtcattttgttggagatcgccacatccagtgacccagtctcagtaagactctattaaacacattttcaagtgaaccatcaagaagtctgtttctcagtcattcagctgtgaacagtgtgctctgccctagccagagaattacgttgtgtctgatttgttcatatatgtttaagaaagaatatgatatatatgtctatatctatatatgcatacatatatagatacatccatagatataatgtatattttagtatatatttagaatagcatatgctttttgtttgaaaaagtctcatactgtaaagtcttctggctattagggtgagtttcccctatccaaatttagatatgttgagttgaaagagaccataactaaaaatactctggctacatccggaacatggggatcctttgggatctgtttcatttgaccatattctaatcataatgattttgagcacggattttgtgccccaggatgtgaatcctccaataaatttttctgttaggttttgtttatttattttaagaaatttacctctaggtttataaattcttgtgggtcagaaatatacacattttcaacacagatcaaaactgtcataaagctattgtttataagagaaataggtgagtgaggtagagcctggttctttgaaatcatttttcattgcattatttgaattgtaaaaccctcgggaattgtgtatgttaaccaatggtttcatgtgcttctaattgccatttaacagataaattaaggggtgtgggaatatcaaccagcacaagctaacattattaactgatcttgctgctttatttttatttttttgagacagtgtctagctgtgtcacccaggctagagtgtagtggcatgacggtggc

SEQ ID NO: 48198 - DNA, 1030 bp, Homo sapiens
agagactgggtttcaccatgttgcccaggctagtctcaaactcctgagctcaagcattccacctgcctcggtctccaaagtgctgggattacaggtgtgagccaccacacctgacccaagttatctcttaagtagctcaaattaaacatgtccaaaacagaagtcctgattttgctccccagaccagcccagtctttatccaaagagcatttcgggagaaggaaaaggaagctccaagacccagaggtaggaaaaacttggtatatttgagaaacagccagttggactggagaggacttgtacagagtaggggatacagtggtggtggtggtggggagtggcagaggcctggtaggagatgaggttagagaaggtagccatgtatggctttgtagagatttggatttttcccccaagagagattgggaaccagtggaaattttaatcaaggagcaatgttgtatatttgaatgcctaattctaatttcctctggctactgtctggagaatggatgtcagggagcaagagtggaagcagggatgccaactgggagactattgcagaagtctcagtgagagatgacagtggctttatccaggataaagctggtggagttgtgttaagtgttcagtattggaagtagtatcaacaagacttgctgatttgctgcatgaaggaaagaagagaaagagaggaattgagattgctctaggtttttggctcgagacaatagatgaatgatgatccatcttttgagatggtgaagactgggctggtttggggagcaaaatcaggaattctgttttggacatgtttaatttgagctacttaagagataacttggaccaggtgtggtggtttacacctgtaatctcagcactttgggagactgaggcaggtgagtcgcttgagctcaggagtttgagactagcctggacaacatggtgaaacccagtctctaccacaagaaatacaaaaacttagctgggtgtggcggcatgcacttacggtcccaactgctggagaggc

SEQ ID NO: 48199 - DNA, 1025 bp, Homo sapiens
ttagctgggcatggcctatagtcccagctacttgggaggcagaggcaggagaatcgcttgaacccgggagtcggaggttgcagtgagccgagattgcaccactgaactccagcctggcaacacagcaagactctatctcaaaacaaacaaaacaaacagaaaacattttattagctcaaatagttactcttccagatgaatgttctatgcaacttgtcagattctattttaaaaaattaggattttcctttgattatttttaatttatcaattaatgggaggggtattgcccatattaaccgtgttggattatcagaacagattttgatgccaagagctgggactgtagtgggttttgtgtgtgtgtgtgtgtgtgtgtgtgtgtgtgtgtgtctagaatggtggtggtgggaggtaagcatggagggctttcctttatagtgtcattttcatagcaattttagagggaaaagtaaatttgctggctcactctgccatcgtggactagaggctctgataacttttatgagataaaacaatctatatttaaaaaggattcaaggccaaataagccaatacagtttagtttaccttaaaatgttaatacattataaagtcactgaataatacacatggaaaagttgccatagtaacagtcattttcatgaagtggatttagatactaaattcttgagtgatggcatgccttgttatttgctttaaggcatctttagtactctttcttgtctccttggggaatagaaaatgggaaagggacttgcacctgatacagttctgtggttgaaagccacagaattcaattttggcttatttaagttgaaaatgtattggtaggatgaagggatggttcatagagttaaaggaaatgtggaagagagggaattcagagaggggctttggagggatcagaaatttggagcaactctgaggacctggggatcagtaatcatgggacagcttctggtatggttaggctttgtgtccccacccaaatctcatcttga

SEQ ID NO: 48200 - DNA, 1068 bp, Homo sapiens
ccttttaaacttctgggtactttaagggaagttgcattaaccttagtatggttcctttcaggggagcatcagagataatacactgtgacagtagtactgtgctgccctggcattaacagtcagacatccctgtaatcccagcactttgggaggccgagacgggaggatcacctgaggtcaggagttcgagatcagcctgaccaacatggagaaaccctgtctctactaaaaatacaaaaaattagctgggcatggtggtgcatgcctgtaatctcagctactcgagaggctgaggcaggagaatcacttgaatccgggaggtggaggttgcggtgagctgagattgcaccattgtactccagcctgggcaacaagagcgaaactccatctcaaaaaaaaaaaaaaaaaaaaaaaaacaggcatcatccttgaggagcctttgagtcccacttcaattatattccttgttgacaaggggcaggtctaatagggctcactggaacccacgtgtacgtgtcacacagtctgccatgttggagtggagaaggatgcttttgaatttatgtctacagagattttacatcacattcttgggaactattttgtactgtgcatcttctgtgtattctgtgtagtgtggtggttgaaaacagactctggagtcaaccacatctgagttggaatcctagatttccctcttaggaactatgacttgtgcaagacactcaacctgtctgaatttcagtgctctcctctctcaaaactgggctattaaaaccatttgcacaagactgtgggaattaagtgacttagtgaatataacaaccaggcacacagaagattcttagtagatgtctgtttccttctcttgtatccctctgctaggtttacaaagatgagcaggtggtggtgataaaggataaatacccaaaggcccgttaccattggctggtcttaccgtggacctccatttccagtctgaaggctgtggccagggaacaccttgaactccttaagcatatgcacactgtgggggaaaaggtgattgtagattttgctgggtccagc

SEQ ID NO: 48201 - DNA, 1053 bp, Homo sapiens
tagtggaagcctgatttaatccttggtcaagagttcgtgtgagaaatggatctttttttttttttttttttttttttttcctcctgagatagggtctcactctgttgcccaggctggagtgtagtggtgcgatcttgactcactgcaacctccacctcctggggctcaagtgattctcccacctcagtctcccaagtagctgggactacaggcatgtgccaccacacctggctaatttttgtatttttttgtagagacggggtattgccatgctgcccaggctgggagaaacaggtcttcttttctggcggcagagtctgtgatcatgagcaggccaggggttctggaatagggaaacttgtggggattaattgaagctgcctcatagggatcttggcaatagctaagggagtatgtacgctgttggacattttatggaaggatttaaacctttagaaattggtaggatttggagctccagccacctgcaataacaggtgattgctaataggcctttaaggaaacaccacctgttcagctgccgcctgtagtgaagcttgttttctttagggaagataggagcaagtgcctggttctttgttgcatttgtgtttaactttttccaatctctttcagtacagttgaaagcagagtgtaacaagggatatgtcaaggtaaagcaggtaggtgtatttataacttggaattttatactcgatgattttcttatgctgttgactttagagtgtctgtgccagccagtgaaggcttctctgtcatgtatggaagtgatggagtaatataggtgaacataaggcaaggtgcttggcatatagtaagtggttaacatagcagtggctatcttactgtaggtgctgttgctattattataattattttctgattgtttattccataggtaggagtcaatcccaccagcattgactcagtcgtaattgggaaggaccaagaggtgaagctgcagcctggccaggttctccacatggtgaatgaactttatccatatattgtagagtttgaggaagaggcaaa

SEQ ID NO: 48202 - DNA, 1103 bp, Homo sapiens
tagggtggcttccctagggctggaggacccacttccaagctgggtcactcatatactggctgttactggctgggagctctgctgggacctctccttcatgtggctaagttgggcttcttacagcatggcagctggatcctttgaacaggagcacccccagaggataggccacaatgtgtaagcagttattaaggttctgcttgtattgtacttggtagtgtcccattggcaaaagccagtcactcagccaagtccagtcaatgtggaaggggactatggaagggtaggaattctgaaaggggagaatcaattaggtctactaaagtaattggctaccacagagagaaaggctaagtatacattttctaaaaaattttgcgttctttttttttctttaatcatgtatgctatatcctctctctctaaaatatccaagaagtcatacaggtgaaaagtaaggtctcttgtgaatcaaagccctttggagggtggttaaaatttttgttacaggcctcataatttaggagcaatattattctatgaaagcagaagttttactgtggttaaacgtatggtgaagacagttgttgaaatagtattattttcacatagacagctggagctttgcttgtgaaaagaatgacaaagtaggagtgtctcggggttgtctgaatggtgtaaatgtgtagacattcaaatttgttgtcaagagggaccaaaccatgctcaggaaaatgccactggacgtccagtctgaagtgcagtaagaaagacaagtgggagaaagagcagcaatgcaatattggaaagactagcagtaaggagactgcaggttcaggagagtgggctcagcactgaggctgtgaaaggtgagcgtgtcctgcagctgtcctcagtagactgaaagctccttaaggggaagggctgtgtctggcttgttgactcaacatggaccccactgcgtgacacagagaaggcactcttaagtgtttgatgaatggatacatttaaagaaacgcagaattggaaaccattccctctctttaagattctggtgccataaaataattagagtaaccttttaaaaaatatggcacttcggg

SEQ ID NO: 48203 - DNA, 1057 bp, Homo sapiens
ctccaaaagggaaatcgtgggcccaggaactgacagcggtcctacccacgcggccaactgcctcccgaccgcggctccatcggtttcccggcgccaatggcgccagccaggggactaggggcagcgcgagggctcaaactcaccggtgcgggctgaggccggtgtgtgagggagcgggaaggagcgccgagctgtgcgcagccggggtagttaccgctcctccgcctctcaccgagcgttctggaaagttccgcccggcgcgccgcagccgtcctcttttgtagccgaacccgggcgcgtcacccgccggaagtcccgcccttctcggccgctgccaccgccccgccgttacctgggcaacggcgcgggggcgcacgggtcgggaggagctgcgccgaaaggccttgtgggtgttggtgctagcgcggcttcccggcgctcgtggaatcttctggagcccttttctccactcagcgagcctgagagtgcggaagtctccggctggtggggcatggcccaggagcactgcaagtcctagggttcccaaacctgtggggtggccgcctgggcccgcgagggcgggaagggctcgagtacagtgacccagcgggagctgtgtgtgaacgggaaagctcttggaacagtcttgcccccccccccccccctcttacgggcgcctcttctctttttgggaacgtggcgagcaaaaaatgcttgagccaggtgggtctagtccccagaccaatagcataggccttgggtcttgctgtttttcacgcgtggtccaaggcggcataattaatcaaattgtgaagttgttaaggctttttgtgcaagtccaggcccctagacacatgttatctgccctggacctcgctgattcgtgcagattgagctcagtgtgtctgggactgagctaaacagtgagacgtttggaccgtctttgatgtacagagggccgtggactcctctggtcaggttttcacccagtttggctacagagtagccgcaagagtgtctgactaaaacaatttgtttaattatttgacctcacttt

SEQ ID NO: 48204 - DNA, 1036 bp, Homo sapiens
taactattaggttagtgcaaaagtaattgcggtttttgccattaaaagtaatggcacattacttttgcaccaaccgacctaatatgactttcttttagtgttcttaggatttttaattgtaaaacatgtaacaaattttcctaaacaattgtgcaattcagtggcattatttacgatgttacgcaaccactattgtatttccaaaatgtcatcaccctaaacagaagccctgtaacattgtcaattaacttctccttcccttcccctcagcctttggtactgtttctgcctcaatgcatttgtctaagtttagttcatataagtgaaattatacaatacttgtccttttttatctggcttatttcatttagcatgttttaaaggttcatccatgtatcaaacagtaaagtgcttcatatttgggggaagtataaaaagtattccttttaatggctgtgtatttcacagtgtatgtacacatgtatattgagaattgagagatttgtaggtacacattaaccatttgttggtggacagtcaggtttccactttgggctgttgagaatgcacagtaaacactgaccatacgagttttttttttttttttttttttttgagacagtctccctcttgtcgcccaggctggagtacaatgatacaatcttggttcgctgcaacctccacctcctgggttcaagcgtttctcctgcctcagcctcccaagtagctgggattataggcgcccaccaccacacccggctaatttttgtctttttagtggagacggggtttcaccacgttggccaggctggtcttcaactcctgaccttaggtgatcagcccgcctaggctgcccaaagtgctgagattagaggtatgagccaccgcgcccggccttcattcgtttttaattccttttgtatagtcatccctcagtatccatgggggtactggttccaggactttccatggataccagaatccgagggtactcaagtccctgatataaaacaagatggttatttgcatataacct

SEQ ID NO: 48205 - DNA, 1045 bp, Homo sapiens
tggctgcccaaaatgctatggcagatacctgttcatcctcaactgggctctgcctaggcttgctccagcagaggttacaaactctatgcttcttcctctgtgtctccaacctcatcttcctcttctcacctccatcctggccctaaaggccctatgtttgaagcattcacactgtatattctgtggggcacacggccccagtgtctggcacatggtagtcaacaccacaaaccgcagaaccagttgtaaaaggacatggagtcggaatgtgagttttaaccagggtcatgctgggctgggttctggcatgatgctgggttgtgggctgagtgagaacagcaagggtgatggtggatggagcaacagtcttgcagccggggctctcaggccaagtgtatggcagctctgtgataatgactttccctttactctttgcagattagtttttagaggcatgtctatatctcgcccaaatgctgtggtcgggaggtgtcgcatgatccgccactcaagagacaagaaaaatgaacccaatcctcagaggtgcattctttgtttattcatactccttccccctttaggatgaggtaggctgcaggtccgaggctctgggcctagagggaaattgaggtggtcaggttacagtggagagggaggaggaagtacgtgtgatgatttcttcttaagatttttgttttaagacaatctccttgtgctcttttccttgtaggtttgaccgaattgcacacacaaaggagacaatgctctctgatggtttgaactcactcacctaccaggtgctggatgtacagagatacccattgtatacccaaatcacagtggacatcgggacaccgagctagcgttttggtacacggataagagacctgaaattagccagggacctctgctgtgtgtctctgccaatctgctgggctggtccctctcatttttaccagtctgagtgacaggtccccttcgctcatcattcagatggctttccagatgaccaggacgagtgggatattttgcccccaacttggct

SEQ ID NO: 48206 - DNA, 1059 bp, Homo sapiens
tttctagaggggaattgctgactcagaggttttggtactctgtgttgattgtagagtgacggcagaaaagtgaggcccaagagtttcctagtgaccatgtgtagtggacaagtcaccagtccctgtgagtgtttggcccaaaggctttaaggcatttgatatcactgtttttgtttctgcaccaggcgggagacactatattcaatcgtgctaagctcctcaatgttggctttcaagaagccttgaaggactatgactacacctgctttgtgtttagtgacgtggacctcattccaatgaatgaccataatgcgtacaggtgtttttcacagccacggcacatttccgttgcaatggataagtttggattcaggtaagagatactcagtcagaatctgtggtaaacatgtctctctcatgtgttgactaggaaatgcagtcctggcagctcaagagtgcctctttaagctctggagcagaatgcctcctctgagaaatgggtgctttgtattagttgagatggaaagaagagaccagaaatgcctgtagtctctgcacatccagacaaaaacaaattttccccccttttttttttttgtttgttttttgagacagggtctggctctgtcacccaggctggagtgcagtgccgtgatcttggctcaccgcaacctctgcctcccgggttcatgccatcctgtcacctcagcctcctgagtagctgggactacaaacacttgccaccatgcgcagctaatttttgtatattttgtagagatggggttttgctgtattgcccagtctggtctcgaactcctgagctcaagcaatccatctgccttggcctctcgaagtgctggattataggcatgtggcaccatgcctggcctaagaacagtttttagcatttgggaggggctctcatctttaagctccaaatgatactgtattttcttgcttttttctttctcttgccccacaagttttggaaagtaaattggaatagttttcccccactgaattatttagcttgtatacctcagcagatgttccttggcc

SEQ ID NO: 48207 - DNA, 1072 bp, Homo sapiens
agtcccagcttctcaagaggctgaggtgagaagattgctggagtccaggagctcaaggccagcctgggcaacatggcgagaccctgtctcccctgcaaaaaaacaacaacaacaaaagcaaaactagagcccaactgctgtgaactcatggctgagtagatattattagccctccacaaactcagcatttgtataatcccaggctgtttccagtaattctctggggatcatctcccagcctgtccactgttccaggatccacacttaggcctataggaatgccccgtcagagcttctgctgccgctgatctgttactgtttcatgcaacccactcggcctagttccttcctcttactgtctcagtgggcacagaaaagcatacagagggtgtttcagcaaacattgccactggctgcagacctgcccccggatctgtcctgttgagagcttagtgctgcgttcttgcatggtggggaggggtgtggctctgtgatgagccagggcatgtgtataggagcaacagtgtctctcttatcacgtagaagttctgactcattgcgagtcttggctttgggttaatggttccagccatgttgctgctgtgtcttttggtgcaggagaggctgggcacagttggtccctaagccattatggataagggatgtgtctgctgatatacacacatggacctgacatccagggaaggcagggtgattggacagaacagttcttccagaagctgttggaacttggacaagagtggcccttggctttctgtagttggtcatctgtcccctgttgcaatcaggggaaggccacacttgccttccttaaccacagttaggattttcttggggattagaccagattctagcacctgtcctgaacctctcgccccgcccctacaaaggctgcttgcaagtgtagtgcacatacacagggagcaggtggggcatggaagtggaagtggagcccctgcctttggcccttgggggaggcactgtctgcttacccacggttgttgcctcataggaatcatacaacagcttcctaactggtctccttgccttc

SEQ ID NO: 48208 - DNA, 1030 bp, Homo sapiens
tatctgtcaccctacctcagcagttgtctctgtcactggtccaagcagctggttcctacacaaggtcaagatcaactggggagaagcagactcctgggtctatcccattagtgaggacagctgcctgggcttatggcctcattggtttggtttctatcttgatcatctctaccatccccccatcccggccttccattttctacctcagctgtcagtgcacagattgatgtgtgtgggaacggagcttgggaggagtggggtagggctggtcctgtcctgtagcctccccttccttcgggcacttggaccctttggagcttgccggggtggggaatgggagtgggaaggccagggagtgtctctgcaccatcactgtttgagtgttgcccctttgctgtgtgccccacctagtctatgtgtgtctctgttctctggggactcaatttgctggtgaattgcttccatggacattgttctgggaaatgccattttttctgctcacccatgactctgtgacaaggaatgacagcttattaggaatttgtttttgcattggaacagtggtcatcagaatgggccccttttcccttgcagctttgacatttgcctctcttttcctcacctctctcccttgcatccacccttttctctttttcttcttttttgttttccttctagcaggggccttttacctttacttgttaatcctgtttgtagcaaagcaagtggaaggaggagttcctctctgatctgcttcttattctccacctaccttctcttctgtactttccgcctcctagagagagagagagagagaggaatgccgacctaactaccgctgccactgctgctgccaccaccgctgccaccaccaccctggtaatgttcacatgtcctcaaatcaacccagagccagggccctgctggtcagggggaggctatgtaaataatcccatgagtgtgccatcctcaggccctggggtctcctaggcaagaccagggcctctgtgggctctctcggaaatgctga

SEQ ID NO: 48209 - DNA, 1082 bp, Homo sapiens
catggtaaaccttcagtaaataccagccgttactaggagggtccactcctgcctctccactctccattcatcctgcctgtttcctctgcctgcttcctctgcctgcttctgtggtggtgaattcttcatggctcccaccgcctcctgctgcacccccactcagggcccgcatcaggacccttcctcctattggtttgaactccttggagtcagagggtaatggatagtggagtgagccaggtggcagaatctcagaggccatcccgggcctataagcctcttcaaaatagggccacgtatcaagctttacacacaggagtgaactttcacaagttgttatgactcatactctgtctatagtaagctgttaaccactcccatttggcttatgcctctgtaattattgtactaacttatatcttaaaataaggatattgaaggaatgagccgggagaggctttcctggttgagatatagaagaacaagagttgctctttttccttaaggtctctcctcccacccctgaccttagctcaccagcatgggagaatactatttgactccttgtactctgagacgtggatttcaagatatagcattccaacttcaacggcagcaagaaaagaagcaacagaaggagaagacatcatagcaaacagggatgcatgctgcatttcctaatactcaaacccggaaacgagacttcactcaaggtgaagggagggcaggtcaccacctggtagcactagccctaaattaaggaatgcagaatgtttgtgggattgcccatcataaaaattacaaaatgagtaaggaatgcaggcacagctggccaggtgggtttgtcacaaccatggcagccctttgccccacagccagtacacagaactggtctctccaattccgattgcatatcttctggcacctctgttcctctccctcagctgcccaggatttttctggttctgaccatgttacttcctcttttaaacctgttagcatttcacgactgcctacaggcaacggtctaaatggtcggaaggcccaagcttagcatccgagaccctgacctacctccagcc

SEQ ID NO: 48210 - DNA, 1033 bp, Homo sapiens
atagttgaactctgctgactctcctcagtaaacagtctctttttatgacaccttatcctctactgaattctctctatcaagaatgacttggccgggcatgggggctcatgcctgtaatcccagcattctgggaggccgaggtgggcagatcacccgaggtcagaagttcaagaccagcccggccaacacggtgaaaccctgtctctatgaaaatacaaaaatcagctgggcgtggtggcaggtgcctgtaatcccagctacttgggaggctgaggcgggagaatcacttgaacctgagggggaggttgcagtaagccgggatggcacattgcactccagactgggtgatggagaaactccatctcagggggaaaaaaaaaaaaaaaaaaagaatgacttgtcttcctcttagagtgtgaggtctacatacaaatattattcttgtattcagcaaatgtatgtcataggcctagtgtgtgttaggaactgtgctgtcaccaacaaagtttagagaggttataaaacttgactgtagctttttagaggtggaggagtgatttgaaacctaggctgtaattccttcctcctgtgattccttcctactgtgttgccttcccttgaaaattgcatttgggggccaggtgtggtggctctcgcctgtaatcccagcactttgggaggctgaggcgggtggatcacctgaggtcaggagttcaagaccagcctggccaacatggcgaaaccccgtctttactaaaaatacaaaaattagctggatgtggtgtgtggtgacatgcacctatattcccaggtactcagtaggctgaggcaagagaatcacttgaacccaggaggcagaggctgcagtgagctgaaattgcaccactgcactccagcctgagtgacagagtgagactctgtctcaaaaaaaaaaaaaagaaaagaaagaaaattgcatttagttcctgtagactgtgtgtcaaatgtctaaatctcttctaacaaatggcctaaggaggtgcaaagcgaagca

SEQ ID NO: 48211 - DNA, 1061 bp, Homo sapiens
tgaggtggcaaacatactaactgtgatttgtgcagagcaaaattatttccatttatagaggaagagactgagattcagaagggttctgtcttgcccaagaatacagatcttggcagagctcaccacaaggccaacggaagccatggagagcgctgtgaactgtgggaattgctgcaggtgacatctaaaaggagatttattgaggatcaaggcagaggtccccagaggacaaactgtacatctgattccttcctcctgcttttcttcctggccgaaatagatgattgaattcatctttcttctggcaccttgtctcagagacttcccttgccacagttccagacccatccaggccatgactgccatgtagacgacacacctctctgctcacaaataactggccaagcctgaggtagccaggttttggagcattgataatatgggtttttcctgtgttgcccctaaacatgttgtttcattttgtccccttgtcatggggtcttcacagaactcctgccttagaggataaggagagactcttgctgtagcaactgtagacaccggtgtgcactaaatagggaggtgaaccttggcagaagatggaaaatttttttggagaaggggatttttggatcagtgcttgtggctctgactctctttctgaaagggaatacccaagaacatgaggattttctgtatctagagcttgaagactagccttctccagtattttgcgctcttccttaaacgatcacaatatagtctgaggtcagctttcttcaaacaggaatgaccttacaggcagagaagatagctataggtggagactgttacctcatactgtagactcagatgtgtaggataggttcagatccagctgcccaagctcaatttggaggacatgccattcttggtactgttcattctgaactataaatttctttgtctgcttctctaagacatctttctgtcttgtgtttactgcttagcacaccaaaccactgtccttcaattatgataacagtgaatcatttctgtgtgcttactatataccacataac

SEQ ID NO: 48212 - DNA, 1028 bp, Homo sapiens
ccacagctaggactgagtgtctccacatcctttctgaagcctacgaagctcatttatgtgctctgagatacatctattcaagcacataccaaggaaatgctcactgtgcatttggaagtaggtgttggacagttggactgcagatgttaggtgtctgtgtctctccacaacataggcatcaaccccaatctgccttacgttggccgtgagcattggtagagtcagcctgacttggcggaagcacgtgtaggtggtcttgcctgttagcttcttactcccccttgctgtgccctttgaggagtttgcctcacgttataattctacatattaggctcagcacctgtttttctttctggatgcatctacagcttaggttcctttaggtgtgaaaagtatgtccccatataggataggttgggttataaaggtgtcatttcctattctttgctgcatcttgaacagctgaccatggtgtggtgtcctttgatagtgttgtttgacagacaaagggctatctggcgatatgcttggcattttcctggggaatgtaactttatggacgtctcaactgaggctgacatgtcacaagatattgagcatattttcaggcacttaggattggttttagaaataaacagatctgcttcttacagctacttcatctgttccagctccaaagacaacaggccctccctctgccctcccgtctgtgagctccctgcccagcaccacctcctgcactgcacttctgccgtccacatcccagcacactggcgacctgactagcagccctctctctcagcttagcaggtatggggaaggtgtgggcccaaagtgagaagtaccttggggcaagtcctggagctcctgtagaaggttgctttcatgaacagagcacacttgttgtctctgacgtgatgtcctgggcttttgcattacgactgtagcttaggttttggccaggttgttccttaaaaccaccagatatggaaaccttgcctgcttgtaccgcctctgctggcacagag

SEQ ID NO: 48213 - DNA, 1057 bp, Homo sapiens
agagccacagatccttatttcaagtacagatttgaagatctggctcagagaactgttgttcttgagggttttgctgtatcccatagttggaggatgcatggttccttgaccaggtgatactttcatcattggtgagtccccaaaaatagagtagtcagctcagtgttcacttcccacccaccatcacaactcccccgcattgctcttagatgcaggtggtgatattaatgccaaccattcctgtttaacttttaatttctcctttttttttttaaatgagacagggtctcgccgtgttgtccaggctggtcttgaactcctgggtgcaaatgatcctcctgtcttggcctcccaaagtcctgggattacaggcatgagccaccatgcccagccaacttttaatttttcttagcttgttttttttctttctctttttagaaaagtcttagcctattttctccttgtttctcactccttcttcttgccagtattgcctgggaacctaaatgcttgtttggctctgttataggcctttgtgacctggaatctgtgacctctgttcctgacacgacagctttgctttttcagatcccagcttctgcagtggaaatgcctggttcagcagatgtcacaggattaaatgtgcagtttggggctctggaatttgggtcagaaccttctctctctgaatttggatcagctccaagcagtgaaaatagtaatcagattcccatcagcttgtattcgaagtctttaaggtactgaatttagtcctttgttatgaagcaaaatagaccctaagagagatcaactggtggaaaagaatacatcctgtggtaatagctatcctcagtgtttatccagaccttccatcatctccataagaaaccccatacctgtagcagacagtctcagtttcttcattgccctgccccttagcaaccaataatctgtctctggatttgcctacctggacatttcatataactggaatcttggaatatgtggccttttatgtctgatctttcacttagtgtaagttttcgaggtacaccca

SEQ ID NO: 48214 - DNA, 2117 bp, Homo sapiens
agaaatatacccattagcaaatgtattctagaatatgatacatgctttataattactttctaaatataaaaatatctacagtaaggccgggcatgatggctcatgcctgtaatcccagcactttgggagctggggcatgaggattacttgaacccaggagtttgaaaccagactgggcaaaactctgtctctacgaaaaaagcaaactaacaaaaattagctgagtgtggtgttgtgtgcctgtagtctcagttacttgggaggctgaggttggagggtcacttgtgcccaggagtttgaggttgcagtgagccatgatcatgcctctgtactccaggctgggtgacagagcgagaccctgtctctaaaacaaaacatcaaaaaattctacagtagatcttagtccagaaaacaatgatgtggtaatttccaagcacatatctgatgattccatgtggaatttaactacctgagtttcctggacaaagataaaaatttttttatggtttgtcaaattctttgaactgatgatcactcttgagattgaaagtacccctttcttctgaatgatgttttccttgtgttttgtttcatattatgtctctatagttagtatattcaatttcttgttttccaattaaatgcgaaagtttatcagaattgacttgctataaaatcatgtaaaaacagtctgagtctgcctaggcgcttacattttttgcttttttttccccctaagaccgtaaaataagctacattttcttaaaatgccaaatgattaacagaggcccttatagtttggatgtgtttttattgaaacagtgtcatttagtactgtatgactgacttccaatgtgtgttaagctcccatccagaaggaacttcagaaactgttagtgaaggctgtgaagataggcttatggaagtataagcttagatcatagcttatacaagaatgttgctttagaatggtgaactgaagttcctacccaactacaggaagttctgagctggcaaggggaagttagaaaggtctatggatgcagaactacagctcttactagggataattattttagtttgttgctgtgtttttcctgaaatttattgctgagaaacagaattttctcccgagtcaaatcgtttgttttaccctgataaaattgagaattgaatatttaaacttttccttagtattttctactctgtgtagccatatcatgtgttgggcttggggacttggtgtttttagtatcattggtatatgaggtggtgtcagtgcttgaagtagaacagcccaaggcttctctattttgagaaggcctaataaaaaccctgatttttaattgacgcaccagagtcttttcctcctccgcctttccctctgctactggtataattatgtaatgcccttgctgaaatctatgtgtgtccactgaattgataagaaggacttgagtttttacagcaatcttcagatatgttgctttatgtagtgaccagcatgagaatgaccaacatgagaaggcagaataagaattgtttgtgtggcgttgtattagagcagtggttctcgaccctactctaatctttaaaaatcactgggagctgggcgcggtggctcacacctgttattccagcactttgggaggccgaggtgggtggatcacctgaggtcaggagtttgagaccagcctggccaatgtggtaaaaccccatctctactaaaaatacaaaaattagccaggcgtagtggtgggcgcctataatcccagcttcttgggaggctgagtcaagagaatcacttgaacccgggaggtggaggttgcagcgagccgtgatcatgccattgcactccagcctgggcgacgagagaaactctatctcaaaaaaaaaaaaaaaaaaaaaaaaaaaaaaaaatcattggggaggccaggcatggcatggtggctcatccctgtaaatcccagaactttgggaggctgaggctggaagattatgagatgccaggaatttgagaccagtctggcaacatagcgaggcctcatcttgctaaaataaaataagctggttgtcatggcacatgccctgtaatcatagctactgtaatcccagct

SEQ ID NO: 48215 - DNA, 1034 bp, Homo sapiens
actttcattcttttcatatgtttaaaccctcaattttacattggtccacagaactggcatcaaatactcacaacatagctcaggatctgtcaaacaaaagttcttatggactcaaaggtatgaatacttaattttttaatttttaaaattaagaatcttataaattgcttgcaatatctttcattttttatcaaagctagctaataaaaatttatcagataaatgtttgtaaactatacctatttatttggtaatcagatttgcagtttgctaatggaaatgttttattgattgactttcaaggtgccacagaattttcatcattattttccatgttcctaagtggccttaacatacattcgttagaggactaacaccaagttaaattgaacataaaacattcatctccaatatattgttttaagctgaaaataaggattgttgaagtttttccgttatattttgtggtgtaggtctaatgaccaaattaaaattttaatattccaaaatatgattaggacctgagcctttgccttctgtatttaatgtctggaattttttatagtctgtgtgggtatggctagttcctgcaacaacgtggcacttgcttctcacatgggagtttcccctgtaatttcctgacttaccactctatcatgttgcatctctgcttataactatctgtttcgctgtttttccttcaggctacatacatagtgccttgtacttgcttttaaatgtactcagattctcaccctattatgcaagtccaaagttgtgtttaattattttcaaaatactgctctcaaagtggtaggccagtcttttttatttttattatattatttttatttattttttttgagatggagttttgctcttgttgcccaggctggagtgcaatggtgcgatctcggctcactgcaacctccacctcctgggtttaagcaattctcctgcctcagcctcccaagtagccgggatttacaggtgtgaggcaccactcctgactaattctttgtatttttagtaga

SEQ ID NO: 48216 - DNA, 1031 bp, Homo sapiens
agcaggtgagctgcaagctgtgggtagttaggtttgaaagatacgtgcatgtgccgggcgcggtggctcacgcctgtaatcccagcactttgggaggccaaggcgggcagatcacgaggtcaggagatcgagaccatcatggctaacacgatgaaaccccatctccactaaaaatacaaaaaattagttgggcgtggtggcaggcgcctgtagtcccagctactcaggagactgaggcaggagaatgttgtgaacctgggaggcggagcttgcagtgagctgagagggcgccatgcactccagcctgggcgacagagcgagactccgtctcaaaaaaaaaaaaaaaaagaaagatacatgcatgtgcctttgataattgtacacactttgaatgataaatgattaacagccgttctctctgatagacttcatgggagactgtagggtgtaagaaaaagaattttgcaaaagaaaattcagaaaacaaagagaatagagagaagaaaagcgagaaagaatcgagtcgtggacgtggaaacaacaaccggaaaggaagaggcggcaatcgtggcagagaatgtaagtacagactttctcctcagttttttctcttctttcatctcaagtgaccctcccgcctcagcctcccaaagttttgggattacaggcatgagtcactgcgctcagctttctcaaattttttcttagtttccatacattctgaacgactgaaagattagtccatagtatgctcataaattcgtttcctcaatgcagaatttgttctaatagttaacactagaaatgagtggcacctgagtagtttcataagcgcctcccatgtggtttcgtatcagcattgacctgggctgtaggcaggtggttgtgtagtgtgatgactcccttctgttatgagtcagacacatttgttaattttagaatggtgtgtgtgtggcaaagaaggggccaggggccatttagttacaggtagataaagctgttttatattctccatttatagacactcatgg

SEQ ID NO: 48217 - DNA, 1058 bp, Homo sapiens
aacatgtcctcattgtaaactcaagagtctagaagaggccatcttcatgtagaaggattatgtaattctgtatttgtatagaagaatcttaatatcaagtgccagttttttgtttgcctctaaccattttctgatatgttcactagcttatggaagtgacagggaaaaatcaggatgaatgcatagtggccctacatgattgtaatggagatgtgaacaaagctatcaatatattgctggaagggaattcagacacagtaagtattattaattgatttgcattgtttacatttgtctccaattccgtagcacattttcaacttcaccttgtttgggggtagggatggaatggattatggtgccattccatatttgttttaagttccagaaagaacgattacctgaaaagactgtttttgttatgtatggtttcttcatgaagtcgtagaatctgatgacttgaaagagaacttggtgatctactccagccttacagtttccaaaaatctctgtgcctgtgtatattttcaccacccccacctgaaaagcatctcttggctctgttgcttatgtttcttcatctcagtcctcacctctgattacttcttacatctctattataacagaaaaccaggatttgctggtatatgtatttgcttatgtggaatattaagttttcttttttttttttaatattgggttaagtttggtgagcttgcaggctcatgagctcaggccttggattttaagaaggatacagctaaagctacaccaggcacttgtcagccctaaaattttgctgtgtgtatatatttatatttatatattatagtttttatacatatgtatatatttatttataaatatatatttatttaataattttaaattttaaataatttaattttaaattaaattaaattatttaataatatatttaataatataaatatatttatatatttaataatataaatatatatatttaataatataaatatatttatatatttaatatatattatatataatatttataatatttgtttaataatata

SEQ ID NO: 48218 - DNA, 1036 bp, Homo sapiens
tgaatttctgtaccaatgtctttttgggtataatgtagcagtattgcagcagttaaactgaggtctcagcaggcataggttgggatgaacaggccaaagcacctggagtttgtataatcacccacccacatggcctggaaaggccttttgaaaagtgctttaaaatgcaaaaaatgtcaacaactcccacttatcccacttcagtcaagattatttgaaatgagtgtatataaaaaactcagaataaaagctgtttattagttccttatggcttttcttcctctaagatctttttgtaaactgttaagctttttaaatatttgtgttgggagttagtatagacttggttagcgaggcaacttaaactattttggagtaattttagatttaatagaccgttgtacagagatgatacagattgttcctgtatattcctcacctaatttccctgttgtaataattacggtaccttcgttaaaactaagaaaccagactggcacattacaaagtcacgccacagaagaataactttctttagaacttttctgattttttgttggtaaaaacatcagaaaacgaaacttcagtcagtaatgtgattgaaaaaatattttgagtgacaaaagtaaatagtttttctgcaaatagccagatgtggtggtgcgcacctgtagtccaagctacatgggaggctgaggcggcaggatctcttgaactcaggagttggaggctgcagtgagctatgatggcatcactacaccgcagtctgaggggacagaatgagaccctacctttaaaaaattaaataaatacggctgggtgcagtgacaggcgcctgtaatcccagcaactcaggaggctgaggcagaagaattgcttgaacctgggcggcagaggttgcagtgagccaagatcgtgccagtgcactccagcctgggcgacagagtgagactccatctcaaaataaataaataaatactccagcctgggcgacagagtgtgactccatctcaaaataacatacatacatacatac

SEQ ID NO: 48219 - DNA, 1039 bp, Homo sapiens
gtgcagagcatttttgtggagatggttttaaactccttttaacactggtagacatttctttgaccctatagttttacttctttgtattcattgttagaaagctatatttggggctgggcgtggtggctcatacctgtaatcccagcactttgggaggccgaggtgggcggatcacctgaggtcaggagtttgagaccagcctgatcaacatgatgaaaccctgtctctactaaaaatacaaaaattagccgggcattgtggcatgtgcctgtaatcccagctactcaagaggctgagacactagaattgcttcaacctgggaagtggaggttgcagtagccaagatcgcaccactgcactccagcctgggcaacaagagtgaaactctgtctcaaaaaaaaacaaaagaaagaaatctttctttggccgtgtgtggtggctcacgcctgtaatcccagcactttgggagggcaaggcaggagggtcatttaaggtcaggagttcaagaccagcctgaataacatggtgaaaccgcatctgtactaaaaatagtaaaaattagctgggtgtggtggcgaacacctgtaatctcagctactggggaggctgaggctggagaatcgcttgaacctgggaagcggaggttgcagagaatcccttgaacctgggaggcggaggttgcagtgagtcgcgatcacgccactgcactccagcctgagcagcagagcatgactgtctcaaaaaaaaaaaaaaaagccatctttgatgtatgtacagatttgggtataagaatggacctcagcctgccacagtggtgcatacctgtaatcccagcactttgggtggccaaggtgggcagatcactcgaggtcagacgttcaagaccagcctgaccaacatggtgaaaccccgtctctaccaaaaccaaaaattagcagggcgtggtggcatgcctgtagtcccaagcatgagaattgtttgaacctaagaggcggaggttgcagcgagccgagagcacactactgcaaggcaacagagg

SEQ ID NO: 48220 - DNA, 1069 bp, Homo sapiens
gtgatctgcccgccttgacctcccaaagtgctgggattacaggtgtgagccactgtgcctggctgttttttttttttttttttaatagacaggacctcgggctgggcgtggtggctcatgcctgtaatcccagcactttgggaggccaaggcaggtagatcacctgaggtcaggagtttgagaccagcctgaccaagatggagaaactccgtctctactaaacatacagaattagccaagcatggtggcacatgcctgtaatcccagctacttgggaggctgaagcaggagaatctcttgaacccaggaggcggaagttgcgatgagcagagatcccaccattgtactccagcctgcacaacaagagcgaaactctgtctcaaaaaaaaaaaaaaaaaaggaaatataagtcatttatttttcatttgttacatggaatatttacatagattgtttcctgctgggcatggtggcttactccagtagtcccagcagaggtgggaggattgcttgagtccaggagttcgagaccagcctgagtaacgtagtgagacctgtctctacaaaaattacaaacttcttatactgtatggtaggataagtgcttgaatctattggcttaccaattaataaaaaaacattttgaaccgggacatggtggctaacacctgtaatctcaacactttgggaggctgaggtgggaggattgtttgagctctggagttcaagaccatcctgggccaagtagcgagaccctgtctccataaaaaatattttttaaaaaatttataagaaaaaaacctttttggccaggtgtggtggcttgcgtctgtaatcccagcactttgggaggctgagacgggtggatcacctgaggccaggggttcgagaccagcctggccaacattacaaaaccccatctctactaaaaatagaaaaattagctggccgtggtggtgtgcacctgtaatcccagctacttgaagggtgaggcacaagaatcacttgaacccaggaggcagaggttgcagtgagccgagactgtgccactgtgctccagtgtgggcga

SEQ ID NO: 48221 - DNA, 1050 bp, Homo sapiens
taattttttgtatgtttggtagagacggggtttcaccatgttggtcaggctggtcttgaattcctgacttcaggtgatccacccagctccgcctcccaaagtgctgggattacaggcgtgagccactgcagcaggtggtgagagttcttttgaatccgtataaaccaggatttttgtcctgggtctagcacttagtaattagatgagttacttaaatctcctttaacctcttttttttttttttttttttttgagctagagtctcactctgttgcccaggctgcagtgcagtggcttgatctcggctaacggcaactgtgcctcctgggttcaagtgattctcctgcctcagcctccagagtagctgggactacacttgtacatcaccacacccggctaattttagtagttttagtagagaggggtttcaccatgttggccaggttagtcagttttgaattcctgacctcaggtgatctgcccacctcagcttcccaaactgcccggattataggtgtgagcccctgggcctgaccgtgaacctcaatttaaaaaaaaaaaaaatacattgtgagatttacggaaaagttgcaatgggaatatgaataattactgaatacccttttttcagattccccagattttaacatttctgtcacatctactttatcctgttctcttcctttccctacagtttattcccagaaacgtttgacaagtagttgtgaataaggttcttcttcacttaatacctcagtgttttttaaaaaacaaggatctttttacataattacagtacaattataaaaaatcagaacatctacagaccatacttatattttttcaatggtcctcataatgcctttttttttttttgagacagttttactttgatgcccaggctgtagtgcagtggtgcgatctcagctcactgcaacctccgcctcctgggttcaagtgattctcctgcctcagcctcccgagtagctgggattataggcatgcgccaccatgcctggcaaatttttatattttcagtagaaacgaggt

SEQ ID NO: 48222 - DNA, 1075 bp, Homo sapiens
aggcatggtagtgggtgcctgtaatggcagttagtcgggaggctgaggcagggagaattgcttgaacccgggaggcagaggttgcagtgagccaagatcacaccactgcattcaagcctgggcaacagagcgagactctgtctcaataaaacaaagacccatttgaataaaatttttaatgttaaatactccctcctcctcaatttggttatattattattttaagtgaagtgagataagtgctaagcacagtacctggtgcaaaattaagcattatatacatgttattgactagattggcaaaccctttttcataggcaatatgcaagtaagtaaactatatccagtttgtcttacttgcagattgatttgactatactttgatagttaattaaaagtgcttcttaaaatcactcatttatacccaagtgccctgttgatgttaggggacatagtgaggagatttaagtgttgcgttacatttttcagtataaagttagtgtagtattctgctggtattaacagacagatatctctgctactcagtgcttgatcctaaatacacttactctgataggaatttattcacaaactgatctagtccagtgatggaaaaatttggaggttttaggctaggtcctccttttatagttgaatttacttaggaaaaagtttgcttaatgaatggtctttttttttttttttttgagacggagtctgtcgcagtggccagtctcggctcactccaacctccacttcccgggttcaagtgattctcttgcctcagccttccaagtagctgggactacaggcaggcaacatcatgcctgcctaatttttttttgtttcttcgagatggagtctccttctgtcgcccaggctggagtgcaatggtgccatctcagttcacagcaacctccgcctcctgggttcaagcgattctcctgcctcagcctctcaagtagctgggattacaggtgcctgcctccacctccagttaatttttgtatttttagtagagacagggtttcaccatgttgcccagcctggtctccaacacctgagcccaagtgac

SEQ ID NO: 48223 - DNA, 1036 bp, Homo sapiens
cggctaacttttttgtatttttagtagagacggggtttcattgtgttagccagcatggtctcgatctcctgacctcatgatctgcctgcctcggcctcgtgaattgctgggattacaggcgtgagccaccgcacccggccacacaattgtttctttaagatttattatttacagctgacttttgcttttaggcatagcctgtttcttgacacattttaaattgggctattggcaggtaaaatcttggctgggtgcaatgttgttttggggttcaaatagcaactgcaagtagtaagaggcagatagcacttcatgtacagtgactacatgtagtgataaaatggttgctggttaaaattggtggtacttgagatttttgtttagaattgctaagctcgtaaaccatagacttagattgcagtagtcgaattggtttaacagataccagcaaaatgtaaaatcctcaagggctacttcttgagaatttgtattccagagagcttttatcttttattgtaagtgtccttgttttctctgaagtacatgcttatcttttactatgattgttttgcttaccatccctactttcttgcagattttctattttgtacatacattattttgtatatactgtatatgatgacttcagtgagcagtgaccattgtcgaggtgctcgggaaaaaccacagatttcagcagcacaatcaacgcaaccacagaaacaagtggtacaggtaagtttttgtggaactctttttttttttttccttttttttcttttattattatacttgaagttttagggtatgtggaactcttgtttgccttgtttagaattaaggaaattaagggagagcatatgatttaatgttttcctttgtaggaaactttaggattttggaccctttgtttaaacagtaggtgatggccgggtgcggtggctcacgcctgtaatcccagcactttgggaggccgaggtgggtggatcacttgaggtcaggagtttgagactagcctggccaacattgtgaaacc

SEQ ID NO: 48224 - DNA, 1061 bp, Homo sapiens
gtgtgtgtgtgtgtgtgtgtgtgtgtgtgtagtaaaatgtacataacataaagtttattgtaaccattgttacatatacagttctctgacattaagtacatttacattgtcgtgcaaccaccactgccgtccatcttccgaacctttgtatcctcccctacagaaactccatacctgtgatacagtaactccccattcttcccctacccccagcctctggtaactaccattctacttgtttctatgaatttgacttttctaagtaacttgtataagtagagtcatgtagtatttgtccgtttttttttaccccttgccccgagagttttgctctgtcgcccaggctggagtgcagtggcactaccttggctcactgcaacctccgcctcttgggttcaagcaattctcctgcttcagcttcctgagttgctgggattacaggtgtgtgccaccatgcctggctaatttttgtatttttagtagagacggggtttcaccatgttggccaggctggtcttgaactcctgaccttgtaatcaatctacctgcctcctcttcccaaagtactgggattacaggtgtgagccactgcaccctagccttatttgtccttttttgactggcttatttcacttagcataatgtctttgaggtgcatccatgtggtagcatgtgttagaatatcttcccttcttaaggctgaataattttccattgtgtatatatgtcacattttgcttatccattcatctattgatggacacttgggtatcttccactttttggctattatgaataatggtgctttttaattaattaatttattttttatttttaaaatttatttatttattttgagacggagtcttgctctgttgcccaggctggagcgcagtggcacgatctcagctcactgcaagctccacctcccgggttcacgccattctcctgcctcagcctcctgagtagctgggactacagtcgcccgccactacgcctggctaattttttgtatttttagtagagacggggtttcaccgtgttagccaggatggtctcga

SEQ ID NO: 48225 - DNA, 1034 bp, Homo sapiens
cagtgttgcgccactgcactccagcctgggtgacaacagtgaaactccatctcaaaataaataaataaataaataaataaataaataagacagggtttacagctgaattagcaggataggaataggacagatgtgtgcaaacagctatgggcaattaattcccttcgtggccttaggtaacctgaaagagaattgtgacgatatcaaataaattttgatgtcctatagtgtttgagttcaccagcactcatcctttccatgggcaggttatatccatggaacagcagataactttgtgattcttctgtcagcgaagtgtgggtgtaggggagttcaaccttgtccatcagctgctagaggcctgaccctgcccttaacagctgcagagaataaaagtatcagcttgttcagctcctggcatgcagggtacaagcagttgagctgcatggaattggatctcatagttgagtttcttggcaccctagataccttgttctctcctcgattacgggtgtagactttgtgttggtggctgttctgggcctcctaatttagttgagattcttttcttttcttttttttttttttgagatggagtctcgctctgtcgcccagcctggagtgcagtggtgcaatctcggctcactgcaagctcttgcctcccaggttcacaccattctcctgcctcagtctcctgagtagctggggctacaggtacccgccaccacccccggctaattttttttttgtatttttagtagagatggggtttcgccgtgttagccaggatggtctcgatctcttgacctcatgactcgcctgccttggcctcccagagtgctgggattacaggcgtgagccaccgtgcctggcctatttttttcttttttaaataatagaaatggggtctcactgtgttgcccaggctggttttaaactcctgggctcaggcgatcctccccctcttggcctcccagactgttggagttacaggcatgagccactatgccaggccagattcttttgtttatttt

SEQ ID NO: 48226 - DNA, 1047 bp, Homo sapiens
aactcctgatctcatgatccacctgccttggcctcccaaagtgctgggtttacaggtgtgagccaccgtgcctggccgcatttcttccttcttcttctttttatttttttaaatagagacaaggtcttgctatgctgcccaggctggtctcgaactcctgagcccaagtggtcctcccaccatggcctcccaaagtattgggattacaggtgtgaaccactgggcctggcctatgtatacattttcttttttttttttgagaagttttgctcttgttgtccaggctggagtgccgtggcataatcttggctcattgcaacctccgcctcctgggttcaagcaattctcctgcctcagcctcccgagtagctgggattataggtacccgccaccacatccagctaattttttatatttttagtagagacaaggtttcaccatgttggccaggctggtctcaaactcttgaccttctggtgatccaccctcctcagcctcccaaagtgctggattacaggtctgagccactacgcctggccctatgtacacatttttaggtgaacgtgttttcagttctcttgggtgcatacccaggagtaggattgcttggtctttatcataactgtttaatttctttaggaactgttaagagttttttttattttttaggagatgtggtcttactctattgcccagtctggagtgcggtgacatgatcatagcacactgcagccttgatctcctaagctcaaggattcctaccacctcaacctcctgaatgggtgggattccaggtgtgcgccaccaagcgtggctaattaaaaaaaaatttattgtatagacgaggacttgccacgccgcccaggtttgctcacctcctgctgtgcggcccagttcctaattaccccagtctgcagcctgggagttggggattggggatccctgctttatagtataggcttttttgcttttttttttcctttttgtaggagagagagaactgttataagtagtggtgaagactggttatgaataattacatgcttt

SEQ ID NO: 48227 - DNA, 1159 bp, Homo sapiens
tcttgtttgtttttttttttttttttgagatggagtttgctcttgttgcccaggctagagtgcaatggtgcgatcttggctcactgcaacctctgcctcctgggttcaagcaattctcctgcctcagcctcccaagtagctgggattacaggcaggcaccaccatgcctggctaatttttttttttttttttgcatttttagtagagctgtgggttcactatgttgggcaggctggtctcgaactcctgacctccagcgatctgcccacctcggcctcccaaagtgccgggattacaggtgttagccatcgtgcccggcccgttgatttcttatagtagtatgaggttacattgtaaggatgtgccatatgttgtctatttcattgttgatggatatttgtctcatttccagttttttgagattaccaattttacttgtcctcatgtggacatttgccaccctgcccacaacaaacaaagtccattttctcaagactacataactgagagtggaatttttggtttgtatgtagggtatgtgtaacttttactaagtaatgctaaagtgttttccacatgttgcacagttgttctcaggcttgtcagctgaaccacagaacacagaaagttgagttactattttctcaaatctgtcaaggatggtacataatgaatttcattctaggtgtctggaaaaagttcagcttatacacagagtggatgccctaagaattgggaattcattctcaaagactgagtggtttaagagttctacatccttgccaacattttatgttgcctttttagttttagccaattgtagtgggatgttctagatatatctttcatgaacgccacatagctggattttgctttgttaagttagcaacttgctaacttctttttaattaattagagtgtatcgctatgttggctgggctggtcgtgaactcctgggctcaagtgatcttcccacctcacccgcacaaagtgctgggattgtaggagtgagccatcagctaacctctttaactagagcatggagaccattcatatctgttgtaattacagatattttggatatatgtctgccattatatttagtcttctagttggctggcctgtgtgtttgttttctgtccctttttttttttttttt

SEQ ID NO: 48228 - DNA, 1079 bp, Homo sapiens
cggcttttccacattttcccctgagtttttagtctaattagttgcccacgcatctcaactgtcaccactctggtctctaatgcttgctcgctttaggggttgatcccatcattattactgttatttcctgtttgatgtaatccagtcatttactaccacttctattggatattgtttttacctcacattcaaggaaggtatatggtttgccagtatttaggcttattgtctttctacagcaccagtgtatcctaacagttgagagattttaaaaaattactattaattttagagatatggtctccatatgttgcccaggctggcctccagctcctgggtttaagcgattctttcacctcagcctcctgagtatctgggattacagtgtgcaccacggtgctcagctagttgagggttttttcaggtctccataaggtatccaaagattatcttttatttgaagggcatataatttcttgggtgaacccagttcttatattcctcttccgttgtgacagcacttttttcaacaaggggtatgcgactagttattgcattcctcacttttcactgtgaattgtgtatccgttttagtgccagtttgtgaaaggtggaaggaagttgaacatgatacctaagctctcccgtatcctacattggtgtgttccccttttacctcaggaaagggaatgtattccactccctggagatgatagtttccttcaatacactcacctgtggagccccttcgctagggttgtccttccattgctttgaaggcttctcttatcattaggcagaagtgattagtttcccaaactgcccttttgcttgctgccagcatactcctgattttcctacttatggctagttgatacgtgtgacgagagattttcccacagcgctgatttcccccatttgcttccctgttgcctctcaccctcaataattatgaaacctttcagagaaggaaggtttttgttgtgattgaaatatgcccgaaagtggtggcatgggagagaatgaggccatgggaaagggttgtggtaattgcctctcttgcctgtttcctgctgctc

SEQ ID NO: 48229 - DNA, 1079 bp, Homo sapiens
caaagtgctgagattacaggcgtgagccactgcacctggccgagagccctactttctatcctgtggtaatttttttgctgtggtcctgcctgaactaaaattctatttatgctaagatgtggcatggtgggataaggaggaagtttacaaagggcatgaggaaacctcagggtaatgagtatgttcattatgtagattgtggttatgatgtcatggatatatacatatgtcagaacctcaaattgtatactttatgtgtcgtatattgtatgacaaacctcaataaggctgaagaaaatactgagtttagttctgaccactgagtaaattaagcttccacctcaaatcttttataacatattctctgtaagagcaccctcattctttattgaagagggaaaaaatacttattttagtgtactttgaaggtttcaaaatacctttttctgacatgccatttcatcataccaagaaccctgtgggaagcagatgagaaaacatagttttacatataagacctagagccagctaaataacttgcccagcatcacacagcttgatgggggaacagctagggaccagaatccaacttaacaaattgtattttctttatctcactttatcccatttctcgctttatcccatttctcatgcaaaaatatggctgtgttatcctgagagtcctaaaaggcacactgtggattgcagttcaccctctctttttcaagtagtgtttattcctgtgcagatactgcaaagtagcttttgttttgggttttttgtggttttttttttttttttttttttgaagacagggtcctcactctatcagccaggctggaggaaagtggtgcaatctcagttcactgcagcttttccacctgccaggctcaagcagtcctcccacctcagcctcccgagtagctgggactataagcgtccgccacctcattcagctaatttttgtatttttgtagagacaggttctcatcatgttgcccagagttgtctcaaactcttgggacacccacctcagcctcccaaagtgtgtgctaagattacagggattacagccgtga

SEQ ID NO: 48230 - DNA, 1034 bp, Homo sapiens
atatagacaaaacataaaccatataaactaatatttaccagtaatacatcagagtgtgataagtgccatggagaagaataaaggcagcataaagggactgagagtaaggtggaggatgctgtatcagaagataaagtttcattgataggatgacgcttgagcagggagacttaaaggaaatgagggtacaagccatgtagatgtctagatgtctggaggaagagagttccagatggaagatgggacccagaggtagaaggcaagagctatgtgtccactacccacagtagtgccaatttcattccagctttgagctcctcaagatagaaggtaaagattgatcattctctgtgggttgagaccaccagagatcagagttgtaatttctacaaaaatattttcagtctgacttgtatgcttctttagagagtttattacaatccttattttactaatttcttattttcctccctgtacctgttactccctgctctccaaggatggacacaaggactggatcttttccatcgcatggatcagcgacactatggcagtgtctggtaaagttgcccttttatagggagcttttgatgtggcagggattgggggctagagattgaaaagggatagtagtgtgataggaaacagcccagccgggctcagtgactcacgcctataatcccagcactttgggaggctgaggtgggtggatcacttgagcccaagaatttaaattagttgagtgtggtactgcatacttgttgtcccagatactcagaaggttgaggcaggaggattgcttgagcccaggagaaccaggctgcatcaagctgtgatcgtgccactgcactccagcctacatgacagagggtgaccctgtagaataataatttcttatttagtgtaaaagtgatacacatttattgtaagaaaattttaaaatataggccgggtgtggtggctcacacctgtaatcccagcactttgggaggccgaggtgggtggattatgaggtcaggagttcgagaccaggc

SEQ ID NO: 48231 - DNA, 1881 bp, Homo sapiens
gtagagacaagctttctccatgttggtcaggctggtctcgaactcccaacctcagatgatccgccctcctcggcctcccaaagtactgggattacaggtgtgagccaccacacccagccaatattttttattttttgtttttgagatggattctcactctgtcgcccaggctggagtgcagtggtgtgatctcggctcattgcaacctccacctcctgggtccaagcaattctcctgcctcagcctcccgagtagccaggattacagactcacgccaccacacctggctgatttttgtatttttagtagagatggtttcgtcatgttggccaggctggtcttgaagtcctgaccccaggtgatccgcctgccttggcctcccaaagtactgggattacaggcgtgaaccaccacgctcagcctgggatcatttgtttaaaaggataagaaacccactcacatttattggaaagacgagttcacaaaccccaagaacagaaagtattattggatctcagagagaagtggaaacaggaattgaaaagccactaggaaccaaggatgtccatgtttcctgtcttttttttttttttgagttggagtctcacactgtcacccaggctggagtgcaatggcacgatcttggctcactgcaacctccacctcctgagtttaagcaattctcctgtctcagcctcccgagtagctgggattacaggcgcccgccaccacatccagctaatttttttttttttgtatttttagtagagatggggtttcaccatgtttgccaggctagtcttgaactcctgacttgaagtgatccacccgcctcagcctccctaagtgctgggattacaggcataagccactgcgcctggcccatgcttcaagtctcaagttttcttttctccaaggactggctttggtaaaaagtggccacccgggcggtttggtctagtgccaccagccagttacatattccctaaagaatctgaatggcctagtccaatctagcctttggactgattgtcctgaaactccctctagactgtgctgtgatcagggggtctaggcttatagcaaataaaacagctacagagcctcaccctcacagggatgtgggggcctactacagtagttgggcaggccctctgaaaggtgactgttgtaaatgcttaagtagttgctggggcaagattgtagaatcaaataagataaattctctgcacttagaattgggagagagttaatagctttatgaggaagacaaataagtaaatattttaaatcagtgcgatatggtctaagtgttgtgggtagagggatatcttgggagcctacaagagaggcacttgatcagcctggacatttagagagtagtccaagaggacatatctgaaccgaatcatgaaagataagtacatgttggccaggtaaaagagtaggagaggctgggtgcggtggctcacacctgtaatgccggcactttgggaggctgaggcaggtggatcacaaggtcaggagttccagaccagcctggccaatatggtgaaaccccatctttagtaaaaatataaaaattagctgggcgtggtggtgcacgcctgtagtcccagctgctcggagggctgaagcaggagaattgcttgaacccaggaggcagaggttgcagtgagctgagatcatgccactgcactccagcctgggcgacagagcaagacttggtctcaaaaaaaaaaaaaaaaaacagaaaagaataggagaatcatttctggcattgtgaacagcatgagcatgaaacaaaataattatatttcattgaagaatttttcatgtatgatatttataagcaattatttctagagtttgaagtccatg

SEQ ID NO: 48232 - DNA, 1103 bp, Homo sapiens
aagtcctcaaaggagtgtatttcttcaggccctctctggatgtgctgcttctagagggttgtttgtttgtttgtttgtttttgcctcatatttttatgctggtttttaagtcataggcctcaaaggaaagatttaagaaataatgatgcttagagcatcattcaggatacataatagtgaaaacagcctaagaacgtatgtcgaagtatttaaaatagcacacttggctgttttttagtgaacagaatctaaaaatgtataaactgaaatatgagaaatacatgaactgtttcctataaggaaggcagggaatgtgtgtctggtagtatatttcagggtataagcattagctctttggaaagtagcctttttaagagtgaatagaaagacagttataaatgaatgaagtgaaaaatttctcagtaagctttgtaaccaacccaattataggccaggataaaataagtcaaagagcagaaacgtttggaatagagtccacgaatagcatgatgtcacaagactggcaaatgaaaagaggcagggcctagggcctaggggtgggaaatgattacgcccagccctccctcggttttcacctcccctgtgtgaatggacaagtaatgtcataatgtgtgagtaaattgaccctggaatgaaacacattttggatcattaaaagagagaagattgctctagatcaagaaagtcttaagtactaggagaagtgtctgtttataaaggacataggcaaaaatttaaacagttttaaggaaggaaataataccatggtggttggtctgtttataaaggacataggcaaaaatttaaacagttttgaggaaggaaataataccatggtggttggggccaacctttcgtttcctcttctgttgaggagtcgcttgtcttacccagaagcctttcaaaactaagtggtggcaacgggcctccacagaacttccttttcttggtctctccagctgcccactcgtggttaagaactgtcatccttgtcacttggagtagaaaaagagtctcctgcttggaagagttcattccactccccgcacgtgcatcatagtgtttagcctagcaaatattac

SEQ ID NO: 48233 - DNA, 1045 bp, Homo sapiens
aggattccttcccccagcagcactggtggtcctcacttccgggtgcctgcggataggcgggctggggtcggaggtcggcggccagaagccagattcccttggccccagctcgtccacttccatccagcagtagccaaacaaccgttgaaaatggcctggcggcggccgggaaacaccagagaactatcttccaacccctagatcccgcccatctcgttccggcggtgtttccgtggcgacgctatccgaagtgcggctgcgcaagggtgacggcgcgcgagcaagggggagggggtgttttggttctagccgctcgccgtccttgcaggctctgccgtcggaaagccgctcattctcgcttccccttccctttcccggctcaagtccttcctctctctttcctttctttccgcctatcttttttctgctgccgctccgggtccgggccattttccgggccgggcgcactaaggtgcgcggccccggggcccagtatatgacccgccgtcctgctatccttcgcttcccccgccccatgtggctgcggggccgcggcggcgctgcccactatggcccggaaagtagttagcaggaagcggaaagcgcccgcctcgccgggagctgggagcgacgctcagggcccgcaggtgagggttgagaggccggcacctgggtggtgaggctgaggaaccaagatgggcttagggtccgcagatcctgcgacgggaatcggggtccagggtctgcagtcagaggcaaaacaggaatgggttcagggcctatagggtcaggactggaccctcgttaactggagggcagataggccagggcggtgaggagccaaaggggaactcaggaatgggacataatccgcgggaggcctgcattcgtggatagggcttgaaaagaaaccagaatcttggctttggaggaaggggaaaccgaagttaagggaatcggaaacaaactctggtagagtgaactctaccttccatgggccctaggaagctgggatgattgcgtccctcctggaagaaggaagtag

SEQ ID NO: 48234 - DNA, 1071 bp, Homo sapiens
ggaaattcccagcaaagcctaaatcgacaatttgggaatcaaaacaagttttctgaaggcatcagtaaagcagtgaataatgagaaacaagacaggtgtttttaaatcatattgctaatagtatcatgtacaaaggtaagtaatgactatttgttattgccaataaaaaaattcttacacaaataaaacatggaaaaacgttacaaagtaggtctatctctcttctggcccaataaagtctccatacacaaaaggaacattaattcagtattaaagatacttaagatgcttgacaccattagacatgaaagaaatgcaaataaaaaccacaatgagagacaacttctcacccacaagaatgtatataatgaaaacgagttaataagagtgggcaaggaagtgaagaaattggtaccctcttgtagtgctgctgggattgtaaaattgtgcagccactttggaaaaatagcagttctttaaaatgttaaacatagagttactatgacccagcaatgccattcctatacattatacccaagaaaactgaaaacatgtgtccacacaaaaatctgtttacagatgttcagagcatcattattcataatagccgaaaattagaaactaccacaatgtcccatcaactgatgaacagataaacaaagtgtgttatatccaaacaatgaaatattattcacctacaaaaataaatgaagtactaatacctcattcatacaacgtggataaaccttgaaaacattatgctaagtgaataagccagtcaccaaggctgctactgcagaattccatttatatgaaatggccagaataggcaaacccatagagacagaaagtagatactggttgccagaggctgcgaggaggctgccagaggctgtggggagtgacttctagtggacactgggtttccttttggggtgatgaaaatgttcgggaattagatagtaatgattattacacaactatgtgaatatattaaaaatcactgaactgtatgtataccttaaaaaggtgaattttggccgggcatggtggctgacacctgtaatccca

SEQ ID NO: 48235 - DNA, 1062 bp, Homo sapiens
cacgcctataatcccagcactttgggaggccagggcaggtggataacttgaggtcaggagttcgagacaagactggccaacatggtgaaactctgtctctattaaaaatacaaaagttagctgggcgtggtgccgagcgcctgtaattccagctactcaggaggctgaggcaggagaatcgcttgaacccaggaggtggaggttgtagtgagccgagatcgtgccattgcaccccagcctgggtgacagagtgagactcagtctcaaaaaaaaaaaaaaaagaaagaaaatcctagtcatcatgtcatttattccataaatattgtatatatctcagctgggcgcagtggctcacgcctgtaatcccaacacttttggaggccgaggcaggtggatcacttgaggtagatcagcctggccaacatggtgaaaccttgtctctactaaaaataaccaaaaattagttgggcatggtggcaggctgttacaaccccagctactcgggaggctgtggcaggaaaatctcttgaacccaggaggtggaggttgcagtgagctgagatcatgccactgcactccagcctgggcaacaacagagcaagactccatctcaaaaaaaaatttttttaaatgtatctcaaagagatactttttaatgtagccataatgccattatcttacctaaagaagtaattctttattatccaataagtattataattcctctaattgtcccataagtgtctttttatagttaacttgttcaaatcaaggtgccaataaaatcctatgtgagttcttattccctctttcattttttctatatcagtgtattggttgaagaaaactgggtcacttgtcctgtaagatttgccacattctgtacttggccacctgcatctttgtgttgatgtttaacatgttactcattatcctttatgtttcctgtcaggtggctaagctctatagccgtgttgttcactatggcagccaccagccacatgtggcaattgagcacttgaaatgtggctggtctgaattaagatatgctctaagtgtaaa

SEQ ID NO: 48236 - DNA, 1050 bp, Homo sapiens
gctcaagtgatcctcccacctcagcctcccgagtagctgggattacaggcatcacaccaccatgccaggctaatttttgtattttttgtaaagactgggtttctccatgttgcctcggctggtctcaaactcctgaattcaggtgatccaccctcctcagcctttcaaggtgctgggattacaagtgcctggcccacatgttacttttataatctgaagaaaaacttacttaaaaaataaactgcactttgggagtccgaggtggacagatcacttgggggcagcaatttgagaccagcctggctatcatagcgaaaccccatctctactaaaaatacaaaaaattagttgggcgtggtggctgcatgcctgtaatcccagctactcgggaggctgaggcatgagaatcgcttgaacctgggaggtggaggttgcagtaagccgagatcacacccctgcactccagcctgggtgacaaagggagactgtgtctcaaaataaataaactgtggaactctgattctgtcaaggttagtaaggtcaacgtaggtgttactccagcctcactgataaagtgtgagcaaatgaaagtgtgtgtgatgcaaaggacgttatgaattgtgtatatacattaactataataatcttgcatgtttacatatctttcatgaaagatatttacaaaagtactgggaaaaccaatatctaaaccttattggaaggaaagatactaattcccttaatcaataaatgctttctaaggtctttactcaaaagctaaagctatccatgagcacttttagaaggagagacagaattgccatatactcgctgtaataaaaggaaacaaaaaaatgtattcccactttagttgtgggttttttcttttttttttttttttttttttttgagaaatgccgaatatatccacatctatagataactatagatctagtgggtttctttgttttggatttcatacttaactataaaaacctatggtgataatttgagcaacgaattattttgtctccttgcctagaaactgtg

SEQ ID NO: 48237 - DNA, 1297 bp, Homo sapiens
cccagtaagaatccaggagcaagctttggtgaatccagtgggctgagtggctctatggatgtggttgtttggatgtggtagggagtgcttagcagaatgtgtgtgtatctctgaggctgtcagggggtgggtgggtgtgtgtctctgttggacctgtctctcctcagtctattcctgtcatagatgtgggtgtccctggtagggaagtgcctgtgtggtctgtttacagtgcagaaggcggctcagcagtgcaatgggctgacagccttggaccgggagtcagaagcctgggttctggttgtagctctggcccctccctgtgatcttcaacaagccacttgctttctctcgtcttcagtttcctcaactagaaaatgaacagcagctgaaattatgttgaagatccttttatacctgaaagagtttcttcatagaaatttctgtggtggggagggggcaatctctgtgtgtctcagtatacctaaaggttggggtggggcggagttgtgtgtctctgtagaaaggcgaaggggcagttcctatcaggactgtgtatgtctgagcacatgtggctctgtttgggattacgtgtttgtctgtgaatgtgtgtgtgtgttggagggttgtctattgtgtgtggctgtatagggtgtctgtagatcaagatgtgtatacagctgcttctgctattgctggtttgggggaggggactggaaagctgagactgaaaatcaagagggaagaggtgaggaaggcccacccctggggctgggcagtgtagacctgccaccgtgtgaagaaaaatgaaagcacagatagcctaagactgcacaggcctgtgcccacataccttatagcacaggcccaggtggatcatctcatgctaacaccccacatgtgctggtggatccactcccatggatccactcacatgctgcaggcatgcagtagactcacccacagcccactctctggacaccaatcctgggaggtgggagctggaatggggagcaatgagaggagggagtgagactgttggcttaggaagggtggtacctctccctgcatcatacccaggaactgccagctccaaaatattggggtacagctcaccaccccccactccgccaacccattcctacctcctctagtgcagggacccaagttagatgatgagaaaatgccaaacaaagggaggcaaggacagagaaggtacctgcaggacccacaaggcccatactggcccccatctgaacccacctctcccacccagatcaacatccccccaacccctgtg

SEQ ID NO: 48238 - DNA, 1072 bp, Homo sapiens
gggaagagtagatgggactcctccaagacccaggaagctacttctggtaacagttgtcacataccaggcagtggactgggtcacctgatggccagctccatgaagctggtaggctttggaaccttggagaactcagaccttggcaaaggagtcaggagcaccactcaggcagcgtagccaaatgggctcccccagccttctgccccttactttgtagccccatcctgcacctcccacaccataaccttcagtggcttcttcttccttctgcgttaatcccaaactcctctgtctggcattcaagtccttcatgttctgagtttgtaaccagagagggtcttcggccccttagcacaggaccagacttataattagtgacatggatatttgttgaataagtggctgaataaatgaattttacttctctaacctgacctctctcttcacccctctatccagagccacacttatgctcacttttaaatgcatttttgcacacactatccctccttcctagaatgtccacctctctccaggtcatggtgtcacctaaaggaagccctctctgactgcgccatccttctgtgattgtctctcccccgccagcctttccctggcatcaagtacacactaactaccctaacatgggagttgtggttcctgaaaaacagggggcagcctcctctttttgccccccactgtctgcctcaggttgtgcagggccaggtactatctccaccaagcagcaggggcctggagttgggatccctgcctcagtccttctaggagcaagtggtttcacagtggaggcccagcccaggctgccctgagtagtaagacagggtggcctcaggggcaggacacagcttccttcccatgttctcctgcagagaagcagcgggagctggcccggaagggctccctgaagaatggcagcatgggtagccctgtcaaccagcaacccaagaagaacaatgtcatggcccgaacaaggtagaggccctccctaccccacctggaccctgccagccaggacctatttctgctggtcctgagcctccccctcttccct

SEQ ID NO: 48239 - DNA, 1033 bp, Homo sapiens
acattttatatcagaagcctgccaattctactgttttttgacatcttcctttctgttcttttatcttctgctgctgcttggttcaggcccctattatctcttgctggcattgttgcagtagtttcctaattatccttacctccaatctcactcccttcccaggcgtcttgcacatggctatcggagggtccttttccatctcaaatctgaccatgttactccctgcttaaggcttcattggctccccgtcatcttctgagtaaagaaaaaaatcaaagcccaccttccagcatgatctgagccccctcctgactccacaaacttgatttcctgcaacttttctccataccttctgagcttcaactatagcaaaatgccgactattccttgaatgtactatgctagttttatgcttctgagacttttcacatgttccctgaatgtccttactcctcactcttaaactaattggtgacctaatgttttaagatcttttcaagtgtctcctttgaccaccctccctttgtcccattctctctacttttatatggctcttggttacctttattaataattattgggaacttcttaaagatgggactgttttcttttctttctttctttctttttttttttttttttgagacggagtctcgctctgtcgcccaggctggagtgcaggggtgcaatcttggctcactgcaagctccgcctcccgggttctagccattctcctgcctcagcctcccgagtagctaggactacaggcgcccaccaccgtgcctggctaagtttttgtatttttagtagagatggggtttcactgtggtctcgatctcctgacctcgtgatccacccgctttggcctcccaaagtgctaggattacaggcgtgagccaccgtgcccagcccttttttttttatttttaaagacagggtctcaatatgtcaatatgttgcgcagactggacttgaactcctgagtttaagtgatcctcctgcctcagcctcatgtagctaggactacaggtgc

SEQ ID NO: 48240 - DNA, 1026 bp, Homo sapiens
ggaaattagattcaaattgcctaccaggtgtgactttggacatattactttatgcaacctagttcttcaattttaaaatgaaaatgatatttgccttacttggttttggggaggattcaatgaaataatatagataaagcacttagcaccatggccgtacctctggcaggtatttaagcaacattaactaaatgactggatgagttttggaagaactacacctgggctaaattgttccgaacaactccctgcctggatccagccagagttcttagtagagctgcctccccaacgtgagctttgagaagtccctcctcttctctcctctcttcccagactattgttccctcttgccactaggaatgtaaccaggttaaggtcagggtggagggctctttgagaggctgtctggggatggtgtgggcgtagagaggctggcctagagccacactattccaagtgtggtcgctgtattaacagcattggtaccacctgggagctaatatgaaatgctgacaattcaggttccagacctactgaatcagaatctgcatttaaataatatgcccagatgatttctatgcacattaatatatgaagaaacactgtcctaggggcacagatgggttcagcaggggtggagggttgagacagtgcaggtgtgtcagctgtctagaagaggtagaggttgtatgggggtgggggaggctgtggcaggggggtgtactcagagaagaggaagtgtcctcagagatgtgggttgtagagctgtagggggctctttgggaaatgttggtcatttgctgtttcagcggcctttcctattgatgcctggagtacgaggtggtaccccttcctattgatgccttgagtatgagttagccggtaagtgtcactgcaccagccagggagtgacaggtgggcaggcaaaggctctctactgccctgagcctgcagagacgttcctgcaagtatcctaggaccatctagcttagcagttgagtattgttttccatggagatgcat

SEQ ID NO: 48241 - DNA, 1027 bp, Homo sapiens
ctgcctgttgaacatggttacaagaaccaggttgtcagaaagcactttgaacagacagaggatcagaacagccccactcctatctccctccaaagagttttctgatggtttggattccaagctggtttcccattcttccgaactcagtaacaagagttgggccttaatcatttgattgtggaagtatatatctgcaagctaatggctgatcttagccctttagtcacaaagaaggctgcatctatctgctcagtttgttgttagtctccatgagaagttgacctgaaattgagttgctgctttggctgtggaccttaagtgaagttttaactaggccaagccttcaggtgagttgaaggagggtttgggggactcctactttggctgttctccaaaataactttgagcccctgaccagaggcttacagtgaagaagtagtcctacaaagagcacaaaatgcaacatctgtctgtgggacaccattagacaagactccagcatggtctgataggtcaggagtgtttgccacctctctgttatagaaagatccttgctatgccttcaaatcaagtagaaggcagtgtttgtcttttcagattatggcctttcattttctatgccaagcattgggaggacatagtggaggcaggcatggtccctaccttcacgaacatttattaaacaaattatacaaatagtcatttaaataaaatttgctaagtgcatgaaagaaatgtatgggggagcaggggctgtgagactacattatagaaggatctaactgagcctggcatttatgggaagcttcttttaagaggtgatgtgtcccagcctgggcaacgtagactccatgtcaacaaaaatatgtatgtatacaaaaattagccaggtgtggtggcgtgcacctgtagtcccagctacttgggaggctgaggtaggtggatcacttgagcccaggaggctgaggctgcagtgagccgagattgcgccactgcactccagcctgggcaactgagtaaggcactg

SEQ ID NO: 48242 - DNA, 1083 bp, Homo sapiens
agaaaaccatcaacattgagcagataccttcctgtttcttactccctgttgagagatctcctacagttccactttcaccatataagaaaaggaaagcaaggggacaaatttactctcacattccccaaggtaaaactatgatcactaatatttgaatgttctggatggttctctttggcttctggccttcctcccattagtgttgtctcttgttgtgttatcgttttctgtatggccattttatgtggtaaagtaggaaagggaccaggaaacttggggcccagttctggatatgggacttcaggggagttactcagctttatagggcttcagattctttttctctgtaaaattgagataaatgatagatggattatcagagattaaatgaaataaaatgaggaaaaagccttgaaattttaagttgcaatataaaaataaatatctatattttctgaatttaaccttttctgatttgtattgtaaactcttatgtcaagaagcatgtctctaaatctgtttactgtggtatagcaatttaataggaagattggagagatactgaagaatctggagaggccacttcattcttttttttttttttttttttttttttgagacggagtctagctctgttgcccaggctggagtgcagtggcgcgatcttggctcactgcaagctccgcctcccgggttcacgccattctcctgcctcagcctcccgagtagctgggactacagacgcccgccaccacacccagctaattttttgtatttttagtagagacggggtttcaccgtgttagccaggatggtcttgatctcctgaccttgtgatccgcccgcctcggcctcccaaagtgctgggattacaggcatgagccaccgcgcccggccgaggccacttcattcttaaaaccaacctgagcaacggggagggcagaggagagtcggaggcttatttcctacttgattcacttctgtattgtgttactttccccattgaatatgcattacctttataagttaaggaaaccaatacagattttttttaatggcttaaaatgatacagtcagtctgga

SEQ ID NO: 48243 - DNA, 1466 bp, Homo sapiens
tttttctacttgatcttcagcactggtttctgaagtattgaattaatataaagtttaaaatccttttgaaataaataggccaggtgagagggagtaacctggactctgctgagcagataagagggggaaagaagcagattcaggaaaagatctcatgaatttcatatgagtggttggccacacttaatatgaaattataagcccttgaccaaagaagcaagaaggaataggctacaagaagagacccataagccagaagtcactggcgaggaaaggccctattataggttatacagccttagcgctcttttgtttacccaggctaaataggcctgctttttccttttaccatttcccgggacactggcttccaaattcgcagtcatcctagctgccctagtggatacttttaggtttctcacccctgaaactgaacacagagctgtacatgtgatctgcacagcacagattattgtgggactgccactacccataatattgatattgtacttctattattgtcagttgagcttccatgatcatatttaataaccatacctattgttatattgaactcagaacatatctggaacagagcagccctttcccttagcagtgtaaaatcaaggcaagaacctggaatcacatcttgagctaggcttactgccaatacaggttaagagtccactgaggatagtgagatgatggttccacatttgttagaaactacactacatgtgtgtcatgtgactcttattctcagaaaggtagctggctgaattcagcaagacagaatttcaataggaatctagggaggctgtgtgattggagaaggtagggacctttaaagcgagctagtgcttgagtggacagaaagcttaatataagtccactatataacaaagctaatgtgctgttggactacattaatagaagcatggaattcagttcctaggaggtaatcatcctactctgccctattctgtagtggtcatcaccatctgaagtcctccattctgtactgatatcatcattcaagagattgggtgactagaataatgaaaggagtcaaaagcatgtcatgtgagaatagttagaagaactgagctgtttggcctatgaataagcagtctcagagaaagcattttgaggttttcaaatacctaaaggactgggattaggaaagaaaaggaggatagtcttcatgttatctgtagcttcacagggagaaccagagccatggtgggaatgtgaatgtgttcttacctcacattctctatggtatcagttcttaaactgggccagaggccagggcaccaggaagacacactgctctgtgcaaatgtcctagtccttccaaagtaggtgctaggaataatattctagcagtaaacatggctctgttatgtgtgtgtactataaacgtgtccaagaatccactgtggaacttagcacaagcagcactt

SEQ ID NO: 48244 - DNA, 1034 bp, Homo sapiens
tatactcttcgctcctatgctcggggcctccggcttgagctcaccacctacctctttggccaggacccttgaccagccaggcctgaaggaagacctgcggatagacaggagcgggcaggcccgcacatatccacttgctggagcccatgtttacagacagggacatacaccatgcagatcctgagttcctgctgtatgagcagggatatccatgcttatgtatccaaacacagagacccatgggaacaaatgagacacatatagatactgagacctgtgtgtacagtaggaccatgcactcacacccatctggagagggagcccccggtataccaagggagccagttgtgttcagacacacacatcacagcttgactcactaactgaggcctttccatagctccacagcttcccacctcctccccaccaaaccggggttctagagttaaggatgggggagggtattatactgcctcagtctgactcctcaacccagcagcaatttgaggggatgagggggaagaggagctgccttttggaggcccccttcacctgcagctatgatgcccttccccttctcccctgtcctcaccatatgccttatccccattctactcccctgctatgcaagtgcccctgtggcttgtccccaaccccctcagcaacaaagctcagctggggaacgagagtaatttgaagaatgcttgaagtcagcgtcttccattccagaaagacccccattcttcctttgggggtatgatgtggaagctggtttcagcccaggacccaccactgaggagaggatctagacaggtgggcctaattccaaggggcccttcctggcctggagaaggccttttacacacacacaacacatacacacacacacacacacacacatatcacagttttcacacagcccctgctgcattctctgtccatctgtctgtttctattaataaagatttgttgatctgttccatctttttgtgtgtctgagcagccggaaaaagcctctgacccctggggacctc

SEQ ID NO: 48245 - DNA, 1067 bp, Homo sapiens
gctcccagcttgaactgcctcctctccgcttcagtcctggtaaaggcgggccttaacaatcgttgagtcccagaaggcttcacttccgggctcgtctgcttcaccagccagtgagctcgggcgagcccgtccattctgggtctcactatccccacacctatccgtatgtagagtggcgctagctaggtcagacctcgcctgaagaccctgacatctgccgctgggcgacttggccccgcccccttgcctcccttgcgcggcaccgccccactcctccgtgctccccccgaggaaatggttcaaccgaagggcggtgccaaggtgcccgggccgctccgattggtcagggcgagccgtaccacggcggtggcgggggagcgcttcgtgggcagccggcgggctccgaggccgtgagcgcaaagcctcaggccccggctccctcctgagctgcgccgtgccaggccgcccgccgggatgcagtgggccgtgggccggcggtgggcgtgggccgcgctgctcctggctgtcgcagcggtgctgacccaggtcgtctggctctggctgggtacgcagagcttcgtcttccagcgcgaagagatagcgcagttggcgcggcagtacgctggtgagcgggcagagggcagggaggggagcggccggcctgggagcggagcctagggttccgaaggcgccatccccggacctaggaccggtgccagccctgactccgccgcccctctgcctccgccagggctggaccacgagctggccttctctcgtctgatcgtggagctgcggcggctgcacccaggccacgtgctgcccgacgaggagctgcagtgggtgttcgtgaatgcgggtggctggatgggcgccatgtgccttctgcacgcctcgctgtccgagtatgtgctgctcttcggcaccgccttgggctcccgcggccactcgggtcagtgctagcggcgggccagactgggaggctggggttgtaaaggggcccatgccctcctttctgatgtttggctgggccatgcaatggcgcgaataccctgatagtgtcatgt

SEQ ID NO: 48246 - DNA, 1364 bp, Homo sapiens
tgggtgctgacttagcagccctgtgctcagaggctgctctgcaagccatccgcaagaagatggatctcattgacctagaggatgagaccattgatgccgaggtcatgaactctctagcagttactatggatgacttccgggtaaggaccacacccgtgcctcaggtacacacatacgtgctttgacccctcccttgataagtctcatccccagttttccctccttttctagtgggccttgagccagagtaacccatcagcactgcgggaaaccgtggtagaggtgccacaggtaacctgggaagacatcgggggcctagaggatgtcaaacgtgagctacaggagctggtccaggtagggcaacttggtccagggtgagtcactgtctcagtacattgtaattgatctgggtgatctcagggtgtcaacacatttgctgcaagagttgtgagagcacgacttaggaacctactgttcttaggtttgaggcactaaggagtcttcttctagagaacctggatctgataccattgggtacaccatgaaataatggaggggatgcttctgtttagttaggtttctttcaaaatgtggaggtagccttgaaccctctttccttttcctcctagtatcctgtggagcacccagacaaattcctgaagtttggcatgacaccttccaagggagttctgttctatggacctcctggctgtgggaaaactttgttggccaaagccattgctaatgaatgccaggccaacttcatctccatcaagggtcctgagctgctcaccatgtggtttggggagtctgaggccaatgtcagagaaatctttgacaaggtgagctacaataggctgaactatgtattgatttgcctgagggcaaggaatagaggctgtttttctttaagagggttgaaatattcttagtgctggctgctcaactgcacagtaagtcacttgattttctttctgaggtctgagagacctagtgttattttttttttctctctctctctcttgagacagggtctggctctgttgcccaggttggagggcagtggtacagtcatggctcactgtaaccttgaaacctgggcttaagcaattctcctacttcagcctcctgagtagctgggactataggcatgcgtcaccacatctggctaattttttattttttgtagagacaaagtctcagtatgttgcccatgctggtttcggatttctggcctcaagtgatcctcccaccttggcctcccaaagtgctgggaatacaggtgtgagccaccacgtttgcctagagacatctagttttgttagtgcttgaatcaatccattcctcctacaggcccgccaagc

SEQ ID NO: 48247 - DNA, 1094 bp, Homo sapiens
gtctcttgcaaattgtgaggatatttccaatgggaatactattttgtcttgttttgttgacttcagtatccccagcccttagaacaatgcctggtacataatagagactcatgaatttgttgaatgaagaaattcgttttaaaaatttattttctttgcttccttcattgtctggccttcctactttggttaatgcttatgttttcctgagccttactaacacgaggccgctcttaaaaaagagagagcgctgggtgctgtggctcacgcctgtaatcccagtactttgggaggccgaggtgggcagatcacctgaggtcaggagttcgagaccagcctgaccaccatggtgaaaccccatctctagtaaaaatgcaaaattagccaggtgtggtggcgcatgcctgtaatcccagctactcgggaggctgaggcaggagaatcacttgaacccgggaggtggaggttgcagttagctgagatcgcagcattgcattccagcctggacaacaaaagcgaaactccatctcaaaaaaaaaaaaaaaaaaaaaaaaagggagagggagcttgctgagtctagtaagtgacagctggaaacgggctaggtaataagttggtgtcactgtctggtgaatgatcctagcttctaggaaataacactgagtgtagacccagtcgactttgatttgggtgagagggatttggatttgccccatgtctcagcatttcttggttttgattttttgagccaactttatggaattgtgtacttttgcagatattactgtgaagttccttttgaccttgagcctctttctggcggtttgatgtctgttagtgttttttccaaatatgatggtctttatgcttggcattcctttggtactatggaatgccctggcatcagtaggtttagcctataaggagggtagcaccaatgattctgcttcgttgtccccaggcttgcttggtagaacttaaggcctccctgagcctcaagggaggttgtctggcttacttaattccctggaaagttagcttatgctttactctatactgttaatcatggtgaccattaataccatgtgccaggt

SEQ ID NO: 48248 - DNA, 1050 bp, Homo sapiens
ctcagtttccctttttataaaacaatgcctaagactatgtcaagttctaagactctgtactctgggctggggctacaggtaatcgagacacttactttcacctgcttcagactctgaagaggctagatcggagggatgaggccactgcactctggtggaggctggaggcccaaactaaggggtcacatgaagatgctctgtggtgaggctcaggcctgctggcttggggctgaggggcagttggtgtcctagagtccttggacctattgtgggtggtgaacactgaaagcgggggtatggctgcccagctttctgccaatctttcacccttaggcatcatccttctttctctccaggtctctccccctgtacctagaaagctatttgagctggatccgtccctctgatcgtgacgccttccttgaagaatttcggacatctctgccaaagtcttgtgacctgtagctgccacgttttgaagagcttgagctgggtccccagtgggctgtctctctgtggggagggctttctgcttcaccatcattaggaatgtgaccattcctatataattcctggactggtgagattggtggtaggcctgtgaaatttgccctagttactaccattctcgttttggaggaaacaatctctgccaccaccaagtcattgactttgctcgaggcaccttttttcctgtttctccttttctgttgtcgagtaaaatttcatatttatctcgtctgcctactacatatacttgcgtgggaaggcttgtgaccgtctagttgagtgctagttgtctatgatgccctttcctgacatcgtctaccttatgaacttgaagtctgggtatgaggaaagggctacaggaatcctcactttggaggcagtggctttagtccttcacattgcctgaatgcagagccccaaagcccaggacagtgacaatgagtggagttgggtctgaagggtggtctagataggcctctcaggacaagggcaggtacctgttacttagagacaggcaggtttctctcagagtaactcttc

SEQ ID NO: 48249 - DNA, 1076 bp, Homo sapiens
ctagcctcaccccttcattgtggcactcagagccagaccaagcacatactagcaagcaggtgcctacagacggggaggtgaggttccccttgctcacctgagcttctcttcccacttctgatgcctcccctggggtgtgactctgcttttgttcttgtgacttgggggatgaatgaggcagtggcaggacataggtcgccactcctcagcctcttaccttgcttctagacctgaactgaggactcttctctaagacattaaccttctctatctttgacactctgaagtctcttccccagtccattctgtaactggggtagatccatactgagccaaaattggagccctaagaccttccctccctttctcctcctcagggcccatgaacatccatctgttagctaagagagaacattctcaggacccttgcaggttccctgctagggcctagggtgaggcttatgggcttttactcctcagggcaggagacgctgcagagcattacttggacctgctggccctgttgctggatagctcggagccaagggtgggtgtgtcttcaagcttctctgcaatggggtagacgggttggtgtcccctttgaaatacagcaagactgcaattttttgttttttcctctattctgtctgtccagtctgggggcccaggactctgcatggtaccagagcctggtgaagaggttggggatggtggctcatgcctttcaagacactgcttcttcttcccactccagttctccccacccccctcccctccagggccctgtatgcctgaggtgtttttggaggcagcggtagcactgatccaggcaggcagagcccaagatgccttgactctatgtgaggagttgctcagccgcacatcatctctgctacccaagatgtcccggctgtgggaagatgccagaaaaggaaccaaggaactgccatactgcccactctgggtctctgccacccacctgcttcagggccaggcctgggttcaactgggtgcccaaaaagtggcaattagtgaatttagcaggtgagcccggggtcctagagggggtgtggagg

SEQ ID NO: 48250 - DNA, 1029 bp, Homo sapiens
gcttttgttaggaggtggaatatttcctccaactagagaggagaggatggctgtagacacgtttgcagattggtggtaggaagtaagagagctcacatatgatggcttcctttttccttctgaggtatgagtcaagactaccaacagcatagggaaggaaacagggagggtgagaggtagaagagagtaatgaagggatgaaacatttgttgcaaagagtagagtaggatacttgttagagaaatatagtaagactgctgccaatattaacttcggtaatgatgaatttatttttaaattttttggaacataaactcaagattttattgtcttcataacaaaacaaaagatgacacttaaaactggatcacttggccttttcacttatctcctcccagttcaaagtgcttgcatctcttaatagccacattttctcagatctgaaattgagctcaacacactcaagccttagcacaatcttctctgtagttttagcttttttctggaaaatcggcttactctgcccaccatagccactgtgcttcctgtcataatgctgctttccctagacacacagagaatccttgcccttcttggactatgtcactttgtggagttggtgcttgtgatacttcttacagaaagtctggtgggtttggggaacattcaccatgttcgctggagtgctgtcagctggtaatgatgaatttagagtgatgctaaatatgctggcctgtacaactttctccagcaaagctgagctatttgagtacagacatggagaaggtaaggggttatattcattcagggttggggttttatcaggcaagtatacttttaaaagaatgtagtatcagtgaagttttattgaagttaaaggactactagtgaggatgcttcaacaagtgaatggaattcactaagctataaatcataaaatctatgtggcaacatggataaatgcttaggaactaaattaaagcagaatataaaataatcttaatgctacaattacatccatgcaaaatt

SEQ ID NO: 48251 - DNA, 1049 bp, Homo sapiens
gcaaatagcatagtccatttatagtcaaaatctcagaataagaacaagccctttgccaaaaacacagcccatctggcatcaagccctaggggcccacccaaaggaggcaggacctgggaaatctaacagcccaacccagtaatacacaacagtgctctagaagagtttccttctctgctttgggcaaacgtttgaaggaatctgcggccctgagaaccttaaatgccaaagtctcacccaaggactaaaggaattactcaataaatcttaactgagtacctccaaagtgccagacactgtagtgtgtgaaagaaaaaaacctgatgcctgccttcatggagtttatagttcacccagggagactaaacaaataaataactatgactgtatactcgattaagtaggcctttggaatgtgctgcattcaaaggaaagatagttaaatcatgaaagccagctccatccagggaggccaattagcatatttattaatcagggtccagtttacactgtattggcaattaaaattatctgttttctctttaaaaatttttattgtagagacggggtctcactatgttggcaaagctggtcttgaactcccgggctcaagcaatcctcccacctcggcctcccaaagttctggaattacaggtgtgagccaccatatgcccagccaattacttatgcctgaattgaaaactcttgaaaagtcaccggaatctatcaataacatactcttggttaagctccacttttattcccattcattttgtgggaattcagtacctatttttatattacatatttttatttaaggcataggaactcacttcaattaacaaactactgtccattacactggagaaatagaaccctgatttgctcttttcagcatcaggccattcatttttgtttctttctggtcaatgtaaagagctaagaaaaggtaggtatagaactctgctcttcaggactaattctgtagcagctggcaagttatttgattcccctcagcctctgtttcattttaaaatggggataatacc

SEQ ID NO: 48252 - DNA, 1026 bp, Homo sapiens
atttttttttttttgatacagagtcatgctctgtcacccaggctggagtgcagtggcatgatctcggctcactgcaacctctgcctcctggttcaagtgattcttctgcctcagcctcccaagtagctgggattacaggtgtgtgccaccacacctggctaatttttgtatgtttagtagagatggggttttgccatattggccaggctggtctcgaattcctgacctcaagtaatctgcccaccttggcctccccaggtgttgggattacaggcatgagacactgcacctggcccattataagcatttttgaaaacatcatcccaaacaaaaactgaaactttgacaataacatacatctaactatgtggttccccctttcccaccccttttgtttctcaccatctgaggtgagcatttgaaacccatttttatcattcccttgctttcctttttatgcagttttatgcatctgcatgtatttttcaaactaaaaaaggttttgtgttgcatgtaatcttttggagtttattcaattcttgtttcaattttggtggactgttgatttcaggaattttttcaaaggtcctgtgattttcttttattcatccttgcagaggggatttatgcttgcctagggttgacatacaatcaaatgattgatttgggatctgtatgaaattttatagcagttcctggtcagaatcaaaggcagaacagaaggctataggctgccattgtggggacccagcaggctgtgtggactgagtggggcgctgtctccagttaaacattttctctccactgccacatccaacactggccactgggtgtggcagctcccatcagagcaagttgtggtcatgtttctgtgatgtctgtccctggaaggaggcacagaggcagcaagcattcctgtggtgcctcagctggccccgtcactcctttctcagattagaacacccttcagggatctagaaatattctttattcagatggaaacaatcatagtaacaggccattcta

SEQ ID NO: 48253 - DNA, 1031 bp, Homo sapiens
tggatgtacatctatggctttgcattaatagattgttatttattctagtcttcactggctgacttgtttaggtctttctagggtatgtttgcttagaggttctttgcagttgcccagtgagtccccttattcctagatcaccatctcctttttggtaatagatggtgccttaagcccaggtttgccttggctcttgcaaacattcagagcactgcccgtctcaaatggggttgtagggggaggtcccaaagggaatgtggggaggctggctaggcgtttgtgaccggaaaacctgtggagtatttctcttaacagtgtggagctattgagaagtcactttaatttggcatctcctttggctgagatgaagaacagagttacatgggctagggttgctagtcctgtctcctctctttgtttctagctgttcttggggattttttcttctacaggcacttgtgatgcctcctgtgggttgaagcaggaatggttttcctgcaagggaatgcaagatgatgggaaagctggttgtctacctcagtctcacattttctggtgtagaaactgtgaacccaggagcaattttccatgtgtggtgcctggaaaactgagtgagggttgtcacagatagagaagtctgtttctctatctgctcaaagtttttccacttctgtgtccctggggattgtctcagcctcatatttgagttctgggatattgctgatgataattttggtcctggatatttgtttttggttttctgtgggagggagtgaagccagattacttctactctgctattttggtggcatcagtcttctacattaattaattttctgttaaaccaacattgcatttataggataaatatattgttatatatatttaataactttcttagtggttgctgtagggattacaataataatcactgggtggggtagcttatgcctataatcccagcactttgggaggctcaggtgggaggactgcttgagccctggagttcaagactgacctgggcagtgaga

SEQ ID NO: 48254 - DNA, 1271 bp, Homo sapiens
agtcccagccctcctccagcagccctagctggtacctgggtgtgcccggaggtcgggattggcgcggtctcctaggaccccggacagcgcagacacaagcagcagccccaccacacccaagagcgaaactgcgcccgccattgccggcccacgggtggagggatcgggcgggcggtgccgaagcggtccggcattggccggccgccccaacgcgcacgcgcacgcgagcaggccggccggctccggggaggccacgcccactccccgtagggcggggccagaccatatttgcataagatagtgtcattctagctttcctgtatttgttcatttcgtgtctattagctattctgctagccacaatgcctctgaaagcctatagtcttagaaagttatgcccgaaaacggtttttttaatctcacgccaccaactttctcaccctaatcataaaacacaatttctttagggctataaaatactactctgtgaagctgaggacgtggttcgtgctgaaggcctgtatcctaggctacacactgaggactctgttcctcccctttccgcctaggggaaagtccccggacctcgggcagagagtgccacgtgcatacgcacgtagacattccccgcttcccactccaaagtccgccaagaagcgtatcccgctgagcggcgtggcgcgggggcgtcatccgtcagctccctctagttacgcaggcagtgcgtgtccgcgcaccaaccacacggggctcattctcagcgcggctgttttttgttcccgagaccacggctcactgcagcctcgacctccccgggctcacgcgatgcctcacctcaggctcccaagtagttgggaccgcaggcgcacgccatcatgcctggctaatttttgtattttttgtagagacggattttcacctgttgcccaggctggtctcgaacgcctggtgtcaagcgatcagtccacctcgccctcccaaagtgctgggattacaggcgtgacaccgcgcccggtcaacgcggctgcttttcatgcgcgggcagctttacgctgttcttggccttgctatgaagtccttgtgctcattactccaaatatggagcattcctgaaacagcctcctcttctacctccctctccctttggcaaacgccatagtagccaccattcactgtgtagctggtacacaacatatggactctgcttgggctagaatcctgcctcctgtactcaagagcggtgaccttgtgaaacttagttctctctccgt

SEQ ID NO: 48255 - DNA, 1050 bp, Homo sapiens
acaaggcctttttgacccctgacctctgacccacaggctgaggcagatgtggcctccctgaaccgccgcattcagctggttgaggaggagctggaccgggcccaggagcgcctggctacagccctgcagaagctggaggaggccgagaaggcggctgatgagagcgagaggtggtcaggggcctcggggaggatggtccgggagggagaagggagcctgtctctgctggtcctgaccctacgctcaccctctccctgcctttcagaggaatgaaggtcatcgaaaaccgggccatgaaggatgaggagaagatggaactgcaggagatgcagctgaaggaggccaagcacatcgctgaggattcagaccgcaaatatgaagaggtgacagccttgcccctctgcctgctcgctgcccagcctgcaacatgcccagtccttctccactgatctaccctctctttctcactccccacaggtggccaggaagctggtgatcctggaaggagagctggagcgctcggaggagagggctgaggtggccgagaggtaaagatacccgggggtgacaagtgagcccattggccctggggccttccacacagtgggaaggtagcatcctaggcttggggctgtagggacaggccctgttctctgacccctgcccgctgcccccagccgagccagacagctggaggaggaacttcgaaccatggaccaggccctcaagtccctgatggcctcagaggaggaggtagtgacccctctgaacctttctgggcaatggcgccttctctcagctcaccttccctccgtctcagcaccgcaggctgctctttctcagctgctggggatcaggaagggcctggggcttctgagccctgcctgctgtcactctcacaactttgctcttctcttctctcctccacccgtcccctgctgtgccatctccactgtctggcttcgctgtgccctcacaccctgccccccccgccacacaccccctgcagtaaatgtggggacctagaggaggagctgaaaattgttacca

SEQ ID NO: 48256 - DNA, 1058 bp, Homo sapiens
tctcaaaaaaaaaaaagaagagtttacacgaagtcacctctatttcagaagataatctagactctattccctcagagtcttttttctccccaaagataacactgtcctaggtatttcctcatacccccaggcccacagttcatggcccacatgtcccctgatgctgtctaccacatgctgaccctcccttttctggtgtagcctgaaggacttcctgcccaaggagtatgtgaagcagaagggagagcgtaagatcttccaggtgaatgtgggtaggggaaagtatttgggatgaccgcggagctttgctgcttaatcttactgactaaatggccccctgcctcctccccgtctcccctaacttggctttcacccaccgggctgttatcccacctcacctctgccaagaaagcagacagcttgggcttttagtctcagctccatccctgcttttgctgtgcaattcagttcaatattcttgtaatcttttatttacctctgatttgggataacagtacttgccccgtgtaggactgataggatcaaatgaggtagcataatctgaaattactgtgaaagagtatagtctttgtccactataaggtgttacccccactctgaatactcagcccagaaggccttctctttgcccttctacttccaaactctctgttcatatctccagaatgtctgcaagttccttgactgtatcccttgactcatcgcttctgcatagcccttatcagcctccatcccgttaccctctcgttctcatatcttgtactcctcaacctttccagtgtccccataattctctctcgttagagttagcatccaaccttaattccttagctgtgatatgaaactctttgctaaattcttccccattttatgcacaggcacacaagaattgtgggcagatgagtgagattgaggccaaggtccgctacgtgaagctagcccgttctctcaagacttacggtgtctccttcttcctggtgaaggtaggttatgggcccttttcactgccctccttgtttcccactcttgcccttttc

SEQ ID NO: 48257 - DNA, 1066 bp, Homo sapiens
ccggacagggaagagccagcaggacacagcaggagacaaagagagaaaaatactgaaccaggcaaaaatgaaaagaaggcaggagtagggctgagaaaggtgatcagggacaaggggcaagagagatacttggatgaaagtagggaggtacaaattccagtggtggggcagggcagtgtcctcaggtagcactgcatttcagacctgctattgtaccttgcagaccagcttctcctttccctcagatgtcttaaattgttaggacttggccgggcgtggtggctcacgcctgtaatcccagcacttggggaggccaaggtggatcacgaggtcaggagatcgagaccatcctggctaacatggtgaaaccccgtctctactaaaaatacaaaaaattagccaggcatggcagcgggcgcctgtagtcccagctactggggaggctgagacaggagaatggcgtgaatccaggaggcggagcttgcagcgagctgagatcgcaccactgtactctagcctgggcaacagaacgaaactctgtctcaaaaaaaaaaattgtcaggactcattcttttgatgtaaataatttttcactctttaaaattattaaatacaatgaaaacaaccttattaccatctactttggtgagtccctttcaaaaacactcttcccttggactccaccatctggggggcctcttctcccaccagaagagtgtattctaatgccctgatgccatgggtcaggtatagccaggctggagaaaagaagctgccaccatggttgcactttcactgaagatcagcattgggaatgtggtgaagacgatgcagtttgagccgtctaccatggtgtacgacgcctgccgcatcattcgtgagcggatcccagaggccccagctggtcctcgtgagtctgactcccccggtggctggagtgggagtcttcagtcccttcttgttcccaggctctcggccttgagagttgacccctttgtcccctaagactactcacccctcaggtctgtgttccatggttccctcgttctttaggcccaaggtcatg

SEQ ID NO: 48258 - DNA, 1033 bp, Homo sapiens
gttttcttctatcctcagccggggccaagaagcctatgagagactgctgtggaatggtgagttcggggagcctaagtagtcttaaggcagctgagaggacaccaggagccttatttttctcttcctcgactccaggccgctattacaactatgacagcagctctcggcctcagtctcgtagtgttatgtctgaccagtgtgctggacagtggttcctgaaggcctgtggcctaggagaaggagacactgaggtgagagaggaggaggagcagccagagagaaaaatgggttttccctggaggtgggaagtaagtatatgagaccatgttcctgcccttgcccctccaggtgtttcctacccaacatgtggtccgtgctctccaaactatctttgagctgaacgtccaggcctttgcaggaggggccatgggggctgtgaatgggatgcagccccatggtgtccctgataaatccagtgtgcagtctgatgaagtctgggtgggtgtggtctacgggctggcagctaccatgatccaagaggtaatgcactccttttcccatctctccaccatctgtatcctggcccagaaaacttcctcaaccaccaaatttcttcaaggcataacccaatgccatcttgtccgtctataaagcctcccatttttccctggtatgcattccagctcctgccttcaggcttctgtctgtgggtcatagttatctcctccacttgctgggagctccttgaaggcaaagactctactgcctccatctatccagtggaagtggctcttcagagggtgccaagttagtatgtatgactgtcatctctcccaacagggcctgacttgggagggcttccagacagctgaaggctgctaccgtaccgtgtgggagcgcctgggtctggccttccagaccccagaggcatactgccagcagcgagtgttccgctcactggcctacatgcggccactgagcatatgggccatgcagctagccctgcaacagcagcagcacaaaaaggcctcct

SEQ ID NO: 48259 - DNA, 1362 bp, Homo sapiens
accattccaacaaaatgaaaaattattttatacagttgtccctcagtatccatggggggttgggcccaggacctgctatccgaggatgctcaagtctttgatttgaaatggcttatagtatttgcaaataaccattgcacatcctcctatatactttaaatcatctgtagattacttataatacctcatacattgttacataaacccttgttgtgccgtacagtaaataaagtgtgtacatattcggtacagacacaactttttttccacatattttagatttggttggttgaatccactgatgtggaactcacagatatggagagcccactgtatacaataaaaatatttgacatagtttgaaccagggaaagggatattaatccctcatagctcctaccctccaagagctaaaactttttttgagaaaataagacttaggggaaatggagactgtgagaccacatcagtgctaaaaggagaggggtggatagtatactgtggaaaaagggacggtgctgcagatttcgctcattccctccacatacatgccaactctgaagaagggtgcatcagtgaattaaaaaatgtccctaccctcagaagaatccatacagcagtcagggacacagaatggtcagtcaatacattataacataatacaccaaatgctagaatagaaggggaggggggcacacataatgactcactgctggaagaagtagaggaggaagagatggcttttgacctaggctttgaaggatgagaggtttcaccagatagcgaacaagcatgagcacaggcatggaggagagaatgtagtgtgctcaaggaacagtgagtgtttttatatgaacagactataggtgcttgaacaggtgatgagtctgatgggcagggagaggccagctcaagaagggccttgaaagccaggcaagagttgagactttagcctgagggccatggggagtcactgaaacatcctaaccaaggactgacatatcttgatttgcctgtgagaaagatcactctgctacccagatgaaaagggccacagaaaaagcaggagattgggcttaagtgaggtgctaacaccaccgtagtggagaagggagagaaagcttgggagatagatggatggggaggtagcaggacttggtgattcactgagcctgggggatgacttgaagctgatggtgcagtggtaacagttgcaggctctgaaaggggaggagctgatttgaggagagggaagacttagtctgtggtccctgtggtttaccccgttccagcctatctgccctcttaagttcacagtgtgcctgcgtcgggaagggcagactgtgtaccagcaagtcctgt

SEQ ID NO: 48260 - DNA, 1073 bp, Homo sapiens
gccctccagcaccacccagaaagactcgtaccagccaccaggaaacgtctattggccacttcgaggtgtgaaatgtgagagggtaggccagaacgagcccattactcagagggaagaagaggaaggaatttctggtggggctgtggattctccagtggatataagggcggaaccccaaggttcttcttccttttctcaagttagtttcttctgggcctccttcttaaccagaccccaccttgcccaccccccaactctctcacagggaagcgtgaagccatgctggagatgctcctgcagcatcagatctggtaagggattgggtaaaggggaagagggatggggaggagaaaaattgggtgagaatggccttgacacccctcgggctacatagtaaagaggtgcaggcagaacaggaacccacaaggaagctcttcgaggttgagtctgtgacacaccatgactaccgaatggagctggcacaagcagggactcctgccccaacaaaggtgagaacccaccccccatcccccgccacttgcaccagctgggctctgacaggctgtggccaagtaccaagcccagaggttgagagagagggctgaaggccaggagttactcagtaccctccctcacagcctcacgactaccgccaggagcaacctgagaccttctggatacagagggcaccacagctgccggtgtgtgagggtgactaggtgttgggggcagagcggggcaggaaaggtagggcagagttgttttgttctggcttggggagagtgggatccatcctcatcctggcactcctccagggtgtcagtaacatcaggacattggacacaccattccggaagaactgcagcttctcaacaccagtacccttgtctctggggaaacttttgccctatgaacctgagaattacccctaccaattgggagaaatatcttcccttccctgtcccggaggaaggctgggtggtggaggggggagaatgactcctttctgaggggtgaggagggaagtggggtatggaatatggaatctatttctgtctgcactagagaggtcg

SEQ ID NO: 48261 - DNA, 1049 bp, Homo sapiens
acccacaaggtgggcatgcatttttgctgcactgtccccacagctgtgtttgaaatcacagtgacccaagcagatgggtcacagggcatcagaggatctgctaaaaacatttccatccaaaatgctgccagagaatgctttgatgcctagtgggcttcagctgtctaaagaagtatctatagaccctcacatgccaaagctctgctaaatagatgaggcgttgtgatatcatagttttctgtttcaggtaaagcaccctcagtgatttctatccctcgctgtaggaatcggtggtggaattatccatcagcatgaattgatccacggaagctccttctgtgctgcagaactgggccaccttgttgtgtctctggatgggcctgattgttcctgtggaagccatgggtgcattgaagcatacgcctctggaatggccttgcagagggaggcaaaaaagctccatgatggttggtgtccctctctcgaggaattaagtaaccaaatagtagacaagtacttcaaagtggaaattccaaagacagctgaacactgaagccagaagtttcccccttttcacttcttagggaaagagcagggctccctcgcactaaaactgcacagtcttcttggctgacccatattgccactcttcctccccaggggtggtggtggacagaggtctagagttccaagacagcagggaagatttccttcagttttgttttctcagccagtatcacagggagggtacttaatacacattttaatgaagaaataaatggacaaaacatgttatgtatatatcacacatacatgcactgtatgtgtagtatatctgtgcttcatacataaaaacagtgtagatttttggcccccaaaaccaatttgtgagcatatgctgaaggaaaagagatggggagtggaggccgagagtgcaggagagaagtgtatagagccctacagtagggttctgaagaggtgggaagagatgagctgcaaagccaggcagagggtccacgagagggcatggcgagccgagatgatgggtg

SEQ ID NO: 48262 - DNA, 1033 bp, Homo sapiens
tgtttgcccctagggttgtcagtgcatcagaaatacttctaaatagtggtaaaaatgcacatggttaatgcacatgttacttttaaatcattaggatatccctcacctgttcctgatgaataaaaagtgtgttaaagaccaaaattcttggcataataatcagctacatacaaatcacatatagtttaatcttttttaatgaaaaaaaatcatgtttaaaatggcaaaagcccatcttatacacttttatatagctgcaaaaaatttatatctgtacagatctaacactacgacactcagtattcattttattgaagcatgcaagtaaagcactttttctaatttatatagaggtatctaattaacacagcacattgtactaatgactaggagtagcagctttttcttctctccctctatgaattcttataatgtccctttttctgtaagtttttgagaggcaattggcaatttaggaggcagcagggtctgttttggtcaaatcttgaatttcgttgttgcactctagtgactgatctttgggaatgtcttgtctttgcatggggctcatagagatgtgtgcagacttgcttattgtggttagtgtgtatcaggaacacacacacaggtgttctgaccagctcaggcttgccacagtgagcaactctgtggctagcaaaagagaagtttatttgtgcccagccattggtcaccttgggtgatgcaccagatagcaggcagatgttggttcattggccttcgtcctctttcctcctaaaataatattggctttaccatcttaactcagctgtgggttttttgtgggttcttgtttgttttttggcatgaattgtcatctttggtgtttttttaacccccagcccctcaaaaaaataaggcctccaggtatcaagatctcatattaggattttctgtccttaattttttgagcaaaatctggaaaatgtgaaagcatatttagattttatatactatctgaaatgtgatttgttaagattcttaaatttgggcc

SEQ ID NO: 48263 - DNA, 1022 bp, Homo sapiens
ataataattacagtattgaaacacatcaaatatgttaaagttcatgagttgatggtggatacttcataaaagaaattaggtggtctcatttatcctattctacctaaattattctgagtattgtttaatatgaggtattctaataaatgaagaatgataaaataagaatattactgttttgccatttttaatgaattaatggatcttgacagtattccatcattggctgctaacataaccagtggacacgatgggtcttatggtataagtattcacatctccctatttataggacaagggggcaagggatttgttaaacccagtgggtcagggatgggaggttcatttagcagatttcaaactgggaatttctacagctcattaacctggtttcttcaaatttaagagtgaaaaagagtcttgagacatattaggccatggtaagttacggatttgtttggatccttatttgaacaaactactttttaaagttttgaattgaaaacaaagacatttgaacgttaattggtcatttgatgttaaagaattagtgttaatattttaggtgtgatgatgtcattgtggttatattctaaaaagtctatctttttagagcagcgattctcaacctggggacagtttgtcccctaggggatatttgggaatgtgtggaaacatttttggttgttacagctagggggtgttaactggcactgagagtagagggaggccaggaatgctgcaaaacatcctgtagtccccaggccagccccgacaacaaagaattatccagctcacagggtcaaagttactaactttgttttacagatgcacttgatacaaatgaaatgataccatctttcagttttgttttaaaataaggtgaggtttaggatagattgtaataggtaaaagattagccatggactattgacctgcgtaatggatagatcaaggttcattaatgttacttttctccttttgtatgtgtttagattttttcataagaaacatttaaaaaa

SEQ ID NO: 48264 - DNA, 1083 bp, Homo sapiens
agtgtgatttagaatcaaattgagggcctactcaaattatatctcctactaagctgaactcacagctgagaattgatgtcttattgatgggagattgtagtgtagtgtaatttttcaggtggtttgggaatttaaagagaaggtcgagtactacacgaaagttttattatgctgttttataccctatatgtcgttacctcatttgccttagaatgagtttttaaaaacaaagcttatttttcacttcgtatcatttactgtgcatctccctcccctgttctaccccatcccagcattttttaaaggttttaaatttgaattgatagcatatatttttttccccgctttacatttttagattttaggttaagtacatcctaacacctgtgcatatgcagtaatgtgaaatctttaaaagatcttactcagttgatccattttgttgcattggcagagtgaagatagtccaagtcctaagagacagcgcctctctcattcagtctttgattatacatcagcatcaccagctccctcaccaccaatgcgaccatgggagatgacatcaaataggcagcccccttcagttcgaccaagccaacatcacttctcaggggaacgatgcaacacacctgcacgcaacagaagaaggttagttgattacaatttatttcttaagttttcttccattggtagatttgtgagtatatttaacatcagaaaacattttttctgtaggcatttcataaacacatcaccacatatacacgtacattcactcacgaaaaagaaagttgcctagatttccagtaggttagaagagtttatttagcttatcattgacagatgaagaaatggaaagaggctaaaatcagtcgatgccattatatatgaaattagctacttaaggtacagattgttgtggactagcctgcgatcttgactattagaagatgcattttgtagttcataactgtaaggatatatggaagtcttagaaatgagctactccttttctactccattccttttccttctgtatcctcaaaggcaattaggagcttaattatgtttcttataaaccca

SEQ ID NO: 48265 - DNA, 1022 bp, Homo sapiens
atggtctgggaaacagtctcaggaggtcccaaggaaatgtacccactacagtcgaattacagttttagggaggcaggagttacaaagtcataaatcaatacatggaaagtatacattgtttcaaaccgaaaagacacagaatatcttgaagtgaggacttaaagattttaggtggattcagagatgagattctgtaatttgcagttggtttatagagtaaagctttgtctaaaaatttggattcagcagaagggaatcttataagaaagtctgttaaccaatacactgggttagagtgacctgtaggggtgtgtgagttaacccttgtctggcttggccttaggtcctgtttataatttggtatcttattgtcacaaaaagtccattctgttaggtcctataatttctattttaacattaatgctggtcagttttgcctaaactccagaagcaggggatggagagataaaatgaggtgtatctagtcttccttcctgtccaggccaagaactcaatttttctagtttctctggggtctctgtagtcaagagagagtcagttcagtcatttgggggggattttatttttagtttacaaaagcagtgggaatatccttccagattcagttttgtatttactcatgtaaagagaccttgtagtagcgtagttctggatgagtttttatgtttttatgtttagaggttcacagacagcatggatcgtgaaaatctgaaccccaaatagggtgtgaggagtgaacctaagtttgaattctcacgggagaaacccacttccactcgaagtcaacacagagcagacatttccttattgacgtttccttctcttttccactggaatgactttttcttgtcttcctttttaagtgtactactttggaaattttgactacttcatgtaggggtctcagtcataaggccttatcttctattcctcttgagagcatcaaaaatacaaatttggtcttcagttttcctcagtttctgagtccttgatgatttccc

SEQ ID NO: 48266 - DNA, 1051 bp, Homo sapiens
aggaggcggaggttgcagtgagctgagatcgcgccactgcactccagcctggcagcagagcgagactctgtctcagcaaccaaaaaaccacattttacgtattatctggacatagtttaaaaatgaaaacctcagcttgtggagaataaaatgaggtaatgttagaagtcattttgtaaactattgtgtgatccaaatataaaattcttaattttctgctttccccagcttatatccatcttctgcaaaacaaaaaaggatcttgtcttattttttagtaacaagttgcttatatagagtgttgatttctaagtgttttcacatttatttaaaatgaataaaatttagtgagagtttgctcttcctgggccctttgcatttaactgtttttccttaattgtggaataagaaacttcatttttgttaaaggtaattaaggcaagtagagaaagtctgggagtttaaaggagaattgaagattcttaactcatgctgtgcttatttgtaaatctaaggtgaagagtagtcctgactgattagaaagaggaccaggttcttgagaaattccatttccccacacaagttgcctctttgctgctttgggaaggaagtccttagggctcactagtggttgccattagaggcatgttgtagtcactgagtagaacttgaaacctgtttctgttttgggaaaagtttgtctggctcagcatctcctattatctctaagacttgctgatatatatataaacccaagatatatattacatataaaattgtttttctttagcctttaatgacttctgacttgttcatctggaattatggaatgcattcttatgcctgcctcaggttcatttcacttctgttgatgttttggtaataaaaatggtttggtgttaatagaggtgtactcctagactcatttttatcagatttaatgctaagcataaaacctgcctttccttccttcctcccattatgacctctttgacctcccttgatccctaaatctgtagcagtgttctatactgtaatgtctgtacaacgt

SEQ ID NO: 48267 - DNA, 1027 bp, Homo sapiens
tgcgagagaagtaaaccatcagttgtgccaataaattagataattggaatttctagtatatttattgctctttactgtttttaatcctcaacgtcttgtaggcaacattcttagtatcttctaggcagttgatcataagcttaagaaaccacaagaaaaatgtttttaaagttacatttgtgatctctaattgggagcactgattttggccctaagtagggtttttagatattaagaagcatagttttggtgaatggatttaattttctgtcgtttaagttagaaaaacattcgtttgcattaagttaaaaaattttctcttatagtattggatagcaatagcctaaaaatgcataggtgtaaaatacaacaatgttactaatcgccacagagtatcttgtatgcacagatttcttgactcaataatcctttctcaattttcttttgggaaaacactaaaatcagttaaaactgattttcagtattgtacatgacagtagaagatggaaatgaaaataaactttcctaaaatccgcaagtctctgaagtgaaaatagtatttagtggtggtagaaggaaagcaggatttctttgtaagcactatacaataattagagttaatattttatgtagcctgtgatggagtatgtacacacatacacatactcttctcttgcacactcacatatccagggtgttaaatacaaagtaattcttcagtgtcagaaaacactaaggggatttgtgttcacagcttataaaattgtgataatggatttattctctaaatacaaaatactcagtgtaccaaaatgaaggcaatgccctatccctaatgtttgacagagagatttttgttttggacaaataaaaggagtaaatgccttaacacaggttactgaattaagtatacccaggaagtgttagtactagttgagataaagtaatttcagggagtgtttttgctgaaaggccctttaccctagagattcccccagaacatttctgtccctttcccagtcttttc

SEQ ID NO: 48268 - DNA, 1100 bp, Homo sapiens
gacagagcaagactccgtctccaaaaaaaaaataaaaaaaaagaagtgtcaccgactgtgattttcttctttatgtgtcataaattttagttggaagtcagatatctcatgtaggacagtggggactgagctctgtagtatttagtttggaaatgggcacacctcttcttttgcctggctcttaggaggtcgatctagttaggagctgagcccgtttgaattatggtgatgataggattatcctcagcgtcccgtaggcttcagctctctccagcattacctcgtgctagttttctccgcttcagatcttcctttgtgcctgctgctcagaggcgatctccgctgctctcgccctccctcagcagtagactgccattatttgtcaccctacgtgatggcagggtttctctcttgtcctgggtcatccttagtctaggtaggtgctgtgtctgtggtcttgagagcaggactttttcagtgaccctggctctacccccagcactaggggacctctgatgatctgggcctaagtcactttcctcccaacacccccagagataagagtgttttcccgctgtttctctgtgcatacggtttgttttgtaagagagttagggggaaagaacacaggagaggggcttaatgcctctctcacttttgtccccagcctgcgtcaggagggtgctgtctccagtctctcatctgcccccagttttctccatgaacacctagtgaaggccacagagaagtgaacaggtgcagctactcccagagtttctgcactcacactaattcacagctggtctttaacagtgcattgaaaatgttagctgagttcttactggcttgtatgacacatgcagccctgcattcagcagggaagtgctcaggcctcgtctccttggaggcgcctgtctttctttttttgagacggagtctcactctttcacccaggccggactgcagtggcacgatctgggctcactgcacgctccgaaaggcacctgtctttttgtagcattcaggctagccggttgtccagcagcctcagctctgatgggttccaccagaaagtccatgtttgtgtatattctttctac

SEQ ID NO: 48269 - DNA, 1051 bp, Homo sapiens
aatggaggctgttttgctgcatagagttgcagagagcatctgattacttaaaccttgcaccaattcttattttaatgtctacccttctaccccttattgctagaggcacctgaagccactagtttctgagccttttagggattccatgatataaattaggttgtgagtttttgttgttgtttgggggttcttgtgggtttttttctttttctaccgctggctcagaattcagtttttcagagtctactacattatttactgttgatctacctattttccagcttctaacgttttattcctgtttcctcttttcttccatccttttaggtttatatcttaaaacaaaaacctttaccgtcatttaatgggatttttgggagggagtggaggtaggtatacgtgcttcatctaccatcttaacctggaaagcatgtattttaattctgtggttttgtatttatttcttaaattaagaaggtgtagtgtatggcactgtggtcatatgaatactggctctaaagacaggcagacttgattttgaatgttggctccaatacttacgagatgggtgattttcagcaagtgagctccgaatctcattttctttaactataaaattaggataatagaaacatctctctacttcaaagtgtcgtaaggattaagtgaaaaaatgcaagtagagcagctggcacaattgcttgacatttggtaaatgttattaatggctagtctttggtataaggcatttagaagtgatttgtgctggcattcacagcatagacagatctcattcctatttccagatgctctgagatagcatactcatcctctaattgtgtacaaacttcaaacttaccaaacacttaagttcattatctaaaaatagccttaaccaatcaataataatgccattttacaggtggagaggttgagactgcaagtttcagtggccaatgagtagcagctggccaaggcctaggggactttttttttttttttcatttaaaaaaattatttctagtcagtctgtgcttatccaggggacttt

SEQ ID NO: 48270 - DNA, 1049 bp, Homo sapiens
ggcaaactatctggagaaaaggttttatgtagtataagaatgaaatttacaataatagctgaatgacagtggaatgggctgctttggaaggcaactagtcccttttgctgggctgtacaggcacatgcttgaccatcacttggagttattttcaaaaacatgttgaataaacctgataattctataatgtagcctatgggctaatagatttgaaaactaattttagatttgtttttctttcagctccatttatcttaaagaaattggacagcatatgaagacaggacatcacatatgaatgcacgatatgaagagcctggttacagtttcgactcctctctgcaagtgaataggcccagaaaggtgtaagagactctttgaatggacataaaattctgcttgttaagaacaagtttggctctggtaactgaccttcaaagctaaaatataaaactatttgggaagtatgaaacgatgtctcgtgatctggtgtacccttatccctgtgacgtttggcctctgacaatactggtataattgtaaataatgtcaaactccgttttctagcaagtattaagggagctgtgtctgaaatggcactgtcttgtcagtcatttctgtttacctttttcttctgcccagagtgtatttgtgaagagtctcttatattatgttttgtggaaatcagcacacaaccacaatgacatttaagcacaggatcattattagtctatgtttttaataaacatatcaattaagaaaagttgggtttctatttttcttatcctactttttgctgcaaaccaacaatcactagtgagacttgtattatattgagattattgcaagcttcagtaagttcatcttgttttggactagagaatttgccaatcctgatgaagtgtcattgtgttttattgccaggcagtcttaatgaaaggtagcattactgcttgatgctgagtatatgaaatattaatactaccaaaggaaaaagtactatatttttaagccaaatagttctccaagtttgttgagtggagggggga

SEQ ID NO: 48271 - DNA, 1029 bp, Homo sapiens
agatgtcatgcaaagacacttgcctatgtgccactgccaccctctgccctgctctttgggtcaaggtacctccaagcgcctcactcctgcagctgcatttttttttatttattttttttttgagatggagtcttgctctgtcacccaggctggagtgcactggtgaaatctcggctcactgcaaccttcgcctcccgagttcaagtgattctcctgcctcagcctcccaagtagctgggactacaggtatgcgccaccacacctggctaatttttgtattttcagtagagaagggtttcaccatgttggccaggctggtcgtgaactcctgacctcaggtgatctgcccacttcggtctaccaaagtgttggcattacggcgtgagcacctggccacgcagctgcaatcttaggcccatcattccactgagttccgaagaatatagccttttcctgaagaaactcctttcttcaatgcttcaggccagttgtgagtctctaagtaagtggacaggatatcaaacactgttagagagtaaacagaaaacacagtgaccacagagggaaaaaaagaacgagtaaatgaaaaggatgttctgtaatatttcgttcaacaaacctattctgcaccatatgtggtactaaggtcttgcggggagaggcaaggacacaggctctgcttgctctcaaggacctcagcctaccctgaaagatacaggcctatgaatggatagggtgcaacagaaaggaacacagtaaaatgggaaacagaagggctctgctgtggcctgggatggggaagggccaagatgctcctgaactgaaccctgaagatcaaacaggaattcagtggtgagaggttaaaagctgggcattctagatgaaggggacaattttttttttttttttttttttttttttttttttttttgaggcggagttgcactcttgttgctcaggctggagtgcaatggcacgatctcagctcaccgcaacctgcacctcccagattcaagcaattctcttgcc

SEQ ID NO: 48272 - DNA, 1048 bp, Homo sapiens
atgctgaggcagattctctttttggtgtttagaactttacccacccaaagctgtgccatattcaggggctttactcctagagccagtgaagttgagagctatcttgtatgcctctccttactacatatcctaaagatctggagaattaagtttggacatcagagaagcatgtttttaaccaagaagcatgttattaaccaagcaccacccttatggtttgaaagagccaatgttcctctccaagtactgaatttaacacaagagaataatatggccaggaaaataagtttaaagtgtcttaacactgtagataaaaaaagttatgattcccagtctagaattaaagtgctctgaccatctaggggaatgacttttacaaagttggtaacctagggagtttgatttctttgtaaggcatagcccacctctgtgatttctagtatacctttgaacagtgtaaagttccttcttggaagaaaggaggcagcaaatgtcatcacgtgccttgttcttgttgaacagctatggagaactgctcagaaaaggaatcacattctaaaggagactccggacacacctttgccacttcattaaatttcattttcttttctcttcccaccaggctattagctccagattgtgaaatcatacaggaagtgggaaaactctatccactggagatagtatttggaatgaatggaagaatatgggttaaggcaaaaaccatccagcagactttaattttggcaaacattttagaagcttgtgaacacatgacgtcagatcaaagaaaacagatcttctccagattggcagaaagttgatataggtggacttttttacaggtcagttgaggcaaaaaactatgggttttttcaggtgaacctcccccatttaaatactcagaagataaggtgtgaatgtatgtattattagagtccgaaagtatttttataagttactggttttcacccacgcttttgtgggagagaaaatcattgcaaaatcattttttttgttcggtacaataaagtttactaaaaaacag

SEQ ID NO: 48273 - DNA, 1033 bp, Homo sapiens
ggcttctccctgcaacttcataactggggggacctagatcttttttttgttttgttttttgagacggagtctcgctctgtcgcccaggctggagtgcagtggcacaatctcgggtcactacagcctccgcctcccaggttcaagcaattctctgcctcagcctcccgagtagctgggattacagatgccggccaccacgcccagctaatgattattaaaggaactctaaatccacatacagatccctcaggaatgagaagtaagcctgtataatgggtgtaagtatttaaattacagacttttcccactactttcccaaaatatgaagtaatagaaaatattgtccgtaactaccaatgttttttatttttttattttacaagataataagcaaactacaaaactaagaaatgaactagaagacattaccaagtatgtacaaaatgaccgtctagattcaaaccagaaaatgcatgcccctgtctctgaacagtacagtgaggtgatctaatggaactgagtatgaattccagctccaccacttactatatctaagaacttgggcaaatctctttatttgagttatagttttttattccttaaatagctacaatatctgtctcacagagggatactgtgaggattaagtaatgtataaaaagtgcttcacagaaggtttggcacatagaaagcattaaaaaatggaagttagtattattaataaataaagcacacttgagctcatgcaccaaagactcttcagatcttcactcaaaactttctttttttttgagacagagtctcgctctatcgcccaggctggagtgcagtggcgcgatctcggctcactgcaacctctgcctcctgggttcaagcgagtctcctgcctcccgagtagctgggactgcaggcgtgtgccaccacgcccagctaatttttgtatttttaatagagacggggtttcaccatgttagccaggttggtctggaactcctgacctcaggcaatctgcccacctcagcctcccaaagtg

SEQ ID NO: 48274 - DNA, 1028 bp, Homo sapiens
tgatgactcttaacgagcatgctgccttcaagcatctgtttaacaaagcacatcttgcaccgcccttaatccatttaaccctgagtggacacagcacatgtttcagagagcacagggttgggggtaaggtcatagatcaacagcatcccaaggcagaagaatttttcttagtacagaacaaaatggagtctcctatgtctacttctttctacacagacacagcaacaatctgatttctctgtcttttccccacatttcccccttttctattcgacaaaaccgccatcgtcatcatggcccgttctcaatgagctgttgggtacacctcccagacagggtggcggccgggcagaggggctcctcacttcccagaaggggctgccgggcagaggcgcctcccacctcccggacggggcggctggccgggtgggggctgccccccacctccctcctggacggggcggctggccgggcgatggctgaatctttgtgtacatgttgtgtgaattattttcttaatctgtagtcttagaaggaaaattatggttgtgtgtgtgttccatattcattacacattggtggctctggcagatatacgccccttaggaactaatgctatctgattctttctgtgcctcagctctacgctttctactttgagagtgatcatggttctctttaacatcttttgtcctgagtgttgagcagttcaccacagcatgtgtgtagtatgaggagggaaaaaaaacttaaggaacttggcaattttttgttccaagtgaaagacctagacggttttttgttgtttttattatttcccattgaaactcttaaatatggtttggattgtttccacctcttggctgttgtgaatagtacttctgtgaacgtgggtgtacaaggtctttgagactgcgctttcaattgttttggttatatccccagaagtaggattgttggatcgtatgttcttttttttttttaaagcagggtattactctgtcacccaggctggaacgcagtgacat

SEQ ID NO: 48275 - DNA, 1022 bp, Homo sapiens
ttacatacctcactttttaaacttagtagtgtgtgtgtgtgtttctttttaaaatgacgagtaggttgaagagggcagggaataggggtgggtgagcgtgaacagagtcaggctgattgctgcagggtcccttgcattagttcaggtgagaagagacccgagtaggccagtgagcctggaggagaggctctctgtgtgtttaattggtttccagctttttttctctattcatgtaggttatacacgtttcttctgtgaatttttatttaaatgattttttgttgttactggatctacaaacagcccaactccaaggaatctggcatctctcagtggagcatacaggtgacttcataatctaaccgcattagtaactgccaaaatcggaagtaatttctctctgtttaaaaggcagtgaaacaaattttcagagcaggtttcttcaactgaacaaaatattttggaccttagaggtggtatggctctcctgatcagggagggacagtgaaaggtttgagctctgacactgcccagctctctggatacaaccaagtgactttctttgagtggggagaagtttcctgactccttgtattaccttccttagggtagactttgggcctgcagtgacattagtcctaacttgctcttaggtaaaaagagttcatcttttctaataggaacatgacagcaaagcagctcaaactccaaagaggcgttaggccatagattgtacagatgtctacattttcttaatcatagtctatattcttagaaaaggatatacagatcttagtgtaacatacttaagtaaaatagtttctttcatttgcttcacaagagaaagcaaaaaaatttggctgggcacagtggcttacacctgtaatcccagcaccttgagaggctgaggcagttggatcacttcagcccagaagctcaagaccagcctgggcaacatggtgaaacctcatctctacaaaaaaaatacaaaaattgggccaggcgctgtggcccacacctgt

SEQ ID NO: 48276 - DNA, 1032 bp, Homo sapiens
gagccaccacaccaggccatatacaatattttatttctgtatctggcttatttcactgcccctaatgtccttcaggcctattcctgtgtggtgaatgacaagatcttttttagggcggaatagtattctgtcatacatacaccacagtttctttatccattcatccttgacagaccttcagttgttttcatatgctgactgttgtgaatggcgctgctgtaaacatggagtgcagatgtctttacaagatggtgattttacttcctttgggtatatgcccagaaaagggatcgctaggtcatactgtagttctacttctaatttccttacaaagctctttactcttttccataatggctgtaccaatctacattcccaccaacagtgtataagagtttccttttttccgcatcctcgccaacatttgttatcttttgactttttgataatagccattctagtgggtatgaagtgatacctcatagtggttttgacttgcatgtccctgatgattgctgatgttgaacaccttttcatatacctgtcagccatttttttatgtcttctttggagaaatgtctattcaggtcttttgcccattttataatcaggttatttgttttttcactatggagttatgtgagtcctttataaattttggatgttaaccctttatcagatgcatggtttgcaaatattttttcccaatctgtaggctgccatttcatcttattgtctcctttactgtgcaggagcttggatgtagtcccatttatttattttgagcttttgatatgatatccaaaaaaatcattgccaaggccagtgtccaggagcttttcccctgggctgtaagagttttatagtttctatttttatatttaggtcttttatccattttgagttgattttttgtgtgtaatagaagatatgggtccagtttcattcttttgcatgtggaaatctagtttattagcaccatttattgaagggattatcttttctccattgtgtcttcttggtaccctcatc

SEQ ID NO: 48277 - DNA, 1034 bp, Homo sapiens
ctggtccaatatcttgaacaagtggagatactgaggcccagaaagaggaagaagcttgcctgcctctggctttcccagcaggcaagctgtttgctagcagcatttgagccagcctgagtcagggcagcaggggtggtgggggaagagggggtctgtctctttgctcttatcgcatggaggatttcatgtcctttcagggctcatggaggaaaaatgaactttctgctcaattagcgtgcttcgtgttttctccttctaaaaggtttaaaagaaatgccacaattagaagccactgctgtaggcaaaacagagactcctcaaacactctttgcagaggactaaatgagaacagtgaactttagaatgtgcagatgccttgcaggataagagagtgcaccattgaggggacactgtgaggaatattagatgacatttccctttattcagaattactgagaaaatgtgccctgctggtggtaaaacattgccaaggacgccaccctcaacattagactggcacctcttctggactctgagcctggtgctttggtgattctggtgcagtgggggtggagagtgtaggaacagccctgggcctatgcccaggagacctgggttcaaatcctagctctgcctctgacaagttacgggatcccaaactagtcaccatgatttgcacccttcctttctgaagggttcagacagaccctagtttgagttctgcatattctctgagccctctgtttactctctagcacagcaagtgtaaatcctgccccgccacctgctctgggctgctgtaacatgtgagtgaggtgatacgggtcagcatgcccagcacagggcctgatatttgggaatagccagctttcacactgtgatagtatgttcaagaagagtagcaaccattgccatcatttttacagataaagaaactggtgttcacattacgtcacagttaatgagtaaagagatgagattgcaacacagctcgaggcctctttctaccttgtggggtctctcggaatagaaac

SEQ ID NO: 48278 - DNA, 1052 bp, Homo sapiens
taggggccagtgggagtggggatatgaggaaaggctgctctcccctcatctatcagcagggagcaagtctccacttccttctgccgtccaagcatccccttgttgggttaacatctgagactccagacacctagctccgtggtggttgcttgctcccatgtgtgagccaccagggtggtccctgcaaggccacagtgggacctccctggccattgttgagttccccacacagccccagcatacctgaatacctgacagtggacttagtaggtcactgtattccccagccaggcccctgcagggatgatgaagccttttaagagcaaacttcagggaaggcaggtgtgtgcagctcaggtacagtactgcttgcctcaggacccccacactgctcagcagtggttgcaggggccctgagctcctggccatgtgccccatgactcccccaacagagggagctctgcacagcggtgaagacaatggctctgggtcttggcttaggctcttgaaacccagctccgccacatactaacagggtagtgttgggcaaagggactgaacatctctgagccttggttttctcatctataaaatgggtttcacaggtgtattaatgaagacacaatatatgtgaagtgcttagcatatgctccagcatatagtgagtgctctatcagtggtagctcaaatgtctttattatggacctcagagagccacgggttgttggggaaagagctcggtgtgtcccagtgcattgcaaattgtctgggttcaacctggaagtctccatctgtgcccacatccactgtcctttacgatgatgggttctagattttattggctacagctggaaagaatgctagagaatctcacagaactggagtccaatccaggctcccctcttcctggataacctgtcttgaacctctcacctctcttgcactctgtacgttgtgctttggtgtgaccttggatgaatgagtgaacttctctgacctcctagttgctcatcaggagctggagatgatgaccactcaacaggtatcctttt

SEQ ID NO: 48279 - DNA, 1050 bp, Homo sapiens
cagaggagacgccgagaacctgctgcgactctgcaaggagtgtagctaccttgtccggaacagccagaccagcaagcatgactactccctctccctgaggtgagtgccgccccgagcacccccagccctcctcggcagcctctgcgagcgcagccggccaccgtgtctgtggcagaaaaacccgccagtgtcccctgggaaacttgccagcacacgttattttaggcctgggtttttcaatttgatcctattctcctgggatacagaggagtttttatgttcactgttgctgcccttccagaagatgaggggcctttttctaggattttgtattaactatccaagaaagctttcacatctgctgtgagccggggtggtacgaagttcctagcatgcctcatcctgctctcaaagcccacgacgatggtcctttgatttttttgaggaacatatcgtcgccaatttgcagatgagtaaacaggttcacggaggtgggtgtggctggcccaagtggctgggccaggacttgtgaccagcccatgactctctgccactgtgagcatgacctagctctggcttgcggtttgtgtgggcctgagtttgggtgttgcacaaagtctaggaggagcactgggaagaggtggtgttactgcctatcgcagctttggaaactttcaggtctttctgacctgtgaggcatttctgtcaggatgggcaggcccagaaataagaaaagcatgttttagttgggtgctattgctggacgggacccaaaagaatgcctaaacccattttacagaaaaactgaggtccagaaaaagaagggatttgccaaggacatatagagagctggtgacataactggggtgtaaacccaggctcttcagccagcacagatcccccagaagcagtgaatccctctgcctggcatcctctctgtcccacttaccgctgttagaggccatgggagggagagccggcctgcagggacacggttgtcaggagagctcacacacatgccggccctgtagacagaggcttcagtaaaac

SEQ ID NO: 48280 - DNA, 1067 bp, Homo sapiens
aaataagagaagaaaggcatgccccttctgccaggcccgccgtccccatcccaggtttggacatgtgtgtacggcgttcctggaacccaggcagcgtcctggcacctgcttcacagccttcccgcttgcctgctttgtggtgagtcgctggccgcctcccctcacaatgaggacctctgttctcaggcacctcccatcatgagtggcagcacaatgccctgaggcctgtgtgtgtcttccaggcgaacacagaggcctcttgttggtgatcctggaaatacaaatcaaacatttgctaagccacttgtcctacaggtacctgaaaggaacctacactcactgggcaggtggggtaggtgggtgagcaaaactcactcttgaactagagggaagaaggggcctcacctctctgggcctcggttgtgtcatctataaaatggtaattctcatacttgtttgggaattctaatacttgttttgctgtgtgttggtgagggtcagatgagatgatacagtacgttgtttggaaagctgaaacagcagaggcccattgtcatgtgaacagggtttcagtcatctacagatgttagtgcattgttgtgaaagttgatggcattttcatagactccgggggtcatgtagtccaccctacctcccaaaccaatgcataatctcccctccttgccccttcctggggtcgcacaactacctgggcagcagtgccttctgggctctccacctcagctctccccactctcacccacctttccccctcaccaacaccccagagtcccagcctagctgttggtgctgtgcaggaacccctgccagggactgtgcaaggccttgggcaccttgactctgcctctgtacattcgtgaaccaacaccagggctgcaacagccttcaagcccctcctgtcagccacatatggtttacaaatgtggcccatgttcattccagctcatgtgcagaggggctaagaagcctgtggcggttgagagctccttgcaagcagtctacacacggtgccttgtttttcatcattccaacctttattgcctctg

SEQ ID NO: 48281 - DNA, 1031 bp, Homo sapiens
cggattcctaggccccatcctgtagaggccctcactgaagcccgagaacttgcactgtaatacatggctccatggctctgggacagatggtcccatggttagagagtccctgctttagcaaagagcttaggcctggggtctccttcagttgttcaagctgtggtctggcctggcctggtctgccagcagcagcaattctcgctgacttctcgctccctctcttttctctctccactgcctgtgggagggatggacatccgttctgttgtctccttgaagctacctgtgcaagtcctgaggacccagccctgggcctgtggaaaggaatggaaaccacccactcaggtgtggtgccccagcctcgtggctcttcttgtcagccttcacaaagctgtgattcatactggaatcttgtaaatctctgaatggccaaatagaacagggctgggggtagagggcatggggtgactagtggagagagtcatgagctggaggctgcaggagtgaattgcagctcctccgacagccggtttgagcttggacaaggcatgcctcagtttctccatctctgaagtcaaggcttcagccagatcctaaggtgactttagtgctaacctgtcctggtagtggtggcagtcacacaaagacacgctggatgcacacagggacacaatctcccagaacacagaagcctcccacgtgctgctggtggttgggctgctgcctcggctgcctttgtttgtccccagtctctgtcagacctccactcagtatgcggcgcttggtgtctgcagcttccactcagcactccagaaacctgtttgtgagctcaagtcacactagcctccctaggggatatctttccacagaagcctactttcgaattgggcctaattgtagcatatatacctttaaataattttttttagtgtatttgaaacagctgtcattttgcatgtgcatcagctgaataaagtggagcagccatttgagctcctggtcaccccgagtctgcagcaggcttccttcac

SEQ ID NO: 48282 - DNA, 1037 bp, Homo sapiens
tatgactttgcatttggaaggagattttacaatgtgcattaataaataagggccattctgggcccgattcatacagccgttgtcaagtgctgtgttggtgtttcatggaaaccagctcccgtgatggtctcagatgtccccttaaagcggaagggacacagggtgggaagagggtctggaaaagtcagtgctcttaagcaataacatgcacaccagaccattgacatcataggaaggcttggtttctaaagtaatactaaaaggactgaaacactcacctggggtaatgcttccctagaaagcatggtgatctccaatgaaattagaaaaatggacggttaggggtttcttatgaagctaaacttactcaccttaaaggactatgctttattctcaatttcctttttacctttttactgttaaattgttattgtctttatcttttttcgtttgattttgttttgttttgttttttgagacatagtctctcgctctgtcaccaggctagagtgcagtggcgagatctcggctcactgcaacctctgcctcccgggttcaagcgattctcctgcctcagtctcccaagtagctgggattacaagcacacaccaccacgcccagctaatttttgtatttttagtagagacggggtttcaccatggttggccatgatggtctctatctcctgacctcgtgatgctcccaccttggcttcccaaagtgctggggttaaaggcatgagccaccatgcccagccctttccttcataaaatgtgggtgaagacagatggcggttgggttcttttagtgtgcgtgatcttgtctttccccccttttttttttgtataatttttttgtatagtagtccatgaaatccaggattctggccctaacaacccactctacccattctacagatggggaaattgaggagctgatagaatgacttagctaatggtgccctgctggcaagaggaggggattacagtctgggcctcaagctccccatggaaacttctggatgttggtgtttgggg

SEQ ID NO: 48283 - DNA, 1064 bp, Homo sapiens
gcagctctagaatgcagtttcagaacccaaatcctgggttctggcttaaaataagactggggcctagggattcatggagggcagggcatgggccgccagactcctgtcgagaggcccatttctcctcctctcccctcgcccctcgagctccagctgcaagttgccccagaggcctgtggcctactggaccagccgctgccctcgctgaggcaggaggggatggtgggcccggccagcctggcctggactcatgagggagctgagcttccctgaggtacttcttatatcagggctgtttccggatgacccctttgctacgtgttttactgcccttgtgtggtcaagttaaagaggttgttcaggaagtaggattacaacgggaccttgtcgtggctttgtaacctctgctctgtagatggcagggactgggcccacagggaggggccaagggtagtaaaatccagaatcttggaatccattcattcacatactcctttgccacaaagtgggatgggtgtgcttggccccagggccatgacccccttcggatcttgcagacttcttgcaaacttgaagtggcagcagcacatacaggctaatgactaagcagttcccactgcgctttaaagtcttgccttaggctttcaattgtgcttatcattcaaaatgctcttttttgcaaaagagcccattttgtcagttttcttcttgtttagatttaatgattaatcagaaaagtggttttttgtttttaggtttttttgtctggtttggagataacattggaggcttaacgcctgacagcagtatctgacagggcactttatcttaaggatgcttttcaccattccagctatgtattatccacatttttccggggaagaaaatgttctctggcgaccccttttttgtagtgtagtgtcctgggctgtcacgcccgcccgccagccctgcctgataagcgataagcgtcaggagttcagaaacatgtttttcttcacggctgacagtctgtctcaaaaaacttccatctcctcacttcctcgggctcctgatcccacccg

SEQ ID NO: 48284 - DNA, 1040 bp, Homo sapiens
tgctgtaaaaccccaatagtccccaaattgccagtaactccaacaagggaaaaaacctccaaactccagtgccctccagagcagccaagactctacattttaggcttctagtggcctcatgcaggcctgtgctgcctgccttttggtgtggtggtgggcattggaaagagcagctttgattctcctcagtggcaggtgggagtgatgattaaaaacagttagtaattaccacctcctctatggagagcttttagctggggacttgtgtgtgatctgcaaaggattcaggacccatgagaccttaggagtgcttcagctccttcagcatcatgcttggcacatagtaggtgcttagtaaacgtcttatagatgaataaatgaattagattagaaagagacttttctggaaagagttgttgcagccagattgaagggctgcaaataccatactaaggagttaattgagcctttggcccacaggcagtgggactccaggacaggtttgtgcagggagggacgtctgcacaacatgtgtcgcgctcaccccattatttgccctttccggtgtgactgagttgccagataatgaggtgttgggctgcacaaagcgcttccttgtgctagagagaggcagggcctgccttgaagccagttggccaccggcctcctccctgtaatttatgtgcagtggcaggttagagtgggctgccaggcagaaccagggcatgcccgcttctccaggtcaacaccttggtgtgctggttccagcataggggccatggccctggattgaggcctggccctgagctttctctgccaccagtgcgttcagggagaatggtttcttttcttaatttttttttttttttgagacggagttttgctcctgttcctcaggctggagtgcaatggcataatctctgctcacctcaacctccacctcccgggttcaagccattctcctgcctcagcctcccaagtagctgggattacaggcatgtgccaccacacccagctagttttgtatttttagtagagat

SEQ ID NO: 48285 - DNA, 2401 bp, Homo sapiens
tactcttcttgcatccctctgctgtaatttctccgctttcagcctttgctttggtgtccctagaagaggccctagagctggcttttctgtttctctgtctcccatctgcctcagagttccagaaatgagatgttaatgcagcacttgagttattttatagagaaattctgagcacagagttggcacatcccaagggacagctgcacaaaacgtgagtcttgtaactgtcatgtcttctcattctaacaccaagcattccttcccttcaaggatttgccgggctgtgtgtgctctgtttggaggaagagactggcggtacattggccctgatcaacaaggaacttaagtttccttgaaggagatcaggtgactgtcctctctaatctgacaatctcagaacatgactgattaccccagggcttaacccccatgacttgaccctatcctctctttgcccccagagcatttctgacccataaaaattagctttaaaagtcaaatctgaaacagctgtggtttcttctgatcagtcagcaaggtctaacttgcctgtggtcaagccttcccctgattagcttagcttgtgctgggagagcccagaagtggtggcctgtggggaatgggtaggccaggcttggccctagaaaataaactgggacgtgtgactttccaacagagctcgcatgctggctggctgacggcaacacaccctgtggctttgtgaggttggttgatggtggtggtaggggtgatgtattttctatttctttttttttttttttttgagacaggatctcactcctgtcccccatactggagtgagtggcacgattacagctcactgcagcctcaacttcccaggctcaggcgattctcccacctcagcctctcaagtagctgggactatagtcacacgccagcacacccaactaatgtttgtatttttttattgcccaggctgatctcaaactcctgggctcaagtgatccgtctgccttggcctcccaaagtgctgggattacaggtgtgagccactgtgcccagaaggttgtgcattttccgcaggacaaaggtggtggtcgtctctgacttcctagctttcatttggcctgtgctgactgagcaattgctatatgcaggccaccatcaggagctgtgtggatacagggatgaaccagggcctggatagtgcccgcccctgaaaagcttatcttttggttgaggacacaggaaccaaggttgaaacccacatctgtatgtcagaatttatctgtaaataaagtggtgtgggtgagctaaaagctgtcttggcacagagactgttctgggcagggccttgatttcatggagccacaggagatgcagggtgaggaggaggtatttgagtaaaaaaggtacaatcacttgaattaagggagttttccactacagtaatattagctaatacttttattatacatactctgagctaggtgcagttctgtgtgctttgtatgtaactttactcctcactacagtcctttgaggtagctactactactgctacttctattttcatttttacatatgaggaaaccaaggcacagacaggttaagtcacttgtctaaagtcaggtcggtggttcatgcctgtaatcccagcacttcctgtaatcccagcacattgggaggccaaggtggatcacctaaggtcgggagttggagaccagcctggccaacatggtgaaacactgtctctattaaaaatacaaaaattagctcggcgtgttggcacatgtctgtaatcccagctacttgggaggctgaggtgggagaattgcttgaacccgggaggcagaggttgtagtgagccgagatcaggccactgcactccagcctgggcaccaaagcgagacactatctcaaaaaataataataataataataaagtcagacagccagtaagtggcagagatgagatgtgaagccagatctagcatctgtttgtaaccactgtgccatactacctcaagctgcacaatcccatgcctgaatttgctttatcatctctgccttatttgtggctagacttactctttgtaaaatgtcccctctgttggcatggtagaagtgactgattccaacatttatgtaagtattccacagcttaaagggcactttcacaccggtaatttgtttgcttctcagagccactctgcgaggaatgggctgtaatctcccctttgcagatggagaaacagaggctcatggggaggagtgcattcttccctgcctcacagcagaggcagagctggtggccagtacctgctgtgtgtgttgaccttgtgttgaggccagtgccctttgtgccggggtggtgtggaggtggcgtggccgaatctggagtctacaggaagggtga

SEQ ID NO: 48286 - DNA, 1938 bp, Homo sapiens
tcccctccaggaatactggcggcttggcttcctttatcatgtttcatctgagagcaaaaatgtcagatcggatgcacagaaaaatggcccaaattgtttaataactagaagaaatataggagcagcaagagggtaatatggagaggggagggcctccatgaccggtgtctgcagagccaggggtacaggcacccagtgttgtggcctggcaccaccggcctctcagagcgtgggtggcccactgtctttacccggaggacagcaggcctgatcaccagcttttctacctgtccctgtaagcatcacgttgctagaagaaaatctcatgccagagcttgcaccatccctagcttgggggttaggggttgtctcttggtgacctaaatgaaaaaataggtccagatcagagttcctgacgcagagcactcacccactctttgaatcgtgggaggggaggcctggttttagttaaacctaacctctttgaggaaccacagagcccaagactggaagccttcagaatcttctggcccccaaccctccctggggacccctgtggcctgtctcaccagagcactcttctgtctgtagatgtctcagctgctctacaagggagtcccatttcaggtgtggggctgggcatggtcactcctgctggatgtctagaaggtggaaactaaggacctaggaaaatgccagatacagcctttccaccctcatccagagcaggacaaacaggcccggtggtgtcaggagcccaggtctccagctggagggaacgtcaaccctgcagtgggagcaggggcccatcgcacatcctaggcacagatgctaatgcaggcactgcaggtaagctgggcttggtatccttccctggcttcagaaagaagccaacaaggagcgttttgcagaatgaaacctttgtttccagaagcactgctgactgtaagtggttgccgtttgtggcagtgagcattttgtccattctgaggttggattggtttctccttttggccttgccctgccctacagaccataaaggagaacagcaagaagcccccagcaaacatccacatatggccctggacatcagccacattctgaggaacatgtcatgttctgggagggctaaggcatcaagtaaggcctgtggggctggaggatccaaggcaaggtggggcaatccagagccatgggggcttcccatgggaattgggaggtcccaaggcagagtcagaggttccacaggaggagtcagagagtcaccaagggctctcctggcccagggagcagtcaacaccatggactgaacacttgctgggctccaacccttgggccaggctgcccatgtggggccaggaggcagctcagagtgggaggcagagagagaagtgtgctcagagggcacctgtatctggatgtaatgtggtcctgagactctggctgggaagtgcttccagggtatcatatgtgttatgcagctacttcctctccccagccttaccctgtaggaattctagtgactatgttgccaccatcttggagctccatgccctcatagtgtaatggcaccagcagatctgcctgtgcacagacttcctgtactacctcactcctgaggggagatgcttctgcgggcctgcgacctggtgctcaactttagacaccatcatcctggagcggcactgcaccctcactagccagggtgttgacgtcctcaaggccaaggccacattcaagactttggacttcattgatgcacttgtgccgagcaaggtgggcatctctgggatcttaattcaggaggtagaatgcagcttgagatcaagtgtctgatcaaagaacttgaacttgatctggagggctctggggagccatggaaggttctggataaaggagggacagtcagccacgttttagagatgactgtggaaggct

SEQ ID NO: 48287 - DNA, 1031 bp, Homo sapiens
ttctggcaaaatttttcctttcagttgagaatgcttacccattgcctgcacaagcattgtagcttggcagcagttaacttgctttatagttcagaggcttatgtgcctaagggactgtatagccttgtgtcagatgagactttaagctttggacatttgtataaatgctggaatgatacaagatttggggggactgtagggaaggcatcattgtattttgcaatgtgagaaggacatgagatttgggagccagggacagaataataaagttaaaggtggggcctggtggagggtgatttaatcatggtggagagtgtgggttggaaggtggggggtagggagaatgaggggattatggtgggggtgaggggtgaaaagtggtggtgggaggtggatccttcacaaatgattaaacaccatctccttattgctgtgcttatgctagtgagttctcttcgtgattttggagctgtgagattgaatggatactggcctcctgggttttggacttgcattgggtgtgtggttctatttgtggttttttcctgggaaatttcttccctttgaattgagaaagcttacccaatgcctgtaccatcattgtaccctgaaagaaaagaacatccttttaaattcagggactcataggtgcaagggactgtagacttgtctcagatgagatgttgaactttttacatttgagttaatgctggaatgagttaagacttttggaaacttttgacaaggcatgaatgtattttgctctgtgagaaggacatgagattctggggtaccagggtcagaataatatggtttggctgtgtttctttaccaaaactcctgtggaatgtactccttaatgttggaggtggggcctggtgggaggtgatgtaatcatggcaggaggggtttggggttggaaggaaaaggggtgggtagggtgggaagtaggttggcagtagggtggtgggagggtggtgggtagtaggaagggggagtagtctgcttcagaggcagaggctcatgggaaa

SEQ ID NO: 48288 - DNA, 1052 bp, Homo sapiens
gatctgcctctgcatcaggcttctgcctggaaacagtgggagttgggggtggggggcaaatccttcaccaatggttaaacaccatctttttgatgctgaccttgtgagttctcatgagatctgcttgtataatagggcatggcacctctttcctctctctgtctttctcctactcctgccacgtgaatcatctcattgccccttgacattctggtatgattgggaggcttcctgagtcctcccagattcagaagccagtatgtttccttacagcctgcagaatcatgaggttctttatgatcatagagaaaattagtactgggaagtggatgtatgaaatgtcttcaaggccttttccctattgtcttgggagtcagtactcagcttcttttcattcaagtatctgagggcttcttgaattttctccctgaaaatggacttgtcttcctttaccacattgccaggctgtgacaaagatagctgataatgtagaagcaggttcagaagggggtggcagacagagatcaggagagtttggagggcttcgaagacaggaaaatgaagaaaagtttggatctttgtaaagaattgttaactacttgtgatcagaaggctgacaggaaaatggccagtgaaaaccagacttggaaggtctcagataaaaatgaggaacttcctgggaacagaagccaaggttacttttattttgctgtagcaaagaacatggctgcatggtgaccctgccctggagatctgtgaaactttaaacttgaggttgatgatgcagtgcatatctggtggaatgaacttctaggaagcaaagctcaagaggtgtcctgtctgcattgaacagcctgtgctctgatgtgtgactgagaaaatgacctctggatgggacttatattaaatgagtcccaactcttatgttaaatgagaaacaggactcaaaagtttggaaaatttgcagcctggccaagtggtcaaaaagaaaagctgattttcagggggaaaattcaggaaggcttcagaaacttgcatgaaaaggagcccag

SEQ ID NO: 48289 - DNA, 1816 bp, Homo sapiens
aggcacagcttgggtcactgcttcaggggtacaagatgcaagccttggtggcttctacatagtgttaagccagcaggtgcacagagcaaaagaggagagccttgggagccttcgtctagactccagagcatgtacagaaaaacctgggtttccaggcagaagcttttccaagaggcagaccctcatgggaaagcttttctagggcattacagaaggaacatatagagttggaacccccacacatggaggcaccattctgcaaacccagattcatagacctaccaacagcttgcaccctcagtgtggaaagctacaagtgctcaacactagcccagcccatgagggcagctgtgggggaaagaccctgcaaagccacaggtgcagagctacccaaggccttgggagcccagccatcacacccctgtgttctggatgtgggatttggattgaaaagtgatgatttggagctgtacaatggaatgactggcctgctgggtttttgacttgcatcggatctgtaagtctcatctatattttgtgcttctttctggcaaagttttttcttttggctgggaattcatacccaatgcctgtacaatcattgtaccttgaaagtaattaacttactttgtatttcagaggctcagaggcagaagggactgcagccttgtgtcagataagactttgggctttggatacttcagtaaaggctggaatgacttaagactttgggggactgtagagaaggcatcattgtattttgcagtgtgtcaaagatatgagatttgggggaactagggtcagaataatacgatttggttctgtgtccctaccgatactcatgtggaattgtaatggggaatgtgaaagttgggacctggtggaaggtgatttaatcatggtgaagcatgggggttggaggtacgggtgtggggagaatggtggagattattttgggagtggggtcaaaagatgaggatggggggtggatccttcccaaatggttaaacactatctccttaatgctgtctgcatgatagtgagttctcttgatgattatggagctttaagattgagtgaatactgtcctcctgggcttggacttgcatttgtgttatttttctgggaaatttattccctttggattgagaaatcttacccaatgcctgtactatcattgcaccttgaaagaaaagaaatcccttttgaattcagggactcataggcagaagagaaggtagccttgtctcagatgagactttgaagtttttacatttggaatgagttaagacttctggaaaattttgaaaaggcatgattgtattttgctctgtgagaaaaacatgagattctggggtatcagggtcagaataatatggtttggctgtgtgtccctgtgaaactcatgtggaattgtaatcccaaatgctgaaggtggggcctaggggaggggatttaatcatggatgggagggagttgggggtggaaggagaaagggtgggtagggtggggaggaatgggttggctgtagggtgatgggagggtggtgggtagtaggaagggggagtaacctgctgcagaggcagtggttcatggaaaacctctactaggacagtgcacctgtgactttacagggtttagcccctgtggctgctctcatggggtgggctggtgttgactacccatacctttttcaaactgaggctgtgagctgttggtgggtctatggatctggggtctggaggttggtggccatctgcgtgggggctccaagcccatattttccttccacatttccctagtagaggttttccaa

SEQ ID NO: 48290 - DNA, 1621 bp, Homo sapiens
cttccacatagtgttaagtcagcaggtacacagagcacaagacgagaaacttcggagtcttcatcttctagactccagagtatgtatggaaaatcctgggtttccaggtgaagcttttccaacagacagagcctcgtggtaaacctctacaaggatggtatagaaggaacatatacggtgggagcccccacactgggaggcaccattctccagaccccagattcatagacccaccaacagcttgcacccttagtgttgaaaagctactggcactcaacagcagcccagcccatgagggcagctttggggaaagaccttgccataccacaggtgctgagctgcccaaggctttgggagaccagccattaaaccaccctcttctctggatgtgggatgtagattcaaaaaatatgacttggagctctacgatggaatgactggcctgctgggtttttgacttgcatggggtctgtaagtcccatctgtgttttgtgcttctttctggcaaatttcttccttttggctgggactgcttacccaatgcctggacaagcattgtaccttgaaagtagttaacttgctttgtatttcagaggctcagggatagaagggactgcagccttgtctcagatgagactttgggctttggacatttgagtaaatgctggaatgagttaagacttcgggggactgtagagaagacatcactgtattttgcaaagtgaaagtaacatgagatttggaaggccaggggcagaactatatgatttgtctctgtgccccaaccaaaactcatgtagaattgtgatggggaatgttaaaagtggtgcttggtagatggtgatttaatcacagcggacagttgggattggaagtgagggtgtggtaagtttggggggtttatgctgggggtgggggtgaaagatggggctgggggggcagatctttcacaaatggttaaacagtatctccttaatgctgtctgtgtgaaagtgagttctcgtgatgaatgcgtacatactctcctggcttttgggcttgcattggacctgtgtcccaattgtgttatttttctggaaaatttcttcccattggactgagaaagcttacccaatgcctgtaccatcattgtatcgtgaaagagaagcactcccttttacattcagggactcagaagcagaagggactgcagcctcgtgttgtttgagactttaatcttttttatatttgagttactgctggaatgagttaagacttttggaaacttctgaaaaggcttgtttgtattttactctgtgagaaggacatgagattcaggggtgtcagggtcagagtaatatggtttggtggtgttttcctacaaaagatcatgggaaattgtattcctgaacgttggaggtggggcctggtgggaggtgattgaatcatggatgggagggggttgcgggtagaaggaaaaagaagtgggtagggtggggaggagtaggttggcagtaagctggtgagagggtggtgggtggtaggatgtgggagtagcctcctgcagaggcagagcctcatggaaaacctctactagggcggtgcacctgtggctttgcagggtttagtaccttggcggctc

SEQ ID NO: 48291 - DNA, 1021 bp, Homo sapiens
agcccccatacagggaggcgccattttccagaccccagattcatagacccaccaacagcttgcactcttagtgttgaaaagctattggcactcaacagcagcccagccattgagggcagctttggggaaagaccctgccatgccacaggtgctgagctgcccaaagccttgggagcccagccatctcaccaccctgtgctctggatgtgagatgtagtttcaaaaaagattatttggagctgtaggatagaatgaatggcctgctaggtttttgacttgcatggagtctgtaagtcccatctgtgttttgcacttctttctggcaaatttcttctttttgtctgggaatgcttacccaatgcctggacaagcattataccttggaagtagttaacttgctttgtatttcagaggctcagggatagaagggactgtagccttgtctcagatgagactttgggctttggacatttgagtaaatgctgggatgagttaagactttggggggctgtagagaaggcatcattgtatcttgcagtgtgagagggacatgagatttggggggccaggggcagaataatatgatttggctctgtgcctctaccaaaactcatgtgtaattgtaatggggaatgttaaagctggggcttggtggaaggtgatttattcatggtggacagtgggggttggaagtgtgggtgtgagaagaatgggggttcatggtgggggtggtcgtgaaacatggagaccggggcagatccttcacaaatggttaaacactatctccttaatcctgtctgtgtgatagtgagttctcatgataaatgaatactctcctgctggcttctgggcttgcactgggcctgtgtcccaattgtgttatttttctgggaaaatcttccctttggattgagaaagcttacccatcactgtaacttgaaagaaaagaactcccgtttcccttcagagactcataggcagaagggactgcagcattgtcctggatgaaacttgaacttat

SEQ ID NO: 48292 - DNA, 1177 bp, Homo sapiens
actagttcagaggcttgagatcctccatatatattttggaagatatatgaaagtgcctgggtgtccagacagaaggctgccaaaaaggcagagcctcatgggaaacctctactagggcagtgcagaaggaaaatatggggttggagcccccacactggaggccaccatcatgaagaccccagattcatagacccaccaagagctttgcaccctccatgggttagaaaccccaggcactcaacaccagcacagcccatgagggcagctgcacaggctgaacactgcaaagccacaggtgagctgcccaaggccttgggagcccagccctcacgcccttgtgccctggatgtgggacaaggattaaaaaaggatgactttggagctgtgggtttgaataactggcctgctgggttttggacttttcatggagcctgtaagtcccatttatgttttgttctctcaggcaaaaatcttccttttggctgggaactcaatgcctggacaatcattgtaccttggaagtagttaacttgtttgtatttcagaggctcaggggcagaagagactgccttttctcagatgagacattgggctttggacatttgagtaaatgctggaatgagttaagaccttgtgggactgtaggtaaggcatcattgtattttgcaaagtgagaagtacatgagattgggggaggcagggacagaataagatttggctgtgtgtccctacagaaactcatttggaattgtaattggaaacgttaaaagtggggccaggtggaagatgatttaatcatggaggacagtgggggttggaaggtggggattggggaggatggggggattatggtgggggtgaggggtgaaaggtgggtgttggggaggatccctcacaaatggttaaacaccgtctccttaatgctttcctcatgatggtgagttctcgtgatgattctggagctgtaagattgaatagatactgtcctgcttggttttggacttgtactgggcctgtgatcccatttgtgttactttcctgacaaatatcttccctttggattgagaaaatttacccaatgcctgtaccatcatcgtaccttgaaaaaaagacctccctttgaaattcagggactcataggcaaaagggactgtagacttttctcagatgagatgtt

SEQ ID NO: 48293 - DNA, 1411 bp, Homo sapiens
cctggtgggaggtgatttaatcctggatggaaggagggtgggggtgtaaggaaaaaggggtggggagggtggggacgagtaggctggccataggatggtgggtagtaggaagggggagtagcctgctgcagaggcagaggctcatggaaaacctctactaggacagtgcccctgtggctttgcaggctttagccccgtggctgctctcatgggctgggctgttgtttaatgcctgtaccttttccatactgagagtatgagctgttgttgggtctatgaatctggggtctggaggatggtggcctcctgcataggggctccaagcccatattttccttctgcactgccctagtagaggttttccaagaggctctgcctctgcagcaggcttctgcctggcaacagtgaggggtggaagtgtgttggggggtggatctttcaccaatggttaagcaccatcttcttgatgctgaccttgtgatactgagttctcatgagatctggttgtataacaggctgtgacacctctttcctctctctgtcttgctcctactctggccatatgcaacattttattgctgcttgtccttctggtataattgagaggcttcctgagtcctcccagaagcagaagttactatgctttctttacagcctactgcagaactataagccaattaaacccctttttgttatgatcttacagaaaattagtactgcgaattgaagctatgaaatgtcttcaatgacttttccccatcacattggctattaatactggtcttccttttagtgcaaatatctgaagccttcttgaagtttgcccctgaaaatggactttttttccttctacattgccaggctgtgacaaagatagctgaaaatataaaagcaggttcagaagtggctaacagccagaggtcggagagtttggaggacttggaagaagacaggaagatgaaggaaagtttggaccattgtagagacttgttaaatacttgtgattaaaatgctgacagaaggagggacagtgaaggccaggcttatgaggtctcagatgaaaatgaggaacttactgggaacaggagccaaggttacttttgttttgctgtaacaaagaacatggctgcagggtgaccttgccctggagatctgtgaaactttaaacttgaggttgatgattcagggtgtatctggtggaatgaacatctaggcagcaaatctcaagacgtgtcctccctgtgtcaaacagcctgtgcctttatgtgtgaccgaggaaatgacctcaagttgcaacttatatttaaatgacaagcagagctcaaaagtttggaacatttgcagcctggccaagtggtcaaaacaaaagctgattttcagagggaaaattcatgatggctttaaaaatttg

SEQ ID NO: 48294 - DNA, 2049 bp, Homo sapiens
tctactgctgccacatgaagcatttccttgccccttggccttctggtatgattgggaggcttcctgagtcctcccggaagcagaagccactatgcttcctttacagcctgcagaaccgtgagccaattacacctctttctttatgattgtacacaaaattagtgctgtgaagtggagctatgaaatgccttcaaggccttttccccattgtgttggtaaccagtactcagctgcttttcatgaagatatctgaagcctttgtgaatttttcccctgaaaatggacttttcttcttttaccacattaccaggctgtgacaaagatatctgagaatgtagaagcaggttcagaagtgggtaaaacagagaggtcaggagagttgggaatgcttagaagacagcatgatgaggaaaaatttggaccactgaaaataattgttaaatacttgtgatcagaaggctgacagaaagatggacagtgaaggccagaattaaaaggtctcagatgaaaatgaggaacatcttgtgaacaggagccaaggttacatttgattggccttagccctggagatctctgaaactgtgaacatgggggtaacgatttaggatgtatctggtggaatgagcatctaggcagcatagctcaagaggtgtcctctctacatccaacagcctgtgttcttatgtgtgacctaagaaattacctcaagttgcaacttctatttaaatgagaagtagagctcaaaaatttgaaaaatttgcagcctagccaagtggtcaaaaaggaaagctgattttcagggggaaaattcaagagcacttaaagtatttgcataaaaaaagagcccagtgcaaatagccaagactatggggaaaaggccttgaaggcatttcagagacctttgcagcagcccttgctgtcataggccctggggaagaggagagaattgtttcctgggccagctccatggcctggctgctgtgtgcatcctcaggacactgctgcctgtatccctgcagatccggctccagccatggctgaaagatgcacaggtacagcttgggtcactgcttcagaggtggctccaagccttgatggcttccacatagtgttaagccaggaggtgcacagagcaagagactagaggcttgggagcctctgtctagactccagaggatgtacagaaaagcctgggtgtccaggcagaagcctttccaagaggcagagcctcatgggaaacctttactagggcgggaaagaagggatgtatcaggtggaagccctcacacagggaggcaccatccttcaaaccccagattcatagacccaccaacagcttgccccctcaatgtgggaaagctacagtcactcaacaccagccccgtccatgagggcagctgcggggactgatcactgcaaacccacaggtggagatctgcccaaagcctttggagcccagccctcacactcctgtgccgtggatgtgggacaaggattccaaaaggatgactttggagctgtaggattgaatgactggcctactgggttttggacgttcatgtatcctgtgagtcccatcggtgttttgtttttgtttctggcaatttttcttttgttggctgggaatgcttacccattgcctgtacaatcattgtaccttggaagtagttaacttgctttataattcagagactcatgggcggaagggactgtatccttgtctcagatgaaactttgggctttacacatttgagtaaatgctggaatgagttaagatttgggggactgtaggagaggcatcattgtattttgcaatgtgagaaagacaaatttgcaggggcaggcacagaataatacaatctggctctgtgtcccactgatgtggaactgtaatgggaaatgttaaaggtggggtgcaggtggaaggtgatttaatcatggtggagagtggaggttggaaggtgggggtggtggggcgaattggggaaaattatggtggggttgggggtgaaaggcgggtggggggcagatccttcacaaatggttaaa

SEQ ID NO: 48295 - DNA, 1760 bp, Homo sapiens
agatggcactggggccctacctccagggcagaataactgatttaccctgactggcagcgagtgaggttggtggctggtccacctgctcctggcacacccttgcagaggtggctggttgctctttgagccagcttggccttgcctggcatgcacaggcctcaatgcaaccactgtgctgcagatggagccacatagaggaaatgagcagcaggctcaggagcaggctgtgcgctgcctttggggctccagtccatgcatgagggctcctacagcactgtgggcttcttgggtgccaagaggcagaccgcaggccatcttgagaaggactccatgttcaagtgcagaaagggcccaatctcgtggatgaaccacatggccagcttctgggtgcaggcacagtgccacgtcttccatcacttcgtgatgtgccacaccagcactgaagagacagcctggagacagggcaagaggaaggctgcgaaggatgaggtggtgaattccagcttcttcctgaccctgagcccacccccaaggtggccctcaacctttaagagtgggagagcaaaattgacggcttcgagcgcttcaccaagaagatggaccacagggcactcagctcaacttctcagccaatgagttgacatgcaagcagattatggtgacgggctttaagaaagagcatcagaaggtggccagctcttcagcctcagccaggtcttggagctggaccaggccatcacttcaccagagatgccttcaacaccgtcggtgagctctttgccaatcagcccagccaggaactggacccagtcatggacctgttagtgctgtctctgggacaccaggtcatcatcctggacatcatccacatacacaaggaagctcttaccaaagtcatggagagcaggcaacatgtggcagaagggaagacagagatgcagaggctgatgacatcagaatcacaggaacaggatttctttggacactgtggctgaaattcaccacttccatccaattccagtgagaaacatggactcacagatgcagcatttcttgcaacaagagatactattttttcaaaaggtcacccaggaattgatagtgttgaatgactagatactcgattgtgcactgtttccagttcaaggatgctttctacagcagaataataacactagcaaagagatagtgccaggtattggcggtagtacaaggatggctttgttctcaattgaaactcggctgaacatagaattgtgtaggaaacagttaatatggcgatagaatagaaacagtagcaaacatgacctaaaccatgctatgaattcctacactaccattgtaacttttggaagaatgataccacttactttattgctttttgaagtatgaatattttcgtgtatatgctgtagacctcaaaccctgtgaagagtctcaaagaagctggctggataaagcctgctgtggatgtctttatattcaaagattgatgatgcaatttgaatatgtgtcctcaccaaatctcatgttgaattatatttcctaacgttgaaggtggatcctggtctaaggtgattgaatcctgaaggcaaatttctcatgaatggttcagcaccatccccttgctactgtcctcacaatcatgagtgacttctcatgacacctggtcattgaaaactctatgtcacctccctactctgcatgttttcctcttgccgtgtgagacaactgactctttctttgccttgcacaaagat

SEQ ID NO: 48296 - DNA, 1163 bp, Homo sapiens
aaggcctcacccagtgggtatcttgtgacctagtcattggaagcctagtcagtggggacctggtcagtggtgctcttattagtggggcctgatcggttggaacataaacaataaaaaactggtcggtggggtgtattcagtgtattaggggtctggtcagtgtggggccttagtggcttggagcctggtcagtgagagcctggtcagagggggctcagtcagctggggactgatccatggagaattattcaatgggggtgaggtgagcagcaacctggtaaattgtggtcttgtcagtgcgaacccagtcagtggggaccaggtcagtgggaaattggtcagtggggtctggtccatgaggcctactaatgggggcctggttagggagacatggtccgtggggacttggtcagtggggcctggtcaatgggggagtgctcattaggggcctcgttggggccacctggtcagtaggaacctggccagttagccgatgtgtgacctcaggcagggggtttgtctgtggagcctctttgcctccatctgtagggaaggtgagtcagggcaccctggagggtggctggaaagagaacgtgagaagatgtgttgaattcagcactgcttggcagacctccaactttacacagtacctgggttccacctagaaagggtgccagccctctctgctctgctcggcacccctcctctgtctgcatccccaggaccaccctcagtggagagggaagaaattggggagcacctgtgggaggctctaatcctggccctgggccctggtggtgacagtgatgaggacctgggtgcacctgtgagtggagcagctaggcctggccagagaagcaagacaaacaaacacacccatatgtacacacacacacgcatacacaaacacaatgcatgcacacatgtcagttcaggggatagaggacaccgactctgggccctcttgacccaagcaggctcctgttgtggtgggttgtgtcaccccacaatgtcactcttgctgagtccccatcgcctctgtgttgtggagcagttagagacacgcagcagtctctgtgagtggctctgcatgaaggattgttttctaggtgaaaggcacatctcaacacagctgactgatcggactcaggtgagtgggacct

SEQ ID NO: 48297 - DNA, 1082 bp, Homo sapiens
cacgtggctgttgagtacatgaatgaagaatgaaaaagctgtgatatttaaccacaattggaattaacgccatgtgtaaatgatttaatagtaattttgtattgtaattgcacgtacatatttctcattcttattaactctgataacgttctcaactccacattttaaacttacacttcgttaactgaaatgttttaggtaaagaacataatcctttctttttctttccaggttttgctatgttgagcacttgctcccgtctactttcttttgtagaatccactggtaagccacatctaatgaagagattaaccataaaatcttaaggaaaagttgtatgatttaaaagatcataaaactttattactgggctatttacatgaaattttaattgtttctcatataatataaaacatcataatctttactaaagtagaatattttcatgtcacatatggtgtatatttatatgttattttaaatgatgttttttagcctccttaagttttaagtggatcttgcaaatgaacaccagcgttattgagtttggcctactcaaattgcctgaatgtcagctgtttaaacagccaaacaaccaagtcatcattgatactttagtaaaggtcatcgagggcttctttgcattttacagtttttattaccatatgtagtaggagacttaaagagtatctgccaggtttgtccatactagtgttacggttttcttcttgtagctcaatagtattttgtgtggagatactttgaagctctgtaaatatctggttactcctcaaaacccactagatttagcatttcatggatgacttgtgtttgaacaagtattactgtgatggttgccagatgattgtttttcttattttcttctttgttctacatggagaaataaaaccaataaataaaggagaagggaaagctcatgattctggtgctccagttccccaagattaggccagtggtagacatttcaagctgactttatgtctttttgaattgtccccattattctgtcagcacttttttactttctggcacaaggtgttctaaactaatgtattttctct

SEQ ID NO: 48298 - DNA, 1062 bp, Homo sapiens
catttaaggaggaacaaaaatgaattatcagaaaaataaaagtaaaagcaagtgcaaaagttctgtggcaaagatgatgacagtaaagcacatttttgtgactcatggtagctttaactttgttcttaaaattctgagtaatttaagggttcacatttgaagaatctactacattatagataacattttatttcaagtcaatgcatttcaaaatttgctattggttttgtattggattattctcagcctacttcattatcaagctctattattttcttaatgcagtttaatgatcttgtggccgagaaggaagctgtgtcttcagaatgtgtcaatttggccaaagacaatgaagttcttcatcaggagttattatctatgagaaatgtacaagagaaatgtgaaaaacttgagaaggataaaaagatgttggaagaagaagtattaaatcttaagacacatatggaaaaagatatggtagaacttggtaaactacaagaatataaatcggagctggatgaaagggcagtgcaggaaatagaaaaattagaagaaatccatttacaggttagtttttaaaatcaggtaagtttatctgtaatgggctttcatttatttcactgcaaactatattttggatatgtatatattgtgtttcctctgcctctcttacagcaatttccttcgtagagttctagaaaaaaagtgacttttttccttttaaatatttaaatttccattattattataacaaaatcaatctttcaaagtaatgattctcactatagagtaaaagggggaatttgatgattaagaccaggtggcataagagaaaactgtgatttagaaattatatgatacttttgaattggtcttaagctacgttgttcattgttcactttttaaaattataaatggattctattactttttataggacaagattacattaatactaacataagtatgatttcaaatttttttaaatcagacaattctgaattcagttattagttttgttgatattgctgataaatattttaagcttcagcctcttttcaa

SEQ ID NO: 48299 - DNA, 1052 bp, Homo sapiens
acagctgcctggcaactcccaagatggctggcgctcccagcctggcagaaccggggctacatgtcgccctggctgcggccaagccaggcggtctacccggcggcggctgcaccgggacaggaaccgaccccccagtcccatccccggtggctgcggagggcccctgtcagcggccccgatctctcttcggaggaggagcgggtcgggagtcagggccaggcaggccctcaggcgggaagggatgcactcctgggattccgggacgtcccgcgggagcccaggagaacccgcaagccagcgacgcgtgcgcccgtgctgcaggtgccccctgccggccacgagggcttgggagcggcttccggagtcccggctggcgctgagttgtaggcgcgcgcctaactggcatcgcggggactcactcggtctgagagttcggagcgctgaggttcaggcgcgcgcctaacggcttagctgggctcactcggtctgagaggtcggagtctgcgagtgtcgctgctgaaggctgtggtggaccgggctggatcgcggattctgagctacattgcgggtttgggggtggatcttggatttgggggtggatcgcgggttgcgggggggatcgcgggttgcgggggagatcgcggatttggggcggagtgggggtggaaaggccacgaggagccgccgcggctcaggagcgggtggtgggcgtctgagaagtcgccaccatgaggaagctcttcagcttcgggagacgcctgggccaggcgctcctgagctccatggaccaagagtatgcgggtccgggttacgacattcgggactgggaactgcggaagatccacagggctgccatcaagggcgacgccgcggaggtggagcgctgcctgacgcgcaggttccgggacttggacgcccgcgacagaaaagacaggtagctcggggactcagcccgcggtgggagggggccgcaggcccggcttccctgcagcccggcagcccctggggcggggaccttggagggcgccgggcaccctcggagcagcggagcc

SEQ ID NO: 48300 - DNA, 1039 bp, Homo sapiens
gctgcctggtcgttcctatggaagcttcgtctcagagggacaccctgccgtatgaggtgtcagtctgcccctacttggaggtgcctcccagttaggctactcgggggtcagggacccacttgtggaggcagtctgtccattctcagatctcaaattccgtgctgggagaaccactactctcttcaaagctgtcagacagggacgtttaagtctgtagaagtttctgctgccttttattcagctatgccctgcccccagaggtggagtctacagaggcaggcaggcctccttgagctgtggtgggctctacccagtttgagcttcctggctgctttgtttacctactcaagcctcagcaatggcgggcgctcctcccctagtctcgctgctgccttgcagttcgatcttacaaagtattagtgagacccaaattcatagaaagatttccatgacatatatcatttaagtgaaaaaagaagttggagaaaacgtgcactgtgcaaaaataaagtacgtgtgaatataatgttaaagaactcaaagtgcattcactgatctggttattctagggaggagaacagattggcaaaagatgacttactcattttattccatatatttagatatttgaatttttacaaggacacattcatgtacataaatacataggctgttaggattgctcatgcctgtagtcccatgcttttagaaaccaaaatgggaagagtgcttgaggtcagcagttttcatttgttttgttttttgagacggagtctccctgtgatgcccaggctggagtgcagtggtgcgatcttggctcaccgcaacctctgcctcccaggttcaagcgattctcctgcctcagcctcccgagtagctgggactacaggcatgcgccaccatgcccagctaatttttatatttttagtagagatgtggttttaccatattggccaggctgggctcgaactccgaggtcaggagttttagaccaaccagggcaacatagcaagacctcatctcaagaacaacaacaaaa

SEQ ID NO: 48301 - DNA, 1064 bp, Homo sapiens
ctgcatcaattgaaataatcacgtgcttattcattttactgttagagtatattacactgattgattttttatatgttgagccacccttgcattttggggataaatctcacagggtgatagtttacaatcctttgattatacagtattgctgctagtattttgctgagatttttgcttatatattcataagggatattgtgctgtagttctctttttgtgctctctttggctttggtataaggataatgctgttatcaaaaaatgaattagcaagtattccttcttcatatattatgtcagaagagtttgagaagaaatggtattaattcttctttaaatgttaggttgactcaccagttaatgcagctatttggtcataaatgtttctttgttaatcactttcgattactaattcaatctgctaggttataggtctattcagattttctctttcttcttgagccactttggtagtttgtgtctttctagtgattcgtccatttcatccaggacagctaatttgttgttagacagttgttcacagtatactcctgtaatccttttgtatttctgtaaagttggtagtaatggctctgctttcatttattattttaataattagtcttccatcttttgctcagtcaatatagtgaaaggcttgatctttcaaataatctatgtttattcattctactgctctccaaacttctattttattgatttatgctctaattatgctctctattatttctttcatactgctagctttggatttagtcttattttgtcttcttccactgcctttaggtatagagtgaggatgttgatttcagatttttcttaaatgtagttatttatatccataaattttcctttgaactctactttcactgcattcaataagttttggtatgttttgtttttattttaatttatctcaagatattttataattttgcttgtgatttatttttttcactcactggtagttgaagactgtattgtttaatttccacattttcgtgaattttccagttttcacttatttatctgttgtttcttcc

SEQ ID NO: 48302 - DNA, 1066 bp, Homo sapiens
ccacttggggcctaatgttcatcgggaatctgatatccacctggggccttgtaattacctgggttctgggcatccacctagggcttgagtatcctcctggggccttgagttttactagggactcgtgtctgccttggacctgagtgtatatctgttgcctaatgtacaccttgagagtgatgtcaacctggggacagatgtcctcttggggtctgagtgtgcacctggtgcctgacgtctgcctagggacttgtgttcacctgacacctgatatccacctggggcctgggtgtccacgaggggctgatgttcagctggagactggatatccacctggggcttggggatccatccagaaactgatgtcaaactggggcctgatgtctacctgcggactaggtatccatgtgaggcttgatgttcatccatggccagacgtccatctgatgcttgatgtccaccttactcctgggtgtctactggagacctcatgtccaactagagcttaggaacctactgggggcctcgtgtaaacctggggactggtatgaagctgggtcctaatgatcccctgggtcatattattcacctagggcctcatgtccacttggggcttcagtgtcaaccttaggtcttgtgttcatctttgacctggtgtacacctgggacacctacggacttggtgtccagttgaggtgtcatgaccacctggggactgaatgtcaatctggggtctgatgtaaacctctagttcagtatccacctgggcctggtcttcgcctggggcctgcggtctacctgggccttgctgtcaacctagggcctgatgtaaacctctagttcagtatccacctggggccagatgtcttcctagagacttatattcacttttgacctgatgtccacctggggacttgctatccatccatggtctgatattcacctggagacagatgttcaactgtggccagaagtgctcctggggtctgggcttccacctggagcctgatgtttagctggggctagagttcacatggagaatgatgtccacctgaagtttgatgtt

SEQ ID NO: 48303 - DNA, 1050 bp, Homo sapiens
taaaaagagactactgagatgtgcagaggacagacaataaagcgtcttcgaatggtagataaatgtgtttggacttttcactcagggctgttgaagtttttgaaggtcagtggtctcagagttttggtgttttcaagccctgctaagcactttctttctagctgatgattggccaccattactgatcatctattggctctgtctgattcagcaatcccaccactgagtatttatgcaaaggaaaagaaatcaatgtatcagaaagataactgtacttgtgtatttgttgcaacactattcacagtagcacagacataaaatgaaactaaatacccatcaacaaatgattggagaaagaaaatgtagaaaatatacacaatgaaataccattcaggcataaaaaacaatagaattataacttttgcagacacatggatggaactggaggccattgttgtaagtgaagcaagccagacacagagtaaacatcatattgtatcactcataagcgggtgctaaaagatgtgtagatattgacgtagagagtggaatgataatggagactcagcagggtgaggggatggaaggggtgaacagtgagaaattacttaatgggtacaatgtgcattattctggtgatggatacctaaaagccctgacttcaccactatgccatccatgcttacagcaaaattacacttggaacccataaatttatacacaaaaagtcttagacctctctctcttctctcataagactcagagctcagtgatccccttggatccctcagcctgctgagttttgattttcctacctaaggtgattttgggcagagacaagggagtgtttctggaagatgttctcaggcacacgcttctaaagaaacattggagactcttctagtggcctttatctagtcactgctttaagcaaggaataaaacatctgtggctaaaatttgtaaaactgtgtttcccacccacccttcagacctgacagaagagattttaggattttaagggaacagctttttcctgacctaaaagggc

SEQ ID NO: 48304 - DNA, 1033 bp, Homo sapiens
atggaaccaagttggaaaacactccttaggatgttattcaggagaattttcccaatgtagcaaggcaggccagcattcaaattcaggaaatacagacaacaccacaaagttacttctggataagagcaaccccaagatactaattgtcagattcaccagggttgaaatgaaggaaaaaatgttaagggcagccagagagaaaggtcgggttacccacaaggggaaacccatcagactaatagcagatctctcagcagaaaccctagaagccagaagagagtgggggtcaatattcaacattcttaaagataagaattttcagcccagaatttcatatccagctaaactaagcttcataagtgagggagaagtaaaatcctttacagacaagcaaatgctgagagattttgagacctcctggcctgccttaaaagagctcctgaaggaagcactaagcgtggaaaggaactaccagtaccagccactgcaaaaaatatgccaaattgtaaagaccatcgatactatgaagaagctgcatcaattaacaggaaaaacagtgagctaacataacaatgacaggatcaaattcacacataacagtattgaccttaaatgtaaatgggctaaatgactcaataaaaagacatagactgtcaaattggataaagagtcaagacccatcagtgtgctgtattcaggagacccatctcacatgcagagacacacataggctcaaaataaagggatggaggaagatctaccaagaaaatggaaagcaaaaaaattaaaaattaaaaaaaagcaggggttgcaatcctagtctctgataaaacagaatttaaaccaacaaagatcaaaagacacaaagaaggccattacataatggtaaaaggatcaattcagcaagaagcgctaactaccctaaatatatatgcactcaatacaggagcacccagattcgtaaagtaagtccttagatacctacaaacagacttagactcccacacaataataatgggagactttaacactc

SEQ ID NO: 48305 - DNA, 1032 bp, Homo sapiens
ctctccaaatgtccactttgagatactacaaaatgagtgtttcaaacctgctctatgaaaggaatgttcaactctgtgtcttaaatgcaaacatcaccaagaaatttctgagaatgcttatgtctactttctaaatgaagctattcccgtttccaacgaaatcctcaaagctatgcaaatatccacatgaagattctacaaaaagagtgtttcaaaactgatgtctcaaaagaaagtttcaattccattagctgagtacacacaaaacaaacaagtttctgagaatgcttctgtcaactttttatgggaagatatttgctttttcaccataggcttcaaagcgccccaattgtttacttacagatactacaaaaagagtgtttcaaacctgctctatgaaaggaaatgtccaactctggagcttgtatgcaaacatcacaaagatgtttctgagaatccttctgtgtagattttacatgaagatattcccgtttccgacgaaattctcaaatctatgcaaatatccacatgcagattctacaaaaagagtgtttcaaaactgctctatgaaaagacatgttcaactccgttacttgagtacacacatcacagacaagtttctgagaatgcttctgtctagttttcatgggatgatatatcctttttcaaaataggcctcaaagtgctccaaatgtccacttccagatactacaaaaagagtgtttcaaacctgctctatgaaaggaaggttcaactctgtgacttgcatggaaacgtcacaaagaagtttctgagaatgcttctgtctactttttaaacgaagatattcccatttccaacgaaatcctcaaagctatgcaaacatccacttgcagattctacaaaaagagtgattcaaaactgctctatcaaaagaaaggttcaactctgttagttgagtacaaacatgacaaacaagtttctgagaatgattctgtctagtttttatgggaagatgtttcctcattcaccacaggcctcaaagcgctccaa

SEQ ID NO: 48306 - DNA, 1068 bp, Homo sapiens
tctggaatcccatgtgatggacaaccactcagaacccagcagcagtgttctgtaactatatgtgaggggcaaacattcagaacacagcaggattgttctgtaatcccatgtgagggacaatcattcagaccctcgtggctgtgttctggaatcctaagtgagggacaaacattcagacaatcatagcagtgttctggaatcccatgtgagggaaaaacattcagaccctcccagcagtgttctggaatcctatgtgagggacaaacattcagacaaacgtagcagtgttctggaaacctatgtaagggaaaaacattcaaacaacaccgagattgttctggaatcctatgttacggacaaccattaataatctcttcacagtgttatggaattctacgtgagggagaaacacacagaacccagcagcagtgttccagaaacctatgtgagggactcacattcagaccacggcaggattgttctggaatcccatgtgagggacaaacactcggaacacagcaggagtgttttggattcctatgtgcggaacaaacattcagaacctcgtgacagtgttcgtgaatcctataggaggaactaacattcagaacacagcaggagtgttctggaatcctatgtgaagaacaaacattcagacccccgtagcaatgttttggaatcctatgtgaaggacaaacattcagacgatcgtagcagtgttctggaatccaatgtgagggacaaacatttaagctacggggagggggcgttctggaatcctatgttacggacaaacattcagaacctcgtcgcagtgttcttgaattctatgtcagggaaaaacagtcagaacccagcagcagtgttttggaatcctatgtgacagacacacatgtagaccccagcaacagtgttctaggatcctatgtgagggaaaaacattcagaccccagcagcagtgtcctcgaatcctatgtgagggacaatcattcagaccctcgtagcagtgttctggaattctgtgtgagggacaatcattcgactgtcatagcagtgttctggaatcct

SEQ ID NO: 48307 - DNA, 1007 bp, Homo sapiens
caggagaatcacttcagcctgggaggcagaggttgcagtgagccaagactgtgtcactgcactccagcctgggcaacagagtgagactctctatcaaaatataaataaatataaaaatacaaaaaagccgggcacagtggctcatgcctgtaatcccagcactttgggaggccaagacaggcagatgacttgagatcaggtgttccagaccagcctgtccaacatggcaaaaccctgtctctactaaaaatataaaaattagtcaggtgtggtgactcactctctaatcccagctacttgggaggctgaagcaggagaattgcttgaacctgggaggcagaagttgcagtgagcagagttcatgccattgcactccagcctgggcaacaagagcgaaactgcatctcaaagaaaaaaaaaaaagaaagaatacaaaaaattagcggggtgtagtggcacatgcctgtaatctaggctactctggaggctgaggcaggagaattgcctgaacctggaaggtgaagattacagtgatgagactgcaccactgcactccagcctgggtcacaagagccaagagcgagaatccatctaaaaaaaaaaaaaaagaatttctatttgggggacaaaataaaaggagtgaaagggatgtaaagaaattgaaagtcaacaggctaataatgacaataaataatgagggagcaaagaaatcagtattggccaaataaaaccaacgtgttttttaatattttttcaaaatttagacaaagcattccagtacactgagacacttctattatcaagactttaatattgcctgagcacagtggcttatgcctataatcccagcactttgggatgccaaggcaggaggatcgcttgagcccagaagttcaagtcaagcctgggaaatatagggagacatcatctctgcaaaaataaaataaaataaaataaaataaaattaaaatataaaataaaataaaataaaatataaaataaaataa

SEQ ID NO: 48308 - DNA, 1123 bp, Homo sapiens
acaggacgagacacccgcggccccctctcccacgccgccccaaacaggacccaggatccagccgccgccgcggcggcagcgatatttaaaggggacgcagcctatctgtcaggagcggagcgcgagtcggctcagccaatgcgcatgcgcgaggcgcgagcggtttctcccgtcacagtggttcccacggttgtcttagaaaccagaccccgaggcttggcagagcaggagccctcggtggcagtgcttgggtgtcgaggctctgaggctccggcctcacctctccacggggtcgaagggaacgtctccggatgccaggagtcgcaaagggccgaccatgatgatgaaaccccaggcagagacgggggaagcagcacgggatcccagcctcaggcctgcacggacggtgttggttggggtgagtctccctaaaagtcgtgccgccgtccgtgatctcgaggacgggtcggcctgcgtgcccctgggctgctctctcacccgagggtcgttctcctccagagcagaaccccgcagcctcaggggttgcctgggggtgtgtgtttcaatgcctctgctgtatgactctgcgtgtgtgtgtgtgtgtgtgtgtgtgtgtgtgtgtgtctcccattctctcttctctctctgtctctcagtctctgtgtgtttctttcccactctctgtgcgtttgtgccagccgaagttgcgtcagggctaccaggtcggtggaggattgggggtgttgcgaattttgcagaaacctctttgctcctccggtagacatttgaaaacgtggcttgggtcaggcacaggcggccccccacccccgggtcccaggtgttctttgattttccttggcattgatggaaaggtcacccgtttcccccttccactggcacatgcctggaccccaccctttgtttcgccgtcgccccgtatgcctccggtgagacgcattcacaccaactgctgtgggattggccagtgccacgcgtggtcacatggtctccccctcggattcgcctgttttcctctttgcaggtgtggtgtaaagcgtggtcggctttctggaaccccagggcctttagaagtggggcaggccactgctctttcaaaggagga

SEQ ID NO: 48309 - DNA, 1047 bp, Homo sapiens
ctgtaacatgcacaagattcccgtgatgatggtgactatgagagcctgtcacatatgatgtagggccccactgcttcctctgaaacatgcgcaagattcccgtgatgatggtgactatgagagcctgtcacatacgatgtaggacagtgcttccctgtaacatgcagaagattcccgtgatgatggtgactatgagagcccgtcacatatgatgtaggacagtgcttccctgtaacatgtacaagattcccgtgatgatggtgagtatgagagcctgtcacatatgatgtaggacagtgcttcctctgtaacatgcacaagattcacccgtggatcttattaaaatggaaactcatagaccacactttgactagctaagataggagcatttaaatggatgtcttggtgacagtgctaagatgctactgttcatgtgggcactggctcaccatattaatgaagcttaggacctccagtcccggctggaaaagaaatacagatacataggatgtgactgtgcatatggaatgtctgttgtgttctggacattgtactagacaatagagataaaaagtcaaatatcccttgcctctatctgaaaggagcttcctactcagtggcttctgactgcagtgtatatgttcttttctgtcctgggtgggtgagctctatctcaatgttggtaactgaacactgcccaatgggtttgatgagggagatcatagctagctgtgctcccacaaagctatgaccatagcatatctcgtgatgccatttcccccttgtcagaagggtccctccagtatcatacatgctccccatgattataaattcttcctctttgcactaaatgttcctaaatcttgcaaagataaaaacataaaccacattctcatcatattagttatataaatatatatgcacccaatacaggagcaccaagattcataaagcaagtcctgagtgacctacaaagagacttagactcccacacattaataatgggagactttaacaccccactgtcaacattagacagatcaacga

SEQ ID NO: 48310 - DNA, 1050 bp, Homo sapiens
ctactaacttagaaaattgtatgaaaacagcaagatatatacatggccctcaggccagctgcctgttttaataaagttttattggagcacatccatggatctatggggctttcctgctacaatggtagagttgaatggttgctatagagaccgtatggtttgcaaagcctaaaatatttttcatctggtcctttatagcaaaagtgaacccagttttagaacattcactttacaaattaagatacagtggatgctgccttaactgacctccacttaactgatttacaatcagcactttcttgtacccctgtacaacttattgactgatgtccactgcaaatggaaagcctttgagctacttttaatgcctgtacatttctccttccatcacagaaactgtacagtttctaagaggaagctgtgttcattcctaaatatgtttacgccatttgttcttgttcttgtagttacgcaatttaattaaatatgatgttgagaggctgagatgggcggatcactaggtcaggagatcgagaccatcctggctaactcggtgaaaccccgtctctactgaaaatacaaaaaaaatagctgtgcgtggtggcgggtgcctgtactcccagctactggggaggctgaggcaggagaatggcaagaacccgggaggcggagcttgcagtgagcagacatcgcactactgcactccagcctgggtgacagagcgagactccgtctcaaaataaataaataaataaataaatattacgtaaactgagaaaatgagtataacaagagtagtattgttgtttctctgagaaataaactaaatatgttggaaaaatgagaaactcaacagttgctgtcagcttaactgttggcaagacaactagaaacaaatgggaaaaattgtgtaatctaggatttcagattgctttaccccagttgtcttcacagaaagtgaacaagaaatcaatgacaacatatcattggcatagtttccacaagaaactccactccgaatccgtgcaagggtttgaccttgtcatgaaa

SEQ ID NO: 48311 - DNA, 1027 bp, Homo sapiens
caccaatcagacgtagatttggtcttttcacatagtcgcatatttcttggaggctttgttcatttctttctattcttttttctctaaacttcccttctcgcttcatttcattcatttcatcttccatctctgataccctttcttccagttaatcgcattggctcctgaggcttctgcgttcttcacgtagttctcgagccttggctttcagctccatcagatcctttaagcacttctctgtattggttattctagttatacattcgtctaaatttttttcaaagttttcaacttctttgcctttggtttgaagttccttctgtagcttggagtagtttgatcatctgaagccttcttctctcaactcgtcaaagtcattccctgtccatctttgttccattgctgttgaggaactgcattcctttggcggaggagaggtgctctgctttttagagtttccagtttttctgctctgtttttttccccatctttgtggttttatctacttgtggtctctgatgatggtgatgtacagatgggtttttggtgtggatgtcctttctgtttgttagttttccttctaacagacaggaccttcagctgcaggtctgttggagtttgctacacgtccactccagaccctgtttgcctgggtaacagcagtgttggctgcagaacagtggattttcatgaaccgcgaatgctgctgtctgatcgttcctctggaaattttgtctcagaggattgcccagccatatgaggtgtctgtctgcccctactgggggttgcctccctgttaggctgctagagggtcaggggtcagggacccacttgaggaggcagtctgcccattctcagatctccagctgcgtgttgtgagaaccactgctctcttcaaagctgtcagacagggacatttaagtctgcagaggttactgctgtctttttgtttgtctgtgccctgcccccagaggtggagcctacagaggcaggcaggcctctttgaggtgtggtgggctccacccag

SEQ ID NO: 48312 - DNA, 1062 bp, Homo sapiens
cagacaatcattcagaccacagcaggagtgttcaggaatcccctgagaggaacgaacaatccgaccctcgtaacggtgttctggattcctatgtgagggaaaaacattcagaccctcatagcagtgttctggaatcttaagtgagggacaaacattcagacactcatagcagtgttctggaatcctatgtgagggacaaacattcaaataacagcgggagtgttctagaatcccatgttacagaaaaacattcagaaactggtcacagtgtgctagaattcgatgtgagggagaaacactcagaaccgagcatcagtgttctggtatcctctctgacggacatgcatgtagaccccagcagcactgttctggaatcctatttgagggacaaacattcaaacaacagttagagtgttctggaatcctgtgttacggacaagcattcacaccctcgaggcagtgttctggagttctactttagggagaaacattaagaacccagcaacagtgttctggatccctatgtgagggacaaacattcagatcacagcaggattgctctagaatcatatgtgagggagaaatactcagaacacagcaggaatgtattggaatctgatgtgagggacaaacatgcaggcactcgtagcagtgttcaggaatcctatgtgagggacaaactttcagaccacagcaggagcgttctggaatcccatgtgagggacaaacattcaaacaatagtagcattgttctagaaacctacttgagggacaaatattcagattccagcagcagtgttctggaatcttatgtgagggacaaactttccggccacagcaggagtgttctgcaatcttatgtgaggaacaaacactcagaacacagcaggagtgttttggaatccaatgtgacagacaaacattcagacacttgtagcagtgttctggaatcctatgcgagtgagaaacactcagaacccagcagcagtgttctggaatcctatgtgacggacatacatgtacaccccagcagcagagttctggaatcctatgtgagggaca

SEQ ID NO: 48313 - DNA, 1048 bp, Homo sapiens
aaactgttcaatcaaaagaaaggttcaaatctttgagatgaatatacacatcatgaagaagtttctcagaatgtttctgtccgtgttttatgagaagatatttccttttccaccataggcctcaaagcgcaccaagtgtccacttgtagattctacaaaaagagtgtttcaaaactgctcattgaaaataaatgttcaactctgtgagatgaatgcacacatcacaaagaggtttctcagaatgttctgtctagttcttaagtgaagatatttccttttccactataggcctcaaagtgctccaaatgtccacttgcagattgtacaaaaacagtgtttcaaaactgctcaatggaaagaaaggttcaattctgtgagatgaatgcaaacgacacaaagaagtttgtcaacatgcttctgtctagtttttatgtgaagatatttcctttaccaccatatgccacaaagtgctccaaaggtccctttgcagattctacaaagagagtgtttcaaactgctcaatcaaaagaaagttcaactctgtgagatgcatgcacacatcccaaagaaatttcccagaatacttctgtgtagtttttctgtgaagatatttccttttccaccgtaggcctcaaagaattccaaatgttcacttgcagattctaccaaaagagtgtttcaaaatagattaatgaaaagaaatgttcaactctgtgacatgaaagcacacattccaaagaagtttgtgacaatgcttctgtcaagtttttatgtgaagatatttctttttctgccacaggcctcaaagcgctcctaatgtccacttgcagattctacaaaagagtgtttcaaagctgctcaatcaaaagaaagtttcaactctgtaagatgaatgcacacatcacaaagaagtttctgagaatgctgctgtcttgttgttatgtgaagatatttccttttccacaattggctgcaaagctctccaaatgtccacttgcagattctacaaaaagagtgttccaaaactgctcaatcaaaaggaaggttc

SEQ ID NO: 48314 - DNA, 1079 bp, Homo sapiens
taaaatggggctggtaacagcatcattttactctcacatagatgaatataaaatgtagctcctgccttcattgtaaatgaggaattggactggttaaaaaatgaaacagaaaaatacagacattcctcctatagttaaagtccgcataaagcaaatgaatatatgagagccaataccttgaggaacatgtcctttatgtagcctctgttgacaatgaccccatcttgctcggggattagcaacattcttagggggaaaagaaaagtgctgctcccggtgcaggccaggggcattcctcatgtggctgtgcacattgtgaccacagtggggctgcagtatgtagagtatagggtgctgatgctggctccatgcaggagagttaaaggttggggagacccttcatattgagtcacatgttaacaagcagaggtgcctcagtgaggtatgggttttttgttttaagctgtactcacttatcttaaaaaaaaaactcgttgaaatttctgtaggaaatagaacttggttgttgctggaactgcattcactaaccctcttttactcagtaaaagaatggcttcctgtagtgcagtttttgacaacccaaggtttcttatccatctgttcaacaacagttcagtgcctaatatatgctaacatggtgctgggtacaatggtgtccacaaaggcagagtcactgtccctacaatttgtgaagttgtgataaaattgcaattgttaaaatgcagacatactattgttgcagacagattttgtgtgctaagctagactgttaagactagaaggagaacagcagagatggcaccagttggtggccaggggagggggctccccactcctgtaaaatctgccacatcttccctggccacccttctacataatgacattcccaaagatagatcatttatttctcaatctttgtaaagtatgaataaaattgttttgagaaaccgtgattttttaatttaaagtctgtaaaacattgtttttaagtggcaaccagattgccacctcaaagccccttttatccagaaattcagggtggtatttagagaggagaa

SEQ ID NO: 48315 - DNA, 2954 bp, Homo sapiens
aattccttattgtcacatagtgtcttttaaaaaataactgtagagactgtgttaattcgagtgcctttcttacttttttgggagcaagattatatttaatgtttaagaaaacaggatggaagttttatcaaacagttgattgtggcccattgttttatttattcccatcgctaggcatggccccgtagggtattttatccttcagtgagagactgatataagcaggcaggatgctttgattattccattagttatcattttaagcaccctaccaagatttagttctttctttctggcaactaacgttttgggggttggaggcatcccatttagaggatggtgtgtgcacaaatagattagcctgaaacctgcgtccaaagggaaacagtggcactctgccctaaaataaaggccagaacgttgtcctaaatgaatcctttgccttactttaggaccttccttccctctcaaattcaggcataatgtaatatagttgaaagggggaaaacagtacttgctttctctcaggtattggaggaaaagaagtaaatgcgtagatgaaattttaaatgtatcattttatctgtttgtatatggagaagggagggataggaattccatatttcaagatagcaaatataatttcatagaaatatatagctaaagattccaaagtgcttttacagagaactgttgaataatatattcctaaagggcagcaatatgccatgttcatggtgaagacagaaaaccaatgaatcagttgtggatctcaggtgggagaggaaacctcaggctcccaactttgacttctctactctcaccaggccatgttaacactgtaaaaccaaactctttgctaagaacaatacagggcagtagtttagtctgctgatgaaaccttgtgcttccaagaatattagctatatataatttgtgctttctggatgattctattgtccagaaagctaaccctgacgttacttttattagtctgttgttattcctcagggtgtagaagatttagtaaattcaggacaaattttatattcagtggcaaaaagaaaaggcaaaaatatgctaaatatattattagctcttaaattttagtatagatcgtattttttataaactattaccagtacagtagctagtagatattctgtgactgcctcattgtttatcttgctgctttggtccctatggctctagtatgaacattctcgtgtcttctgtggaaatgatttctgtgttatagttccatctttggtagaggtggggatgattgtattttgttttagttgacatcattctcaacttttagaaatactgttgaggaaaatgattaccgttggttttcaaattgacaactattttgcttccaaagacttcagtttccctttgttttatgtgtagacctcatatatgttcaacacattgcatactgccttgcacattgtaggaattcaacaagtcaagagttgataaaagctagaaagataaaactagcttagctatcatatcatcattgtccatattcttagctttgggaaaaatataccattttgcataaaatacataatcagtttcaaatgcataaggcaaagatatacagttgcacaacattgcaagtgaaatttacaaaggatttttatttttgtgtatgctaaaagtgctcctacttaaagcagttttctttattagaccaacaccttccagcaaagttagaaaccaaacacaagtgctcatttgcccaaattaaccagatagttatgtaaactgttcatattaagtctttagtggtttacaaacaataacattctggcttttcttccataccttttaggaatcagccttaattttaagtatagcagtcactttcctcaaggtactatgcagcatactttagattgcttatttatcattataaggtgataggtaataaatttgaggtttacttgtcatataatttcatatggcagatattgattcaaggagcattctattagaaaaagttgataaattatcctcccttacaaatatcatcttgcatttggagcaggtatttttttcttattagttaaagactgggtacagttatagtagatgctcaataaatgcttagtcagtgattgatctaacatcaaactaacagctttcagaaaggagactgttgacatcttttcaccaaggagtatatttgtagagtaatatatgtgtggaattttgaaattatatcatttgacatgatttatgaggcttatttaagctggagttagtaacgtaatagaagtattatttatacagaacatagttgaaagataggagatgtgaaagattaagtagtattttcttgtgcaaggcatattaataaatgtaattaaatgtcttaataagcagctggctgaactctagagagaactgctgtagtcttctgcaatcagtctctgtattggtatatccagtactatcgggtttaggttctttttatttttccttaaatcttacttgtttctagcgtcttaagagtggtaatggtaaaatgtgaagttacaataaacttctgcttgttttctcagaacatctttggcatgaggaagaactttttgtgaatgatacagtagtctcagcatctgttaatttgtggttttcaaagcatttttgacagagtttacctaatgtaaaaagattaaacagttttataaaacacaaataaacattcctacctgaactgtgaggaacagagtgtatagtacaaatgtaattaggcattgcctcctggcgaggttcttgatgcatgacttcgatgctggctgctgactgaggtgaccactgtcagtattgtactttggcatatgttgtttttaggaaaataatggaatgcattcttagattaacttactgtttttgagttggaaaaaataaaagatgaggtattataagtatgccaaata

SEQ ID NO: 48316 - DNA, 1343 bp, Homo sapiens
ttgtgccctgcacattgtgaggactcattaaatatttattaaattaatgaatgactaacaggaagagaaagattgtttgtgagtgttaagaatgagtgatgattgagaaattgatggattagtgcaatggattgggaatgaatgatgctttctagtttcgtaatacttgggaagagctattgcatatagagtaagttgatttagactttttttttcttcatttcattaccttgtttaaacttgttaaatcccagccaagaaatgcagctctgtaattgtcaattaactgtattataatatatattaaaaatttgtagagctaaagaacccacttgcattaagaacaccactttctgttcatttgtgatactagaggacagatcctgcatacagagccgaaactgcttttaatcatctgaagaaattctttgatttcagtgacttactgatctgtacctgtgcacatatcattttatgcttctccttttttccccgcaacttgaactgtgactctttcagatatttcttaaatctgtatgagtcattttttaagcttagggatttgatatgtattaatgtcccctttgtcttctgtagattttagcattttattacctcttaagaaactctgggcccagactttcagtcatatttcttattcctatggtacagttctcacttaaaggcttaattattagtagggttaaatatatacaggttatctctaaaagtacttaaatttttaaataagggcttatgtgatacaagatacggaaacaaaagtttttggatttttatgcagtagtttgcaggaaagcaaatacatagtagatcgtatgccacttaggtatgttcaggtcatgccagtttattcttgttgggccacacacacatgtatgtgtgtgtaaaaggaatttttagtattgaagcaaacaaattgtcagtttaataattttctcttacatagcacaagatggcagataccacctactgtacaacaatctaataatccctaccttagttcccctgagttatagaagatgctaaagatttagttgtaaagggaagtaacatgattttttttttctaaaaagctgttttaagctaactattattttgctactggaaaattatattttaaaacttacagatatttaaagtatgctagaaaatttgaacctgataacaactgaaccttttgtcttgaataaatttctcaaatagaactgtgcaaaccctagcactttatgtgttgctgcctccccatacctaggtatgctctgtaataagctcccatttaatggagagatgtgtggaggcactgagaagttaatgaagaaaaa

SEQ ID NO: 48317 - DNA, 1049 bp, Homo sapiens
aatctaaattattgaggatacactatggaaactataaaattatcatgaagtgactgttaaagtttactggcaaatgccaagggaaggaatagtatgtgcaaaacaaaacactttgatactgaacttaatcagggatgaggtaccaaagtatccacattatagccgtatcttatgtttccaataacaagggctgagtttttcaggtaggtgggatgagggtggggaatgggccatgtaatgtctgctttcttatatttgcccttttgtaagtggtctgtttcttcttttcatatactttgttttgccaatccattacgtattttttgtcacttttgtgtgtcatttttgtatacctttcctttcttacttcaggggtgtgtcttcaagatttctaccccctatttgcaatgaatttcatacctcatctaaaatacattcatataccagaaatatgaagagtggcccttctaaaagtttccctaatgatggaagctgtcagttgtcctatctgtgcagaatgtgagtaatagtggcagaaataagtgtgacaacaatgctttgcctgttgttctttttacttgctaggtaatttgtaaagtggggataaagatgtagggaaagtaaacctctctctcactgttacggaaagcctggacttgagttaggtagactgccttaaagaagaagaaatatgtccttttctttggcatcatggttttgttgagtggcagactgttgaagtgagttgagacttaagaacgccagaaaagttgtctagcctggccccagtagacagaatttgttcttctctcaagtaaaaaattacctttttatagcttttatattatttagatgaaaaaataccattatgaacataattccatggccctttgtgtacaaagcatattttgaattaaatacctcaaggtccacctagacctctatggataaaatcataagtttatgatttttagctcctgtgagtgtttgggggcaaactacacagagaagacatgggtggttcagcccattccactaaaatatgttgc

SEQ ID NO: 48318 - DNA, 1139 bp, Homo sapiens
tcggaacgtggagcaagccaggtttgccagtgcatacaggaaatggctggttactttgagtcaatgaaagaggtgaattagtcctacaaggttccccttttagtgcaatattgctttcttttattatttacatagttgcatgaactgtttactattattggctaaccatatgttcttcgtctttaggttgaaagtccatagtaaatctttcattttatttattttgttaataactggcattcctgtggggataaaataatcgtatagttccttcctgctgaacagcgagtcttaaattttctgtttaacttctcaccctttgtatttctatatgtggggcttctcatttggttttcctgattggttcacacacacacacctctacccccctcagtccaattgctgcataggcaaattcttttaaaaattaaaaatttaaggcctaggcaggaggattgcctgagcccaggactttgagaccaacctgggccacatagcaagacccgatttctacaaaaagtaaaacaaaatagctaggcatggtgctatgcaactgtgttcctagctatgcaggaagctgaggcagaaggattgcttgagccccaggtgtttgtggctgtagtgagccatgattgcaccactgtactcagcctgggcaatagagttgagaccctgtctctaaaacaaattgaaaataaacatttatgttgcagttcaactgaagaatgttggtatgaatgccgaataacttgatgtaattgttttgagaatcaaatggctagatgggcgaatgtttaaaaatgtaaactagttctctttctctagcatgttctacccaattaccaaagtcagaagtattggaatttatatgaaaaaaatgcttccaatgtaatccattttttaaatggttatttaagaaaaaactaacttaagagtttatgtaattgcagtaaaggaaaattatttttattgctagttttgatagattatttttacctcaaatttggtatatgccaaaacacatcagtccttataaaattgatttttttttcctgaaaacctggaatgccatttttagctattactactttttaatttcaaattcacttatgacaaatgggagaaatatataaagaaat

SEQ ID NO: 48319 - DNA, 1029 bp, Homo sapiens
aaaaatgcttcaacaaaaaatgatctcactagcatagtgtatatacctacatacatacatacacacacacacctatatacatatatgtatacacacatgttattcattgtatatcctataaaccagttgagcataggagaaaaaatcctggccttaagattcatggaacttagtcctgtttcataagttaactagcggctgactttgagtataacttttaattatcaagagttttggtttttttatctatgaaataaaagatttgaattaggtgaatttttttatgattctattaaacttttaaaaaaatatgtctggttggtcttatgaagggaagttgctccataaatctaacttgagggatgtttatgacagttaatcttgaaaattgttctagttagatgattagtaaggttttgtgctagatgagtagaaagggaatcttgatttttaaaaaatcctttgtggatatgtgttctagtaaattttaattcatatcagtaagattgattgacatagaaagacatcaaatcataggtacattttgagcaacaaactaccaacttcaaagtaaattctaaccctataaggtctctattgcgtatcaaatacacagaactttatttttaattgttagtggatctcttctgtactaaccctggaaggcattgagtgattttttaatgcatttttcaaactgctaaagaataatgcaatagacgtctagttcaatttgtgggtattgcagtcttaggggaaagaaatagaggcaaaaataagtttttgaactgatctcctgtaattacagtgagtgatacacataatttagaatttcagctgtcttttttttttttaaagaaaactgctttttttttttgctttggaaatttgtgaattacctgatgaaagaggttgacttagtaataatgtcctattttcttcatcagtctatgtacttagagtaagcaaaacacctttgagcaactagaatagttgatgccaaactccagtgattcatgttctgaactc

SEQ ID NO: 48320 - DNA, 1048 bp, Homo sapiens
tcttatccagcaagttattgttttttctattaaatattgaactcactgtttatgaagtgttgtgggtaccatctttactgtgtgaaatagaagtttaaaatacagttcttgaacccaaggcactaacagaaatttctgtaatggtggaaattttctgtgtctgtgctgttccatatggtagccactagccatagtagctattgagcaattgaagtgtccctaatatgaacagggaccacattttaaattttatttaatttaaatggatttgtacgtagtggctccatgtgcctagtgactactgtgatgcatagtgcaggtgtagatgagacctaagactaactgcatgaacagtaaattaaccctccaaagtagtttatagtaaaagttggataggagcatgatgagcaagtgctatgggagtctaatagaagtggagaggaggctggttatgtctcggataggggtgctagtggaggtgggttttaagccaagtattaaagtctgggtaggatttgtagtctcagagggagccagagacctccacagggagcagtgaattgacctaaacaagcaaagtgtggctgagaaggtacagtagggccagattatggagatccttgactctcatttaatttctttcattccattcatacattctgcaaaagagtacctccatttgacaggcacaatgctggtctctgggtatacagggttaaaaactgggtggtttaatgaacaaaccacacatggtccctatcctaatggaactttaatcagtcaacatacagattatgaaaagagtcataaaaagtaagaagggtacttagaataaaaacagggagacccaatttagattataaggtcaagaggttctttctgaggcaatagcatttaaactgagtgagacatgaggggtgaagaaaagctggctcaaggatgtacacttctaaggcaatgggtaggcaccagtgaacattttttagtaaagaatgatgaaaggcaattttagatcgtctgcaaggtgaactgaagaatagaaagccag

SEQ ID NO: 48321 - DNA, 1035 bp, Homo sapiens
gagcttatagctctagaggccagcaaatacttatttggtctatgagctcagaaaaccagaggatccccagagaatctcaatgcgagcatcaaaaaataatgtggcatcacctagaatttgggaaaatatttctttaaaatgcaatgactgtacggctgtgaaatattcacaagatagaagtttggaagtggggaagggaagtggtattttcaggttcataaacaaactttggaataaatgtttgcctaattaagcttattagtaaaactatagggaaagaatgcctggtctgtcttttcggatgtctccatattgctgggagaacaaattgctgatccaacaatgttccatgaaattactcagaaaactcacgaaagaatggactgacataaacactatgttcgtgtaaagtatgtgtcagcaactaccagttgtgctaatctatcttcccagtaattttctcataagttggcatgaaacacagaaggtctcaacaaataactgaaaggaaatgaaacagaaggaaaacaagagtatctcagcctgccttactcatatttaaagcaatgtagaattcatgaactcacaaatgatgctgagtttagcttgaaaaactcaagagtaggttccttttccatacttagctccttattctttgacatgaaaacttattccacttgacagtataattttccttgttctgtgtacaaagccaccttaatctgctctataatgtgttgattatcttgtcagtaattaatgacctttctatttctactttgctctcagctgctctgctttaataatgctgggacattaatatcctgaagcagttctcttccagtgttcccagacatcatgaaatgtgataggaaattcacctcctctcatgtgtcttgtctacacattggttttctgcttccttaatctctttatagcagggtgtctggctgttaaatagccaactatttataaatctctacagaaactttctagacttgctcttctattcgagtgaacttctagagctgcctt

SEQ ID NO: 48322 - DNA, 1022 bp, Homo sapiens
ttagtattcttcaagatgctttccaccttgggggacttgcctgtttcagtttagatgctattcagagaacagctgccaagtggcagagaaaccaacagatctcactgggttgggaaggcaataaccgaatttcagggctaccaaagcagacaaaacattcagggacaagttttctgagaaaagggaggtatgaaaaagtgatcccatcacttggcaatcttctaaggcatttgtgaaattcttaaattacggagagtaagaggacaagaagccaaatgcaaaacaaagtgggattttcagcaatctcatcagctgaagaggcaaaaattgaagtttagtacatactaaggaggagagtccctagttaaatccgagagtatatttttggagggtatatcctaggtttagggtagaagcagaagtaggctagcaaaacagaactacaacactacctcaggttagcttagttctgattggactgaggtgacttgctctattctagttgtctactggagaacaggttgaactctctctagtgggaaataccatcaccccaggattctataatttttcactgacaagtccattattcagtcaaattcacctgatattatcaagaaacaggaccagaggggatgggggtgggggtaacagatgacagaaacagaaccacaagtggcccacatatggagttatcacacaagtactgtaaataattatgattaataattcaataatatgagcatttaattatatgtttaaaaaaatagataaaacagttacaccaacaaactcaaatctgttcaaaagcaaaaaaatcagggaggaatatggaacctttgaaatggtggagtaaggacttctgaaaatcttctccataaaagcaatgagaacacttgcaaaaaaactgtcacaataaactttttcagaattctgggaattaatcaaaggcttttcacaatccaagagtgcttttcccaagcactctttgcttgactgaacttcagtcaggctcctaaacc

SEQ ID NO: 48323 - DNA, 1041 bp, Homo sapiens
gtaaccaaaacagcatggtactggtaccaaaacagagatatagaccaatggaacagaacagagccctcagaaataataccacacatctacaaccatctgatctttgacaaacctgacaaaaacaagaaatggggaaaggtttccctatttaataaatagtgctgggaaaactggttagccatatgtggaaagctgtaactggatcccttccttacaccttatacaaaaattaattcaagatggattaaaaacttaaatgttagacctaaaaccataaaaaccctagaagaaaacctaggcaataccattcaggacataggcatgggcaaggacttcatgtcgaaaacaccaaaagcaatgacaacaaaagccaaaattgacaaatgggatctaattaaactaaagagcttctgcacagcaaaagaaactaccatcagagtgaacaggcaacctacagaatgggagaaaatttttacaatcttcccatctgacaaagggctaatatccagaatctacaaagaacttaaaacaaattaacaagaaaaaaatcaaacagccccatcaaaaagtgggcaaaggatatgaacggacacttctcaaaagaagacatttatgcagtcaacagacacatgaataatgctcatcagcactggccatcagagaaatgcaaatcaaaaccacaatgagataccatctcacaccagttagaatgacgatcattaaaaagtcaggaaacaaaaggtgctggagaggatgtggagaaataggaacacttttacactgctggtggttctgtaaactagttcagccattgtggaagacagtgtggtgattccttaaggatctagaactagaaataccatttgatccagccatcccattactgggtatatacccaaaggattataaagcatgctgctataaagacacctgcatatgtatgtttatttcagcactattcacaatagcaaagccttggaaccaacccaaatgtccatcaatgatagactggattaagaaaatgtggcacatatacaccat

SEQ ID NO: 48324 - DNA, 1059 bp, Homo sapiens
acatccagtcaacttcaacttttcatctcattggcagtagtttcatccagatgcatgcttaagggaaatggcatagctgccaactttcccatgatctgctcaaaaataatagcaaaaaaacctgtcagtgttctgcagtgctcaccagtgacatcctcattacgaactcgagtggtcagttttcagtctttgtcatttttgtaacattggacatagtggtttaccacttcagaaagtagaattacattcttacgttggcttgcaagacactgtattctcctgctttttctccttcctcactggtgactcctttgctggtcacttttttcacaattccactctctctttcctgaccttttgaccctggagtgccccaaggtccagtttttacttcgctattcttacttccttgatgatctcatcttgtttcagggctttaaataccaaatatgttatatctcaaactcaaattttcaacctttttgctgaaatctagacttgttcaaactgtctaatggacatctccacttactgtcaggtagacatctcacactgagcatattcaaaactcaacttcctgacagcctgaagtagactaaatatccagtcgttgacacccaaaacctgtgagtcgcacaccactactctctttttctgattctccacatcaaggctatcaggaattcccactggctctacctttaaaatatatccagaatccagtcacttctcttcttaccgcctccactgctatcaccctggtccaagctgctatcatttctcgcttggattaatgcaacagcttcccaactactctgtctgcttctactctggtcccctgcaatctcatctcaaaattgtattcatagtgctccttctaaagcaaaagcaaaatcataccactcatttaaaaccttccactgggttagcatttcagagtgaaagctaaagtccttacaattggctttagaaccccatacagtctcccacctattctcttacctgtctcattcctactggctttctcctcacttactgtgttgcttggccacactggcc

SEQ ID NO: 48325 - DNA, 1049 bp, Homo sapiens
tcagactccacattctatacataagaagtctcgtgggcttctgatgacatctcctcacctctgctgcatagcctaagccatcactcctcttgccagggctactgcagcagcccccaaagtctccttgtcccattgcagtatactttacacgcagtagctggagtgatcatttcaaaatcagataatattaccttaaagctgtatgatggcttcttactgcttttggaacaaatttcaaactctttaccacaccttctaaggattttcatgattatcacaatacttctttgacctcaccacttgatcaacttgacttcttcttcctcttattttccttcctcttcttaatattatttttaattgataaatcacaattttatacctttatggggtacaatgtgatatacacacacacacacacaaaatgtgggatgattaactcaagctaattaacatatctgtcacctcacttatttatcacttttttgtgataagatgtgaaatttactctcttagttattttgaaatatacaatacattattgactgtagtcatcctgtgttcaacaaatctcaaaaacatattcctcttgtctatctgaaactttgtagcctttgaccaacaactccccattccctgctcctgcttcccccagcctctggtaaccatcattctactctctacttccatgagctcagcttgacttcttcatagcacttgttatctgatgttactctctctctctctctctctctctctctatatatatatatatatatatatatttgttgtttggcttgcttttttttttagagacagggtctcaatatgttgccaggctgatctcaaacctcaaactcctggcctcaggcaatcctcccacctcggcctcccgaagtgctgggattacagatgtgagccactgtgcccggccttggcttgcattttctacgtcctccccactagaatgtaaattccaaacaaataagaactttatatattacattcattgcagtatcttcagcacctagaatagtaaatggacaata

SEQ ID NO: 48326 - DNA, 1035 bp, Homo sapiens
cctgagaaacctataatgtgcttactgtccttccatgtattcatccatgtgaaatatagttaaaatgaaggtgaaatatagttgaaatgaatgccaaaggcaacttggaaagggaaaagaagcatcaaacaatcgaattttgtcgaagaagcataaatgagggaaggggagttaagcagctcactttccacctcctttttttctcttagattaacttcaggttgtttcttagcaacaactggtaagaattacctccttttctgctctaagccaatatccagtaccccaacccccaccctcttttcccccaatttccaaagttggcatccctagtaggattcccagtttagcaaccttagaggcaattttggtagccaataaatcctgttgaaagagggaaacttggaatctttgcctagagtgtaaattgacattgaggatggagctggtaggagagctggcacgttcaggaggtgaccttgtaaggataaaaacacagctgtgtcagcgaaacagactctttgaacaatgtctgaaaatagtattcaacaaatgttagctgtgattattactatggatttatgttaccagcaaggaggctggtgaatgactttattcactcaccacatattataacccccttactaggtaccagatactgtgttgagtcctgaatatgcaatcttcactccttaattcagcaaatacagtaattcagcaaataacagtatttttattatagaaaaatatttaatttgtattcttgtagtttgagacagtatcgcaaagtccgttttcagtcaagcttatatgattgggaaaaaatattacctccacagggtcctgcctgaaatttaacatcatcaatggcaatatcacttcttattgatagctctggacaggaataatgctttggaggaattatgatgcctagcctagtacgcagctgaataggtcaacatcttgaaatcttccttccccaatgtttcagctctgtttagggatttcctccactataggcagttaatcataaat

SEQ ID NO: 48327 - DNA, 1008 bp, Homo sapiens
tgttatttatctattcagagattccccttcttcctcgtttagtcttgggagggtgtatgtgtccaggaatttacccatttcttcttgagtttctagtttatttgcatagaggtgtttatagtattctctgatggtagtttgtatttctgtgggatcggtggtgatatcccctttatcattttttattgtgtctatttgatttttctgtcttttcttctttattagtcttgctagaggtctataaatcttgttgatcttttcaaaaaaccagctcctggattcattgattttttgaagggttttttgtgtctctatctccttcagttctgctctgatcttagttgtttcttgccttctgctagattttgaatttgtttgctcctgcctgtctagttgttttaattgtgatgttagggtgtcaatattagatctttccttctttctcttgtgggcatttagtgctataaatttccctctacacactgctttaaatgtgtcccagagattatggtacgttgtgtctttgttctcattggttttaaggaacatctttatttctgccttcatttcattatttacacagtagtcatttaggagcaagttgttcagtttccatgtagttatgcagttttgagtgagtttcttaaccctaagttctaatttcattgcactgtggtctgagagacagtttgttgtgatttctgttgttttacatttgctgaggagtgctgtatttgcaattatgtggtcagttttagaataagtgcgatgtggtgctgagaagaatgtatattctgttgatttggggtggagggttctgtaggtatctattaggtctgcttgttgcagagctgggttcaagtcctggatacccttttttaaccttctgtctcatcgatctgtctaatactgacaatggggtgttaaattctcccattattattgtgtgagagtctaagtctcttcgtaggtctctaaggacttgctttatgaatctggttgttcctg

SEQ ID NO: 48328 - DNA, 1058 bp, Homo sapiens
atagacagtgccttctcactgtgtcctcccatggtggagaggaagaactcatctctgtagcctcttgtaagggcactgatcctatttatgggggctctgccctcatgacctaatcacttcccaaagcccccacctcctaataccatcataatgggggttaagtttcaacatataaattttgaagggatgcaaacatttagaccataacaactatcttctgtgttctcttttttggctttactccaagcttttgataatggtgccacaagaaattggaacaaggtgcaggtaatagaaccctgtgagaccgtctctaactgagggcatattacttttgcttttggcaaattcataaagtaaataagtgaaccttcatggcctgaaagggagggaagaaggcagatggtaaaactcaagtccttggtacccaggaccaagtcccattctatccccccaaacgctgagcaaaaccacacactttctaatcaatcttgttaaagaattggtggaacagatctaggcagggattagggatctgaggaaaaccagtgcccctcccacggaggaactaaaaccccatacagcaggcttctgctggagatatgaaaaccttcttgagagaatgtttaaaaatgtttttcgtttttaaacatttgtttcaaacatcatacaaaagtttaaaatgatcaaaatgtctgctgcttcttactgtagtagtattaacattggaactgcatagtagtagctgtagaattggtagtaatagctaatacaacagcatttaccacacaccagctatggttctaagcacctttactgatttcatttctatatgctggatcagtgtctcaacagactggcctctttctaaaatttctatttattgggtgcaaaaactgacggaaagattcaaaaaaataatcacaattaatgtaacatttcaagtgttctttgtgatgtgttacaatagagagcctaaagatgaatgggccttcatcgctttcaaggatgtaaaatgagaaaacagtattaaattgttccagaagaactgaccttca

SEQ ID NO: 48329 - DNA, 1168 bp, Homo sapiens
aaagaggaggcagcacaccgaggcctgtctagaacttctttcatttaaccaacagtgaatatctaatctacaagaaactggagccgtggcagtttaggagcctgccaaggttgcatccctgggagcttattttctattgtgggagacaggaaaagaacaagtgaatcaactgtgaaattaaataattcaaacttaaagctgttggaactttaaattattctgagccttgcgaagaatgtggcgatggggcctgagtcccatggcatacagctgcaatgtctgccttgttttttcctataatcaggaagaccaaacagagacagaggtaagaccccctcagatcactacccccttcataaattaatatagttatcttccttggaatgtagctatctataactaatctaatcgctgtaatttatgcactgctcttgtattgaaaatgtactcctgctgaaccttctctgtttctgcctgtgtaaatgaaaccttaacttcactttggaacattgaccctatttgtttggagttggtgtttccaggtggctgtcctcaagctttgcgttagaataaactctatacttaatgatattttctgaatttcactacttaaggctgacacaacaaatgattagcataatgtcagactgtgacaggtgttaggaagaaaacaaaatgaacctgatgggtgggaggtacggaaggcctcttagagaggtggtggtgtttaagataaactctgaaggacgagaagaaactgtgacgatctgagaaaagagcaccccaggcaaaagaattttgctggaacataccagtaaggacaaaagctctgaggtgggaaggccagtgttgctgcagagcagtgaacaaggttgcagagcagaaccttgtccatcgtggaaaagcctgaattttatttttaaagcaatgggaagccattgcaaagttttaagcaggagagggccatgttctgactaaagcttttaatttttttatttgattttttttatttgatttttttgagacagagtctcacccagtcgcccaggctggagtgcagtagtgccacctcagttcactgcaaactctgcctccctcgttcaagcggttcttctgcctcagcctcccgagtagctgggattacaggtgcatgccaccacacctggct

SEQ ID NO: 48330 - DNA, 2438 bp, Homo sapiens
gtctataatggctgaaaccactacatccatctatgccatttacctgaaaacttaactgtggcctttatgaggccagaaaagtgaactgagttttcgtagttaagacctcaaatgaggggagtcagcagtgatcatgggggaaatgtttacattttttttttcttcagaagtaacgctttctgatgattttatctgatatttaaaacagggagctatggtgcactctagtttatacttgcgctctgaaatgtgtaaacatagggtgcctacctatttcacctgacccatactcgtttctgattcagaatcagtgtgggctcctgcagtgggcgcgggtcacggctgactccaacttccaatacaacagccatcactagcacagtgtttttttgtttaaccaacgtagttgtattagtagttctataaagagaactgcttttaacattagggactgggagcagtccatgggataaaaaggaaagtgttttctcacgagaaaacatgtcaggaaaaataaagaacactttctacctctgtttcagatttttgaaacacttattttaaaccaaattttaatttctgtgtccaaaataagttttaaggacatctgttcttccatacgaaataggttaggctgcctatttctcactgagctcatggaatggttctgcttatgatactctgcacgctgccttttagtgagtgaggagtttggggttgcctagcaacttgctaacttgtaaaaagtcatctttccctcacagaaagaaacgaaagaaagcaaagcaaagtcagtgaaagacaatctttatagtttcaggagtaaatctaaatgtggcttttgtcaagcacttagatggatataaatgcagcaacttgttttaaaaaaatgcacaatttacttcccaaaaaagttgttacttgccttttcaagttgttgacaaacacacatttgatattctcttatatgttatagtaatgtaacgtataaactcaagcctttttattctttgtgattaaatcctgttttaaaatgtcacaaaacaggaaccagcattctaattagatttactatatcaagatatggttcaaataggactactagagttcattgaacactaaaactatgaaacaattactttttatattaaaaagaccatggatttaacttatgaaaatccaaatgcaggatagtaatttttgtttacttttttaaccaaactgaatttttgaaagactattgcaggtgtttaaaaagaaagaaaagttgttttatctaatactgtaagtagttgtcatattctggaaaatttaatagttttagagttaagatatctcctctctttggttagggaagaagaaagcccttcaccattgtggaatgatgccctggctttaaggtttagctccacatcatgcttctcttgagaattctatttggtagttacaattacagaaactgattagtttgtcagtttgcagatagatttagcacagtactcatcactcggatagattgagatgttctttcacatcagatgatctgtaacactgtaagatactgatctttacaactgtttaatcagttttatttttgtacagtattagtgacctaagttattttgctgtcccgtttttgtaaatcaaatgaaattataaaagaggattctgacagtaggtattttgtacatatgtatatatgttgtccaaataaaaataataaatgataaagactgaattgttctagccattatgtgttgtaaaagggggctatttcaccataatgaaagttacttctttaacctgtgttcgcaggattttgggatgagtgcaaagatgattttaccctgtacctttcaacacatgcaatagttatatagacttgtgtgtatttactattcacagacctctgaggaagtagatgcaatagaggtcacttgaaaccattgtgttatgctggaggggaatatttatattttgggagataaatcactttaagaggcttttagagctcataactgtgcagggtgtactaggaactggtcagagaaagttgtaagctcagattgtgctcttgagatacgatattaataagaacacacaagttgaggtttcattggctcaacagtagaaacataacaccaagcaaagacaagcatcaaagtgtgtgtgtgtgtgtgtgtgtgtgtgagatttatgcagacatgtactagctattatgtattaattaagcttttattgtaaactactcatggcgttgggtgtttaggtttttcacatttaatccttacagcagctcagtacagtagataattattattatgtacatatttctgatgaggaaattgaggattggataacttgccaagaggcacatctaataagtggcacagacagtgtttaaatttggatctgctgaatccaaccctgcatctttg

SEQ ID NO: 48331 - DNA, 1021 bp, Homo sapiens
gaaataataatatgtgcatctagttaatataaagagatatgaaaaatattagaaacatttgaactgttgtacacatgtaaagggtggtgaaatataaaaatgatttcctttgagcaaagaactcggtctgggaaaagtcatgcttgcacagcattttagaaaatctaataatttcagaatgaattatcataatttcaagaaagcctttaaaaatatgaactctgtctaatgaaggctcttttgataaagcaaatgatcaccccttttaaaaaaatctgattttatatgagacgtttttgtcacataactacacatataattgcaatcagtaaagataaccagcctcagccagtcctgccttgtctccctaattgatgtcctttcttcttccagtatgtgcgagtatcttttgatacaaaacctgatctcctcttacacctgatgaccaaggaatggcagttggagcttcccaagcttctcatctctgtccatgggggcctgcagaactttgaactccagccaaaactcaagcaagtctttgggaaagggctcatcaaagcagcaatgacaactggagcgtggatattcactggaggggttaacacaggtaattgcaagtggaacagagaaagtcaacataggccatgggaatgttgtgcctgatgtaattttctgctaagattaattatttctatatcaccccacttcatccctacccatgggtccatagttgctggttatcactccctcctttatctaaatgagaactgtaaagttatttcttaaccaagaagaattacttacacataagaaatgggttgggatatttaatagttgactatacagaattcataaacatgactaatggaatttcacaggatatttttaaatagctcaagttgccaataattctttagggaatgacttctgctttaaattggaagccctacctctgtcctttacacaatttcaagtttggtaccaaatagctttaatttttacaaaatgacgtttccatctg

SEQ ID NO: 48332 - DNA, 1032 bp, Homo sapiens
atgatacacaaagtgctgttcaaaccacatttacattactaatgttattccaggatgcagtgaaaggatatttacaaattagagcaaatcctgaggtatttgccaagttggaaaaggtaccgtaaactgaaactcccaaaccagctgaaagatgtgactaaggagtaatagctaccttcaaatatttgagaggcatgtacaatgtattttatctggctctcagagcaggactgggtgaaaattacacaataccagattaaagctcagtatgagaaataactttatggctatttgtccataaaggaaagggattgcttcctaagcattaatgagtatcttatcactagagacagagcagaagctgaatgacatctgtcataggtgtcacagaagaaattccagatttaaatgaaaagtcgaactagatgtactgtgtgtaaggtcgtttgagactttgtattccattttgatttcccctacttactcctgagagcttacctatggtttttagaagacagtatgatgtagaattaaattggcagtcagatctgggcctcttgtcagctaacagtgactagatctgcaacattgggcaagttatttctggacctcagttttctcactagaaattaatggaactaattgaataataatatcccttacatttctaatgtaatgtgaaaatttcagccctactcacacgtaatggctcatatcagtttttagccttaactgatgactaaaatggtcccaatttgtttgttttgatatttggcttttgtacatactaacatagtacaattttgatagtaacacaaatccttggtcttgtgccatatcctccaagtacaaaaaagaatgatgaagaagaactttcatgaactagtttgtcatcttcatacttttccaggtttcttacacaaatttaccagttctgtatcctacatgaatatataccatagattttttttttctcggtgatttctataaatatataggtagtgttcactttaagagagcttcataagtgaa

SEQ ID NO: 48333 - DNA, 1024 bp, Homo sapiens
tataacaactataagaaagtattataattaaaaaaatagctttattgagtgataaggttcacacttttaaaggttaacttcagtggaataatgaagttttaaagggtgctaagttaaaactgatagccagctttcattattagtgcttcccagtaacgcaaaagggtcactttactcaaacaaaacatgttagtattcagttcagtgttctgtgtctatatgaaaaaatcccattttttaagtggtcaactttactgtttttttcttttcttttcttttaatcttggcatttaccaatttgaagaaaactttgaaaaatgattttcagccttaatttttttaacatatttgatagccagtgttaatcaggaatgggcagatttcatcaataatcccacatactattttagcacttatattttagaattttagacctgtgttttctttcgtgttgaaaccaaaatatagttggagtttcataagtgtaggtactttaggaaatattacttctctgagcctgtgtttcctcatctgtttaatgaagagattgaattaaatgatccccaagatcttttccaattctggaattctgtcatctaatgaaatgtgtgtaattagaatacatgccttttattttatttgcctgattaaaagttaggacttaagtaaccaggagagagaaaataaataatgaacttaaataatgttcatttttgggatgaatgaacattggaatgtcctttttgggaaaattggatatccataataactccaatttctgaccttctgatggaccaaaagaaactcggggcctggcattcactatgcacctttcccacaaagtccttgagttcctcatctgtgtgcttcagaggtaaaaaacactgaactgggagtcagtatacctgggttctaattatagagctgtcatctactggtgactttgaagatctgctcattaggcagctggactctagattagatggtctctaaactcctttctagctcatactgttaggcagtt

SEQ ID NO: 48334 - DNA, 1030 bp, Homo sapiens
aaccccatctctactaaaaatacaaaattaaccgggtgtggtggcgcatgcctgtaatcccagctacttaggaggctgaggcaggagaaccacttgaacccgggaggcgtaggttatgatgagctgagattgcgccattgcactccagcctgggcaacaagagtgaaactccgtctcaaaaaaaaaaaagaagccaaaaatctgtttggaatcatacctaaaatagtaatagtcattaaccaccaataaaatttacccatgtctgtgttttaactttttattgtatgagtctacattcagttattaaaatatttgctatctccttttctttttcagagcatgaataatctttcatttagtgagctatgttgcctcttctgctgtccaccttgtccagggaagattgcttcaaaattagcgtttttgccacctgatccaacttacacactgatgtgtgatgaaagcggaagccgttggactttacatctgtctgaacgagcagactggcagtattcttctagagaaaaagatgctattgagtgtttcatgactagaaccagtaaaggcaacagaattgcttgtatgtttgtacgttgttcacccaatgcgaaatacactttactcttctcacatggaaatgctgttgatcttggtcaaatgagcagcttttacataggactaggatcacggattaattgtaatatattctcatatgattattctggatatggtgccagttccgggaaacccacagagaagaacctctatgcagacattgaagctgcttggcttgctcttaggacaaggtaaattgtggttggaatttatttttcatactcgtggtggttagctaaaaatatcttgtgtaagaatagaataaaagctgtttttattatacataactgctatatagaggttatatttactattatatacctgtgaataaatattttagacagcaattttaaatttcacataatagcaaaacaaagtttttaaagacagtttcaggtttgtttgtctacattaa

SEQ ID NO: 48335 - DNA, 1037 bp, Homo sapiens
tttggactatgttcagaaattcattagctaatagtcacaagtgttttttacactttctcatggtttacttgcaacttcagcttacaaggaacctctcaagaacatgaatccttttgattcatcaaaccgtggattaaaacatatagatagcctaattgagttgcactgctcatttttaataaaatggcttttatgttagaattgggttagaaataagtctgtgtcataaagataaaattttccagaatagtcttgtgtaggcaatctcacttagttctgtgtgttttatcaatgttcaacagaaagatctatgagatttacgtatatgtactttgatggaaaagccaggaaggaaggtgctctttagcatttgaagctagtatgaatttaaagcatggaactgtttgttctggattgtctgggtttcaaaggttttcgttcagcactgcccattagggctttctgtagtgaaagaaatattcatactatgctgtgtaacttgtagccacagtggctggtgggattgaagaagtgaatatttaattttaggtaatttaaatttaaataatcatatgtggagagtgagtgcttagctagtgcagtgtctagcagtatcaagaaactgagggaaaacaaaagtaataaaaagcactgcattaaaataaataggacttctgacccaaattagtttgcttggcacagcttatagactctttacccttaattttcatcttctactataatgtcatcatagatctaacatcttcatttctgaaccttactagctttttttttactaggatagtaagttcacaacttacactagaactgacactattttgatgtctctggttgatgcctcctatcttcacctcaactttcttttttcgtctaactccagtactttccaccagtgagaaaggactcttatttgcacattgcccagtacatttttttttccatttgagaaactcctctaaatttttctaaactcaaattattaaggcgtttgttcagtttaccccaacaaaacccac

SEQ ID NO: 48336 - DNA, 1055 bp, Homo sapiens
gaattttaagaaacaacctataattctgaagcagacctagtttgctgtaagtgtggaagtatacataacagtgtagtttacttcgccagacctttgggtaagggggtggggggtagtgcttgggagttgtagtacagcaaaatcaaacaaaaaaatcttacaaaaaggagcttgagattcagaatcaacagaggtatgtgatgaaaagaagtactaggtaggcaggcaactgggctgtgaactaacccagaacataattatttcaaattaaaacagaaatcactggggtctaaacatgtctttaagaacaacatggattttgttgaacaaattctaataaattggaatatgttaaatgtaataaaaaggcaaaaacttcagaaaattaaagcctcttctgaaagtccaaatgtgaagcaaacgaaaatgtgccttatttttgaacagtgaggtgtaattgagtatcaagaatgtaaacaccttgacacttggaatttagtgacataaaattgctgtttattctctgagttttaccatgccccttggatgggcagtgaatgacactgtaagtactttttattatccaattaatgagaatcaaccaatagataaaaacttaataaattgcaaatgatataaaacttaatgtgaaacttaattgtatagtcagcaataatggtatatgattacatgggggagccagaagaaacttcctaaagttgatagaataagaaatacaggttcagctataatatctaaagttataactaatacaaactaaaataaatcagaatgagcatagaaggtgggaattagggtaaatcttctcagtctttcgtgtgtgtgtgtgtctgtgtgacagagtccagctctgtcacccaggctggaatgctgtggcacaaacttggctcactgcaacctctgtctcctgggctcaagctattctcctgtctcaacctcccgactagctgggattgcagacatgcaccgtcactcccagctaatatttatttatttatttatttatttatttatttttatttttagtagaaaca

SEQ ID NO: 48337 - DNA, 1033 bp, Homo sapiens
cttttgttgcccaggctggagtgcaaaggcacgatcttggctcaccgcagccttcgcttcctgggttcaagcgattctcctgcctcagcctcctgagtagttgggattacaggcatgcaccgccatgcccagctaattttttttttttttttttttagtagagatggagtttcgccatgttggtcaggctggtctcgaactcccaacctcaggtgatctgcccacctcggcctcccaaagtgcttggattacaggcgtgagccaccatgcccagcctcccatgtttttacttcctttccaccatgcaccctatgcttttcttctttctcactttacacattatcctcctagcctggaggattttccctccgttttgggaagtcatatctaaatgaagttctaattctctcacaaaggctttcctaattcttgatctctgctgtcttctgatttctgaaagcttaaaatctactccacattaaatagcccttaattttttattggatgaaaagaccctacagaacattaattcccaatctgttaaatatattgttcttattttcttatattaggcatctagtctattctttgaaatctttattccatttcttcttaagcactactgaaaaaaaatgtatgaaaagacaaaatttccatatttgaagaaggtggtgaaatgtaaactttttgaggctggaaaagttttattaagcacaagtaacaagtgtttgttacacatctaagagtagtgctatttcttcaaacctttacttacagatgcatatgattaagggaaaacagctgcagccagaggaaaaggaagtggtagagatgacagtttatgcagctagccaaactgggtagacaaactgaaggccacattagtaaggattgactgacatgttacaacatctatgtaaagagagttaaagagtattacatttatattgagagtgcataaatgttataattcccccatatctctactaaaaaggtattatatatagtatatggaaaagggattgatagttaa

SEQ ID NO: 48338 - DNA, 1042 bp, Homo sapiens
gtgttgtggtaatgcctgttttcatctgtaaatagttaagtatgtacacgaggcactacttctgatttattgcaatgttcagtcctagtttttacttttattcttaaagcattcagttttgctttcaattttatgtaccttagttctgagttagacctgcagatgtgtacagatagttcatatttatgtattgcacataatcatgctattcagcattgatgctatattgtattatgtaaataataaaagccatgtacagagggaaacttcacttgttcattgggtttttaagccatagttggagtcctaaagggggaaaattagaaaatgttactttacatggctatataattttttttcctttgccatcgctgaacttgttcaagtgataatcaagagatattagaagcatttgcaggtatgatacctgataggcagtttatttttgaagaattcaataggcacctttgggattaaaacaattttaaaatttgagaaagatgaaatttgaacaattatggcctacctcgcttctccatgttgtaaaagatgatgttttatgacaattctgaagaagaaagtaggtatgacttagtttacaaaaagagttctgttttatttctgttttgggtttggctctaatacagagattcacccatggacttggtctctgtagcgtttatgccagatcataaagaacaaggggtgacaggtacatgttgactttacctggggtaaatgattaccagagtgcaactgttgcttctctgtgatggagtttggggtggaaataccctagttttatctgtcagttctttgcatgctgctacttttgcttcaagttagggaggtacatatgtatgtcaaagttcctatactgacatagggtagtatttctctgaatatgaaaagtcacaattgagttgaaaatttagaagttgaagatttagaagggcaacttaatttttcaagttaaaaatggaagtaagagtggtatagagaaggtaagatgagccctcggactccatcactctgaaggtct

SEQ ID NO: 48339 - DNA, 1105 bp, Homo sapiens
aaattttgttatttttgtgttaaagaactagtggcagtgtgggctttagtacagtaatgtattttttgttcattgtgagaaattttattgatgccatgtgtacactgaaacttaaagcctttttaggtggagaaacggtgggactgtttgtagatgctatctctgtcgatagtggatgcccattttagataagattcttgttctgcctgtggaatccttaatagtttaaaatcaatacttctcgagtagtttctaaagactgtttgccgatctgtttttaaaaccaaggtttaaaaaaatctttcaagtcttcctatgatgtttagtgcacctgtgaaaatggtaaaatgattgttttggaatttttggatctgacgttgatttagggatgaatggtttgagttttatttgtcaaaatttgctgtttttatatctacaggattttttttcctataagcataaaatcaaagttggctactgttatttactgtgatgtaatgaatttgaactgccctgattgaaaagtttgcatttaggaaattataacgtggaaaaactgagcatatgattaacatctcccagctctttaaaacagaattaggattttgtttttagtactggctgttaccagtgttttaaaggaatttcttgagtgaagcgatcattttacaaaattagagaagcaagtagtatggtgattggcaggaatttctcagatttgaatcaagttctgatgttaaaatggaagattctgtttaaagcttgtattttcaaggaatacttataaacatttttatcaggcatcttcctgtttctcttaaatacttccttttttgacttaaaaatgttagccagtgaatgcttgacaaatttgtgtttttgtccttttcagttgtcactcagcccagtccatcagtttctcagcccagtacttctcagagtgaagaaaaagctcctgaattgcccaaaccaaagaaaaacagatgtttcatgtgcagaaagaaagttggtcttacaggtattacaaaacacaagacaatgtatgttttacttctgcagttaacaaggagcttttggtcactccctaagagactagttggtctta

SEQ ID NO: 48340 - DNA, 1029 bp, Homo sapiens
aatctggaaagtaaggacttgcccaaggtcactgacttagtggcagactagagacttgaactcaggtctccattcccaggtgagtgggaattcatgccatctcatcacatcatgtgcacctgaaagaactgtattccataggtgtaaaagctctttgttcagaattggaattggagaattgttcagttacactcgggtgtttttttaagctgtaagttagaggaagccataaactttataaaatctgcattctagctatacctgatagagctgacacgtgcatgctcaagttgctaattactttaaaggcaataaatagtaatggtatttttttctaaaatacaaggggaatgcaatacctaatgggaacacacatcccccacttcatcccctaaatcctcactaaatgaggattcttttttacactgtctccactgtgcttagttttttatcaacaaccttgaccattttagctttgactatgctttcatcttctagattgagattgttctgtagtttttcctacattaggaaaaaactagcagccctttttttgttttcttatgttagatatatgaacgctgcatccttagttcttggggttgtgtaggagttggcaggctttgagatataaatagaagctgatttcagaggcccctgttgactaggctttatgtgagagcctccatccagctcagcttgtcacattgcagccttgtgacaggctgaagcgccctcccatgtgatctgagcttctgagaaatattaaagcaagctgtgcacatgtgatggcatttaaaagctggctttctaggggaaaaaaatctaaaagatgggaacccatgtagaagactcatgtcctggtacctcttgtgtgtctcgcagttgaaagttatttataatgaaatgaaggtagacatgttctctgaagcaaagttggaatactttgttatctctgagtgtgtgaaatctttagatggagtatcctccattttatctaaaacaaatattttaagaatcagattaact

SEQ ID NO: 48341 - DNA, 1031 bp, Homo sapiens
tattgttaaatgtatagaatgtgtgataatcaatttagggtatttggggtatcaatcaccttgaatatttatttctatatattaggaacattccaagtcctcttttctagttattttgaaatatacattgttgttaactattaactatagtcacccaactttgtaacaaacattagaacttactctatctaactgtatgtttgtacccattaaccaacctctcttcatagccactcccacccatatgcccttcccatcctctgatggctatcattctactcactacctccctgagatcaactttcttagctcccacatatgagtgagaacatgcagtatttgtctttctctgcctggcttatttaacttaatgtcctccagatccatcaatgttgccgtaaatgacatgatttcactctcttttatgactgaatagtactccattgtgtatctagaccacatttcctttgtctgttcatctgttgatggacacttaggttgattccttatctttgctgtcagtagagctgtcaaaaacatgggagtgcatgtatccttctggtatactgatttcctttggataaatgcccagtagaagaattgctaggtggtatggtagttctatttttagtttttttctctattgttttccatagtggctgaactaatttacatttccaccaacagtttgagttcccttttctgtacatcctcaccagcatctgtaatttttttttgctttttaataatacgtattctaatgtaaagtgagacctcattatgatttattattattgcatcagtcaacctttaatgtccaaaggaggcatggatgcagagcataggagatgtggcagggtctcaggccttgctccggaaatgagggagagacgaacacaaaccagacactttcaactgaccacacagtctgggagggcagggagaaacacagatttggacattcatgaaaaaaataaaacctgaaatcaagcactcccattttgtgcccattgaagggtttgatataggaa

SEQ ID NO: 48342 - DNA, 1060 bp, Homo sapiens
ctgaatgattgtgatctcaggcaagccactctttggcttatttcctcatctgtaagagaggattaataccatctatttcagatggtttattaggtcatatgagcttttatatatatttttgtgtgtatgaaagcacatgatagacgattaccataaatgtaatttcagtctgtgttgactgctatatagtgatggaaaaaatgaggattgttaacaggacattagttttaattatcttacagtgaccctttgaaaaagatttccgtggaatcctggggaaaacagtaaaaaatggtaggtacagatacagattccaaaagtttgttgggaattataatgaagtataatagtaggtaatgggtgagggcataagtaaaatttaatggcatgttactcccacttttattaacctgctagcacatccctcttatatatgtttgattctttctctttgatacctatttagatgtgggatctttcagtcagtgtgtatgtgcattttcagtgaaaagttgcctttcagaaggactgcaccaatttacatgccaggaacagtgtttaaaagtaacgtatatccattctgtggccagtactggatattgctgagcttttcatttttgtcagtacagacatacctcattttattctactttgctttattgcaccttgcagatactgtatttttttttaatttttttattttttacaaattgaaggtttgtggcgaccctgcatcaaacaagtctgtattggtgtcgttttccaacagcatgtgctcatgtcatgtctctgtgtcagcatttttttgcaatcacgtatttttaaattaagtatgtacattgttcttttagacaaaatgttattgcacatttaatacgctacagtatagtataaacatacttttatatgcactgggaaacctcaaaatgtgtgtgactcactttatcatgatggtctggaactgagtctgcagtatctccaaggtatgcctgtataagaagtgttatctaatttgaatattcatttacttaattattgggacagttaagcaatttctctg

SEQ ID NO: 48343 - DNA, 1072 bp, Homo sapiens
agaaaaacagtaacatgttataaaatagtgtgtgggaaaaccttaaatattcatacatttagtcaggggttggcaaactacagcccaatttggcctgtagcctatttttgtatggccctaccactacaagtatttcttacattcttaaagggtaatggggaaaaacacaaataagaatatatgctagacactgtaagtgggacacaaagcctcaactatttgccatctgtcctgttacataattaatccactattacctatgtttattagattaattatacttctagaagtctgtcagaggcaaataatcagatatgggcggactaaagactgatgaaatggacagacatactcagcaagaacttagagtgaacttatatttctaacagtaatggagtggacagtcataagacattcatacagtaaaactattttctagaaataatgaaatagagaaatgttcctaatgaagtataagatgtaaaactgtatatggaatatactgtacatcaaggaaagactgcaaggagataaatattcaagtgcttactctgaatgttagacttataggtgattttttaattttttaatgctttttcatgttatctcagcttcctagttttgatcttataatcaaagaaaaaaacatatctttgctccttctgttatggccactaaaagaatatgaagaaagctgcgtgtggtgttgcatgcctgtagtcccagctatttgggagactgaggcaagaggattgcttgagcccaggaattctaatccagcttgggtaatataacaagacactgtctctaaaaaaaaagttaaataattaaaaattaaaaaagaaaaaaagaacgaagagacatgagagttgagaaaataaagaaccctttgaggaatgtgtctctgttattcatcttcatatatatccagtgccagacattagctaggtgcttggtaaacatttgtttaaagaatgggcaactaggtcgtgaatatgaaaaactgctcagcctcaaagagatgcaaattcaaattatatataattttccccatatcaaattagcaaatatt

SEQ ID NO: 48344 - DNA, 1033 bp, Homo sapiens
taaagttatttggaatctgattgtatatgtgataggaacttttgaacttcgaagatcttgatgaaataatttactgattaaacccagaaatagggaccagggacagcattactttacggagcccaaaagagaagtttggatattttatttctccaggtttagtagtaacagagggagcaaggcgtcagaccatcagagaattgaatttgatgcaggaattgtgacggaaagaaccataaagttaggaaaggcagctaacatcagatagctaagagtgggagatacagaaaagtctggtacattttgctcttgaaaaatctagaaagaatattgggaaatgtcttgggaatatggtggacccatttagttaagtgcgtagttgtacttacttttaatatattaggaccaatttaaaattgatatttatgggtaagtatgggatgggactttgttggggtaggggttgatcaggaactgaagtgtggcaatatagagaagagatcttgtgtgaatattctagtggttgtgatactatttcctatactctcttctttaccagcgtaatgttggattcaggacatttcattttttaaaaaaaacagtttttatttgtatatactctcttgaaacacttcaaatacttgggctgaaaatagtataacatcaaaaatatgctttttaaaatgtcacttaaagcctaggggtacagaaagtttatgtagcagagaacagtggattgttacattctaatattttgtgatcttctagacttaaactgtagccactaatcatatctggataaatttaagctaaaattaattagtatttaataagctttaaaatttagttgctcagtttcactacccatatttcaggtgctcaatagctacatgtggctagagtctgctgtactggacagtgcaaataaaagcttttccattatcgaagtaggttgtgatggacaatccggttctacacatttagcaagtacagttgacccttaaacaatatggatctgaactgcacgggtcca

SEQ ID NO: 48345 - DNA, 1010 bp, Homo sapiens
tcgatgtcttagctgatgtctcccaggcgaaaagtacccagaaaatcatgagagtgcagttcctggaaattcagttatttctttctcgctgggcttgctctgcctttagaattgttgtgactctggattcctgcggaggaactagggcctggggtgacctcatggctcctcagctatgatgcaccttctcttttcttcccttatctcaagtaggtcctgagcagcccagcccaggtggtctcttctgctcaccaggggtggcctggagtcaattgataagagccctcttttcttggcccttacaaaacaaatttctgcctaaagacagctaaagggaagaaaaacaccaccaaaccaacaactcctttgtacctccattatccccaaaattagataaagaaaaattagaataccaggaggcagcagacacctccacaatgcagctcggaaacagaatttctatagatctgctgtcctttttttaaaatcacatagaagagtttgtacaaatctcatttgttttcacttccttcatttttgtgtcttaacacattattttgaggaaaatgcctctgaattttatccttgctcttcaattacggttgaacaggaactgttaattgagtttagccactcaaaagaagaacaaagtatttcatcattcttacatattctggttggactcatggttaaagaagacaaatagaaaaactcacacatcagcctggtgtggggataaaaccaaaaacagtgatgctcacaggcatgcctgagagtggaatggtggtgttggtgggggagtgcctgtttactggtagtaggagtaactctcgtcatcatattccagctcatctatgtcatcgtcatccagcagcccatatttaaatttccggtagactgtgccatcctggcccatgtagacgatgtcatcatcatcatcctcatcatagtcccgatccctgtactcaatcacctgatcctcttcaaagctggtgctctctctatagctg

SEQ ID NO: 48346 - DNA, 1017 bp, Homo sapiens
ctcctcagacaccgagttaaagaaggagcagtttattcggccaggagcatcggcaagactcctgtctcaagagccgagctccccgagtgagcaattcctgtcccttttaagggctcacaactctaagggggtccacgtgagagggtcatgatcgattgagcaagcagggggtacgtgactggggactgcatgcaccagtaatcagaacgaaacagcacaggacagggatttttacaatgctcttccatacaatgtctggaatctatagataacataaccggttaggtcagaggtcgatctttaactgccaggcccagggcgtagcgccgggctgtctgcctgtggatttcatttttgccttttagtttttacttcttctttctttggaggcagaaattgggcataagacaatatgaggggtggtttcctcccttagattgaggcagtgctgatgaggcagaaagacagattgagctgatttttaggagagaaaattcagaattgataaagctagcttggtctttgagtgtaggaagataaaaagaagaaaaaatagcactcttgttgtgtatctcttacttggaaaatgtaatgctaagcacataaaaatgctcagaaagttatttaataagtaagtctccatagcattatctggtcttgatttaattttatttccaattttaaaattactttctattaactggaacctcccatgctttacccagccttttggtgtgtttccagtctacaaggattctcttaatatttccaagtagaaaactaaaaggtgactttgttttccaatcacatatttatctatttagatagtcattagcatagtattcaaaagccatctaagaatgacgttgcatgactaaaaacaaagaaggaaagatgtcaaacctcaatacacaagcatgagccttcttttcattgcaggccacacagaggaacaccacaatttttcttagtattgaagttcatctcaacctcaaccaatctttaactgtgtatcat

SEQ ID NO: 48347 - DNA, 1039 bp, Homo sapiens
atacagaactcagaaattgcatctttttttttttttttaaagatggggtctcactatgttgcccagactgaagtgcagtagctgttcacaggccaggttgtagcacactgtagcttcaaactcatgggctcaagtaatcctcctccagcctccagagagctgggactataggtacatgccactgcctgcatctggctcagattacatccttatacattgtggtacccaataacaaagattaataattggtttttttatgcatttattttttaaattatgtagaaaataaagagtggagttacaaaccaaaattataatactgactttgataattgctgtctgtgaaagactcacttgaccaaagataaaaatgatttaaaagcctgtttcataaaattgagcttgccacaattaatgcacttcattcaccatttacttcatgcatcaattgcgcttggtcaccctcttaagataaaacagtttactacatggatggtggatggaggatggtgcttattgatacagtcccacattggtgcttttctctttcctttttaaaccacctgagggtatacttttctgccctactctttacaggaccccacaacttcagtgttttatctgttagatttggctgaatcttttgtcagctcaaatgtgtggcaaaaacaaattacagtgaagctaaattttgttctgtgtggagttaatagaagtgaagtgtgtcactgctggaaaactacagagctaaatgctggcgtaagcaatagtaatgacgcagaagtacttaacattttgctcagtatttcagttatttttcagtattaatgatttgaaaattattttttggagacaaggaaaacaatcgaaagatcacaaaataccattctgttgaatgaggaaggaaaagaaggggaggggacaatagcccataactaatttgtctttagctacttagataacaaaaatgttattatacagccagttaaggaatgccttttgagtgttaggaaaaattgaatttgaaacataggcatat

SEQ ID NO: 48348 - DNA, 1076 bp, Homo sapiens
ggttcaagtagatagctggtatggattttaattgtcttctaaatcatcctttatgcagggaaagcctaacatgtttgagtgattactttttgtttggcatccaatagtgccaaaatggactttggcatcagactgatttggttaattttaggtgctttttttttttttttttttttgagacagaagcttgttcttgttgctcaggctaggtgcaatggcatgatctcgactcactgcaacctccacctcctgggttcaagagagtctcctgcctcagcctcccgagtagctgagattacaggcacccaccaccacccctggctaatttttgtatttttactagagtcggggtttcaccatcttggccaggcttcagtcttgaactcctgaccttgtgatccacccacctcagcctcccaaagtgctgggattacaggcgtgagccaccgagcctggccctaggctcttattatttagtgagtgaccttgggtatgggacctaacttttatagcctcaaattactcatatgtaaaatggggatgatagaacctgaaatagagtgattttgatgattacatgagatactggacctaaaatgcacacggcgaatgcatcataaatgttagcaacctgtcacttactcaggagatttctggggtaaattgctgttgtattttcacttgttgatcactactttggaaaggttaaaagtgtacttttaaaaatctcagttggcagggtcttaagatgacttgaatctatcaggttgtacctgaagaatctggagtatccttcctcatctaattctccagtttttctcccctcgaattcctctgtcagaagcacaactgtaagaacaccaccacttctctgctcagaaattttcaatagcagtttggagatgaccttaggcaagtgcacacctcttagcttcacattcaaaaagccttctacaattgggcctctgggtctatccttctagatttatcacattccctctgctcctaccaaaggaggtcagttgcatgctcttccgaatacatagccgcattttcccccctgacttcactcccat

SEQ ID NO: 48349 - DNA, 1045 bp, Homo sapiens
gcccttgaaagccgggtattgtccaaggtttctccccatatgatagtctgaaatatggcctcgtgggatgagaaagacctgaccgtcccccagtccgacactcgtaaagggtctgtgctgaggtggattagtaaaagaggaaagcctcttgcagttgagatagaggaaggccactgtctcctgcctgcccctggtaactgaatgtctcggtataaaacccaattgtacatttgttcaattctgagataggagaaaaaccgccctatggtgggaggcgagacatgtttgcagtaatgctgctttgttattctttactccactgagatgtttgggtggagagaaacataaatctggcttacgtgcacgtccactcatggtaccttcccttgaacttaattatgacatagattcttttgctcacacgttttttgctgaccttctccttattaccaccctgctttcctactacattcctttttgctgaaataatgaaaataataatcaataaaaactgacggaactcagaggccggtgccagtgcaggtccttggtgtgctgagtgctggtcccctgggtccactgttgtttctctatactttgtctctgtgtcttatttcttttctcagtctctcatcccacccgactagaaatacccacaggtgtggaggtgcaggccaccccttcacttcattaaatttaccacaatttataactattttaattatgtgtctgattacttttttactatctaactactactataccttccagatcaccatcaccaccaacccctgcattagactggcaagttccatgaagtcagagacaatgtcattgcttccttgccactttatctccagtaatatttgttaaaagaataaatcaagaccattttaaaatgaattctagtttaatataatcactatttcaattctgaccaaggtgattatgtatatacaaattccactcaaatgatgccttatgtccccaagcagtatttttcaacaagcaaaacaaaaattgataagtatccaaaaaaagttac

SEQ ID NO: 48350 - DNA, 1090 bp, Homo sapiens
aattcattctgaagatgttcgtggacctgaacccagacagtgacaaaattatctactcccacttcacgtgcgccacagacaccgagaatatccgctttgtctttgctgccgtcaaggacaccatcctccagttgaacctgaaggagtacaatctggtctaattgtgcctcctagacacccgccctgcccttccctggtgggctattgaagatacacaagagggactgtatttctgtggaaaacaatttgcataatactaatttattgccgtcctggactctgtgtgagcgtgtccacagagtttgtagtaaatattatgattttatttaaactattcagaggaaaaacagaggatgctgaagtacagtcccagcacatttcctctctatcttttttttaggcaaaaccttgtgactcagtgtattttaaattctcagtcatgcactcacaaagataagacttgtttctttctgtctctctctctttttcttttctatggagcaaaacaaagctgatttcccttttttcttcccccgctaattcatacctccctcctgatgtttttcccaggttacaatggcctttatcctagttccattcttggtcaagtttttctctcaaatgatacagtcaggacacatcgttcgatttaagccatcatcagcttaatttaagtttgtagtttttgctgaaggattatatgtattaatacttacggttttaaatgtgttgctttggatacacacatagtttcttttttaatagaatatactgtcttgtctcactttggactgggacagtggatgcccatctaaaagttaagtgtcatttcttttagatgtttaccttcagccatagcttgattgctcagagaaatatgcagaaggcaggatcaaagacacacaggagtcctttcttttgaaatgccacgtgccattgtctttcctcccttctttgcttctttttcttaccctctctttcaattgcagatgccaaaaaagatgccaacagacactacattaccctaatggctgctacccagaacctttttataggttgttcttaatttttttgttgttgttgttcaagc

SEQ ID NO: 48351 - DNA, 1032 bp, Homo sapiens
attgcaaaattacatttttagtttatcttgctagatatgtcacaatcctttttcaaagcatctaggagaattcttggtacataagagactccttcttaaatcaatgtaagaaaatataggttgggcacagtggctcacacctgtaatcccagcactttgggaggccaaggcgggtggatcacctgagattaggagtttgagaacagcctggccaacatggcaaaaccttgtctctactaaaaatataaaaattagccaagcatgatggcaggcaccagtaatcccagctgctcaggaggctgaggcaagagaatcgcttgaacctgggaggcagaggttgcagtgagctgagatcttatcactgcactcttacctgggcaacagaatgagactccatctcaaaaaaaaaaaaagaaaagaaaatataaaccaattgttttatcatcacacatgaactgaatgctacacaaatgtagtgtgctcagaaataccagaaatctatggaagtgagactgttacagaggcccattgtagatagacctgaccttacaaacaggtgttctaagagagatgtcagtctggaagatgtaaaatgatccataatattgggtcgtttggaggacagattgacaggagagcccgaggcagctgtatctttgtgcacacttattatatagctgaaacaagcatacttaactcagttgaacagaagtaagctatcactcccctgatgaagagcctacagtggctcccaatcactcagggaatcagagtgaaggccaagctaagaaataaacttagccttggctttcaagtcatctgtctgctttcacctatccacattttgtgaatgggtgggtgcctgggtgggtggatggatggtcagacatagcagtgttagggaaaatgattataacagatcaaatctgcagtgcagatgtaggcttcatgagcaatgacacagtatttattgaaccaatgatgattgaatacattagcagattaggtaacaaagtgtccctcttgtctctt

SEQ ID NO: 48352 - DNA, 1026 bp, Homo sapiens
tctgtatccgaaatatggaatggcaagatggtctcatggtcaccatggggtgcattcaaaatgtacttttaagggtaatttagactatgtatgatttcttccttgcactctgatccgaattgctattacattcctaaagtcagaggaaatatataaatctgtgtaccttttattttatgccagctgttatgagcacatggtcactgccagaattccttctactttgagtttctgacttccagtgggaagctgagagttagaccaggagcagcagttccttaatcacttattcaaaccttaaggaagatattggtggagggtggcagaaacagtttggggaatttcagatgtttttgtagttgaataaaaccgtacagcttataaactcacaaaacctcagaaatgtactatttaacaagtatggcatagctatcagtcagtttaaaaaaaaaagatcagccaatccaaatggatattagccataaactgaatgtcagccagctcataacacacattgttcctgaatagttgaactcttactgcctcactctgcctctgtggcagctttgagatcttcagtgctcatttccctcatctggtctatttcagcaatagaattggttctgatcccttctcccttaatccttatttaaatactccactcttcaagacacttgtaagttcaaaaattttcccacctatttccattctctggatacctgaagagttacttcaccccagaggttttaagtgtgatacactctttcatggctctgtgccgactgtggaccctctcctgctgatgttgtttgttttttttgtttgtttgtttgttttttgttttttgtttgagatggagtctcactctgtcatgaggctggagtgcagtggcatgatcttggctcactgcaacctccgcctcccgggttcaagctattctcctgcctcagcctcctgagtagctgggactacaggctcatgcccctacgcccggctaatttttgtatttttagtagagacggggtt

SEQ ID NO: 48353 - DNA, 1023 bp, Homo sapiens
tgacagaccaagactccttctcaaagaaaaaaaaaaaaacaacttctaaatgcttcattaccgtttttcataggataaagaggtattgtttttgtttctttatttttattaatggaacagtttctggctctgttaaaggggcatttaagcaaggtattctaaaagctctattccttccccaagattctaggaaagtgagccttttactttcagtttttcctaacacaatttcttgaatgtctgaagcttcagtggtcagatttcacatgggatgttccagaaagatgatattccctatgtaagactctgaaattcttgggagcatttgggccttttttttttttttttaatcaaaaagcttgttctttttattttttcgcctgtctgaattctaccaactgaacagggaaatcttctttatctgtttttcctgttgtcaaataaaataaaattccaaaccagcagcaacatactcctctggttaatgagattgtaggagcacagacattacaaaggactaaaatgattaggctttttctgaggtataatatcaggaaatgaaccacataacattatgtgatctcagaaatgaagatgatatgaatctataaagcaggcatttacctattatgccagggtggggagaaatcagtcaatgagttgttttgttggtataaaatcaacctacagttggttgttaggggtctcagtctctagtcagtgttttcaaaacatgatttaattcaccaacagtctcgtcaacagatctggaggcaaaaaaagcttccatggtcaaacaagtttggaaaattcaataatatccccaatgctaggctcatggatttatagcacctttctaggtaagggccattgcctttttataacttctgtgttctgcagcacagacctctgtttgactatttataaccattattctccccattctcttacttggacttcagaatccatttgtcaaatacctattaacattccaattaacttagttttccattaacttaattt

SEQ ID NO: 48354 - DNA, 1043 bp, Homo sapiens
ccagtgtgagatgctggataattgtttatttaaatgcttccaatgtctatttttactgcaagcctctcaccacaaagcagttaagaaagcttctctaatatatgtgttatacattcggagttttctttttttcttttataggtaagcataaactcccatgggggcagaaaatattacgaaaattctttgtatgtgtgtctgtgcttcaatacaatttggttgggctggggtttttttgtttgtttgtttttttaacatgaatacatgaggtgtgatatctgggcttcacgtgtaacagtatgagctcagcagtgactggtagagggagtgctgtttcttctaccatgtgtcttccccagagtccagttaatactccttgtatagtgctcaggagtggcctatcggtctgctttccctacctgtgtccctttcatctctctccagtgctctccctgaagggaagagtatgaattgtgaccctgggctcagataaaggaactgccccacgaacttaaggtctatgcccaaatcatcatcttctcaccccttccctagagacaaacacattgtcatgatctagactataaaatcaacaatggaagactgataattcatttattctttttttcttttttgttttaaagtatttgattcagatgtaagaccaaacatgttatatatgttataaaacaatcaaatgcagccaggtgcagtggctcactcctgtaatcccagcactttgggaggccgaggcaaacggttcacctgaggtcaggagttccagaccagcctggccaacatggtgaaaccccatctctactaaaaatacaaaagttagccaggtgtggtggcgcatgcctgtaatcccagctacttgggaggctgaggcaggagaattgcttgaacctgggagacagaggttacagtgagccaagattatgccactgtactccgactccgactccgtctaaaaaaaaaaaaaaacaaaaagtaatcaaatgcacacatctgcaccaaatacccatttgagaatgaggacagag

SEQ ID NO: 48355 - DNA, 1028 bp, Homo sapiens
ttggcacctgctctgtttacttaagcactcaattgataagaactggaatctttgctgatttttacctaaagctagaaaagaaaacctttcaagccagcaaaaataaccttcctctgaaaaaatacatcaaaggagtggtgccagctcagttggtattaggttgtgcattgcatgggttggaaacgatggactgtaaagaaaaggggtctttgcagcaggcagaagtaaagcaacaacaattaaagtaaacagagcaaactttccatgacatgctgctaccagcatttgtaataacccccaggataggaccctactggaagacgggttagctagtgggaaactgacaggagggatcaggagtggggaggcaggacacagttactagagcagagatacgtaataaaggcttggagatagaaacaaaagcaaaacatttagaatggttaagactcacttgatgtcacttacctgtcccagtgattgggttcttttcagtgccctctgtgaagacaagaatgacatcagagcatacgtccagctctactttctcaggagccacagattttggctcttcatgcagaaatactcagaatatgcagataatgacacatatcagaaaccttatcactgaacattttaaattccatggtgggggaaggaggcatgtcctacacaataggcatcctgttttgggggaggtttatcacaaaaactttttattgatcactgaggggaaaaaatggggttttcatctgaaaccttgggtgtctcagtctttttctttccgattttgtgtaagctagacaattatgttggatttactttctccatcttcagtggaagaaatgaccttgttgagtaaaacaagtatgttaagtgtcaattcataaacacaggtttgtatggaaagagaggatatgaaattagacacacctgtgaagatctggggatgggtgacatcttttttttccagtaaacatttattgatcctttatgaggtaccaagcactttagtaagagctgggaag

SEQ ID NO: 48356 - DNA, 1007 bp, Homo sapiens
cttgccaggaccgataagaccttcacttttttgagaccaagaataactgtaaggtagggtcaagcaattactcttcatcctacatagccagcctcatattttactgcattctgtatggctgatgctagtctaaaggtactttaaaataccatgttaaaatcttggcttccattgaaaagctgctgttatgcagtctgtccaaatctataaacaaatgaacatcctgaatggagctaattttcttgagcttcagatcttcttacaactccgggtcttatggttaccagggcttagagttggtgtgtttaagttgaaaggcaaccgttgtttctttactttaaagcaaaaattccaatttacgctaatggagataattctttttaaatcatattttcaggtttcatactgatggcttactaagcttcatatgctttttactatacatagtgtatccaaacagatatgtggatctaaatgtaggattgatttaatgaaattattaaatttatcattatttcacatctatctccttctgtagttaaagcaaaacaaatccattaagggagtgaataggataattcttctaaatgtactgtaagaatatactttcattagctcttcgtttctgggtttcattttgttattcatcagcagagtatgaggtgttacaattacgttatagaatagtactggaaagaatagagttcttgcattcaaaggagaccagagaaaatttccaggagttagcatttagagcaggtattggtactcccacaggcgatgtgaaattgggggtgtcaacatgggaagatcattttaggtaggaacaggcaggactctgctcctgtgtttgatgtgttaggcaaagaagtaaaaacagtccaagaagctgacatttatagctagtgtgatggggcctaagtatggagatggaaagacacgaatggaaataggaaagtacagaggcaccaacggaaggagtgagttgaggtgaggtgccttcaggc

SEQ ID NO: 48357 - DNA, 1041 bp, Homo sapiens
atctagaggaatttgcattctctgcctgagctggcttggggccagctttgtggaatcctggtgccagttctttttctgcttcaggggctattttttaaaaaaatcagtagttacattttatgtttaccaatagatttatatagcaaatgatatttgttttttatttaaagccacaatatcaagtgtctttttaaaaatataaataataatcctcatggtatgcagatgtagcagaaaattgtgcaggtggtatgtgggcaactggatttggggaaatgctgctgcatgtcatgcacctctccataggtaggtttttcccctttattttctccctcttttcagcaaaactctcccctctactttcccactgaaaaatagcaatggtgagttaaactagttagtctgatcatggtgtgggcaatgggtggttgggttaagattcttatttcatttgacttgtccatcaaggccttcttgttatgtcactgactttgagcaattcccattgggtgcatgattgaagtataaagggatgcctttaggattgtggcttctgtgattctcctaatttccaggaaaagggcgaccaactcatgagctcaaattctgaagctctttagtggcattaaacctggctctgatctgtgaaagttgacattcccaaggtgtttttcccattcctgagagctctgcagagatcttatttgcgtgaagcaaatccataaagtcattagcagataagtagatggacctgcctgtggtgaacacccaggctttcaacctaatagtttgttggcctggctggtggttcctgctgaaaatctttggggataattagcacagctgactgttgctgagccaggtaaaaagttaaattatatttatgtttacacttattccagtggcaaagatgtggactcatgtaacttcttgcctttgactaaagaggttcatttagtttgtgtaaaggatttaatttcttaaaaaattgtgttgtttaatttcattctattagttctaggatgcagggtaaccagccga

SEQ ID NO: 48358 - DNA, 1015 bp, Homo sapiens
gcaaacttgttggaggtactagaacttgaactgcagggccataaataattacagtaacagagaaatgagcattgcagatgggtctgcgttgtttgccatgcaatttaaacccattttctcctgcccttgtctcataaaaatgggtcattcctgttagccaagaagagattatgctattcaatcaaattcttatgaattagttattttaagtacagaatgggatcatatacttgtacgtgaaagtcagtaattaaagtaggttacggtaattgttttcacactcctcctcaaataaaaagcataatttggtggaagatatacatttattacccacctatattttttccctaatttgaaaaataatacaggagtctcaataaatgtgcagaatctatgtttgaaaatacgtgaacttgtctgtcagcaattcagcttcgattttcaagtgtccttgaaaagaactgatgagtttttacctattctcgtcattacatggggtggtgaaggagctacttctgtttctgagactactatacttagtatttataatgctaaaacaaagttcatgaaaaaccaatgatacccttataatgatagtttctatgacatggaatagggattataaacaaattatatgagtacagaatatttgaatattcttcggggagagttggtttacaagacaagcattggagccattattaggtgtagaaaaatgtgacagagtaattgcagctgcccattcattcgtaggactttctaatcattcttgggaacatccctattgaaaatggctagtctcaaatgactccaaatatgagttttttggctactatgttgaaaatcaatctagttgaatggatttgttatattatatttaattgatgataataatagatatggccgtctgttttaattgatttttcctcagttactctgtgtggagaattttgaccttttaaggttctattttgtggctaagagataaagaaagtcaagttgagactatcgctgt

SEQ ID NO: 48359 - DNA, 1092 bp, Homo sapiens
tatcaaaactactttggtgggcaatgaacagggaacagagactagacagtttggatttggagtaagtggaggaagcaaagatagggtgtgaccacatgggacagagcacattttcctagagaccaaaaactctgattgtaccctggtccacagactcagtgcagaagcaggtatattaaaacccaagccttataatagatactgggaatgccaaaagcgaggagagtgggggcgggggcaagggttgaaaaattacctataggttcaatgttcactagctggggaatggatacactagaagcccagtccccgccagtatgccatatacccatgtaaaaacatgcacatgtactgcctgagtctaaaattaaaacaacaacaacacagaacctaaggtttggaaaaaaaaaaaaaaaactacccccttttttctctgtcagaagtaaccactgttcctcagcctacctagaaaagcactctactctgattcataagtttcttttctctaaatcaggcaatgagaatgaaggtacatgaggtgtctggatgtttttgatgctgctgtaaccatctggagactctcatatagggcacagtgtcacttccctggccactggcagaggctaggctagctggggacacactggagagagtcagggtaaagacttatttatagagagaaatggagagatgggacatcagttatatttcagttaactgctggaacatgtccctacttaaacttccagcgactatgtttttccccgtaacttaaacaatttatttcactaatcacatctgttctcttgtaagatggtttcttgggttagtaagctgtgaactgaagtgtttgcattttgattttaagaatttgctttttttctcagaagggtgctaactcttttagacatggctttgatatatgtgtttggtaacaacaatagacttattggtatggaaatcatgagaataagttaaatgctcagatagtttccctcagaaacagtaacatattcctgtgtatctcatctgcacaaaggcactttaaaaatagtttattacaaaaataatttagacaatacagacaagtga

SEQ ID NO: 48360 - DNA, 1051 bp, Homo sapiens
gcttagtccttagtagtgtagataacttctggaggacaaaacacagctgcccatgcaatgtgtcatatgttgtcattttcctcttttatgacaaatagtgaaggaacagaaataagtatttgaagctagaaggtgtcagccagatccactatgttctgaagtgcatagtaaataattagggtcatgaaatgaatgaaaatggtttgtaaaattgagctagtgccttcattgagctaatggcatgataaaaggggaagttgaggaggagctgttctgtattaaaatctagaagagacaaaatgttgttagtgcatgtcctttgtttgtatcctgattggaacaaagaaatgagaaaaaagaaaagaaatataatttttaggtaactggtgaaatgtgaatatggaccaggcttgataccaagaaattattctttcttttgttaggcatgacagttggcattgtcgttgtataaaaaaagtttttattttattgctgcatattaaagcaggtagggatgagtgacagctttaggacagataggacttcctctgaaatacttcagtaaaacagttttaaaacgtagaataaatgaagcaaatagtatagtatggtaaaatcttggtgatttttgaaaggtttatgggagtttattttataattctccaaacttttatgtatgtttgaaattattcctggtgagtgttttaaagtaactgagttctagaaggaaatagctactgaagtttattaagtaattcacaagtgttccaatttagcttcttttgttgtaaatttctacttttaaaaatggggatcatgtattaactaggtaagtgctaataaactgccccctgcccccagatttgtaaataaaatctgtgatcaggcttctatccagcatgtcttctaccactttgtaactaaatgcaaaattttaggtattttctaatttaggaattgtatgagtccattttcatgctgctggtaaagacatacccgagactgggcaatttacaaaagaaagagcttttattggactcagttccacgtg

SEQ ID NO: 48361 - DNA, 1030 bp, Homo sapiens
ggttattttatttagaaattattttttttttaactttaagttccgggatacatgtgcagaatgtgcaggtttgttacataggtatacatgtgccatggtggtttgctgcaccaaccaacctgtcatctaggttttaagccccatgtgcattaggtatttgtcctaatgctcttcttccccttgtctcccaccccctgacagctcccagtttgtgatgttccccttcctgtgtccatgtgttctcattgttcaactcctacttatgagagagaacatgcggtgcttggttttctgttcctgtgttagtttgctgaggatgatggcttccagcttagaaagtaagttttgttgaagagcaaatgtttccgtaagtgctggcaatcctgaaggactctttcaagaatcatttggacagaattttcctgaatatgaaagcagtatttaatggcattgacagctaaaggcttcaggttgaattatctccaagtgtatgatcgacttttaagtgagaataagcaagtttatgccccatgttcctgtgcagttatctcatgcagttttctgacagtgtaaaatattacagccccactgcatgctttaaaagagaaattttgaaattttattctttcattttgtagagtctgaaaagatttcccctaagcctgaagcagtgataagctttggaatcacctggggggcttaattaccatgcagacacctgagcccagccaccagagactctaatccagtaagccttagactgtcttttgagaaaggtagcccagctctgattttaatcagattattagaacaatagtaatactcataggcgtggttttgtagttgtaaaaacaggaattgttactataatagcagtactaataattgtaaaaatttctattaatggtaatgttatgaatcttttaagtatatctgataactcagcgatgttccaagttccacattcaatgaatgggcaacttctggatttgcctttcttaacatctaacttaattttatttcttggtaa

SEQ ID NO: 48362 - DNA, 1030 bp, Homo sapiens
attttatggcttccttttttttttaagtttattattttaaaacttttactttaggttcaggggcacatgtgcaggtttgtttataggtaaactcgtgtcatgggggtttggtgtacagattattttgtcactcaggtactaagcctagtacccagtagttattttttcttaccttcttcccccccaccctccttccgccctctttataccgatgtgcttttctgatggatctttgctttggtgttgaaatcagctcttaattaaaaaggaaaggatataaagtgcctgtgtttatgtggccaaggaactgtctttgagttacagctgagggagtggatctcagggtttggaatccttgattttttactgtctgaacttggcagttggggttcttcctgcgttgcctgttactagttatttcatatttgtttgccttattttctcagattgaaaattatcttacagtaagcaagcttcttcctttataattctttatctcctccgtaacatgccagacatgttgtagaagcttttgtttattgagtgaattactccagatagcggatcatagtatcctttgatagttggcttataatctctatgaactgtgaaataagggtggtattgtggcaatttcaaagtattgataggccattgctctctttgccagtcctgggaagagaaaagaatctgatacaatgcttcttcatgtagtgaattttaagacagttgtctaagagaactccgcctcaccttgggccaatgttgagtggacagttgcacctttttttttttgtaaaccagtttttccttttagacttgaaagtcctgataaccagggcttatttagcaccttggctgcagctgtctctgacaaactagccaggcgttttgaggcctgacacctgtgtttccctttcgcctagcatggaggggttatgagaggatgtattgctacagtgccttttgtcctctctaagcaattctgagaaagaacttgtcacaggaaagtacctcgttaaacacattt

SEQ ID NO: 48363 - DNA, 1038 bp, Homo sapiens
caagtagctgggactacaggcgtgcaccaccatgcccagctaatttttatatttttagtagagacggggtttcaccatgttgaccaggtgatcttgatctcttgatttcatgatccgcctgcttcggcctcccaaagtgttgggattacaggcatgagccacctctcccggcctcatgtcaattctaattaagtagacattactgtgttgaatactattcagttataaattgacatcataaaacgttacaatatatgagttttcctcagataccataattatcctcataaatcctcctacatatcatgactttagtgtgatgacctcccagtttcccatgtttaaccacctttcattcatattacaaatgactttcacgtttgtttctttttctctatatcatatacatgttctaaagcgtcattttcaccttgcttcatccattaactttctgaactctgcccacttgttgcctttgtttatgcttgttaaggacatcatgtctactccttcctgttcagctcagctgcctcttcttccgagagttctctgatagcttcccagcccctcatagtgctaagtaatcctactgttctttagcatatccatagcgaagtgtttgtaattgcctagcttgtattgattatggtgacttggatgttgatcttattttcctcactagattctgagctccttgaaagtcagtcttcatcagttccatctttgcattcattcttcattgtccctggcattatatcttgtacatagtaagtgctcaaaaaatacatctttttgaataggtaaattatttgtggccaggtatggtgactcatacctgtaatcctagcacttacggaggctaaggcgggctggtagcctgaggtcaggagtttgagaccagcctggctagcatggtgaaatcctgtctctactaaaaatacaaaaattagccaggcgtggtggcacatgcctgtaatcccagctacttgggaggctgaggcaggagaatcgcttgaaccctggaggtggaggttgcag

SEQ ID NO: 48364 - DNA, 1027 bp, Homo sapiens
cccgttaatcaatacatcccccatggatgcagtctttgctcctcagggattttagatatgctgatcctataagtgagccttgccttttgttgataaaacactgcatttatacctataattattttagagccttcaataagaaattttcattctctcagtacttttgataaatctactgtgaaggatatttccattttccaagatcagtaagcaatagcaagaagttgcaatgtccagtgggactcatagatttaactcacaaagtgaacccactgctaaaataaggcaattctgtatacctttgcctctgttaccatcccaaggcttctataataaaataccaaatcatcttaaaatcaggcatttgtttttcttagatggttccttgaaattaacactggtttcttacctaattgatactttcatacctggttttccggtggcaacaggaatctttccacaaataacaaaaagaccctccacaaataattcctcctgcttttattttcaagggtgaaaaagaactgtgcaagtttgtgagcccaggaacatggtaattgagccagagtaagctgcatggatatatctaagtagtctgaatttgaaaggatcagggttctccctgccccaagaaatctcagtggtttctgaaatcgttagcatgcttgtttccttgtagttgtaattgtgttgagtttgtttgttgtttatttttttaataccagcgagttttccagtttacggtcagttaataatatgatgatctgatgaattctgcctgacttaccatgtgtgtgctatttgttttttatatatacacaccacactgccagtttacacactaaaatataatctccctgaattttatcccccaaaatcttatttcttagatgttccagaagaatccttcaggaccttgccctgttttaagacaggaccttgcccatatgaagatcatttattatacagtcatgtagatgttaaagatggggtggaatttatgccttattcatgtaacacattgaag

SEQ ID NO: 48365 - DNA, 1098 bp, Homo sapiens
agatctagaatattgtagcagtcattcatttaatatgtagtatattgacaggctctaaaaaaaagttgatggtgagtatacttgggagagccttaagtacacaacaggacaagaaaggaatcattctagggtcagcgttaggctacagcttttggtttttgaagccctgccccaactcatgtgtggtgtgagtgcgggggtatgggtgtgatttcacaaacccctggaaatatcacccaacttagtgatgcctagtgattcaatattttctttttttgatttgttaaagtattttgcatttagttggtttaatttctgttaacttccttactggttcaagtaagcaagtacagtctatgtgaggcactgttttcactagatgccttaatgacttttttatcttttctatgatgaaacatttcagggggaaggttgcatataagacagttggtttctgatcgtttttttaaagactaaaaccatgtttattatgcttcctccaatgttatttttatgtattattgggtcggtgtattaaaaataaggtctgagtatatactgctataattcagacagcatttgttgggtcatgaggcctaaaccaagaactaatccaagagccatacattatatcttgggttatgatatctcttcccctttaactctagtttttgcttcttggatcacttcatgggttgtagaacaagaggagaggctcaatttaaattaagaggcaaattggtttcacttcctcgtttttcaggcaaatggtaggaagtcatcatatgtgcaggctttactaaacattaataaaatgcaccgatgtactttctttaactttactttctcaaggagtaattctggttgtaagagtgtcctttcttatttcctgcctgcttgttatacatttcaaggtgtgatacttccgagcaaagagatccttccctttgcaggaagaaggcatatttccatgtgcaatttacttagtagtaaggaaacccgcatttatttattttaggcttaggttgactattgctgtttctgaagaaactgaaggggaaagatgggaagagagactcctgctctgttaccattttg

SEQ ID NO: 48366 - DNA, 1034 bp, Homo sapiens
tttgtagcagtcgtttggaaaggagactcttctgattttttttatactttgagtattggtaaaatattaaatattgtgcaaggtaggaagagaaaaactcaatgatttttagcaattatagagataaaaataattgaaggaataaaacagtgagtgaacaaaatatactgtgctataatgttttgataaaaatattcaaaacggacttgttatttcccaaaaaacatactttcatgcagattgaaatttgcaaatgatagtttagaaaatttatctacagaattatttctataaaatcctgacttgcaatggcagtctgtttttatttaaagatttatttgtattttatggatatttagaatatcacacatttactaataaatttcacattatctgtaagtatgaaggatgaactaaaacatataaaaataaaagttatatatgaaaacagatgattgcaaactaatgattctttggattaaaatacaccagaagaaaagaaaatattttatcatagactgaaagttgggatatgtaaatgaagcaagagactttggaatgacaggacaatgtgagtagaacagaaaaactttacaaggtaaattaattattttagggagaaatgggttctctttaatgcgtgaagaatcacctggaagcttactaaatattgaactctggggccctctccttgcgtgattctaatggagatgtttatataccacacctttcaaatggaccacacctttgaagaacagtgatattgaggcttatatgcacaataaaatgctcatttctttctttatctccttttcaatgaattgtcttagtactaagtattatactaataacagtttggggtacctctgagttgggaaaaggggaaaatcatgaaagaattgaggagtttgccaagggttgcaaactgctagttttggggttgaaatcagtctgcaaatgtattttgttttgcatagctggtggtactccccaacccccattgcatttgattggccacagtcggtactgctccc

SEQ ID NO: 48367 - DNA, 1033 bp, Homo sapiens
ggtaagatgccagacattgtgaatcttacattgttgattgctggatattttggattcctttgaaaagtggtggactttgttctgtcatgcagctgatttacttgggatcacttcagtaatttgtagtcttgcttttaggctttgttagggtaagtttagagcagcctctctttcatagttacttaaacttcactattacgttgatacccttatgaaaactcactgattccttctttgtggtgcagtgaacctgtgtgaaccttgggaattgttcagactatgtgttcccatgtttctttctcaccccactcacgtgtagatcattattattgagcttcaggttcaagggcacccttctgcacatctcaagagctttctctctgttcagctctttcctttccagcattctgtcatgcacattctaggattctaagcctttctcgattctgatctctgtttttcaacccagtgagagcactgggttctttttgggatcctccttgccatgttgttgtgtggaaactgaagccgtgtggttatgtggaggcagtcctaggatttaccttatttgtatccctgtgctccttgttgtcgtgtgttaaaacaattgtatattttatttgacttcctgggcttttccccccattttataagtgaatgagtataaattcaaagtctggtaatatccattaggttctaaaagcatctacttttgttattttaattttaaatataaaagtgttaccagacattacttttaaaggaaagagtaaatggctagaatttgaactgttctgtttgttggaatccaaactatgtgtttcaaataatgaaatgtattaaagatatgtcatacagggaatgatctcatatatcatttatgaaatggttgcttgtacaaaatgatttccaggcctcctgtgctcgttagtatttcattttaaagatagccatgaaaaatacaggaaaggatgtaaactcttaagtttcttatttttctgtttattctagtgtagtgaatagatcatttttt

SEQ ID NO: 48368 - DNA, 1028 bp, Homo sapiens
agtggcatgatacccttttcctgagatgcattcagggttaaagaagatagttcacctacacgttagatttcccgtgaagataaaaagtcccaagttttgaaaagcagaaggaattctaaaaagaactgaaaaacaaaagcccatggggagagtgatgaaatgagtttctgagaaagactgtgaagaggggttcaaagcggccgctgacggactgcccgaacctagggcaatgaaagacctggggcaggaattgatgttgaccgtggcagaggcagtggacctggtgggcagcccagaggaaaaggcctttggcttgctgagagagctcttccagaactgagcaagagcatagtttgttgaagaatggagaggtccacagtccatctcctgtgccaaggattagtatttcatttcaagaagcgatttggtagtcacagagtgaatattattatttttccacaaattcattacctctttcccctcatgagtatcttagcattgaatttcctgactttatgatgaataaactttgttttagtgtttattaatgccctatttactttcccctgggtgaagttttggctagtaataagattttgtgtctctgctgtagtgaggcattgctgtagaaagccaggtctaagaaaaatgaattttgttcctttggggaagcataattaccttaaaaaagtttaaagtgtggttttcaacttagtaaaatcctattataaagaaaaacgtacatagcaaaaattttgcttgtaggtaatacgatcctagtaaaatagaatttacattgtctcttatagtttgttgtaataacattttgtaataacagtttttttgcgatgtaattgatactcagtaagctgcacatatttaatatgtagaatttgatgttttgtcacttacatgtgtctatgaaatcatcaccaccatgaagataacaaatatattcatcaaacctgaaggttgcctgtgcctcttttttatcctccctcccacctatctccccctccaaacactga

SEQ ID NO: 48369 - DNA, 1034 bp, Homo sapiens
tggccacctccaatatcagttcttccctgagtctcacagtcagaactgcttcacaggctcagctcagtcactagggaatttggacttgcagcaatggtccaattcaggattcaacattcgagtctgaactgagggccaccaccccttgatgcacatgaggggatgggtgccctaactgatttgggcctttgctggcaaatgtttaatggagaggggatgttgggtaggcagccagaggtacttgcttttataaacagaaaatgacggatgagaatgggtttttgaaaagatcataaaacgtgtctgtcaaataaaacatttggttttcaagatttttaaaaaacatacttcatttctgtaaagagaatgttgctaataagaactaaagataattttactaaaaaaaagttttgccagcagagaatttatttttaaaaaataaacaaaatagttatccaggaattcttatgtaatctctggcatggggcttgaattgaacagcgttttatctttaggaataatggagttctaagtccatagctgacactcatctctgatcatcttaggagttactgccatccttactaaatcttatgaagtaatagtctgatgaaatatgagtatttagacttgcattagctttcaaaaaagtccccagtatttgaagagggtacttcctgtggctggtttggcaattgagattagtaaattaggaagatgctactgtcttcattgaccttttataacatgtgtttgacaaagccttgagtcttctataataacaacaatggtaatagccattctttatttgtcacttgcacacactgccaggccctgtgcttcacaggtagtatgttaatcatatgtttattttaaggggaaaacctaatatgtaccatgcttcctatcccataagtggtgcaagatgagagttggaatcagatctgtctgtcccctgaatcctgttttcgataatacttcttcaaaagaagaaagatgagaaaacagcaattacgtgctccattgatggaaga

SEQ ID NO: 48370 - DNA, 1067 bp, Homo sapiens
gataggaagggaaaattggttcatattaagcacagggagaaagaatacctttgagtgtggagcattgttagtgattgaggtggatcataagtgaatacagcagtaggagttgatgaaagttaaattaatatggctgccggaaaccagtaatacaccatgaaatggatgaatctgagatactagtaacccagtaggaaggatggataaagtgttccacaaagttctgaaggaatagtaacagattcataaagcaaatagaatgatagggctaattaaagaacattcacatattcctggtatcaaaaaataactatagatatatcttgtttgtttaaaatacacgtggctagatgaggtggctcacgcttgttatcccagcactttgggaggccaaggtggaaggatcacttgagcccaggagttaagagaccagcctggacaacatagtgacaccccatctccacaaaacattttaaaagaattagctttggcaaaaaaagttagctgggcatggtgatgtgcacctgtagtcccagctactctggaggtagaggtgggaggatcacttgagcccaggagatcaaagctgcagtgagctatgatcgtgccactacactccagcctgggcaacagagtaagaccttgtctcaaaaacaaacagacaaacaaaaaacccaaagcccctcaatatatttgggtttacaaagcagcttcagtaagggaaaattatgagatggtttttcatttcttaaggattttactctagatttttttatacctgactagttaaaacatcattttattacctattttagctctatataaatcatttcaaaatgatattttacagttatgtgttcatatatttaaagtagtcttgaaatgtcattttttatttttccttttggaagatttcaagcaatattgtgagtacctttataataaattataatttagctgcaccttttttttttcttcccctgagatggagtcttgctctgttgcccatgctggagtgcagtggcccaatcttggtttactgaaacctctgcctcccaggtttaagc

SEQ ID NO: 48371 - DNA, 1034 bp, Homo sapiens
ttctgtttggttattaaatattttgaatctcactggggattacatacttttaaacatttttttctgtgagggtttttggatgtgccatttaagagaaaaggttattttagtaagttctaccaaattaaaagatgaatagtaagaacttgctagtatcctgtttatggctgaatctgagcaggcgtttacagttattttctaaaataatcttgagttaacgttaatggaactatgtattatcagtcccacactggaaagctaattattggtatgtaatcttagcagaattactatgcttgttggtgtaatccatgtcagcaaggtgacacattataattttatattcattttccacttacttttctcatcttctgcatgtatcatcagacaagctttctttattacagatgtggttattttaggggcaaccacttttacttgaattgacataaaaaccatccctcatctctgggccacatggtctttcctgagacgtaaatgtgatgtagcatctgccacataatctttcttaatgatatgtgtgtagacacctgaaagttccttttgtttctgtgtctgaactgttaggtcatcagcttacttaccagaggactgatgtgtttcttcaggttctgctggcataacatttggggcctatttttcaccgctctacatttgatttccctatagttttaaattcaggaaaaaaaattgaatttttgatgctaattaccctctttttaattctatcatttgtaatttaagatgatagattagattttggacatttatagtttatgttctctaatattttaacctttattagatggctttctaaaataagtgtctcgtacaagtaaatttctcttttaatgtgtggttttagtactttctaagcatattaacttcatattttcttaagttatgatctaaaactgatgagaaattaacctgttttggctcaaggaagcctagatactccctaaatgttaccctaacttagagctttaataacattttttcctactagggaa

SEQ ID NO: 48372 - DNA, 1035 bp, Homo sapiens
ctttttggacattctcctttatatttggatggatttcctgtaatacagacacaaatttggttttgaattataaggctaaaacaaatcttttaacttggttgctaaatttcctctacattatcaaagctctttttattttgaataccgttttccaaatttcattttttctttgactcataaaatctagtgttttgaaaacttcttatatggagctttcttttgatttttaatatgaaataactactatgtatttgtttgagacctcctgtgtatctcgttctgtactagatgctatggtagactgaaaggaaatgtgacattttctaccggccctcaaagaattagtcatttaggtggggagaaaaggtagttgatatgatgatagaaaaccaattgtaagtattaagggatattcaatgacagttggatgtctttgatttttttccattcagtcctaatttcatgtattccttcatgctatcatattgtataagttgtgggttcagattcctagttgaaaagatgcagtccctgtcagatgtagaaatttacctgcgggtaagattgtgggtcagtgtggttagggaatatcacagagaatgtacagttttctaggtcatcctttgaaaagtcagctgacttagaaaaggccacgcggagatcaaggaccttgtagacattgtttggctctgtaccaagggctggtttggtgtctggaggggccctgaagttaatgggagaggccactgtctgctagtaaaactagcaaccagatgagaattcttgattctttttcagcgtatctttcttgtggttgtgtgtctctgtgtgggggtgtgttcttctctttgtgtctgtaaatattttaaatattaatttcacaatcctcttgactttgactcctttcaatctttgacaactggtataatctctgtgcatagattctttctgtgaggtggcttaggggagtaaatgataagggggttatttctcagttagttcacatggggaggaaatatgtcttcctctgattaa

SEQ ID NO: 48373 - DNA, 1054 bp, Homo sapiens
gggtggcttgcttgagcaagggaatgcagtgaataagtttatcagcgttagaatctgtggttatgaaattatatcacttattaaaaactaaatattttagtcaaggtttttaagtgtcctttgcaaaaaaaaaaaaagcttttagattgctctttacttgtactttcccagctgaaaatgaaagataagggacaaatattagtatcaattcttttatttgcatgccttttctctaatggttgttccttgccttttagtccttgtgtaatgaatacgttagaggcaaatgtcacctatcttgaaaccataaagacttagtttctgtactactactttttaggtacaagtgcagtctgacttctgaatgtagaaccagtcatcagaatagccctagattgcacagtgggaagaacttgcattggctaagtactctggtgaagctgaacaattccaggttgcaaagagtacttggctcatctctcattttcatgaggactaacatcacacacaatgctaaacctcactagcaaagaactgaaatgaactcctgacaggccaagaaatgcatccagtaacctcatgtgatcttttaccccatcaagccaaggccatatctctgaggttaagaaaattgtgcattacattgcaaaatcttctatttgtgagttagaagtctcaaactcgactttgttacatttagacagttctaaacacacatatgaaaacaactcaatttccatcataactttgcagtaaatttccaaaaggcgtatttcaggagaccttaagataagcattgtttctgaaagcatgatcaaatgaaggaaatgaaagaacaaacactatcctagtttgaatgatgcttggaaaggttttagtcctgggattgcagataatttattttttttggtagtaccaattagggatatgctgagaacagtggggaaagcaacagtaggtttacttcttattgcctgatagagtatttttctctaagattttttggtatgtgtgtacaagacagtgtttttggttgatcctatgtctcagttga

SEQ ID NO: 48374 - DNA, 1348 bp, Homo sapiens
ttccctcaacattgtactgtttttacaagcagaagagctgtgtgtagactcagccgcttctgtttggtccatttgtattacttctggttgataggtccgttgctattattaatgtagataaggtttttctttctacattttttttcttcttgttcatcttgagggatagaaaggaagttgctgtttttagagggctgccgtctttccaggaagtgtgctttatgagtcttgatgactgtaattaacacatgtgaagtctttcatagagagttataattatagaatctcagttaagaatgtgctttaaagtccaagcatgcaccccatacttgagtggcgtctgtgacatccccaatttgtcgttaagtctgttcccctctaaattcagtgatgagaacattatcccccaattaattccatcttcagtcatctgtttattagaaatctttcattgagctgaaatctgtcctgtaactagcttcagattctattcctggggaacacggagagactggaacccactggaacacatttgtttctcccagtaattgaagttggcctcatgacacccttggggatggctttcttccttttatgaaccatcgtgagttcttgccatcatttctcataaagcaggaatgaaatcttgttccttaatatcctgattgttctcatcttttaaaaattacctgtaatgaaacccagcacttgatgtgtgccttgatgaagtcagagtagataattctgtctttcctccctgacattcgtgtgactctagaaatctttgtctttttgtctaaataaattatcccaacaattacagcaattttagtgcaaagggcactcaataactttctctaccagtaccagttcatgtttgtttcatttttcttgatacagcattgcactgctagtcctgtttttgatctgtggtcatctgtgatgtgtacatagtcttctgcatttttccttttccctttatcatgtatttgcttggattttttttcaattctgagagtttttactgctattgaatttcatcctaattctgggaacatccttccaagatcagattcatttaaactttattcccaatttctagcatttgtaattctaccctgttcattctctaaaggaaagtagaggaacctgttacaataagatttgtagttagatcagggaaaaacaactatttttgttaatactgtcagtaaagatagggaagtttttagatttcaagacagattgccatagtctgtcattctgtatctccagttgattccaagtctttattactttgttgtttacttacttaatgggcatgaagccaataataggctacccacat

SEQ ID NO: 48375 - DNA, 1048 bp, Homo sapiens
attgtgtgagccttgtagagtgtacttacacaaatctagattgtatagcctacaacacacatataggctatgtggtaaagcctattgttcccaggctgcaaacctgtaaagcatgttattgtactgaacgctgcgggcttttgtagcacagtggtaagtatttgtgtatccaaacatatcttaacatagaaaaggttcagtaataaaagataaaatatgatacacatagagcgcacttaccataaatggagcttgcaggctggaaattgctctgggtgtcagtgagtggtgagtgaatgtgagggtctaggacatgactgtacacttttgtacaactggcagcttggtaggtttgttacacaagtattaccacaaacatgtgactaatgtgttgcattatgataactacgatgtcagtaggcgataggaatttttcagctccattataatcttgtgggaccacagttatttacgtggtctgttgttgactgaaacattgttaatgtggtgtaggactgtactcttttatgaggtacctaaaaaacgtcgatgagaattaaaattttgtcattaccgcattaccttttatgtaagttaatgctattatatcttgaactcagcatcgttattaatattgttctgttgtttacatttacttgatgtatgtctctcatttattttcaactattctttgttttagctaccctcacaagtttgttttgttttgttttgagacggagtttggctctgtcacccaggctggagtgcagtggcgctatctcggctcacagcaacctctgcttcccgggttcaagcaattctcctgcctcagcctcctaagtagctgggattataggcatgcaccaccacacccagctaatttttgtatttttagtaggggggtttcaccatgttggtcgggctggtctcgtgatctgcccgtctaggcctgccaaaatgttgggattacaggagtgagccaccacgcctggcctaaagtttttgtttttttaaacctcagcctgagtgaatcttttcttaaaatagt

SEQ ID NO: 48376 - DNA, 1049 bp, Homo sapiens
ccatctaagatgttatccagatcacgttagaaacgattacaaattttgggcacataccacttcttgtagtaatgagtcccatgcattttctcatcttatatgggagaaaatacctgtatattgctttatcattttcagagaaacagtttgtgtttccttatccaatacatcttggtaaagagtggcattttaatggaggaaattacaggacttcatcaatatttctttagggaaatcctgattcaaagtatattttcatgaaaatcactagctctgtcctttgagaaacgtattttttgtagggctttctactctaggccatgcttgttatgagaacagattcttctgcagcgggtgggaggatgtttctaaacccctggagtctacctatgaattgctactcaaattacagtgtatccatctcagaattaatgtgttgtgcatgcctagtccttacttgtgggttgacacaatgatttctattaaaaatattctttatgttttatactataatgtatccttaagcagtatgctgtggcctgaatttaccttgtcttttattctctttttggaatgaaataagagcacttgagatactgtcatttggtggtttggttgtttgtaaaatagtaaaaaaaaaagtttggtaaggagaaaagctattgtgcttaatagacagtccaagtttgagtcgagaagaaatgtttattttcttccacttaatgttctgacattcttaagaaatacattatgttgttttcatgctagtctttgaaagaatgacaacccacattctgttatttaattacattattttttatagcctgtttttcagtgattttgaaattttacaaataatgcaagttttttgcacaaaatttaataaaactttttaaaatattcataaatttatcaaaaatataccagtctaaactaagaaccatgctctttttgcacattcctttatagtctgttttatttttatgttttttacatagatgtgatcatactgtacaacttaacattaggttgtaagcattttttatgtg

SEQ ID NO: 48377 - DNA, 1034 bp, Homo sapiens
ttgaaactccatctgagtttagcaactccagctgagagcaaagaaaataagaagtgaggatggtgagaataagagaccataatttcttttagattttaatttcaaccaaaggagatagattctgtttctcagctttaatttctctctagtgaattaaatgggagaatgttcatattgtttcaagtttggggcattctttattgcattacttaggcttgtggaataaactccagtgagccagtctgaacatcatgattgtgcacaggaaatagaaaatagaataggagtgaattttttcccttaaataatctgcaacctttaagttaacttaatatactgttgtgactcacttcagggacttctgggggcaatagttaaacagattctaggagggttctaagggataagagacgacataatataatgtcatctagtgggtagaagccaggtataatattggggaaatttctccaagtctggtggaaccaagctactttacaatactgtagggctctgaccaactgatcctgtttgcctgggactttttcctttttttttttttttttttttttgagatggagtctcgctctgtctccaggctggagtacagtgacgcggtcttggctcactgcaacctccgtctcctgggttcaagagattctcctacctcaaactcccaagtagctgggattacaggcatgcggcaccacgcccagctaatttttgtacttttttagtagagatggggtttcaccatgttggccaggctggtcttaaactcctgacctcgtgatccacccacctcggtttctcaaagtgctgggattacaggcatgagccaccacgcccagccgcctgggactttcttaattttagtgtcccaggaaccctcaccctatccctgtatgagtggaggatatcccactgtccatggaccttaatctgtttgccatccctgggggatgagaggcaataggaaatgaagatgaacgtggaggggactctttagctatctctgcccacctgttccctca

SEQ ID NO: 48378 - DNA, 1028 bp, Homo sapiens
cctgcaaattaggaagcttgccttgccaaccaattataaaatcttaatgattttacctccccaactccccataactaaaacaaaaaacaaaaactctcttaaatatggcaattttcctccatttttgttaacatttttctagttcagaaatgatttcctttcaccaagatgattccaacagcctccactggtcttctgatcttcagtcttggcccctcctccagcattctcttttgtatgatgtggccacagtcatcttcctaaatagcagctcttgttctattgtcactgtaaaatgatcccaatccccatcccaaatagcctctattgatcttaggataaatgtcaaactccttaacaagtttaacaaggtcatttataagtgttttttactacctgttcatggccaattttatgtgtcaacctgaccaggtcatggtactcagatatttggacaaacatgtgtctagatattgctgtgaaggctttttgaaaagatgagattaacataaatcagtagactggactaaaaccaactgccctctctaaagtgggcaagtcataaagtggagttcttaagagaaaaaactaaggtcctctgaggaaggtagaattgagctttggactcaagttgcagtatcgactcttccctggctgtctagcctgctggccagacccactgcatttggacatgccagcccctgcaatcacataagccagtttcttaaagccctcattcacttctctctaggaatacacatagtactggttctctttctctctcaaaccctgactaacacactacatctgctgcctctgtctcactactcccatcctttaaccacttcgaactgtcttaaattctttgaaagtaccatgtctctctcactcaggatatttgccatgttgttttttagaatggaatacatttctccattattctccatcttattaatatttacctccagatctaggccacaggattctcccaatcactatacattaccctctccttaaacattatattg

SEQ ID NO: 48379 - DNA, 1050 bp, Homo sapiens
ttattattgccatgtgggtattagtttaatttctgtttttctaccttctgatataggaatatgtagcttaattttttgaaattaagttgaggtgaggccgttcctttttaaaaagaaaaatgagatggggatctccagggtgacctcaaactcctgagctcaggggatcctcctgcctcagcctcctgagtagctgggaggaccttccttttgatgtcagttgtgtttagctataataattcctcactttacttctctctctccctcttcaccttgtcagaaatgacttttggtttatgggatataaatgtagtgtgtatatttcttgcttggataatgctcgtttttgtctgtagtgatagttcctttgctggaattttttagtttagctttgaaatagcaatatattaagcctctttttgttttactttccatccaagaatttctccatttgtatctttgtcctgtttaggagccttgttcctgccccagcacattgagaagtttggaaacgtgtaattgatagaggaagttaggtcctagaactcagaatcttaaatgttgactttggctggaatacttcctcatttatcaacttaggtcatctgtttcttgttttctttgcttgtaatcttcttttacatatccattttaagaagttttgtatttgcctttaaaaaaaataaatgaaaatagagtgtatgcctctaaataaggaaacaaagagtctcccaacctaatgctttgaagtttgctactttcaagttagttgttaataaagccctccgttaacacagaaatgctgtcttccaaataaggtgggaattataccctgttctgcatattttctatttggaagaatacgcaaatggccaaactggaaaaattttgtagatgtcatgggttagatgtgcagacccttaaaaaaaattgacagaggaaggttttacccatagcaggtaaattatactttcttctaaagtcttagaataataagactgattttcttatgagccccatgtcactattcctcccagccaccgcctttat

SEQ ID NO: 48380 - DNA, 1032 bp, Homo sapiens
ttagcttttagcggacatgtatctaggtaattagttcggggatccagccggctcacctttcatccccaaacactgtggtaaagacattacttagagcttctctatattgaattgcgttggtccctcccagctgcttttatctaagcctcctggcatttgtgtagcttgaacagtcatgaataaaagagcccagctcctctagagtcagtccctgaggcgggccaagaggcttgggattgccttccggtcctcagttttgatttcctcctgcatatggttgagctggagacaaccctcccatggtggggtccatggttttcaggggagctttgagggctggccacctggctgattacctctggctggttaggaatgaaactcagggcttttaaaaagataccataaaatatttgctcctgttgtatactgttgcattagatgtggtctaacttaaaggtatcccccagccccttctattttaaattgtggcagagaaaggtaacataattgtctgttggccctggacactgtcctcttagtgctcaaacatctttcagagattggggttatctgggctttgtgaaaggaggtttttgcacagctcattcaacattgttcagggcagtaacacatcactgaacaaattgcccccttgcatatgctaatcccacacttaaaagaactcattgtaacatgttctgatgctttagcctgaggggagatgggaattgaagagatgtcagatcatgtcatgtgaccccaaaatatctaaaatgcctgttttctttgggtcaacagttcctactcggcatatgcgaatgaaagtatcctgtgtcatttgtggaaaagattagtccttgttcctgcttttgtgtgtgggagctggccttgctattgaagattcactggctgaaattccccccttagatcttaaatttcagtgctattggcgaggaacaccaagtcttattttcaacaataaattaaaagaattcaaaagagttccttcattgttgctgtggaaaatgtgat

SEQ ID NO: 48381 - DNA, 1050 bp, Homo sapiens
cctggagccataagcaacacacagtagggagtgcacgaggagaaatcacaacatgagggaaaaacacctcaagaaatgcagtacccacaaagtcacttttgggtttctgggaacaaatgagggaatcatgaaggtaagggtcccccaggcagtagtttaaaaaccagaatgtttgctgttgctgccagcgaagctcattaggctggaactgtttgcttatatcaagaacaacaatgaaagcagcgtcagggctggaagaagtcaggggcaattatacacagaaaactgggttcatgggagcaagagtaaaaggaagcggtctgtttttggtggggtagactttaggtggaaagcctgccgggcgtccggcagctgcgtgggccagggatccctgggtctgagtgtggtgtttctgggcctttccagcccacactctgctgccttgttttgagtcagttttacagcatcaaaggtatgatgaggcatcttgttttgtaacttgttgaagtctgctgttgaatggggcccattttcagataagcaggggtgctaattactagccctgtccaccacatttagaggaactttcagagcttttcaaaacctattcagattataagcttcatttaagccgctcaagcggaaattacagtagtaactttgaacacatagacgcagaggcctcaaagcttgacagtcttaaaggtccagccacggaaaggttattgtttctaacagaaattgtattgtttctaacagaagtgtagtttacttttacgttcacagtaccatttgacatcattaaacgacaacaacaaaaaaaaacaagacattaagaagctgtcttggaatggccctgtggcttggatgcgcagtgctgatgacagcaggagggcttggaaggctgtggagagagacttgaacttaaaactggtcagcacacccagcctctgtgccccattttgctgggcacttgggcggatttaaagttgaataagatacagccctgccgtggatgctgcacagagtctggaggaggagacctcgggg

SEQ ID NO: 48382 - DNA, 1065 bp, Homo sapiens
gctgcagtgatcttcctgccttggcctccaaagtgttgggattataggattatagtgagccactgtgcctgaccctaaacatttttagaaaagttggagtgcttgaaaattcattgtaaaatttccacagacactgatttctgccttaagatggtgttttctctaacttttgaggctgggaactgtgtttgggattccattaaaaatcagtgggctgggtagaaatgactgaagatctggcatgaagatttaatatgttcagtgcacgcaaagggataataaataaaatgagtaattgagtcccaaggaagtgagcacaaatcagaatctggagaattttctaacattgcaccttagaaattgagccttaatcatttttactgtctcatcaaaaataagttttatattggacagctgaaatgtggccagattcatggtacaggggccatttcttggatactttttcatttcatacaatgtgcttttaaatataatgtataagagcaatgatactgtgtaatgagaacagacttagaacttctggaatgggttaagcaatgggggcaaagtgcagtcatggaaaaggcatttgggaacgggggcttggctcgctggctggagtcccacacataagtgctttcctcatccacggtcctacccattctaggtctcagtattttcatcagtcacaatgaaagagtgggtttgagttgtggagcttggtaggaaggaaaggataaacaaagtttcgtttctaatgtttcttccagcggccacaagcctggctccctgagatcctctcccctgtctgtggcagcatggtaaacagcagccttaagagttgctcctgtactgactgcagtcccctcttgcctagggatagagtttcagcaatttagtcagtgcctttgagccttcattccttctgggaaatgggaattgcaatacttcctcacagtactgagagggattgatggaataagggggcataagtgcctgggtggtgcatgagacacccacccagattactgggtcttcctttccaaattctattccttagtgata

SEQ ID NO: 48383 - DNA, 1050 bp, Homo sapiens
caattctcctgcctcaacctcctgagtagctgggattgcaggcatgcgccaccacacctggctaattttgtatttttagtagacactgggtttctccatgttggttgggctggtctcaaactcccaaactcaggtgatccgtccacctcggcctcccaaagtgctgggattacaggcgtgagccactgcgcccagcctgaggtgatatttcattgtggctctgatttgcgtttccttcatgattaatgatattgagcatttttttgtatatctgttggccatttgtgtgtcttctttgagaaatgtctgttcaggaggtcctttgcccatttttaaattaggatacttattttttaatttttgtactattgagttttttggatgttaactcttatttgaggtatggtttgcaaatattttctcccattccttaggttgcccatgcatcattttctgtgtgctcctgcattgagatggggcctttagtggattgttattttagtttttgttattgtcttcaagtggctggagaattcttggccccataagcagtttcttcctgttgatcacccttgcccctctttacgtgagaggccattcacataatgggaggttttgcgataactcctgcagtagtgtccttgatgttttctgctgccagacagctcttttgcacgtgtttacgtagcataccagttttcttctttatttttatttatttatttatttattttgctgtctcccaagataggaattgagtgttttaaagaacagggaaatagcagaaatcaaggaagagtgatttggagagaactgtcaacaaatgctctttttcacgtttttgtccccttaaaagaaagtgtttaaataccgggtgctataaatgccacttactgtcactcttagcatcagaggtgccacttaggggcatggttttagtttgggttgggttaagtctgtgatttttatgacatagtttttcttggggttacaaagcgggtgaagtttcagaaattaaagttgattccatggttggtggtaaggagctta

SEQ ID NO: 48384 - DNA, 1067 bp, Homo sapiens
ccttggaaatccagatcttctttatcttgggtaactgaaaccttgtaccctttgaccaattgctcctcattttcccctaccccgcaaggcagccgccattctactctctgcttctgtgagttgtactcttagattccacatagaaaggagattatgcattatttgtctttctgaatctgcttatttcgcttagcctactgttctgcacatctgcccatgttgtcgtaagtggtaggattttcttctttttcaaggctgaatggtattccattgtgtttataggtaccacattttctttatctgttcatccatcaacagacatttgggttgttcggtatcttggctctcgtgaatagcactgcagtggtcatggattgcagatgtatctttgatatactgatttcattttctctctctttctttctttctttcctttctttcttttctttcattttttgagacggagtctcactctgtcacccaggctggagtgcagtggcaccgtgttggctcactgcaacctctatctcttgggttcaagcagttctcctgcctcagcctctggagtagctgggattataggcacccaccaccatgcctggctaattttttttttttttaagtagagacggggtttcaccatgttggccaggctggtctcgaactcctgacctcaggtgatccaccttcctcggcctcccaaaggctgggattacaggcatgagccactgtgcccggacctcggaccccaatttcattttctttagatatatacccagaagtgggattgctggatcatgtacagattgagcagccctaattctcagccagtaagaatattgcaaatatttaaaaatctgaaaaaaatccagaatccaaacattgctggtcccaagcacttcagaaaagggataattaacctttttgagaaagtagttctatttttaactttttgagaaacctctatactgttgttttgcatcagggctgtaccaatttacattcctaagaacagtgtacaaaggtttccttttctccacaccatcactaacactatctttgtcttt

SEQ ID NO: 48385 - DNA, 1062 bp, Homo sapiens
cagggcttaaaattacatcccaactggagatggagaaaaaacataagagccaaggaggattaaagaatgagcctcagcttgaaaactctcctttcatcagtttctcaattgcagatctgcagttgagttgtctgtggtaagctattggcagtcaattaggtgaaataaactaggagggtgaccttcatttccttttaatagctttttcctccctgaaatggggagcttcagtggattttcagcttaaattttattcaagctgctttattacacttgacagcttagctctgcataaacaattctccctcctcttccccccagatccaggcactgccttccccctccttcagtatcacatttttgactgttacttagtgggctctctaatcacattcaacaaaaaacacaattacatctgcatttgtctgctgccttctgtacccttttcttgtgtaatgaattgctttatttcagagatcaaatcaaatattcactggtacttttgcatgtactgtgtttgattagcaaagactaatagtgaattgtacttgtagctcaagcacagaattttttcacccaaatgaatgaggatggaaaagcctgttttgattaaaagaaaacatatgcaaagcagttctcaagtacccggttaaactttgtggaacatgtttgttttctgatagactctacattacgacatataatttcatgatggcaaaactctgacgtttaaattctcaaaggcaccgcccagctcttgtgaatctcctttgcacctacactttaggaaggaggaaatcgcattaaccagatgttcataggtaatacccattttgagctgaatcagagaataaaaatagcagatctttttagaagggcaaatgaatttctaattttacgaatggctttagtccaggaaaaatgttgtggaggttattataaaggcaggttagctctggatgccttggcaacagtaaaccaaagtggtgaatcaggcgcaatgcaagcgagacttaggcccattgtgtgtcttgggcatactggcatgtgcggtttttatca

SEQ ID NO: 48386 - DNA, 1045 bp, Homo sapiens
ttttaaaattgctgtaaacttatgaaccccttttgtgaacaagggtgatcttccaaattctgttctatttattttttaaggtcctatgttatcattctttatgtccttttttgttttctaccattccaagccgaaatttacagccagaagtagtgactggtgttgtttagaaataaagggcagcgccattctcagtttttctttccctatctatgttctgtgaaaataaagtgtggttgagaaattctgcatttaaacccttctacttcagcctgcattgcacacagcatttgactttttgttgttagaatatacagtgaagtttttggctgttgctaatgccctttcttctccttgttttcaaagcatcaacaacaggtggcccaggctgttgaacgtgccaaacaggtgaccatggcagaattgaatgccatcatcggggtacgtggcctaccaggtctacctcctacagtgtgtataaccagctttcatttcttattaatttgatggctttacgtgtgtgtgtgtgtgtgtgtgtgtgtgtgtgtatcttaacgttgacctatttgataagggtgggaggaggagaggaagagacttgggatgtgctaaggtatatggaggaagagggcttagcataaggaagatgacaggagaagcattttaggaggggacaaaaaatctattaattaaaaaaattctttttaaacagaccggggtcttggtattttgcctactctggcctggaactcaagtgatcctcctgccttagcctcctgagtagctgggtccaaaggcaggcacccccttgcccgtccctaaatctacttttaagtgggaaaataaatgtagttcatcctgtgacacctaaaccacccttgcttcattagtctagtaaaagctttaggttagaattttaaatactttcctcacttctgtcttacaatgttagatcacagtgaggtcaaaatgggtctctgaattatcatttcatttagttatccttgctttttgccttttgctttctggggtattcgaacctata

SEQ ID NO: 48387 - DNA, 1013 bp, Homo sapiens
cttacttagattcctctgtggattgtataatgatgcagtgattggggttttttttggtaaagaagtaatttgtatttaaaatgttattcctgtttgcctccacatgcatgggtgagtcaatattctgtgaatccatacaccatggcacctgtcatctaggatccttttgcttactctcttctaaatacttaaaataatcttttccaaaggttatgctttgaaaaatttagctagcatcccagatttcattttaatcgtgactaaaatgcttttgagaaaataaaacttcttgactgttaactgttcacaggttctttttctgcctcagtggctccaaattttaatccctacccttgcccaccacaacttccaacttcctttacatatccttctttttttttttttcgagatgcagtcttgttctgtcgcccaggctgctggagtgcagtggcgcgatctcggctcatcgcgacctccgtctcctgggttcaagcaattcttatgcctcagcctcctgatgtagctgggattataggcatgtgccaccacgcccggctaatttttgtaattttaatagagacagggtttcaccatgttggccaggctgatctcgaactcttggcctcaggcaatccaccctcctcagcctcccaaaatgctggggttacaggtgtgagccatcacgcccgggtctgagtatccttctggctactttgagagtgagttgcggaacattgcaggttttttggcatgtgatattgattaaaaacataattccaggttccatccgggaaggcagcaaccttatcttccttcccaaaggaccacctctccccagccactcagcttgggggggagcaggaatacagctcaagggctgggacttccccgctgaagtttcagcactgagtttgaggggccaggaatggctttgatacatatatcaaaattggagccattatgtggcactgggggcctagatctccttgtagagagctgttttccctaagaag

SEQ ID NO: 48388 - DNA, 1032 bp, Homo sapiens
aaaaaaaaaaaggacttgttggcagtctgttttttttttttttttttttttaaatgaagtctcgctcttgtcccccaggctggagtgcaatggcgcaatcttggttcactgcaacctccacctcccaggttcaagcgattctgttgcctcagcctcccgagtagctgggattacaggcgtgcaccaccatgcccagctgatttttgtatttttagtagagtcgggatttcaccatgttggccaggctggtcacaaactcctgacctcaagtaatctgcctccctcagcctcccaaagtgctgggattacaggcgtgagccaccgcgtccggccttgttggcagtctttattgtctaagtaaaatgtcttactttggccaaacagcagaatgtgtccttggaaggcaatagctttaagtaatgtaactatcagtaagaataaagttgtgttgagttttttcatttaaagggatggaagaacaacaaaggatttggttcattctatcaaagtaagttttggcagaataaggactaggaggtatatttcagagtttttctttcgaatgtaacatggaaaatttgtcattttgaaaacaagcagggtatggaattagagggtcaagttgttgcttggttacagaaagaaaaaatttcattttgatgagggatatgtacacctgtggggagtgtgtgcatgtagttttctttttgctctgtaaagtactgtgcaaaagttgtgagtagagtagttgtggtgctgtctttcttcgtctactccatgggcttgagatttttgttgacagtcaaggttcacagctgctgctgatgtactaatatttggggaagcaaaaaaaaaaaaaattgttgggaggctgaggcgggacaatcacttgaacctgggaggcggaggttgcagtgagccaagatcgcaccatcacactccagcctgggcaaaaagagtgaaactccatctcaaataataataataataataataataatttattgcaggggagaaaggcagagccattgg

SEQ ID NO: 48389 - DNA, 1030 bp, Homo sapiens
ccccctaagtcaacatctcacacagggaaatgactagctagagtataggcacttagagttaagctccagcaggtgttaataatcttgtcatacaaagagggtagctgtcatcaagattggagtggtcctcaacttcattagccaggcctgttctttgcaagcataagttaaaagagagaaagctctctgcatttagagcctagattccgaggtgcaagattagcctttgtttcttatcagcaagcaggactgatctctcacctctcagtcaccttccccacccttcagcagtgggccagtggctggtttttgtcctggacttgcactggagtaaggcaagggagtccctgggcatggattttaagaaaatcacaaaacatagttatcatgatcaatattttgaaaattcaaacggaatgcccccaaaatcttcaaggaacaacatgtccaaattttgtattagggcaggatccaacagggggagttgggaatagggtgaggacaggaggtagagtcaggccattgcagggccacagcacctcccttgcctccccctctttctgcctttggttacctgtcctgtggggagtggccatgaactataggctctgacttggttccgttgtagttcattgaagtcatttaattggggatttccattcgggactgggcaagtcatgaacacgttccctggcttcagttcccctctctgtataatgagggttagactagacaaaagtctgtttgttccctcgcatggtgggagccatcccagcatacacccgcagaacccagcacctcgtgcgtgcaaattgaggagcgtccttcgccagaggacttaagatgttctcccaaatagtgtttattaagaaacagaaagaaaatctgtttctttagtaaatatttaaataaatcatcttgagtggtagttaaactaaaaatatattcagttactggctcatggaaccattttaagtttccatggatctgagtctttgctgttttattattaaaccttttgtggtctcca

SEQ ID NO: 48390 - DNA, 1122 bp, Homo sapiens
acttgacatattttggcagggatttaaaaaccaaaggttttgaaagggaccagcaattgtaggagtaacttaacagataggattttcaaacctagagaccgtttgagttggcaaagatggcacagcctatgcctaagagtgaagattgtgcaagggccggattttggtggagtacagagaaacaaactgatgcaggaaggtagggagcagatgaccatgaggaggaatcagttagaggttctgacagatttttttcattcttgtcatctaaccagataggcaccaagaagaatggtagctgaatggacaccttgtattgttcacattattccttttccctattaaatgcaaggacaaagcttttgggtgtttacctagatagtttatggcttttccaaattggtctgtgtttttacttgaagtgcaaatatgtgaggcagatgttaaaacaagtgacataatgtttacattaagttgcctgttttgttttcctagccttaaattggaatgtgagaaactggcaagtgaaaagacagaaatgcagaggcactatgtgatggtaggtatcaaagattggactttttcctttttcatatgatattagcaaacgtgttagcagagtgtaaaaaacatgagttaatgaaatgcttgattcttttttctctttacagtattatgaaatgtcatatggattaaacattgaaatgcacaaacaggtaagctttagttgaacttcaagctgaaatgagacatcagttcatatgatttaataatactggctttgttctcagtagtgggctctaggggtgggggtttgtatgctatttttctgccttggtttcctgtcctgtggattgatggtagtattctgcatcaagggttgcttcttgataattacaagtgtttaaatgactaggagagggagaggtgttttggaaatataaactagcctctttattgacagataggaattaagacttgagtttactttttcacctgtatagatttatcctcttgaaagggctgggtatcttctacagttgctgaagtttagaatagttaatgtttttgtgctgttttgcaaggaagtgtggacctgttggggggaaagaagggtattca

SEQ ID NO: 48391 - DNA, 1048 bp, Homo sapiens
atatatatatatatatatatatatatatatatgatgagaacttcaaatttagttgggaaaaaaagcaaaaagattatagggtttaacaacagaagagctaaaaaatatcagaagtagtgccactaacgtagtcatggtttgggttaattgctgtgtgatcacagaaaaggttttgttttagttcagaagaggtgaagaactgtattgaagaggtgatgctggaggtgagcctaggtagaaagatagctctgtgctgggaaaggggagagaggcagccaggatggcaacatcagcaactcagagctggtggcactgctgcctgccaggcactgtcctggtccttcgcaagcattaactgatccagtccacagaacatctggtgagacagggaccttcattatgtccattttacagatgggaaaagagagtctcagagatgttccaggtaaggcagtaaccaaagcagggaccagaacatagggaaggatacggcttggggaaaggtggtcagaccacagggcagaaagagacattttgaatagaaaagcaaaagtttaaaaaaaaaattaaaaagtttaaaagctagtttaaggttatcatagaaggcccccgaattttggtttaaggaacttaaattcctatagacaattaggaaatgtgtacttttatcatccagggagcagatggacaggttattgtgaaccaaacttgatagcctgggcattttgggaagctagtgatgaggtttgtatgctcaggggaataggggctggaggagagggccagtgttctgagcagtttggggaagaagccagagcttccatcataaagcaacagagggattgccacagaatgagtgtctcacgagcttagcaagcctggttctttggggatctctgtggtttaggtaaggagaggagggagagcaggagtagtgtgagatggaaagaggaaggaatcacaggaaaggagaaaatagatggagttgggattatataaggctttagatgagcagggaaggttcagaggattgaaggcacagtttctg

SEQ ID NO: 48392 - DNA, 1048 bp, Homo sapiens
tttcactgatgtagtctattccacagtgtgaaaataccgcaattgatttatccagtttactaaaaatgtccatttggataatttctgtgtcatggatgtcacacatagtactgcagtgatcatctgtcacaagtcttttggtaagcatatggacatgggcaacacattggtcagaaaaattgtttgcaaaatcactgaagctttccgtgctaactcagggtcatcatatgaagtctagctttatcccgggaggtagtagaatgatatccccagggatttgtggagatggtggttcagcttagcattttaagttaccgtgtggagtgtttgtccttgccgtcaggctgccaaatgacattttactattctcagtacttccttccttcctgggtcttttgtctgttgaagttttggaaaacaaattatcagatacattagaattgtgttttaaaagcactgtttgaatgtagattatttctaaaccaagcaggggtgtctcagaggctgtttttctttttttttctgactttccaacctccttttggattcttcttagtcagatacctgagtttcagatagctggagtgctgccatcattttgaaattataatattatttgtagttttactcctgttccatttttattcatacattaactcctttttcaattttgtttattttggagattcctcaagtagatgctgtagttctaaattatctttttagaaattcagccacttagagagataagcacaaaacatggagttatattattttgaatacaaataagaagtaggtgcccagccaggagtgggcatggttcatgctgaatgaatccactggagtctgtcagtcacttcatatgttggtcactgaaattatttttaatcctttctcttttgagtcttaggggaatgcttaaaaaactacacaccaagataaacaaatactactgctttgtggattctccttgtccactcaagcaaattattgtaataactttatgacaactttctatatagttcttgcatttaaagcaacaattagg

SEQ ID NO: 48393 - DNA, 1083 bp, Homo sapiens
gtgactgtggaggctggtaagtccaaactctgcagggcaggatggcaggctggagacccagggaggggttgaagttgcagtcccggtgaaaaggtcatctgctagcagaattccctcttcctcctgggagatcagtctttgttctgttaaggtctttactgaatggatgagactcacctacccacattatggagggtaaactgctttactcgaagtctactgatttaagtgttaatctcatgtacagagtaccttcacagcaacatactcacatgtttaagcaaatatctggctaccgtggcctagacaagttgacataaataaaattcaccatcatagccactaagaaagtttttcaaatattctcagttttgagatcacagagcgtttttgaatgcttctagcttgtaagtaacagaaaattcaaactatttgaatcaggaaaaattcctatacatatattatattcccccaccttccaaatgcctaaacactccacaacaaagtaccaaatttctatgtcaactttaaagttattaattttttttttatttcccaagaaaaggcttgccctacatctgcttatggctctgagatgcccctctgggaggtcttattattcagccttgttcctacccctctgtcttcaccctacaatcccactcttcatcaaaatactcataacttcaaactgagcacctcacagaagatacatcttggatttgggcagccatagccgtccagcaagccacacaaacattttgctttgctggactttcctgggcaaattcactgctttctggcttcccttcttcttctccttccttctcactccttccttccctcctttctgcagatgctctgtgaaaggaagacattgtgccaagaagtccaaaggctgacattttaatgaggaacaggaagaaattttttccagtaggaatgggttctatctgctatgcccaactactagtttttgtccccgagttggaagttactaacagggatgtaatagagagcacagggaagccagaagtattccatcaggtataggtcctaaagcagccacaagagagctgctag

SEQ ID NO: 48394 - DNA, 1046 bp, Homo sapiens
gggatgatttgggatcaaatgcgttcactgtaaaaatgaagtcctggcattttgtggcctagggtaaaggacatttctagggagggatgggctggggcaagtggtgtgcatgtccaagccattcatgttttttatacaggtgaaatctagctacgatgaccttaagggggaaaaagcaatgttaccaaagtgcaatgtggccatgaagaaggagagagggttatattattgaaagtaggagtcagccattacttaatacattgtctgattatatctcacatgtgattctaacttatgcatagagctaaagattctttgaactttcaatgagactataacagtgaatttatccagaggatatttatccatccttctatccatttatatttcatccatccatccatgcatctttccatccatccattcataccactaatatttatcgaagagcagccttttgtggggcactgtagtagtgtgggatggcctagcccagattttcggccatttcatccccaagctggggtctccttcatcatccacactcccctatgacctcatggtttgaaagattttatctacaaaataattcatgaagcaacaattaatttgcctcctaatttttattagtcaaagacagttttgactatcatttagcgccttcgactatcaagaggtcactagccaacagcaaagaaatttgacagccaatttctatgcttaagggatccttggagtccaaagcagtagttataaaatgacagtccttggactacactgtgacccagatgtatgtagtttgagccaaataatagctgtaaaaaatggaaccagttgccataaagttctggcttcagttgcgactggggttttggtcacatggctccctgacttctgtgtggcaacactcagcagcagtgcctctttaaaagaatcctttgtctctgaattgccaccatccctgctctgccaacttaccttctccttccattgagtttgcagccaccatttttttttttttttacagataaggaaacagagttctg

SEQ ID NO: 48395 - DNA, 1103 bp, Homo sapiens
gggtgctcagagatgtgtaggcatttctctttttacccttgaagatcctctggaggtgccctttgttagtgtcagctgaagaatcatgaagtacataaatttggaaagaagagctttatttctcacaaagggttgcagcttgcagggtggccattctgacaggtggggaaacgtagactctggccagaagctggaaacaagcacttcaagggtgggaagaataagacaaagatttatgctgaatggggtggccaagtatacgtattcaacaggttattataggggctgtgaatagtcacaaaaggaaggcacaggcatgcatagtaggctagcacataagcaacatgcatcccatgttcacttttgggtggagacttaacatttaaatgtattatcattagggcctatacaacaaaaggtgaggcagaggacacaaaggccctctgtgcacagcctccatagactggccagaaccactttgtagtcagtggtctcttaccaggaaggaatgctgatcagttactgtgtcaaaaccacaaaagggaggggcagcatcggcaattggttgatatcagtggtgcagtctttcagaagggctggtttctgtttaacccttggtgtaggaaacctaatagcaattaatgagggagggggtataatgaggtctgacctcatcatgtctgggaactcagtttttaagggttctctggggcctcttggccaagtgggggcaatgttcagtctgttggggggcttaggattttatttttatttctcattagactccagcaacaactttaatctagtatgctcttctgttttagatgtatactccttaatttcaagagcaatcaatttgtttttaagtgcaatcccgctgggttccttctagtgatttttcaatgaataagccacacctgcataagcctcagagcaggcagctccagtcagggaattcctgacacagagaatattagctgtgaatggaaccccgaggaatgtccactggtttccatctaaaggtggtaccacctcctatcctggggagcatttggaaatactggggcgggggcattaaatttttaaaaaatgtaaaacatttt

SEQ ID NO: 48396 - DNA, 1056 bp, Homo sapiens
ttttacataggcccttgggtacttcttggacaaatatgttggctggagttgggtgagatgggataacttctcaaggtcttcagttccacataggttaaccacaagaggccaagtgatggaaggggaagtggtatatgtactgggacattagtccactagtccatgtcactcaaccatctggcctcggggtagaggtcagctactacaacctggcccttgggtgggaaacctaccaaattctaatttttttgagaagggaagttaaatcctcccatctgaactcctggtgattctaaagataatgtgtcccaaactttcaaattgaggcctaaaagatcttagtgacagtgacaatgatatctgacagtaagaaaaatgtagttcctgtcatccagatgctggcctggtgttaaaagctaggccttcatgtcctgctaagcatacacaatttcacaggacacctacatcagaacaagactgcttttcagccgtggtgggtcaagacaaaggaacatttctttagtcatgtcaacaccgaaaaacatgagcattttccaagatgcaaaaatgaccagacatctccctgtccttgttaatgtgcttcttaaccagttatagctttagcttcacttccttcttcacactttacttttttttttttttttttttgagacggagtctctctctgtcaccaggctggagtgcagtggcacaatcttggctcactgcaacctccgcctcccaggttcaagcaattctcctgcctcagcctcgcgagcacctgggattacaggcacccgtcaccatgcccagctaatttttgtatttttagtagagatggggtttcagcatgttggccaggatggtctctatctctcaaccttgtgatccgcccgccttggcctcccaaagtgctgggattacaggcgtgaaccaccgcacccggcatattttcttaagataaccagttatcccccactttctgacagcatccatttagagagccctgcttccttgaaccctactcaggactacctatcatgcaaccaaacctta

SEQ ID NO: 48397 - DNA, 1092 bp, Homo sapiens
atagttaaatattgtgcttttcagagcctcagagaaagggggacggggtgggggggtggggcagcggaatctgtcctggatggggccagcttaaataatactggcaaccaagattctgttaggatttctgtgcatatagtgtagtaaagaagtatcattcaggggtgaaaaacaaagagccgttttaatgatgttgagtacatttggctgttttatagcctttttcttccctcccccaaagaattctgtttgcctaactcccaaactgttggggtggtacattcctttaggaccaattaaaacataattgagggtcagtgatacatttggctgactctggttcagtattctcttaggtgattatattctctcatgtacagttacaggaaattaaaatgttaaagtaacctaaaatgaattcagaccaataaaatcaagggaaatacaagttgattgcattacttctgtatgttgcttgctattaaaaaggttaagaggccaggttacccaccagtccttgcactgttctgacactttccccaggaggaaaacaagtacaaaggttacggtggaggcataagtagaagagattgttaagaagggtattcatgtgtctttgctctttctgctttatgcctcagtttggtttaaaaacttctgtactggcaaatggtggtattcagtgtgggatagtgtcataactaatttgacaatttattaatcataaaataacaataaatctctagcttttacacttgatttgtcttgcctcttttgtagaaagaaaaaaagtctttaacttttgctaaccatgtgttttaaaggctattggagttgatttaccccagattttgtcacattttacattctttatttttcaggttttccaattaaaacgtcacagtcttttgtggtgtgataaaaagatagcacactgggaaggtaggtgacttgagctccacttttgatcttggtacttgactagttatgtgacattgaggcgtcatggtttctttattatacatgtggtggtgaggcttataggtgtgctggactgggcgataagctctgaagtacctttaagctactgca

SEQ ID NO: 48398 - DNA, 2021 bp, Homo sapiens
ggaggaaaagttggctcagtccttttcactttatggaatttttcagcagtaattttgaccatacgtaatttttgccttaagttgacttcagaagctagctcttcattagacaagattttactgtaaatgcagaatgtttaaactcatcagtcctcttttcctggtatatgttgggcatgtacttttagagatgttttagttttaaagttctttcgtagttcagttgatacataatatgtataatcatttgtacttggtgaaattaaacacagtgcatattatattttaaagctttaacttttgtttaagtatttttccttaatatgtcttttttaaaaacaaactttcagctagtatgttcaacacaccaggaatgcagagcttgttgcaacaaataactgaaaacccacaactgatgcaaaacatgttgtctgccccctacatgagaagcatgatgcagtcactaagccagaatcctgaccttgctgcacaggtgagtttgtaattgtattgaaaaagactgtgcagtgtgaattaaaataacctaatcttgtaattgtgattttggcacatttgtgttgtgtatgatatcttaatacactagaaaaataagtaaactgtgtctccaattttttagaccgtgtgtttctttgcagtaaattaatacttcatatgtaattaaaacaactttatctctgccattcattgactagaaagaagtgcaggtttagtttgtttctacatatgttgagttaggagacaagtacagagttctggaatgcccactcttttgaagataaactacttaatgaaatgtaaatcttgaaagcaattaagagcaatgttaatacatttgaaatacttttatttagtagatcactcagattataatagtcatgctcagaatggcagttgtaaaatagcatttattaaagacgggaatttgtcagaacaatgttctccttctttcaactattgattcccctgctgaaaatcgtatacaggtcccttattaatgtattcctttttctaatttgtttctaaagagaccacagctaagaaaattggggatcttaatgctggctgaacactcaggatcacttgggaagctttatagacagtaccgatggttggggcctcatccttagagattttgagataattgcgtccgataaccctttctccctcaagttgcctaggtactatctaggttccataccacagggcttgaaaaaccacggagaatgtgaaataaaccttgataatctgtagtttatatttgctgttcgttaaaaatggcttctgtagtgtgtcaggaatttggaagactttatagttaatctcatcccttaaattttaaaagctttaagtcaaatgaatggtttttattttctaaattctaaaactatattgattcaggtatctttgtgtataattctcagtaataacttatgccctcaccaaatttgtggaattggaaataacaaattttaagaagaatttttgtgtctgtgattctgtatattggaggtacattttatggaagattgatttatgcatatgaaacttatcagactgagttgttagtattaaatgcttcaatttaccataataagccattttaagtgtgtatttggctaatactgaatgtgcatcttgcttttaaaatttgactttaacaagcacatgcgtagcaattttgtaataatcttactttagtaaagtgacttgagcactcacatactatttttttactctaaaacaaaatgttgctagtactagattggcatgtcttttattacagataatttagaaacttttacaatgttcttgttatctgcagattaaaatttgtggtttttctattcttttgatttttaaatatttaaaaagactcttgagtgtaaaaacttgtggtataagcactcaggtaagttataagaagtatctaataagatgattatctgtgaaaggatacgtttaagatgacatgcttttttaagatgaaatgaagtgaattc

SEQ ID NO: 48399 - DNA, 1050 bp, Homo sapiens
caagagtgaaactccgtctcaaaaaaaaaaaagcagtgtaaacgattgagcaacataaaactataataatcaagacaatctggtactggcataagaatagacatttacagattgatagaataggattaagagttcagaaacaaactattgattttggacaagagtcccaacgcagttaaaagggcaaaagaataatcttctcaacacatgatgctggatattgtcatgcagaagagtgaatttcgaccctttcttcacaccgtgtacaaaaattaactcaaaatggatcacagaactaaacacatgagctaaatctgtaaaacttttagaagaaaatataggagtaaatttttgagttaagcaatggtttcttggataaaattggacttcatcaaatttaaaaacttctgtgatacaaagaataccatcaagaatatgccaagacaagccatgaaatggtagtaaatgtttgtaaatcatattcaataagatatagacatttagaatatataaagaactgttacaactcaaaaaaacaagtaacccagttaaaaaatgggcaaaggatctgagaagacatttctccaaaaagatatacaaatcttcaataagcacacaaaagggatgttcagcaccattcgctgtcagggaaatgcgactgaaaaccgcaatgagatagcacttcacacccggtggctatcatgaaaaaggcagataacaacaagtgttgatgagaatgtggagaaattgcaacccacttgactgctgatgggattgtaaaatgatgggctgctttggaaaattatctagcgatacctcaaaaggttaaacatagagtcaccagcagttctactcttaggtatatacccaagagaattgaaaatacgtccacacaaaatcttgtgcatgaatattatagcagcacaattcgtaatagccaaaaagtagcaacaacccaaatgtctatcaaccaacaaatggagaaataaaatgtagaatgggatatttggcaataaaaaggaatgaagtgctgatacaagccatatatgg

SEQ ID NO: 48400 - DNA, 1049 bp, Homo sapiens
tagctaaacttgttctcaggttaatttcattatttcttttttcttctgtctagagtaggtgcttgtacatacctctttataaaatctcaacaaatcatgccttttcaggagttttatttgattcttagtcttttttcttctgttggactgaagttgttttgttttttaatatgttgctttttaaatgccagaactgttaggaagggtatctcatagatactcatttctctctagtcccaattttatctggccttccaaactccagtccttctagtatggttttagttttaaaaatcttagtgatcatcatatgtcttgaagtctaaatgatccagtcttcaatatgcttgaatgcactatcattggaggagtacccaagaaactgtaacagtggttgtcaaaggtggcagtgggggagatattggacagagggataggagaaatagcctgcctgctttttacagtataagcttctgaattttctatcatgtccgtgtactacttatgtaaaaattatattaaaaataaaaagaactgtgtgaagaaaggaaccagggaacaaacccagtcctatctgtctctacaacctacttccttcttatagcactgtgctttagcactaatgctccacatgtctacctttagctgattatgagcgtggacaaataatttattcactttaggccctagttatattatgaaaagtaatgttggatctgttgatttctaaaattatgataaatgatcagagtgcaattgaaataaagaataaagaaaaatacgctaaaaaaatgaaccctattgttaatgctaccaacacacaggagtgtagcagtaatcaaattagactattaattttatttttctttctgagatggagtctcgctatcttgccaagctggaatgcagtggtgcaacctccacctccagggttcaagcgattctcgtgcctcagtctcccgagtagctggggtctacagatgtgcaccaccatgcccagctaatttttgtatttttaatagaggtggggtttcaccatgttggccagg

SEQ ID NO: 48401 - DNA, 1041 bp, Homo sapiens
ctgctgaaatgagcaggtaatgatgaaaaggaaatagtgtgacttggccctgatcctatataaggatgccgttgaaggcccaggaactttgacgaatttctgctgagtatactactgatgggtcacttaggaagacctggagccttatgtgggagactcacttggaagaaaataatgtgtggaagtagagtagatcttgggataattacactgagaggtgaggaagagataagggcaagccttgcaactgatggacaatatactgtctggaatctatcttattaatagagtaataatagatttcaaaagtagctacatttacagggatcaggcaatgactatatactaggcagaaagcatacaatgtagggggtgttcttcctgacacagtatgagaaatttcggggatggagggctgagccagacagaaagctggacatggaaaacttagctgttacttggctgcttatgtcaaacacgaaagagaaattatggtaagaacaaagtttcctactcctaaatcaccatatagataatgcaaatttacatcaactaagccttagcatacaatctgagagctagaattaaacacctaaccagatggacagtaggaaagcactcagttcgcctgtttatgagcaaacactggatctcagttgatcttgtatcaatggaagaaaagtttctgccacatgaaggaaaagcacattgtacttagtgtctggagtgaaagcacacctcgaaaaagatttgctgcaggaaatggaagtttattttagatagcatctatgttttgctttaataaaaatcaagaggctagaacgttttgtaaaagtcaaggggatagtaatgttatataagaaagtaagataaaataatgcactaaaatgaaaaagtgactgagagaaattaaaagggagacgggtgaattaaaactgagatggggccgggtgcggtggctcacacctgtaatcccagcactttgggaggcctaggtgggcggatcagctgaggtcgggagttcgagaccagcctgaccaa

SEQ ID NO: 48402 - DNA, 1034 bp, Homo sapiens
ggagggaatgtttaacttcaggaacaggtcagagaacgcttcatagatatgctagcacctgagcaggattttgaggaataaatggaagttttcagtggaagagatagatggcattgtagacaaaagagaacagcatagttaaagatatgaacaagtaaactaattgtgtgttcaagaaatttcaagttgttttttcttggagtacatgcaaaatctgaagaaagagggttgctagagaaagccctaacgcatgctattacatttaataagtcaaataattggctttttgggtatgaagtatatgtaaaataaagactttgttatatttttgacattgctgccatcttttttttttctttttcttctttgacaaagggtctcaggctgtaacccaaggtgtagtgcagtggcacaatcactgctcactacagcctcgacccccaggctcaggtgatcctaccaccttagcctcccaagtagctgggaccacagtcatgcaccactatgcctgctaactgttgtacattttgtagagaaggggttttgccatgtttccctagctgatcttgaactcctgggctcaagcaatctgcccacctcagcccttccaaagtaccaggattacaggtgtgaaccaccatgtgtggcctgctgccatcttaagtataaattaatagtttgtactagtggtagtcattacattatggaagatagtagaagatatatttatttatggtgaactgcctgcatattgagaatgtgtgtttatttcacattttgccctgaaacatttctgtttttaaaattatcgtgtgaatttattttgtcttccttcaactatacattatccttgaaattagttttatcatttattttatgagatacggttttgctatgttgcctgggctggtcccaaactcctggacttaagtgatctcctgcttcagtctcccaagttgctgaaattacaggtgtgcaccactgagcccagatatccttgaaattatttttaaaaggaactcaaagggaggagg

SEQ ID NO: 48403 - DNA, 1024 bp, Homo sapiens
gttctttgttacttttccaaaacacttgtaaaccgaagttgagtttcttaaactaattaatgttttgttgggggctgtagcaaaaccatcctgacatggatgcttactcagagtcacccacttccttgctgaatccatttttttctgatgtagtgctgctacagaccttttccttttgtcctttcctctgttgctgtggatttgatcatctcacataggacccaaactgtcaccctgtgctcaaagacttaaggcttcctttctctcattgctagcccctagggagtagagtttcttggtctccttgctaaaaaccagttcctttaggaaacaaaccaaaacaaaacaaacttataaaaaggaaaatatctcttaagcatggtactaaaatttatttaaattaaatagatttctgtggacttacctgggaatgaaacaatttataaatattggtccaatgagatactattttctaaatttcaaaaaactaatttacaaacttaactgggaaattttatttttaccaggaactgtttgaagtcagattctggtttccagctagtcttccatttttataaatttatgtacatttatatataaatataaatcatacaaaccaaaggtaaaacatacacattataaatatgtataaatgcactgaccttttgccattattatatatatttcatatatatatatgtatatacacttgtacatatacaagtatataaggaaatgtgtttgtatttccataagtaaaacaagtatgtgtaaattaattatttctaactaaggcatagcacataatcttacaaggaacttataattaggatctttgttaataaatacatatttatttaaatatattattgctgtgctttgttgaaggcactgaccttttaccattatatatacttgtatataaacacttgtatatatatagtattatatatatacttgtatatagatataggttatacattttacattatttcactttatattatttcatatcatattttat

SEQ ID NO: 48404 - DNA, 1029 bp, Homo sapiens
tctttagcagaatctcaccagggaagggatttcttttctccctgttttgtttattggtggattgcagagtcctagaaaagtgcctggcacatagtagatactaaataaatacttgttcaatgaatacatgaataaattcttggtaaggggatacatgtgaaaactgttacttgttaattttatagttgtggtttaaaagagttataatagcctggtggtgggcatctgtaatcccagctactcaggaggctgaggcaggagaattgcttgaatttgatagtcggaggttgcagtgagctgagattgcaccactgcactccagcctgggcaacagagcaagactccgtccccccgccaaaaaaaaaaaaagttataatatatagaaatgtagtaaaataaattaactataaatttggggttgtagctttgcttttgttttaagttccagatgtgctttctttttctaaattttcagcttcagttgtggagggccaaaagggtatcattcctcgagctattcaagaaatatttcaaagcatctctgaacatcctagcattgactttaatgtaaaagtatcttatatagaagtgtacaaggaagacctaagagatcttctagaattggagacatccatgaaggatcttcacatccgagaagatgaaaaaggaaacacaggtaaagtagcacacttaatcagttgccttcattagcaaacagacatgctttaatgctttaattaagtttctggatatattccaaggaatctttaaaaacagatgcagaagcaaaatgaatttatttttacttttaaattgaacagctttattattaatccctctctctctctttttttttttttttttttgagatggagtttcgctccatcagccaggctagagtgtagtggtgcgatcttggctcactgcaacctctacctcctgggttcaagtgattctcctgccttagcctcccgagtagctggtattacaggtgtgcaccaccatgcctggctaatttttgtattttta

SEQ ID NO: 48405 - DNA, 1055 bp, Homo sapiens
gtttttgtttgtttaatgagatattatacctgtgattctgtaactttctttttgcatttaacaatgtaaaatatcatttcagaccaggcgtggtggctcacgcctgtaatcccagcactttgggaggccgaggcaggcagatcacttgaggccaggagtttgagaccagcctggtcaacatgatgaaaccctgtctctactaaaaatacaaaaattagctgggcgtcgtggcacatgcctctaatcccagctacttgggaggctgaggcagagaatcgcttgaacctgggaggcggaggctacagtgagccaagatcgtgccactgcattccagcctgggcaacagaccaaactctgtctcaaaaaaaaaaaagttggatttattttttgatgttttagtgagcattttatgtttcccagaatgtctctataggacaccaattctgggtcagctttttggttatagaccatgcaaataatgttttctttttacccctccagtgaatatttattgagcatctgcagtgtctaggttaccgtgctgggcactagggcagaatgaaactctcttattttaaaatgtattttactttattttaaaaacctttttgtagagacagtctcactttgttttttgtttttgattttgctttcagatagggccttggtctgtcaccctggctggagtgcagtggcacaatcacagctcactgcagcctcaaccttctgggcttacgagattcttccaccttggcctcctaagtatctgggactacagggacatatcaccactcccgactaattttttttttttttaattttttgcagagacagggttttgccatgttgtccaggctggtcttgaacacctgagatcaagtgatccgccctgcctcagtctcccaaagtgctgggattacaggtgtgaaccaccacgcctggctttatttttaaatatgatgcttatttagctaatattcattttcctgcttttcagaacgttggaattacctttacaaggtatagccttttccaaaaacttttgtgtactcttt

SEQ ID NO: 48406 - DNA, 1046 bp, Homo sapiens
taattttcagctcctctgttggacatataagtgcatctcttgttggacataggcaaaataacttggcaaacttagttctggtgatttcttgatggtttggaagtctattgctgggaagaaattccatcatacatattcatgcttataataagctggggattttttgtttgtttttgcaaatgcttgcccctacttttcaacaattttctatgttagttgtgaagaactaaggtggggagcagtactacaagttgagtaatggtatgagtatataccagaattctgattggcagcaagttttattaatcagaataacacttggttatggaagtgactaatgctgaaaaaattgattatttttattagataatttctcacctatagacttaaactgtcaatttgctctagtgtcttattagttaaactttgtaaaatatatatatacttgtttttccattgtatgcaaattgaaagaaaaagatgtaccatttctctgttgtatgttggattatgtaggaaatgtttgtgtacaattcaaaaaaaaaaaagatgaaaaaagttcctgtggatgttttgtgtagtatcttggcatttgtattgatagttaaaattcacttccaaataaataaaacacccatgatgctagatttgatgtgtgcccgatttgaacaagggttgattgacacctgtaaaatttgttgaaacgttcctcttaaaaggaaatatagtaatcttatgtatttttttgtgtgaagtgtttttctagcatttataagtgaaagctggcaggggtggtagttgggctcataattaacgtggtaatttagcaaaatgagagcctagtcatccaattttttttttcttatagtcagccagagctttcctcattacctatgagaaattttgagtgagttacttggttcctttctctaaaatagctttagtttgatgtttgagaatatcggagataatgtaaaataactgcagagtatggttcccggctcatatttctgaagtactacttattaacctccagctgtccagaa

SEQ ID NO: 48407 - DNA, 1044 bp, Homo sapiens
gctgcagaacaggtcagtttaagtttagctttgtgttagcttatacatactaaaacctttaaaaagcttttcttctcaattgatttttttcttttagaagccatggtgtctcaaccttttggggacctaacttctaaacattctaatagtttgccttaatttttcttctgctttcttactaaaaatgaagacattcaatactaatcttgctggaagaagccttaaccaagcaaacttctcatttctctggtgaaaactgctgccaaaaccacttgttaaaaattgtacagagcctgtagaaaatatagaagattcattggatgttggcctagttctgtgtggaagactagtgattttgttgtttttagataactaaatcgacaacaaatcacagtctgccatatggcacaggccatgcctctacaggacaaatgattggtgctgtaaaatgcagcatttcacaccttactagcattctttgtcttttctaccaaatattaacaactttcaattccgttttcttaattctgttctactaatgtccgatttactactcatcatttttcttgacacttaacattgctttaatttgtaattgctaatggtttttgaactcttctaattgtaatggacgtgtttatcattttaatttagcattgaaattgtcttgatgttgattaagatgttacgagcaaaaattctaattcgcacttttttttcttttcttttatagtgtgaagcagtatgcagatgttgaaggattctaatgcaagatattttttcttttttatagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttgggggggggaagggcgtgcaaaaactaacattgaaattttgaaacagcagcagagtgagt

SEQ ID NO: 48408 - DNA, 1050 bp, Homo sapiens
cttaattagaaatagcgacaaagtgtaaaaatccttgattgcaccatttcctgtgtgtgaatcaattacagtattactgaaaaccattgcaggtggctggttaaatccagaaaaatttttttgttttctttgggaagaaaaatgtccatctgttctttaacagcttgcacatggagcacaaagaatttaatgttgaggttgcatgatttaaatatgggtaaagaatagagtaggcacttaatcttataattgggaaactgttcgtcaatgcctatgatttgtttgagtcttcattttacagtgggttgactcttgtgattagacacattaaatgttggcagtgccagaagtgagcacatttataggacttggctacaccaaaatttctaaattttttttctcatagtgtacacatttcttaatgtttttcttgctaaaaatgaggcaaataactttgtgtcgagtacttatttgacagtatttcatttctctcttggtcgcagatctttgtatgttcctcttgattactgtaaactgaacttgaaaatttgtttaaaattttacaaacttgcctgttaggatctaggaatgcatttcaaaacctccagaaaaccaaaccagtcttattagttagggtttttggtggtgtgggaatttttgttttgtcttttataaacctctctcctcttaatccagatgttctgtataattatctgggttattaatttccccatttcctcaagaatttcagtaaactttgagtcaggttttgtgtctaccctcatgagccagcctgctactgaaacatcgtttgtttttcttaaaaaataaaaaaggctagaaccatcatttgaggtccttaatgttaagccacagtcagatttagagaagtccattattgtgttagtcttcagaacaacttaagcttgtttcattgagagtatgagtatagtttgtattaaattaaaatttattgcttttcccccttttccctctccttgtttttttggccatatatctccgttgcccatgtactggatcgacttaccc

SEQ ID NO: 48409 - DNA, 1049 bp, Homo sapiens
tgtaacttttcataaatgtatgctttgtggatgacatttatcttttcagggttttgggaatgtgccgtataaaacaattcattgctgtggtgggacttaatccagtggctaaaagttattgttctaacttagcaaaaaatgaaaccaggctcccttgaattttgtattttttaggcagtcatttgaattgtgaaaccctaaaatgaagaatcaagttttagaaacagctggttttttgggttcaaatcagtattcactgtgatcggaaacaaatattcagtaataagaataaacaaaagcaaaactgatttgtgttggttcttataggctactgcagcactggggtgtcagttgttggtccgacccagaacgcttcagttctgctctgcaaggatatataataactggtacgttctagaagcaatgtcttttttttttttttttttttacagcttgctttccaataagccaaatgtactagctgctttatttttccacagattggtgtgcccgtttaataaaagaatatggaaactgaacagccagaagaaaccttccctaacactgaaaccaatggtgaatttggtgagaagaaattttagttttaacagtatttttttatcctgttaataaattgcctttttctgttaattattgccttaggagtgtgtggtgaatttttggtattactgtttatgtaattctgcgattatcagtagttacatcttagcttttatttatgaagtagaagtaactgatttgcatataaagaatttttcttgcattttgggatttcaaatcctttgaagtattttgtggcagtattttgtgtttggtgcattttactagatggaagcataacgttcaagtctgtagcaatgcctttggtcttttcaaaacatgcctaagattagcaacaagtctcttgaaacagaatggagttactttggagacttcgctgctttctttgaaatgtgaactgttaatttttaggtaaacgccctgcagaagatatggaagaggaacaagcatttaaaagatctagaaac

SEQ ID NO: 48410 - DNA, 1071 bp, Homo sapiens
cctcactttttcctatagtgtttttaacctgttataattggaatgatagagatgtatttcagaattttgcatggtccaaatcaatgatttttctttttaatatgtaaagtatttcattaacagtgtagattctttctgatgtttggggagccatgtttaaaaatgtagtatggagcaattgaaaaaggggtctttttccctagcctaattcttactaatctcagaaaacaaagatcaaatagactgtgaagttgaactagtcctcttagtgtagtaaccaaatttaggaaagatcaggataatttaggaaggaaagtaatcatttatttaattatttataattataaacaattattttatgttttgtatattttatgtataaaacaattacatgttttattatagttatacttcttcagagagtagattatggagccaccatgtccatacagttagttgttccttggtattcttggattgattccaggaccccccacagttacccaaatccacagatgctgaagtctctgatataaaatggagtagtatttgcatttaacctatggacatcctcctgtatgctttaaatcatctctagattacttataatacctaatacaatataaatataaatgctctgtaaatagttttattgtatagtgtgtgtgtgtgttttaagagacgaggactcacaatgggacactttgaccaggctggtctcgaactcctgggcctacacaatcctcccacctcagcgtcgcaagtagctaggactacaggtactcaccactatgcctggcagttttttaaatttgcgtttttaaaaattgtttattatttattgaatattttctacctgagattgacttaatctgtggatatggaacctatagatatggagggctggctgtatatgaatttgtttttggcttttacaaaattagaaattaaaagtaactacagttactataatgtgcagaatgactcaaatatttccatttattatgttagtgtaaaaactcctaactacgtattataatattttatattaatgaagtactttagcataca

SEQ ID NO: 48411 - DNA, 1056 bp, Homo sapiens
acacagtgattttagtagaattaaaaaataaatcttagcctgcaaattgatgaaatcattcaaagaaataacctgatgagagagttcactgttttttaagctatctatctaattttaggatatatattgatactcttgtaatacaattaatgattcacatttcactgcttattgtcaatacaaggaactttcacctattataaatttcaacttgttcatttggataagatttttaaagttaatgcagcttatattatattggaatcaaagttagtccagtatggtgaaataatcttatattaggaccttaagacctcacaaagtcttgtatgttctgtgtgttttggctgcagccctaccacttatgtcttggatgaagatgaacctcgattccttgaagaagttgattacagtgcagaaagtaatgatgagttagatattgagttggctgaaaatgtaggagattatgaaccttctgctcaagaagaagtactttctgactctgaattatcaagaacatacctaccttgagcccgctgccatctcttgttaactgcaaagaataaatgaaatatcttggtttttatttcccaggaagcttgagagaaatgagtttatacagagctgactcaaaaagacaaaaagtaacttgggccagtttggtttcaagataataaatgtgttattaattaatgataaaattggcgcttgttttattttcgatattcaatgcactttatgtagcattgaatgatcaaatattggatttacctttaaaaaaaaaacctgagtatcattgcatgaatttttatctccctatggttatatcctgcatcaagtggataattttgaagtgtgttcagaatataaaattgaaattttagagttgttgaaaatcctgacttgttgaaaactaatatatatgtacatggatttctatagatgtgtttgtttagaagtgggtagatattgcagataagactgttcttcagaatcatgttaactattgggttgtgactgaagtagtccagggtttgccttgaaaccattacattc

SEQ ID NO: 48412 - DNA, 1050 bp, Homo sapiens
ctttgatagacagtggtcatctcactgtaacctcatatggcagaagggttgagggatctttatggggtctcttttataagggcactaatcccattcaagagggctctgctgttgtgacctgatcacctcccaaaggcccgcctcctaataccatcaccttgggaattaggatttcaacatatgaattgggatgggaggggggatgtaaatattcgcccaatttcagatattatataattactctttacaatactgtgaaccatcaggttttttgcatataacatttaagttttgtttaaataaactaagaaaaaggtaagagacttattcaaagtgaatttgtgataattatgaaaaataagttgccagtcgttccatttagtttctacaccattgctttggtgaaagataaatttagttttataaataacaatggagatttaaagattagatgtaaattaaacagagcttaaaactactaatctataaaattattttaattggaaaagcttgaaacttctgagtgtgtgagttaatattacaaatttgacagaatcttaaccctgctggtgttactatgtatgtaagcgtaagctatctttttgtttagtatttgtttttagccttttgtgtctttatatttaaatatgtcttttaagcagaatatagttattctttatcagagcatttagttcacctacatttattgtaattattaacatatttaggtttaaatctaccagattattatttgctttctatttgttccatctgtcctgtatttttttttttttggctttcttttagattggtagattttagattgattttagatttatattggttttattctcttaactgattttaacggacacttggcattacttcatgcagtctcactttatcaaactcttaatataaaagtgtatttttgggaggccaaggtgggtggattaggaggtgaggagttcaagagcatcctggccaagatggtgaaaccccatctctactaaaaatatgaaaattagctgggcgtggtggcaggtgcct

SEQ ID NO: 48413 - DNA, 1091 bp, Homo sapiens
ttattcaacctgtctgcagtgtggatcgtgttattccacaacttagccctcaattcagttttatccttcttggttttaactatttcccgagatacagtatctgttataaattaatttattttcatttgtaggcaatgtatatcaaataagcttgaatacttgcagcaataagaataaatatttacattaaatgtctttttcaacataagtagtaactcattgacagatgttgtcctagtcagctcaggctgccataatgaaatacaataggctggatggcttataaatgacagaaatttatgtctcacagttctggagattgtgaagtccaagagcaaggcaatggctgatttggtgtttggtgagggcctgcttcctcataggtggccttcttctcactgtaacctcatgtgacataaacattcagttcattacccttcatccctgttcccatcccaaaattcatgtccttctcacaagcaaaatacatcatttccatctcaatagtcccaaaatgttcgcttattccaacattaactcaaaagtttaaagtccaaagactcatctgaatatagtcatgcatcgtttaacaataggaatacattctgagaaatgtgttgttaggtgatttcatcatcgtatgaatatcatatagtgtatttgtagtaacctagatggtatagcccattacacacctcggctatatggtatagcctattgctcctaggctacaagcctgtacagcatgtgaccgtatggaatactatatataattgtaacacaatgggaagtatttctgtatttgaacatatttgaatatagaaaaagcacagtaaaaatatggtattataattgggaccactgtcatatatgcattacatcgttgactgaaacatcattggagcatatgactgtgtcatttaaatcagatatgggtgagattcaaggtataatttgtcctgaggcaaattttcctttagctgtgagcctgtggaatcaaccaagttaggtgcttctaaaatacaatggtaggacaagaacaggacagacatttttattccaaaaagaaaaagaagtgacaattcttgagc

SEQ ID NO: 48414 - DNA, 1034 bp, Homo sapiens
agtctaaatactcccttcgtgaacaccggctgagttctgcctagtgttgccttctgctgtgacattgacagcactgagttccaatgcaaagtcccacagtcactgcatgttctctccctgaagcacacagattctctgctccatgtggccactggggctggactgcgggagtggtgtgagcaattccagattgtctttcctaccctcttcagtgcatttccttggtatgatcgctcacctaatttttggttcttaaaaaggtgctttcttgcgtggatagttgttcaatttggtgttcctattgtggggcatggagtggggggcggtgatcactggaggcttctatttggccatcttgttctgcctctcagctgtttattttgttaaataggtttactttccctcacatcttctctttgcttcctgcaacaccaaaaaattgaatatgtgtttgctttatggtgtgccatatgtcatgtaggctttgttcattcttttttattctttttttctttatttgtgtctgactgggttatttgaaaacacctgtctttaagttctgaaattctgtcctctgctttagtctattgtcaaagctctctaatatatttttttctatcatttaatgaatattcttcagttccagtatttgtttgctttttaaaaaatgatatctgttttgttaaatttctcacttatcatctgaattgtttttctgatttctttgtattgtttatctgtgttctcttgtatctcactgagcttctttgataccattattttgaattacttttccagcatttcatgtatttctttctcgttggaatctgttgctggagaattattggttgctttggaggtgtcatattttcttgttttttcgtgtttcttgtgtccttatgttattattggcacatctggtataacagtcgcatcttccaatttttttatttactttcatggggaggacttttttctgaaggcaagtctatgatactggctggatagggcactgtggctttgattctgggtgg

SEQ ID NO: 48415 - DNA, 1049 bp, Homo sapiens
gaaatgtaagttaagatgtactgagatatcattttccacatatcagattggctaaaatctaattgagcataacattctattgatgaggttatggaaaaacagcctctctcatacattaattgaaagaattcatgtatgagagaatctcaattgagggaatgtcagttgagaataccactggtagagggtgatcagacagattctatcaagattaatgtgcatgtttcctttgacatgtcagtcccacatctgggaatttgtgagatatgtttatttcacaaatctcacatgtctgtgtgcacacatagtttgcatacgtgtgaagtggcattcaaagtttttcattgcagtattgttttgagattggatacaactcaagtgcctatttgtcaaggactagttaaattatggtgtaacctttttatgaataatgtgcagtggttgaaaaaacaaaaagctgtctataccctgatagaggtgtaagatgtattataaaatgaaataaacaaggtgcttgttttatgacgttttagacttcgtatcagaaggagggaaaagcagtctacatttatgttttcatcaagtaaaatctggaagaaaagtaataaaagtagttccttgattatgtggatggaagatacaggttgtgttaataagtgagacttttcattttttgcttttatatcatacttgattttgtgtaatgccagcatattaccttttcagaaattttaaattaaaaagtagataaagaattgtggcaaaggcaaaataaagaaaacaaaactctggatttcttatatgaagtttagaatggcttggaaaacacaggtacttctggaattgaggcaatagtggaagtattggtaggaataaaagcagcagatagcttttattaaagacattttaggcattttgtgggccagacacacaattcagtaacaagcattttatatgcagtgtatatatgcatataaagtgtgccatttaatactatagcacctctatgaggaaggtgctattatttttcttattttacagaagagtag

SEQ ID NO: 48416 - DNA, 1050 bp, Homo sapiens
ggcaatgggttgactatgtgtggaacataggcaatccagtgattagcctgttgcctactcccttcctcaattttaactgtgaatggacatgttacagccggcctggaatgagaatgattaccaggggctcacactgctcaggaatgagagtttggattgcttaatcagataagctatcaagacctgcagaggtgatagctgagggtgagagggatttaaatagatcctggggcctgggtgcagtagctcacccctctaatcccagcactttgtcaggccaaggtggatggatcatttgaggtcaggagtttgagaccagtctggccagtatagtgaaaccccatctctactaaaaacacaaaaattagccaggtgtgatggcacacacctgtagtccaaactattcaggaggctgagggaggagcatcgcttgaacccaggaggcagaggctgcagtgagccgtgatcgtgccactgcactccagcctgggtgacagagcaagactctgtctcaatcaatcaatcaatcaatcaatcaatcaatcaatcgtgccactgcactccagcctgggtgacagagcaagactctgtctcaataaataaataactaaataaataagtaagtaagtaagtaagtcaatcctgtaagtaagtaaattgatcctgggggatagaggtgagggcttgcaaccctgagaacagttgcagtgattgaggatgaactctgtcccactgtttttcttccaagtttccccttaggagaggcccacaggagcatatctcattgtgccttggcatctgctttttgaagaatctgaacgacccacctggagtgagtcagagtcaggcagcaacttgatatttcttcttttcagcatcatctcttaggctctttacctctccaaagtcaaagatgtcatcttgactacagaaggcacttcctgaattttaagtgctctttaagccctgaaagcaagttttgttattaaattgcctcaaactgaaagtattttctcttactagcctgtaatatttgaggtaaggttagaa

SEQ ID NO: 48417 - DNA, 2878 bp, Homo sapiens
tggctttctaaaaaagataaaaaattttaaatcttttaaatttatttctagcatatagttgtagaataagaagacacagtctttgtaatcataaccttttaaaaattttgagactcgttttatggccttggatatgatcaacttttgttactctttcttatgtgtttgaaaagaattctatattcgttagtcacagttgtctatttgcctattaggacaagattgttaattgtgttgagaagttaagttctcttttatccttatggatttttattcttattctattaatcactgtgaaaagtattttaaaaatttctcacaatgaaaaaatttctcacttgtgattatgattatgagtgtgtttctatttgcaggtctgttagttttttgttatatattttttgagggttattatttattgtatatacatgtagattgagttttcttcctttttgagttggactttttatcattatgaagttactatctttacctctaagattctaagacaaaaagtactttaaaaaatattaatatacttatattaacttttaacttttcagtatccttcgatgtgtattttttaaacagcgtatagttggattttaaaaataccaaatctgagttttgtcatttaactggagcatttagatcatttacatataattacttctatatttggatttatatttatgaaatcttattttaatagttttatctctttatgtttatctctttttcttgccttcatttggattatctttctcttactccaccttttccctattactagtttgaaaactgtatatacagtcttttttttattttaatcaacttttttgaggtatagtttacataaactgtatccatttaaagtattagtttgattattgacaaatacgcaaaaattctagttactctagattttccaacatatttatcaaagtctaaagtaaatcaggacctttctttcctctttccctcagccataaatggaaacttcgagtattctaactaccatgacttcccaaatcaacatatatatatacacactttttttttactaaacataaaaagcaaagcagtaacgtcaagtgggttttctaaaaactagagttaagatatataaaaaacctatttgacattactgctttgcttttttatgtttagtgtagacttacccacatttttaccactttaaaatttttcattaccttttgtgtctcagaccttctgttgggatcacgtcgtttagtggcgtgtacttgcatgtgcacttgtgcacatgctgtcttgctctccctccccgaaagtgtctttattttgtaaacattcttaaaattagtctctttctctggttacttttaaaaaatcaactttattgagttaaaatttgcatacagtaagtttcacttaagttcagtgagttttgacacatttatacacctatgtgactaccacccattgagacagaaatatttcttgtcattccagaaagtctccttgggccccttgtagtctcttcatctcctgcgcagatgactgctgatctgctctctgtcactgtgactagtcttgactgttttagaacttcttataaattgaatcatacagcatttactttttagggtcaggcttttgctgagcatatgtttttgaggtttacccatgttgctgcatataacagtggttctttccttattgcttgatagtattttattttgtaaatacaccacaatttctttgtggatgcgtgttggaatgtctgaagttttagacttcattggactttaatatgagtaaagttgataacattttgtgcacaaaattttttggggtggccaggcatggtggctcatgcctgtaatcccagcactttcagaggctgaagcgggtggatcacctgaggtcaggagttcaagaccagtcaggccaacatggtgaaaccccttttctactaaaaatacaaaaaattagctgggcatggtgatgggcacctgtaatcccagctgtttgggaggctgaggcaggagaatcgcttaatcccgggagctggaggttgcagtgagctgagatcatgccattgcactccagcctgggcaacaagagcgaaactctgtctaaaaaaaaaaaaaaaaaaactttttggggagatatgctttcatttctcttgggtaaatacctatcagtgaacttgctgggtggtatgtatggtaagtgtatgtttttattttataagagactatttttggtggcttttaacatatactttttttgctttaatgctacagttcctagtaatgttgactaagtgtggattttcttttttaaaatcctgtttgggatttattgtatttggattctgtgagttgttttctcataagatttggaaaaactctgcgttctcttcttcagttactgcgttttgtttttgccctccctcttttgcaattctaattgaacgtagacctttttactccctttcatgtcttttaacctcttttttctgttttccttttctttgcctctctgtgctgccttcagattatttcattagaactatctgtcagtttcctaattctctttttggctttgtctcatctgtcattagaaatatctactaggggccaggtgcggtggctcaagcctgtaatcccagcactttgggaggccaagaggggggatcacaaagtcaggagatcgagaccatggccaatatgatgaaaccccgtctctactaaaaatacaaaaagtagctgggtgtggtggtgcgtgcctgtaatcctagctactcgggaagctaaggcagagagaattgcttgaaccagggagttggagcttgcagtgagctgagattgcgccactgcactccagcctg

SEQ ID NO: 48418 - DNA, 1100 bp, Homo sapiens
ttaccttagttttttcttttctagatcaatcatatgtacttgtttttactattcctagtatagacattgatggatattttatatatgagaaagagttaggtcacttggtttatgccacttaacatttctgagccttaatttctcatttgttttgacaggtcagatgtgaaaatgtatatggaaacttttacagtgtatcatagtaccatctaaatgtcaaatgtcactaataatactgttgttatatgacggtttcatatcccatgtcccttaacccttctccagattagataccaggacagcaagtcagactcttaaaactttatattgtgggccaggcgcagtggctcatgcctgtaatcccagcactttgggaggccaaggcgggcggatcacgaggtcagaagatcgagaccatcctggctaacatggtgaaacctcgtctctactaaaaatacaaaaaattagccgggcgtggtgtcgggcacctgtagtcccagctactcgggaggctgaggcaggagaatggtatgaacccaggaggcggagcttgcagtgagccgagatagctctacttcactccagcctgggtgacagagcgagattccatctcaaaaccaaaaacaaagaaacaaaaaaacctttatattgtgatattcaggctatccttttataaggtgaatagccaacttatgagaggtattattgcatgataactgatacagttctgaggaaggtttggtcaaatgcgtgtttttttttttgttttttaatttcttacaccttttaaattttcttgcttaatccttttcccccttttcccttaaattatcttttttattttatgccctaggcttgccaagtgtccccccaagtcactccaaagatggtactgatttctgcttagtgaaaatatttaaggaaaagttcttctgaatttgccacatggggttcttacttacagatagataattctgaatagtaaagctattttgtaattattctgtgttaaaatattggtttttgagatatttgtttctagaaaattattaatgtatgacactttttgaactaaagtaaaattggttcagttattcatc

SEQ ID NO: 48419 - DNA, 1049 bp, Homo sapiens
ttcacataagaaatcttttccgtagctctagtgagtgtcttctgcctgtctaatgtcagaacatagttctgaaagggaattaataagtttatctcagtgttatgttttaggtttgtactagcacatttagaaactgtaataattcaggcagctaaaatcagtggaggcttactactgcattatcttagtgtccatactgtgaacctggtgggtattttataggtgtatttgagattaagaagagattagtatttccttgtaattaaacaacctcagatgggtattgcacattatcttgcaccccttataattaacccaccagagcagcattgggtgacttgatatgttgctctgatatgattcccttgccactatcttagtaaaatgtgccctatggttaataattttaaatactaatacttttaaaaataataaaattaggtcaaacatggatttatttgttaattctactccaataaaattgagtatttacaaaaacctttagtgtagttcttattgcaataaaaatctaatgactagaaagccagaaagcactattttctaatcatgtaatgctccttaaatttcatttactaaaaaagttacggaagtattttttaatgagcattgttatagtatgaatatttatataattgtggagtaattagagcaattaattttagtggaaacacaaagtttgcaatagaagctacaattcaatagggtttatttcagtgggaacataaagtttgtaatagaaattataaaaatgatagcagatcttctaaaaatcacattcacaactagcaagtagaaagcttatacatttcatttggtgtaacaaaaatcagtatattcataaattgtaaaatacctgaagcttttgttagtaaacaaaagcctttaaaaagatgttcctctaattttagtaaagagattttgatatttataaatcgtgaaacattacacaggcagattttggaagaggttgtaattttctctctggaacttcatatttattttgttagaaaaaatataaatatgtgctt

SEQ ID NO: 48420 - DNA, 1032 bp, Homo sapiens
aagcaaaaacaaaaaacactatttcttcatgtggttagcttagatggactttaaggtgacttgagttgacatttactaaacaatttgtatatgtttttgcctatgtatcactaagtatacacatttttggttgtcaaaccttaaaataattttgcatctctttctccccctctcagctgtgaattcagtatccttagggaaaaatggagttgtggaactgatgtttaaaatcattggaccatttagtaagaagaattccagtcttataaagtgagtaaatgttttgaatgtaaacataggtatagcctttgttactctgggcctcattatcttgatatgtacaatgagcaggttgaattaaattgtctccagggttatttcatttcttagttcttaaataatgattttatcatgataaagattttctttagtataaaatttaatcttcacaaatatctcaaaattggacagttttgacttcattgaatataatgtttatagtaacttagactgaacatttctagatactgtaaaaggaaaaaagattatctatagagtattcattcagaaacatttattgagtgcctactatatttctcacccaattttacaatcttgtaatgactttttcattcttatgaatacctgaacaatcttaaattgatacatttctattttgtcaaaatcacatcattctttttcccccatcctgagatgtgtgtgtgtgtgtgtgtgtgtgtatgtatacacacacacacacacacacacacacacacacacacacacatgtatgtatgtatgtatttttattcattcctaggcctttcagcctcagaaaatgaaagccatgtctcatttattggttacagtttaatattttcttaagccattttagaggtctttctttaaaatttttttttattgtggaatttttaaaacatacataaaatagagtttatattaaactgattatattgagttatattaattacttgttgtgtttaacaattctgaacattccaccatttttgt

SEQ ID NO: 48421 - DNA, 1050 bp, Homo sapiens
taatgattacaattttacttatatatgattaccaccctcccatttacaaatagtacctaattccagtgctacttgatatagatttttggcaaaaagatatcaagtagcatagaatattggttattatggggtcctcactttgaaattcaggctctactatttagtggttgggtaccttagggaggttattgaatttctaagatgtataatagctgtaccatctctgaagtagaggtaacgaatatcacacggttgtcatgagatttacatgagaagcatgtaaaaagaatatttaaaatgttctataaatgtcagctgtaattagactttttttatattttgtgatggtaatagtactaaattgatatcaaaaccccgatagagtacacaaatagtattgactttgtactcaggaacataatgtgaaaaggctcaaataaaactttagggaattaagtctgtacgtggaaatatgaatatcattgttaaagaacacatttcaggaacgcaagataccaggaaatatatcactataacattatctgaacaggtcaaataaaatccatgtgattaccttaatagatagtaaaaaggactttgatgagactaaaaactgtgcatgatttaaaacacacacacacacacacacacacacacaccctcttttttttttggataagagaaaaccagcactactttaatatttaacagtgcacataaaaggtatttctgttagaattaaggtctaataattataatctttatttaatttttaaaaatttcattattctggaggcttaggtcattcagataagatgtttggcaggcatttagtgtttcaagatctcagtgtctattaacccttcttcttggtcatagacccttatatttattttgataacttcctcccatgtagcccatgcatttggaggatagttgataccaccccattgtttcttgcataatttaaaatacctgtaccttttaattaagaaagccactgtattggattccaggctctggaaatattgtacttatcaactaaggcaa

SEQ ID NO: 48422 - DNA, 1079 bp, Homo sapiens
tatggagagaagtgaatggatttgagatgttttgagatagaacttgtattgggttgcagtgtggaaaagggagtctagatatttatgttgaaccttcaactgaattcatgtgaatttgtaaaggttaagattggaagaggactaggttgagaggaggaacagaagttttatattgggctggttaggttggtgaagctatcagaggttgaggctgctattgaacataggagccaagctgcatacagataataattacagctgtgggattagatgggatcactcaaggcaaaagtgtagtgagtgaagagaagtgggctgggacagagctgttgggggagatgtcagtgtcttagaagtgtgtcagaggggatctcaaagaaggggcaagaggaggaaaatcaggcgagtatagagtcattgaatcccaaagaagaaagtgtgttaagaaaagaggagataactggtttgtatggtgcagagatgtgaatatgttggggttagaagtgaccacaggatgcttttgggagatctcagagttcagaaggcaacctggtggtttgaaaagtgaacagtctgtggggaaatggagagagcagtacatatttctctttggaggaatatcagagaaacagctggtaggagctcctagatcatacttgtgtgcctacaagtcgattaattgaaggggaaagatagatgagggatcagagaaagtataattgaaagagaaagcaagtactttgagaatgaaaggggctgggagcaagtgtacgagtggattgttctttgaatctcaatgtaccagccaaatagagcccgttaaaagtgagaacatgtaactcttctgctcaaaaatttcccatctcactcattgtaaaagccaaagtccttaaaatggcctacaagcctctaagcaatctgctatttttctctgttctctcccatgcctacccccaactctgaccttgttcctcactgtctcctccagccacactggccacctcattgttcatagaacatggcaggtttgctcctgcgcagggatctaggagcttgtgcctccgtttttctggacagct

SEQ ID NO: 48423 - DNA, 1089 bp, Homo sapiens
atgccctaaatcttatcattagaaaaactctaatttcaaaatactaatttattcttttcattctccaactataatctgttatctttctagctcacttgctcaaatatctgttctctaagagttctacctcacccagagctctaatctgttaacttttgttttctctcattcatctcttcctcctcctcttctatacaacagtatagaatctgttgtccattattacacgttcttgctgatatctgagatgtctttaccttgctttaaatttttccatcacatccaagagacaaagtccttaccctggataacctttattgagcagctgaatgacattggaggatgaactcatttagtaggtatcactaaaaaaatggtgacagtggatatccttatcttgttttctggttgtaggagaaaagcattcttttacctttaaacattttgttaactgtgggtttcttaaatgctttttatcaggttgaaaaaattctcttatattctagtatgctgagaattttttatccagtatgaatgtctgattttgtgaaatactttttctgtctgttgagatggttgcaaagtttttctcttttagtttattaataggtgaattatattgaatgatgttcaaatattaaaccaactttgcattcctgtgattgatcttacttggtcatgatatattgttattatccttttcatatatttttggatttgatttgctaaagggttgtttagaacttctgcatctatgttcatgaagcatattgtaatatttttatctggttttggtattaggtactagccacatagaattttggaatcaggaagtatttcctccttttcagttttttggaagagtttgtatataattggtattatttctttgtatgtttggtaatattcatcagttaaggcaccttgtcttggaattttctttgtggcaagttcttaaagtataaattcttggccgggcatggtggctcacgcctgtaatcccagcactttgggaggccgaggctggcagatcacctgaggtcaggagttcaagaccagcctggccaacatggtgaaaccccgtctcta

SEQ ID NO: 48424 - DNA, 1087 bp, Homo sapiens
gaaaaggtgatacttgagcaatggaagtggtggagttagttattgggatatctggcagaagcacattccaggcaaaagaaacagcttatgcaaaggcactaaagtgagagcctggcatgttggaggaaaacatggaggcccagccagtgcatccagagcagagtgactgagaaaagttgtaggtaggatatgaagacagggaggtaaggactgggggtattcctctagggtcttttatgtcattgaaattggcagccgcacagggctttgagcagagtagtgacaaaaatctacttaaggtgttttttccttcttctgtcccccagtgtattaaaaggatcactaagcatgttgtgttgagaatagactgtagggggcatcagaggtagaagggagactagtgacattgtttacttgaccgtggtagatgtggtaaagtgatcagattctggatatattttaaaagtagaattatcaagactttctgatgtattggatgtgggacaggagacaaggatgaagctaaggttttgaattgagcaactggaggcatagaattgtctttaacttagatgggaaagccagagtagagcacacttggaagggaaggtcagatccgttttgcatatgtcgagttggtaatattattagagattcaagtggaaatgttgagtaattacaagactagatgagatcaccaaggaagagactgtagttagaagaggacaagaaaggactaagccctgggcattccgttaaaggaaacttagaagtggtcagtgaggttgggagaaagcaaagtatatagccaaatgaagaaagcatttccaagaagaggatgtggtcagctgtatcaaatgctgctgataggacaaataagatgaggactgagaattgacaattggatttagtaacatggggatcattagttgttgataagaatggtgttggtggagtggggtggggaaagtctcattggaatgtgtttaagagaggattggaagggaggacttgttgacagtgtgcataaacaagtctttgctttcagaaggagagaaatgggacagtagctgaattgggagcgaga

SEQ ID NO: 48425 - DNA, 1044 bp, Homo sapiens
ataattgtcagattcaccaaggctgaaatgaaggaaaaaatattaagggcagccagagagaaaggtcgggttaccctcaaagggaagcccatcagactaacagtggatctctcagcagaaaccctacaagccagaagagagtgggggctaatattcaacattcttaaagaaaagagttttcaacccagaatttcatatctagccaactaagctttataagtgaaggagaaataaaatcctttacagacaagcaaatgctgagagattttgtcaccaccaggcctgccttacaagagctcctgaaggaagcactaaacatggaaaggaacaactggtaccagccactgcaaaaacatgccaaattgtaaagaccatcaatgctatgaagaaactgcatcaattaacaggcaaaataaccagctaacatcataatgacaggattaaattcacacataacaatattaaccttaaatgtaaatgggctaaatgccccaattaaaagacatagactggcaaattggataaagagtcaagacccatttgtgtgctgtattcaggagacccatctcacatgcaaagacacaaatagactaaaaataaagggatggaggaagatctaccaagcaaatggaaagaaaaaaaaaaaaaaaaagcaggggttgcaatcctagtctctgataaaacagactttaaaccaacaaagatcaaaagagaccaagaaggccattacatgatggcaaagggatcaattcaacaagaagagctaactatcctaaatatatatgcacccaatacaggagtacccagattcataaagcaagtccttagagaccaacaaagagacttagactcccacacaataataatgggagactttaacaccccactgtaaatattagatcaatgagacagaaggttaacaaggatatccaggacttgaactcagctctggaccaagtggacctaatagacatctacagaactctctatcccaaatcaacggaatatacattcttttcagcacctcattgcacttattttaaa

SEQ ID NO: 48426 - DNA, 1057 bp, Homo sapiens
agtgactgccccaacttttctaaatctttataccctggaggagctgtgaaataacttttaggtctcttgtctttttgataatagccatcctaacaggtgtgaggtgatgatatttcactgtggtcttgaattccatttctctgataagtgatgtggagcaactttttatatacctgttggctattttaatatattctttggaagagtattcaggtcttttgctgattttttaattgggtcattctttttttttttgctattgagttgtgtttcttatgtatttaagatattaaccccttgtatcttgagataagctatatatctagatgtatggctggcacatactttctccgaacctataggctgtctttcatttgttatttcctttggtgtgcagaactttttagtttgacgtagtagtcccatttgtttttgtttttgttgcccatactttagatcctatgcaaaaaattgccaagaccagtgctgagcaacttgttcactgtgttttcttctaagagttttatggtttaggtcttacatttaggtctttaattcagttagtgtaatgttttcaaggttcatttatgttgtagcgtatattgaacttcattgctttttatggctgaatagtattccattgtatgtttctaccatgtattgttcattcatctattggtgggcacttgggtggttttcatcttctgactgttgtgagtaatgctgcttcattctttggcatgtggatatcaagttgttccagcaccatttgttgaagagactattttttccaactgaatggacttgacatgcatgtcaaaaatcgattggccatagatatatgagtttatttctggactttcattccattggtctgtatgtctgtctttatgctactactagctgattttaattaatgttatttatttaggttggtgtgaaagtaatcacagtttttgccattacttttaattaaaagtacaattaacattaaaagtgatggcaataactgtgattacttttgcacctaatataccatgaaaattattgacaatat

SEQ ID NO: 48427 - DNA, 1047 bp, Homo sapiens
aacggttctctgtcctcatggttcttgggtgatgcctcaaggcgctctgtaaccacctttcggtgcccgctaccacagcacagctccagaactactgccctcctgagctatctggctctgtcaataggtcactggcctcctgctgtcttgttccctcaccgatatcttgcttgcacactccacgtggctacttcttgatcaaagattctctgatacacagaacagcaaagaaatgaaagcaaagaaaggaaccaaaaagcttatgtcattgatactgggactcagtctctaccttatagtttctgaaaagaggaacaagaactaaaatataatgaccaactcacgagtagctctccatctatttatctgtagaaattaaagtacactctgttcttaagtttaaaaataatccacagcacctttcttttttttctttgtttttttactactacggcctttctgctgctcttccattatcctttcctctgccatttgagagccatcggcacgactcaatgttgacatcaaccatgcgtaaaggaattcagagagataccttaaaggatacaaaatgttagttaatggtagatgtctaaatgagacagctttatcaacacatatattaacgatagatatttcaaataatgctttaggtctttaaaaacagatcattcattagataatagattagatcttacaagaaatgaacataaggattaattttccctttctacattttacaactttccagaagatttcttgataattatacatgtacatatgcaaatcaaatgaatgcccattaagtttttattatatcagaacacagttcagttcagtctataaatattttcttttaatcacaaagcaaataaaatcagaaaaagataaaaaattatcggcattatataaaatcattcttaaaaattaagaacattcacatttacaatttacttgagtttatttaataaatgaaatataaaacagaacattctctaccagacactaatttttcagaactttaacactgctaagccagaaaagtct

SEQ ID NO: 48428 - DNA, 1032 bp, Homo sapiens
aacaaggaaaacacccacctctcctgaacttttccaaacagggtgcactttatttaaggcagtatactgtcttagagtcttgtgcaaacaaaacggtgaaacaggcacacttgtcaaagagtggcctcgtatgattttgaggtattcttccctgcagcctgtcccaccacctcagtggcctccccattccctggccctcccaagtctattccttgggacctatctcagtcccttactctaggagctccctgagcaatggcaacccccagaaaattacagtgactatagttactgagtcctcagttcatctccaccccagatggcacctcccagtttgagaccaaactacctgccatcttcaccaggatgtcccaaagatatctcaatgtctaaagcaatctttatcccaaacctggtctcctaccttgcctagatatctacacaagtggcaccaccatcgtctagttgccaaagccaaaaaaatttctgaaaaatcatccttgattttggcagaaactctcattcaccatgtcccattagctgtacctctgaaaacatttgatttcatccactttcttccacctgctctgccactacctttgttaagaccaacattttctctcacgtgactggcttccctgcctcccttttcaaccattctcaggcaagcagatttgacttgatcccatcatgtccctgcatacaagccttcagtagaatctaccaatatcagaataaagtccaaaatctttaacctgtggcctcccagggttttgggtatcggcttctccttgcctctcatctccgccatccttttcctgctctatacttcggccaggctgctaccctctcccctccaagcctgtgcacattctgtctgggacccttttcccagcagtgcctcctgaatagatgcgatggggatttgtcacctaaagtttcacgtggggcagttctcctacccagcatacagcatattcttcactgcattttcaatacctgttgcttttctgtatttgtcgtaagatgata

SEQ ID NO: 48429 - DNA, 1426 bp, Homo sapiens
agggtttttataggcacagaatgggtggcatggcaggccagagtggtcttggaaaatgcaacatttgggcaagaagacaggagtccttgttctcattaggtccatgggcacaagcctgagggtggagcccttgccagtgaccctgcccttctctacccagcacttccctgtccccctcccatatcaccgttgccatcttgtccttgatgaggaatacaactcccaattacagtgttgctgtgggagatgcagtcctctttatgacagtttctagaagttgataagaaaatgggacctgcctagggctagtatctcatttaatactctatagaatattatgtgtttttcctttttagtttttaatgttgaagatcagaaaagagacaccataaatttacttgatcagcgtgaaaagcggaatcatacactctgaattgaactggaatcacatatttcacaacagggccgaagagatgactataaaatgttcatgagggactgaatactgaaaactgtgaaatgtactaaataaaatgtacatctgaagatgattattgtgaaattttagtatgcactttgtgtaggaaaaaatggaatggtcttttaaacagcttttggggggtactttggaagtgtctaataaggtgtcacaatttttggtagtaggtatttcgtgagaagttcaacaccaaaactggaacatagttctccttcaagtgttggcgacagcggggcttcctgattctggaatataactttgtgtaaattaacagccacctatagaagagtccatctgctgtgaaggagagacagagaactctgggttccgtcgtcctgtccacgtgctgtaccaagtgctggtgccagcctgttacctgttctcactgaaaagtctggctaatgctcttgtgtagtcacttctgattctgacaatcaatcaatcaatggcctagagcactgactgttaacacaaacgtcactagcaaagtagcaacagctttaagtctaaatacaaagctgttctgtgtgagaattttttaaaaggctacttgtataataacccttgtcatttttaatgtacaaaacgctattaagtggcttagaatttgaacatttgtggtctttatttactttgcttcgtgtgtgggcaaagcaacatcttccctaaatatatattaccaagaaaagcaagaagcagattaggtttttgacaaaacaaacaggccaaaagggggctgacctggagcagagcatggtgagaggcaaggcatgagagggcaagtttgttgtggacagatctgtgcctactttattactggagtaaaagaaaacaaagttcattgatgtcgaaggatatatacagtgttagaaattaggactgtttagaaaaacaggaatacaatggttgtttttatcatagtgtaca

SEQ ID NO: 48430 - DNA, 1574 bp, Homo sapiens
acctttcttttatcttgagttgattatctctttaaaaaattgagatttgggttgttagtttctccatgttctgcctagaatgcacccttgtatttagggccatgctgtctgtagattccgagtccaagtggagtacacataatgcatgtgcttgtcctggaagccagcccttgcgtccctaccatttccagagaggcagcagacagatctgattgtgagcaagtatggctaacccccagcacttgtgctctgatagtcctgtgacatcaagacagaaatgatgtagcttatgttttatgtgctaattttacagggagaaaccagcagaaactgagaggagaagatgactacaacatggatgaaaatgaagcagaatctgagacagacaagcaagcagccctggcagggaatgacagaaacatagatggtaagaatggggcctacatcggtgacgaggtcacctttcatttctctttcctggtccttcaccgtgattatccaatgaatccccaaaattatattgtaattaatgggtcatttcaaggagatcgtctgttctttaggagcttttaaaccaggggcagtggagggaagtgagggttgagaagcccaaggtgatgaaaaccattcggaaagtctgcatcgtttctagaaacatattcagtgtggctcaactctttaagtaggatgatttttcagtgacatttagggatttcccaacaaaatggctaggtcactacttgatcagtctgcctcccagatgagaagccccagtatgtgcatagagcttccaagcagctatgaaagctgccctttgtattattattttgaatttttgaagagtccaggccagtatcttgtagaatgtatcaaactctggccttgtctgtttgcttgtggtggattcaggctgatgaattcttgcttctccccaggaggcataacagcaggtggtcctacaggtgattggttgatcccttagctaacatggtgcccacaaggtctcagaaggccattttccttttgatattaatacgtcatctagaagaggatgctttgaacttgtgtagctttaccatccattgatgaacattgcccaagtggtgacattttacatgctgccatcacagcacatttattacctgacattttttaaggaactcctctccctcctccaacacacttgtttgttttggtatcactatggactcatagtattctttcttaaaattcatttttctgggccaagtgtggtggctcacacctgtaatcccagcgctttgggagaccaaggcaggcagatcagcgggtcaagagattgagaccatcctggctaacacggtgaaaccccgtctctactaaaaagagaaaaaattagccaggcgtggtggtgggcgcctgtagtcccagctactcgggaggctgaggcaagagaatcgcttgaacccgggaggcagaggttgcagtgagctgagatcgcaccgctgcactccagcctgggcaacaagagtgaaaatccatctcaacaacaacaacaaaagaatccaagccatgtgactgtagtttcccacagc

SEQ ID NO: 48431 - DNA, 1051 bp, Homo sapiens
tgccacttacatgtaagaaaaagccaacctaagtcctcaggaagaaacactgtcacaatctgcatgacctttgtctcagaattgaggatggaggtagtttgttcctggctctcaagttggaacatggaaagccccagttgatctgcaaggctgtgagataaaggctcttcgtacttgattttagcagggctgggagcaggtgcaatcagtacttcccttttgcaggtttaaaggttcagggatagcaaacgacctgctcatttagttctacagtatacagacagctttttgttcgctatgtttcagctcctgtgcactaatctaccacctgtggcttgtatatttgtgagaattgtatttaaatgaaattttcacctgatctgtcagctgttcaaggtcaggaactcggcactgcattatttccatagcacctggttcccttctctgtgtgtggtacattgtgacccagtggtgctttgaactcaagggtatattccaagagtcagaggttgatgtagtactcactcacatttggctctgaaatgcctgcaactcagaaaaggtgagctgtgtggtggagagggcacaacagtaaggagccctggagtctggcttcagtttccacctccctctgaccctggtccatgccagacaaccatgtcaccccttagtattcttatttgcaaaacgagtgggtaattctcttaattacttcatagctctggcacttgtcaaaatactcttaaaataaatccaggcagcaagctgaagcaatgcaatagcaattcaaccgagtgtcctccagttcaagttttgttttgttttttttgagacggagtctcgctctgtcgcccaggctggagtgcagtggcgcgatctcggctcactgcaagctccgcctcccgggttcacgccattctcctgcctcagcctcccgagtagctgggactacaggagcccgccaccatgcccagccaattttttgtgtttttaatagagacagggtttcaccgtgttagccaggatgctctccatctcctgacctcgtgat

SEQ ID NO: 48432 - DNA, 1029 bp, Homo sapiens
atggaaggctcccggcacctgagagtggccggcgtggggctgccgggggctgccaggtctgctcgtcacactggccccaccagactgcattctcctgtggccagatgcaattctcagagggttctggtgtcttctctctgggccagctttgcttgtgcacctgcgaatgtaatgattgtcttctgggggaaccaaagcgatcttgtgcagataaaagtggtgtctttgatttttatcacctttaatcgctgtgattgatgaatccagagttctagagcagcttttctgtttttattctcaccgattttccgggtccagttctgtcagtccgttcagtatttgttctgttctgccctggcctgtgcccagtggtggggaggctgtgttcattgcacatttaccattgagtgctggacaaagatgaggaagtgagtgtagtggggtcagtgtagacagagaaaccacccagatattttaagcaggaaggatttgatacagggaaatagatactgtaagctgtgggaagggcctgcattgaggtggggtggctctcaggcactatctcaggacctgcccctgtgcccagcgtagagcgtgagaccagcggggttctgctgcagtgcaggcccagagtcaggggcaccccactttctctgttctgcacctcccacaccctcactctgttccacattctagcctccagtaagtgcatctgattggaggcagaatcccactggaaatgattctggaaggtgcattttagcttccgagcctttgtggttcaggaaagcacagcaaaaggcgtgtggaaccgacgtggaggagccgatctgctgcatcccccaccaggcaggcggctcaagggccatgggagtcagcagcgctgtcccccacagtgtctaacctggaagggtgcctagggaactgcgagtggctgggcccgagcagagtgtgatgttggggtgcaggagtttggacttgagtttgaaggagtttggacttgagttcaagaccggggaagccgtcata

SEQ ID NO: 48433 - DNA, 1052 bp, Homo sapiens
ttacaggcatgagctaccatgcctgaccaccattgttgcattttatattaaaaaaaataggtgctttgggaggctaaggcgggaggattgcttgaggccaggagttcaagaccagcctgggcaacatactgagaccctgtctctacagaaaattaaaaagtaactgggaatggttgttgcatgcctgtagtcctagctactcaggaagctgaggtgggtggatcaccttgagcccaggagtttgaggttcaatgaactataattgcaccactgtgctccagcctaggtgacagagcgagaccctgtttctaaatatacgtgtgtgtgtgtgtgtgtgtgtgtgtgtacatgtatatatgtgtgtaaatgtttgtactgaatcacaagataaaatttatcattgtgggtcatggtcaaaagagtctggaaagatatagagatacacctggacgttaagtagctggatggttgtacatcctctcatttttattagctgttgccacagaacgttcctgctgttatatttcactttgtacaacttcctggcctgcagatcagatcctttggccctacatttctgtgtgtaatatttcactcttttcttatttcttgcaatctaagttttgcgcctgatcaattagcttatctcatgggtttgagactgttacttagtaaaagttcgagttcgtggtaaatgaatgaatgggaatctcagtccatgtaccagtacttactggatgtctaggatgtgcctggggccctgtgtccttagcagcttgaatgctgttttggaggaagatgagattccctcacatatctagagaataatcaggttttttttgttttttttttttgaggtggagtctcgctctgtcgcccaggctggagtgcagtggcatgatctcagctcactgcaacctccgcctcctgggttcaagcagttatttgcctcagcctcccaagtagctaggattacagtcacgtgccaccacacccggctaatttttgtgtttctagtagagacagggtttcaccatcctggccaggctggt

SEQ ID NO: 48434 - DNA, 1043 bp, Homo sapiens
actccagcagacctgcagcagaggggcctgacagtgagaagggaaactaacagaaaggaatagcatcaacaaaaaggacatccacacagaaaccccatctgaagttcaccaatatcaaagaccaaaggtagatacatccacaaagatgaggaaaaacctgcacaaaaaggctgaaaattccaaaaaccagaatgcctcttctcctccaaaggatcacacctcctcgccagcaagggaacaaaactggacagagaatgagtttgatgaactgacagaagtaggcttcagaaggtgggtaataaactcctccgagctaaaggagcatgttctaacccaatgcaaggaagctaagaaccttgaaaaaagtttagaggaattgctaactagaataaccagtttagagaagaacataaatgacctgatggagctgaaaaacacagcacgagaacttcgtgaagcatatgcaagtatcaatagccaaatcggtcaagcggaagaaaggatatcagaggtcgaagatcaacttaatgaaataaagcgtgaagacaagattagagaaaaaaagaatgaaaaggaatgaacaaagcctccaacaaatatggaactatgtgaaaagaccaaacctatgtttgattggtgtacctgaaagtgagggggggaatggaaccaagttggaaacactcttcaggatattatccaggagaacttccccaacctagcaagacaggccaacattcaaattcaggaaatacagagaacaccacagatactcctcgagaagagcaacctgaagacacataattgtcagattcaccaaggttgaaatgaaggaaaaaatgttaagggcagccagagaaaaaagtcaggttacccacaaagggaagcccatcagactaacagcagatctctctgcagaacccctacaagccagaagagaatgggggctaatattcaacattcttaaaagaactttcaacccggaatttcatatctagccaaactaagcttcataagtgaaggataagtaaaatcctttacagaca

SEQ ID NO: 48435 - DNA, 1050 bp, Homo sapiens
aagtactattccagttgctttacatgtattcgtctaatcttcacaataacttcaagggggcaggtattattgtcctcattttacagataaagaaaatgaggcaccaaatacatgattggtggggtatattttagttttttgaaaatgctatttatatagttttataccttgttttttcatattattatccttctgtgtatacctaatattctattatgtgcatagttcctcatatacttggtcatatcgtaagttttggattttaagttctttgcattgttaattataaggtttttatgaatatttatttagcagaatttctacccacctcctcctgatcttcttccttctaataatttggcaaccaaaaattgatagttttaatttgcatttcattgattacccctgatatagaattttttcatatacttatgccatttttttttctattttatatattaccttttcattacctagttatctattggtgttcattcttttctctggtgacttacaagttcattaagtatggtagtgtgcttaggaaactcttaccctaccccaggattacctacaggattactcactctttcttacgctctgactttcttatagttacatttaattctgtattcacttggaaatgggtagagaagaaggatatggtgtgaggagggaaactacctcctttcttcccctccaaaattacttatttgacataatacagttattgaataattcatactttcccccattggtttgaaatgcaaacttcattatgtattactttgttacatataatcacttaagaatttctcaggtctcttcagttttttcgttgatctatttgttcagactccagaacaaaatttagtaactattctgtggtattggttttaatcagtaatcctcatttgtgtcctccacctgtaaatataataaatttccctttttccttttatatcaataagttattgctacaatgattaccatccacagcttcgtatctgcagagtaatgatctaagatatttatttctggccagataat

SEQ ID NO: 48436 - DNA, 1034 bp, Homo sapiens
tgaagttattttcaggttattcatgtcaaaaaaaaaaaaaaagattttatttaactgtacttaagagaattgcagcatctaaaatgaactttgaaaactagttttaagaaatttgtattggattttgtgcactgttgaattgattttccaagttatgtctgtcttctgcctgtttttaactttagacctttggcatgatggggagggggcacaactatttggagtgtattactatgaaaatttaaggtcaggtatgttcaatgcctgacacaactgctgtcaatccttgatggcaacaaaccccaccccacatcatcccccaacccccactggccattgctgtttaggtaaatggttggaatagcttcatcattctcaattcttgctgtgcatcagaattatctgtgaagccatggacaactatttttacaaagctcgacaagtgattctgatccacagctagggttggaatcattatttatatttgtcaccttataaatcttaaaactgtttgttctactgaaagatcatacatatagtatttgtaacgcatatactttcataagaataagggaaaataatctcattttattatacatgtatttcctgaaaagtcagttgtaattctgatgatttttactgtaaaatttcatgtaaaaatgaatgtactttgttgtggaaaactgctaaaacccaaagaaatcacttgaattttagcaaaccttaaacaaacaagaaaaccaacccctgatgagaaaggatactattttggcatcatagtaaaacactgaaaataaatgctatactatagatagtactcatatacacacacatcttcctctgaagagtgaagtgtctgctacctatgtcagtgatattgtaattatttttcaaaagtttattgggattttgttacagcaaacgctttttgttcataatataatgagaaattcatattaaatatgtcaaaagattatttttattattgttttactaaaacctccttatagtaaattacaccaatgggtgcattc

SEQ ID NO: 48437 - DNA, 1049 bp, Homo sapiens
cgcatggcgacgccagcagccaccaggcgctgcatgctgcccgggacgacgacttcccctccctgcaagccatctccaggatcatcacgtagctcctgccagcgtggccagagctattgcaccatgagcgtccttcctccttcctctccgggctgccaggcagccaggtcaggcccggtgaggccacctggcctcttggttggccaggcccaccaggaagtcaccaggacggtccacctgccctgttggcacactcaggcgggagtccacccctgcctcagtggtgggccagtctcggtttgcattcttgtgcttttgggaggcgccaggggagggaagggctgggatgctgggacctgttgttgctggcaaagccaaaggtcacagtggcctgatctgggccctcccgaagctgagggctgcagcccctgcggcctcagagctgaaagctgcggcgccactggtgccagagtcaagatgtcacatatgtgtgttgtgtaaacagttggctgtttcgtgcttcaagaatgttcaggattaaaagcagacaagaaattgtgctacttgaagttgaatctttttatgagacaagctgaatctgggatctcgaattgcctctgaccttttataagacattttatcttcaaataaatttattttgcaataccacacacacacacacacacacacacacacacacacacacacacacacgctcttcttctaatatcaggacacagcaaaaatgaccaccctttcattcttattcaacaatgtattagagatcctagccattctagccaataaaaataagatatagaaagtgatcttatttaaatggaagaagtaaaattctttaatttgaagattacatgttttatttttatgcagaaaattctatagattcaacaacaaactaccaaaactaataactgagtttaggaagatcacaagacataaggtcacaaaaatcaattgcatttgtattcattagccaaaaaactgaatttaaaaatgtttaagtacaatttataaggtaccaataacat

SEQ ID NO: 48438 - DNA, 1034 bp, Homo sapiens
tgtggtgagacccctgtgggtggtcaaagggtaacatggctcatggatttctgctaggctctgaggtctctgagctgtttggtggtcttttccctggtgggagtttaggcttccttaagggtgtcttccctggttggggtattctgagcactttggggttggggttcctcactatgatgttttcgagctgggtaggggccaggtgggatgagaatggtggtcccaggtgggaagctttctgggctagatggggaggtggtctgagccgatatgtgctggagttagatcctaggatatggcatctctgagctggtcagaggcctgtgtccttggacatgaaagctctgagcttgttttgcagcaagaagatagttggcagtgcccatgggtctgagatttggggcaggtttgcaggtctgccccagaagtgtcctagagcaggagtctccgagaagtcttggaacagctggggctttgctctgggttctagggttgagggctttgagggttcagggactgggcctctggacgtgaggctccagggctggcttgtggggccttgccctggagtgcagtgttagagctgctctgtgggtgggtctgtggtccatggtgggagatctctgacctgcttggggctctgtgtccacaggtctgtgggctgcatcatgggggagctgttgaatgggtccccccttttcccgggcaagaacgatattgaacagctttgctatgtgcttcgcatcttgggcaccccaaaccctcaagtctggccggtttgtaggggcccttggtgaggtgggtgtggggcaggtttactccactcccaacagcaagtaaccactccctcccctgaaccttctctctcctggccccaaccccccttgatggacagggaccactgtcctggcccaactcagggcttcctccttcctgctgtcatttgggttggggtagatcctgtcctttgtcccttttcaccccagtacacacatgtgcagtgtctcagcaagctgtgcacagagtcgtcatct

SEQ ID NO: 48439 - DNA, 1053 bp, Homo sapiens
ggatgctgcctcgggtgtcccacgaggaacatgttatcatccaggtttggaagtgtcttagctcaattatttatagcctcaggcaggaattctatcattacaggcatgaaaatgcaccgcaaaatgatgatgaatttggaatactggaggtactaattttgctcagaatgaagaaagagaggaaaatcaatatgaaagtcagtttgtctgtccctgccctggaggtgggggtgtcaggctgcaactgagccctgtgactgtgcccatagctctcagtgtgtggctttcccgggaataatggtttttttttggcttttacttagttgctacttatttttaagttgtggtaaaatatataccacataaagtttaccattgaaaccatttttcacagtggcattaggaacattcacattgttgtgcaaccatcaccaccctccatctccagaacttttcattttgcaaaactgaaactctgtccccattagacaacaactccccacttccccctccccgtcccgatccagcaactcccactctgcgttctgtctctatgaatttgactgctctagcatcctcatctgagtggagtcatacagtatttgtccttttgtgactgacttatttctgttcgcataatatcctcaaggtttatccatcttgtagcacgtgtcagaatttccttcctttaatattccattgtctgcatggaccacattttgtttgtccattcatcagttaaggatatttgggttgtttctaccttttaaccagtgtgaataatgcttccatgaacatggtgtacatgtatgtgtttgagtccctgctatcacttattttgggtatgtactcagaagtggggttgctggatcatatggcgattatatgtttaatgttttgaggaaccgccatgccgttttccacagtggctgcacaattgtatactccaacaagttcctatttctccacattcttgccaacacttgttgtttcctgttttttgtttgtttgtttggttggttttttttgttgttgttgttagtgaccattctg

SEQ ID NO: 48440 - DNA, 1046 bp, Homo sapiens
agcctgttgccactcgtgaaagaagcactcttcttttttggaagtggatattcaacttaaccctggctgagaaagactgctgtaaatgagcagggaagaccccttgattggcactgtgcagaagttcatatgcagatttttttttttttttttttttgaggaactgcattgccacaaagacacttgtcatcgctgctctgttaatttgaaaagaaaaagcaaaacccaggaaattggtattttacagtcacctgggggtgaatatcctttttgtttttttctatttaaaaattcctgctgccttccaagtcaagattcatcaggattcgctgaagatctgattcttaaaaagccttcgtcacattttaacgcatcgctgttagacacttttacaggctcacacagatgggctgagcagggacgagcaaaacctaacagaataatgggtttcagaaagttcatttgacgatttgaaggaactggattggatttacctttggcacaaatgcagattgcgggggatgggaaggtgaaaaatcaaaggttggaaggaaatatctgggaaggtagaaaaaggaaatttgagaattgattggctatagtgtgctgtcagcgggtggatgtcgtttttttcttctttttttccttttttttcttctgctacaggaagtgatttgcagtgctcaccgagcctttgttgagaagggtctcctctcagagtgagtcatgcttttgctgtgagcagccccaagcagctgggcgctccatcagaggcaactatgacttttgcaaagcaaacgtgcaaccccaagcagcggtctcccgggccggggctgcgcggccgccgctgtgctggcttttaacggtgggagggcaccatcctcttgctctgctctcgttctccagaaggctgtcccggggcccccactctccgtcccgctccggggacagtggctcgcctgctatgcgcggcagcccgcgccggggccggcaccagcagcgcccgggcggatgcagcgagcccacggaggggcatgcttccacgc

SEQ ID NO: 48441 - DNA, 1023 bp, Homo sapiens
atctgccatctttccctcaaaattccagtgagttttactgaaatactccatgtgcaaaatgtttataattaacacctgactataaagtaatgagactgagatagcttatgaagtctatgtttttactttataagcatatatgacttaaaaagatttttgtaagtctaccaattgggtgattgggtcaatgatctatttaccatctatttcctcatcttcttcctcatgagcactcaccatctgaggcagcattgtgcagccagtgtgctgaattttgcagactcccttgtgccggaggtggctccatggcacagtgttggcccttgagacataaacctgctgtaggtttctgggaaaatttggctagcctttcttccttgttgcttccttctcctttctgagtggaatgtggaagtgatggctggaacggcagagccatctttcacccttgacttgagaaaaagaccacgataatacatactcttctgctccttgacctactgatataatgctaggactgcgtggctcctgatggctttttgtataaagaaaaaataactcctaattagtttaaaccttggttttgctaggttttctcttacagctccaaatacattcctcaataatatttttgatgaacacaagacaatatggaagtcttccttagagcctgactgggctctagttgcctgccggctgctgctattgtctgttctcctgaagtcagctgctctctagtatctaacatcaatgtaaagaacctaaaatgatgctctatggctttcagagtcttcagtagcctagagaaaccataacggataatgttttccctgggggaaaaaaaagagtgtggcgattaaaatctgcagtggtcccttctgtcctcagggagatgataatgtctgggaatgcaatggcctgacagggacaggtgaactgtgtttctgaagctgatgcaactggctgtgatatggtactccagtgtgtgggaaagacagcacctacaggaggacctttctgttc

SEQ ID NO: 48442 - DNA, 1072 bp, Homo sapiens
atatctttgatggtggaggcacttgccagcaaaatttcggccatgcatgggccacgtggccaggcggttgcctcttctctgtggagccagctgctctttgtctgtgttggtcagtacaagatgaggatggaacagaaaagaggtgttcaacacctggtgcatggctgccgtggtctcccttcctccttcccccattcttctccagatggcctgttatggcaatttggtgccactgactaggtctagaaattacttatgttttcctttaagatttaaaaaggaacacacatgcacacagacacacttgtagacacacacatatgcacatacacctccatacacacatacacatgtacacacatatgcatgtgcacatgcatactcactcacacgtgtgtacacgcacccaatcactcacccatatgctcacacatgcacactcatatacacatatgcacacgcacatgctcacactacggcaatatcaggtctcagccacagagattctgatctaattagttggagtgagtcctgagcattattatttttaaaaactgggacgcgcgcagtggctcacgcctgtaatcccagcactttgggaggcagaggcgggcaaatcacgaggtcaggagttcgagaccagcctgatcaacacagtgaaaccctgtctgtactaaaaatacaaaaattagccaggagtagtggcatgcgcctgtggtcccagctactcgggaggctgaggcaggagaattgcttgaacctgggaggcagatgttgcagggagccgagattgagccactgcactccagctggggtgacagagagagacttcatctcaaaaacaaaacaaaacaaaaaactgaacacacacacacacacacacacacacaatcctcaaaaccgtagacacaaagttgtggtagttactccattatacacagaacgacaacaacatttcacattgctcacagatgcttttcagaatcgattgacagggaaggcttctaccaactccagaacccacaacttttttttttttttttttttttttttgagacggagtctcgctgtc

SEQ ID NO: 48443 - DNA, 1768 bp, Homo sapiens
cccacccgccatctcccagaactcggtcacatggccacaccagggcagctggccacacagggagcctcgcgcccaggaggaggagccagtgggtttggggaagcgcttgctggtcctactggaccacccgacccgcctgtctctgtaggagcctccattcgtggggacgtggcttagttgcctggacaagcggaaatacatcctgcctgccgtggggtcctgtgccttctccttgggcctcagtaggctccaggtgggggtggaaggcccagctccatggccatggcagcaggaagtggctgttcagtggtaaaaagactgtgccgcctgaccccatcaggctctctcacggtgatcagcaaatggagaaacggccagtaccacgccctccccctgtcctacagctggggaggtgcgctgtgcctccaccctcacctcctctcccctgatgacaagcatggggttttgctttttattttggtaaatacacatcagatgaaatttgccgtcttaaccatttttcattgtgcacgtcagtggcattaagaacattcacgttgttttgcagccattaccactgtctgtctgcagggtgcttttcatcttcccaaacagaagctttttacctgtgaaatacaaactcttcattttcccctcctccagccctgggcagccgccattctgctttctgtttctgtctgggtacctcatatgagtggaatcacacagtatttatccatttgtaactggcttatttcacttaacataaagtcctcaaggttcctccctgctgtagcaggggtcagggttttccaaggctacatactcctctgtcgtatgtgaataccgcattttgtgagtcccgcattttgtgtgtgcgttcatcccttgatggacacggttgctcccaccttctggcttctgtgaacagtgctgctgtgaacgtgggtgtgcagatacctcaagtccttgctttccattccttgggcgcacacagcagatgcggtttgctcggccctctctgagcccaccgagtaggctgtgtctgtattttcaccaggactccttgggatgctgagctacagctagcgtggcagagggcaaggaaggcacttagacagctcagttgcctctgatcacgtccaccgtcactccaacctgccctcggggtctgacgcgcacacacagcagcagagacagagatgggagcatgagagctgcctgcaaggggacaatcctcaggcccagggaaggcggagacagggggcgtcgaggggcaggagtgcacaggacaggcttgctctcagcgggcctcactcatgctgccaggtgcctggtcaggctttttttctttgcctttaaaaattttgtcttgaaataattttaaatttacagaagagttttgatgattgcacagaaggatcttgagcgcccccacctagctccacatgtccgatgtctcacatagccagtgtgcatttatctgagccaaggtgctgtcatggtgcagtgcgttacctgaaccccagaccctggaccctcctacctcccgcccaccacattcctggctcagcacctcaggttgcactggacactgcatctcctcggcttctgctctgttcctgcctccctgacctcagcactcctggagaggagtagtctggtgttttgtggtgtgtctggtgtattcttgtgattatcttggggtcgtggttttagggggagcaccaaagagggcgctttctggggatggggcatctgtatgact

SEQ ID NO: 48444 - DNA, 1028 bp, Homo sapiens
gcaatgtgatgatcatcagagagggagaagtagcattttaaataagtccatgtgaacatggaaaatgaagcacattttctactgtgtatccctggattttaatgagtcctgataaatgtaaaatatgccacagtgaaaagcatcatttgctagaaccctaaattaattggaattaaaatattttccaatcttgagtcagagataaatgacaagacaacgtatggcctcattagagacttgatgaggaagcctggtatttgcacacagacgtctggggtgagattcatagtaggggtctacccagctgcctgtaccacagatgctggcaacgaaacctgatagggggtgggggtgctttggggatagtaagaccctcagtcctcaaagacagtcgtttgtatttacttttgtgcagaaagtacggttggaccagaaacattttgcacaacaaaggatttttctggctaaactcaatcagaagcttaaagttctgtcatttaaacttacattctgtagataggttagctgttgaggttagaggatactgtatttggtttaaatttagacctataatttttcctaatttttttttttttttgagacggagtttcactcttgttgcccaggctggagtacagtgatgcgatctcggctcactgcaacctccatctcctgggttcaagcgattctcctgcctcagcctcccgagtagctggattacaggcatgtgccaccacgtctggctaattttgtatttttagtagagatggggtttctccatgttggtcaggctggtcttgaactcctgacctgaggtgatccacccgccttggcctcccaaagtgctggtattacaggcatgagccaccacgccccgtcaatttttcctaatatttttaataaaagttttcacagctgcagaaaagatgtatcacttgtatatcctggcaacctagattgcacaattgggagtgtgtgtgtgcacgtgtctgtgtgcctgtgcatgtctatgtgtccacatgtgtgtc

SEQ ID NO: 48445 - DNA, 1030 bp, Homo sapiens
catgtctgcgtacacatacacagatgcgcacacagatgcatgcacgtatgtgcacatatagctgtgcacacatacatgtatatgcatacacagatacatatgtatggatatatgtacacaggcagacatgcacaggtgcacacatacattatacacacacatacacagatgcccatgcatacacatatgtatacacatgcagagatccaagcagatgcacatgcactcacacaggtgtacatatgtatgcacacagacatacacatgcatgtgcagacatgcagacatacacatgtacacaacacacctgtacagatgtgtacaaatgtacaaacatggataggtgcacatatctatgcgggttcatgtgcacacatacagaaatacagatgcacatgcgtgcacatacacagatgcatacacacagatgtacatgtgtccacatatatatatacatacacgcagacatgtatgcacagtggttgctgggtactcccattttctctgctgtgatctcctgccttgatttgaagacccctgggggtgggagagctgccttctgacaagtactgacaggcaaaagagtgtggggctcagagcccccttggagttccattctgctgacatttaaagtgggctcgtgcaccctcatgaacagccccaattacgtgtaagtaatgagagtgacatttcacaaccctgtctttctaatgggctcctgtgtcaagtcattctttctgaatgcaaagggcagcaatttcacactgtcagggcaaaatgcacatgcatacagctcagctcccagcgggatacctttgcttctcagaaatggcgaagaaagccagcaaaatggcctttttctccttttgttttaatttaactatttagagtgaggtccttaatgtaacacccatcaatgattatggagccactgttctgaaagaactcgcagggccggcagatctgtgtgagttgtggtgtgtgctttgcttaaagcaactttaaaattatatgaaacaatgcattcttg

SEQ ID NO: 48446 - DNA, 1019 bp, Homo sapiens
gtgattatttcccagttaaaggaagcaaacctgtcagcctgatcagtagaagccctgagcctctgtttaagaaaggcaagagaagaacacattgctgacacattgctgacagtctctaaaatggttatacaggttgtaacgactactaaagatcccagcacttgtgtcttctgtactaactttattaagagatttcatcaaaatggagattttcaagaacagcagacagacatgatggaaccatggaatctcccccgtgcccatctcccagtgccctctgtgtggtgcctagacctctgtaacatcactgtgaacattccagacagaaaagattcttggccgggtactgctggtggttaaagaaaaatgaattgtaagtggagagttggaaaggatcggaatgtcccacattatgatatttaattatggaatattgcacagccgtgacaggctgctgagggcaccacgtaataaacggcacggggatgcgcacgcatggtgctcggggcagggacacacaggacctggacgtgacccacgcgggccctcttcctctaccagcctgtaggctccagcctctctcttggacttcaggtctcctcttgcatggctcccagcctgcctgtcccacttcccatgttacagagccagcagggccccccaaccgtcctgtgcggttgctgtggcctgccctccccaagccagaaagcaggggctgggggtctacagtctatatctgactctcaccttcaccccacaccctccagtagtgactgttgagtgaatgagtcagagtttcttagaatgaggaattcaccaaaatgccagaaagaccagaactgtatgtcatgtctgtctgctgttcttaaaaatttccattttgatgaaatcttcctcttagtaaagttagtacaggagacacccgagctgggatcttactttaaccagcgttataacctgtgtaacctttttagagatcgtcagcaatgtgttctcttgcctttcttgaatttttcaaa

SEQ ID NO: 48447 - DNA, 1076 bp, Homo sapiens
caggaaaatggaaaccacagctgctttttgcctttgtgggaagctgtagaaataagagtacagtggaaactctctgcttcgtaaaataacttcatgttgactcagaggggaaacaggaaaggtgccttctatcttttttatgcgagtttttctctctgttggtggggcctttgcttttaaggagtgtttctacaagaatacttgttggatatttagtgtgaacaggaagtaagatgtgctgactaacttttccattattttaatggcatttttattgctcagaaaatgaagacagaaagcaaagagtgaacgctttcattgtgctgggtaaatgccataaacaacctgcctttctgaatttttttctctgcgattttcagatgcacacacatgcgtgcatgcataagtacacacacatccatagagggggtgtttccccaaagtcgcggtcatgccacgcagaggtatgcaccttgctttatttgctcaccactgtgtcatagatgtgtatgttctgcagtgtgctacgaagccatgtgtgcccttgtgtgtgctgtgtgtccctggggccttcagtggaggtctctccagtctgccacacccttgactgttttccttggtgtacattactcttgtcaaggcattgattagcaggacatgtgatggcccctgtgaatggtggagcccagaaaatgaaattggcagtgttttagtaggccgtgtgtgtttgtgtgtgtgtgggggggtgcatgcatgtgtgtatgtgaatgtgtgtgagcatttgtgtgtgtgtgtgtgtacgtgcatgtaccttgtgcatatatgcatgtgtgtgtgagtgcctgcctgcacatgtgtgctcataggttccagaatagcagtgcacagcatgctggaagtctgcattctgggagagtttcttggatttaggagtctcttctcattaggaggcttactgaacttattttacggaagtcttagttgtatttttagccaaaagataaaactcgccccactctcctccatgcctccagcttgtctaaagtgaaatggcctggggagaatttgacatggta

SEQ ID NO: 48448 - DNA, 1043 bp, Homo sapiens
gaataaagaccagtttctttccagttagaatgccttttactcctttttcttcttttctttcacttctaggactttcagtacaatgattaatagaagtgataaaagtggacattcttgcctgttcccaatatcaggaaggaagaatttcaagttttgttgttgttgttgttaagtatgatgttaggtaaagatatgaagtgccttttacaaggcggtggaagttttttaatttgttgagagcttttatcatgagtaggtgttgaatttcctcatatactttttctgtatctgttgagatgatcatagggtttttcattttttgtttgtaaatatggtgaattacactggttaacttttgaatgttaaatcattcttgcatttctggcacaaatcccacttggtaattatgtatcttttttatatatttgttttatatattatatatatatatttatatattgctggatttgatttgctgcaattttattaaggatatttgtggctatgtcatgagggatattgttttcttttctggtactgtattttatattggtatcaaagtaaagtttgccccacacaatgatttgagaagtggttcctcttactatttttgaatagtctttgtaggattgggcttctcttgccctcccctccccttcccttcctttccctttttggagacaaggtctcactgtgttgtccaggctggagtgcagtggtacaatcatagctcaatcatagctcactgcagccttgacttcctgggctcaagtgatcttcctgcctcagcctccagagtagctgggactacaagcatacaccactatgcctggctaatttttttgaattttagcagagacagagtttcactatgattcccaggctggccttgaattcctaacctcaagccatcttcccgctttggccttctgaagtgctgagcttacaggtgtgagccactgtgcccagcctgtctggggttttctttatggagaggcttttaattatgaattcaattccttaacataggactatgaagattt

SEQ ID NO: 48449 - DNA, 1017 bp, Homo sapiens
tcccactaatttttgcatttttagtagaaacggggtttcatcatgttgcccaggctggtctcgatctcctggtttcatgtggtctacctgcctccacctcccaaagtgctgggattacaggcgtgagccatcgtgcccagccagtctttcctttcctaacaagcaaatatgtggtatgtgtgtgtgagtgtgttaatcaagtaggtcagtttattgctgtctgacaacctcctagaactgactcttacataagcaatgttgaatcctttgggttcaaaaagcatgattctaaatctgaatgattggttttggcctcctttcttttctaagacaagagacagccctctaattatagcataccacaataagaaaatcagcctaattaatttagttgaaaattaattacctttctgtacccaggacagggagtgaaaggctttgctctcaaaagaccacccctcccaccctgactgagggctctagggacaggatgaggaggcacacccccactgggccaggctgccaccccagtaccatatgggctagaatgacttatggggtaaagagacatgaagcacaggagcccatcacagaatgcatggctgggccctgctgggccgttgagcaatattgtgcttgctgtgtgtgcaaagcagcaaggcaagaggaagcttggctgaaatcagcgcaaaatgcaaaaacacttccttagtgacctggcttaccctcatcaacatgtgaattcttattgttagcaaagggttccagggtgctctcaaacatcaaacactgcacagataccaaacccacactttgacaagtgttaaggagaaacaaaccaaaaccatttgctcataaaacacagatggattgaaaagactaagaggaaaataatctgggcaaaatacaattggagttagtaaacacagcacatgcaaaaactgtttgagacactgggaacaaaaagactagggtcagatcacccagccctgttgttaaacctcttatctcctccac

SEQ ID NO: 48450 - DNA, 1014 bp, Homo sapiens
taatggtaaacccaaattagaggcagcaccacggtaaagagctatgttggatgaaatcctgaaccacatttgtgggaaggacacagggctggcccagtgaagtcactcttccagtgaaacagcagagctaacatcatccttccaggaatcctgcaaaagaagccacctgggatgcagtaagatgacagtagctttctggagctaagatgacagacagttttttctttggccacaggttctgattacaaatcagcaagcaaatgtgttcacacagatgaaataagggtatagaaaaggatgatgatttgtcccatttattccagccctttttactggcttttacagtcctttttacgtggctttcattcattcttctttctgcccatgaagcttatcctagagagaatttctgagaataaatgaagcatagtgaagcttctagaaaatagtgtaaaatgctaacattgttattattgtcaagtcatgtttatcaatatgtggatcattgatgataactgaactattcaagaaaagttgttaactaaatggctgtatgacttttggtgggagattgtatcgtagctcaggaaaaatttattccccttgcggtacccgcacccccacgcccaggaggaatgtacatccttgtcccagaagcaatgggctgggtgacttgctttggcttgttggaatgtgagtggatgtggatttgcctgtccaagctaagagccaaacacacatggtgcattgggctcactctgtgtgctcttatcgcatcagagccatgcgtcccagagagtggttgtgccttctgcctggaaatgcaggagaatcagatctctgcccttcccacctgcggacttcagtagaactgccacggcccacctgcaaactcaagagtgagaaataaagaaatgctggcaatttcacacctcactgacaggtgagtccccacgcacaaaggaacttcagtaagcctaatggctgactactcataattgtggaggtgagctg

SEQ ID NO: 48451 - DNA, 1051 bp, Homo sapiens
agacagagctataaacaatggaacagaatacagtctagaaacaactcctcatgtatatgattaaacaatctaacaatctttgacaaaagtaccaagaccacacataggaaaattaacagtttattcaacaaattgtgttgggaaaactaggtatccacatgcaaaagaataaagctggatgtttaccttacagatttacaaaaataaacacaaaattaactacagaactaaaattaatacctaaaagtataaaatttctaaatgaaaaaatgggagaaagcttcatggcattggatttggcagtgagttttttgatataaccccaaaagaagaggcaaaaaagtaaaaatagacaagtgggactgtagaaaactttaacttccgctcatcataagaagcaataaagtgaaatgtcaacctgtggagtatgaaaaaagatttttgcattaagcaagaggtttcagcaatccaaatgtccatcaatgaatgaagggataaacaaaatgtggtatatacatcaagcaggatcaaaggaaagaaacagaaaacttgaatacaggtcctttgaaagtactgcgtcagagggataaaaagaaaaaagaaaagtgaaggaacctatggcacttatgggacaccatcaggcagaccaatagatgcattatggaagtcccagaaagaagacaagctaaagaaaaaagaaacaatattactactcacaaaaatgaatactgcaaaaagaacaaagctggaggcatcatgctacttgacttcaaactatactacaaggctatagtaaccaaaacagcatagtactggtaccaaaacagatatatagaccaatggaacagaacaggggcctcagaaataacaccacacatcttcaaccattggatctttgagaaacctgatcaaaacaagcaatggggagaggattctctatttaataagtggtgctggggaaattggctagccatatgcagaaaatagaaactggacccctttcttacaccttatacaaaaattaattcaagatggattaaagacttaaatg

SEQ ID NO: 48452 - DNA, 1089 bp, Homo sapiens
tattcctaacatcacagtgcgtgtacaccatggatggacaccctgtgatgtttctcatcatatcctagggggatattaaccttaatgtcacagtgggtgtacaccacgtgtgtacacactgagatgttactcgtaatatcctagggagaaattacgcctaaagttacactgggtgtacaccatgtgtttatgttctctgatgctattcataatatcttagaaagttattagtcctagtgccacagtgggtgtataccatgtgtgtacactctgtgatgttattggtattatcctagggagatagttctcgtaacatcaccgtgggtgtacatcatgtctctactccctgtggtgttattggttttgtcctgggttgatattactcctaatatcaccgtgggtgcacaccatgggtgtacattctgtgatgttattcataatatcctagggagatatcactccctgtgtcatagtgggtgcacggccttgtgatattataggtagtatccttgggatgtattactcctgttatcacagtgggtgtacaccctgtgatagtatttgtcatatcctagggagatattactgtataccttgtgatattattcgtgacattttagggagctatttctcctaaagtcagagtggatgtacaccctgtaatattcttcctaatatcacagtgggtgtacaccatgagtgatattttttctaatatccagcggggaagaggatgatattgcttccaatatcacagaaggtgtacagcccctgtgatattgttcctaatatccagggaaggagaggatgacattatgcccaatatcactgggggtgtaccacctcccaccgggatattgttcttaatatccggaggtggagagaatgatgttactcccaatatcacagggggtgtacaccacccctgtttgtaaacatcccctgtgatattgttccaaatggcctgtgaaagagtaaatatgactcccattatcgcggggggtgttcagccctgatgatattgttttctaacatccagggaaggagagtatgctattactcccaatatcgcaggggttgtacaccctt

SEQ ID NO: 48453 - DNA, 1016 bp, Homo sapiens
tgggttaaacactatagataaaaattctacatggactctgcaactaaaatatcaggcagggaaaagaaatgagaaacatgcaataaagtctgacggcaaacaactcaactcccaatctttttagtactttgatgttacaaaatttatattaacagacatgtactatcctgggtggattcacctactgtgaaagtgaggcaatgggtggaattcaatagctgcctttacaagtatgtggcatgcgtaccagtcctgtttcctacatctcataaagacagcagtgatagctgcggtgtgtgcttcataacagactcagggattcctcaaactccaagcagctctgatctgccctgggcagtacttcagacactctgcccaaagaaacatgcaaatcatttctgtgaaatatctgaaatctactttcttaaaatctacagaacatgagaagacagtccataatgtccctatttttttctgatgtgttgtaagatccaaagtgcaaaatcactgtgaactccagaaattcctcagtactctgtaactcttcatatgagaattaagcacaagatagaaattttccttttcaactacttcatgcaaaaaaaaaattattgtcaccttaaggagtaaagactataatagatttttctggctgggcatggtggctcaagcctgtaatcccagcactttgagaggctgaggcgggcagatcacttgaggtaaggagttcaagaccagcctggccaatatggtggaatcctgtctttactaaaaatacaaacgttagccaggcatggtggcaggcacctgtagtcctagctactccagaggctgaggcaggagaatctcttgagtccgggaggcagaggttgtactaagccaagatcgtgccattgcactccagcctaggagacagagagagactctgtctcaacaaaaaaaaaaaaaaaaaaaagagtaaaataaatttttctgccaaatgactattccactatttcttcctctttgaaaccccc

SEQ ID NO: 48454 - DNA, 1047 bp, Homo sapiens
ccaagtactggttactaagattcctagcctcttccgaaggcggtccttcctccacacaactgcaagaagaggccttttcagtgtagacccttactttacccctccaccccagggcccattttagggaatagaaaagcaatttggaaggattagactgagggacccgtgcctccagcagataggccagcggaagagcagtcagtgctgtgggagatgctgcggggaggagcgtgtctgcgaggaaggactgctggcttcagcacttcccgattggaacttcatgatggaatccttggcacaccaatgctaaaaaccaagtgtgaaaaaaatcaccctagaacctgctagagtgatactgtggaggatctgtgggctgcaccgcccacagggactgccctgtatcagcatggagaactgatatcccatggcagggccactgggtagcggctgctgctaagtgggggtgccggatgcgttccttggttcatcttccactgatgttttggaaattgggctccgtaagagcacccagaagtgcttattaagaaccacccgtgctctgctggttcctgaggtgccagattccctccagggaaatgttgacctttgtgatagactatcttatgaccaaaagcttcgcagcattaaaatgtgatccatctcattaggttgtcatatgaagcctataaataactccagaaatgagatcctgtgacagctatttattttcactcttattatttaacataaatattggctatttatagccaggtcgtcaaggcagtcattgcttcccccatcttattatttctctcactctgacttgggaagtggggacttgaacctggaagagggagagaggtccagtgggggtggcccccgcttcttggaacctggtctccttagggacagaaattttcctaccccatttatactctggttatcttgctgagaagcttattgcgtcttctccatcttggtattcttatacgtgcatgttttctctcccagtacgtttgaatttgaaagaaccgtgaaggctctgag

SEQ ID NO: 48455 - DNA, 1043 bp, Homo sapiens
gaagtggtgcctcaagatgtgactgaattgccgcaatctcatgatcaaacttgaatggatgaggagttgcttcttatggatgagcaaagaaaatggcttcttgaaatggattctactcctggtgaagatgctgtgaacgttgttgaagtgacaacaaaggacttagaatattacataaatgtagttgataaagcagcagcagggtttgagaggactgactccaatttgaaagaagttctactgtgggtataatgctgtcaaacagcatcacattctatggagaagtcttttgtgaaaggaaaagtcaatcaatatgacaaagttcactgttgtcttattttgagaaattgccacagccaccccagccttcagcaatcatcaacatcaaagcaagaccctccattagcaacaagattatggctcgctgaaggctcagatgatcattagcattttttagaaataaagtatttttaaattaaggtatgtacatttttttaagacataatgctattgcatgcttaatagactatagaacactataaacataatgtttgtatgcattggaaaaccaaaatattagtgtaactagccatattctgatatttgctttattgcggttatctagaaccaaacctgaaatatttctgaggtatgtttgcaacattctcaaaaaatgcaaaccttaaaccctgaatttgagttacagaaagccagagacacatatatacttacatatgtacatttattcagatttatcgaagaccgagttattctgcataaagttccaagtggcattaaatttcatttagaaataagaatttttgaaacaaatgtttataagccatatcataattttccttctctttttaaaaaacattttctgaaaacaacttgaccttttgcttagtgacttagcatttttttttcccaggagaggtgcccgatgagctcccagtcatgtggttcagggcgggctctggaagactcacagaggagactcctccgagaaaccaagaaggtttctgtccaagtcgggatctgct

SEQ ID NO: 48456 - DNA, 1072 bp, Homo sapiens
aaccgtggaatgtcaaatatgtgggggaaaactaatggaagataaggtttatttagtaagtttgtttatgcagattgaagccagtatcatgtcaagggataagcattgtctccttttcctggcagagggggaccccttcacaaagggaaatttatgccctcctttacacaggtgggaaataatagagagattttcctgcttctgctatttctcatttgccttcagctcaaaataatccttatgccaaagtggtatattctggggtggcatgctctgactcccttcagggatgactgcagaagggcagttacaaggatttggggttcttggggccatctttggagacacatggcacaggggagtgagagatgtaaggtcactctttggtgtttgattttaaggaaacattagtgtatgcaaactttgtgtttaaaccaaagagcagaatttatcatttgaaatgaaaattttatagctactaaagtaaaaataggtgagtttagttattttctgttgagtgctactccaccaaggttaacaaaaggactgaagtgcaaggatttcgtggtgggaacgcttgtctcctttgcctgcttcccctcattcattatttttgtatccggatacaggaaacagaaatgctacatgacaattactctcagatgcaacggtctttcggacatcatgttttgctggggtcagatggggaccttattttctgtgtgttctggttctcctctctggtaaaggggtgtccctaggggcagcttttaaagggctgagtggcttcaggcacaggcaggggccctcctgctggggtgatcccctggtgagacagagcccctttactctggtctgcactgttttacaaaccttgacttcccaaactcaggttctcccaccttagttccagccacgaacctgtttctataatacaatggatcatgttactgccttttgggaaaacccccgactgctcctcctgatcctcctgactgactgcagtggaagcatcatctatattccagctgaaccatcttcctgcccacccagcacacactgcgcaagaccc

SEQ ID NO: 48457 - DNA, 1092 bp, Homo sapiens
aaggtaatggcctctagctccatccatgttggtggaaaagatatgatttcattattttatggctgaatagtattcaattatatatatgtgtgtgtgtgtgtgtgtgtgtgtgtgcatatatatatatatatatatatatatatatatatatatatgacattttctttatccagtcatctactgatggatacttaggttgattccacatctttgctattgtgaatagtgctgagagaaacaagagtgcaggtgtctttttgatacaatgatttattgtcctttgagtagatcccagtagtgagattactgaattgaatggtagttctattttcagttctttgagaaatctccatgctgttttccatagagcacttactaatttacattcccaccaatagtatataagttcccttttctctgcatccttgctaacatctgttattttttgtctttttaataatagccattctgtctggtgtaagatgatatttcattgtgtttttaatttgcgtttctctgatgattaatgattttgagcattctttcttatgtttgttggccatttgtatgtcttcttttgaaaaatgtctattcatgttctttgcccactttttaatgggattatttgaggtttttttgttgagttgtttgagtttcttataaattctgactgtcagtccctgtcaaaatgcatagtttgcaaatattttctcccatttcactagttgtttgttcactcagctgattatttcctttgctgtgcagaagctttttagtttaattaaatcccatttgtctgtttttgtttctgttgcctgtgcttttgaggtcttggtgatgaattttttgcctagaccaatgttgagaagttttccctaggttttcttttagtacttttatagtttcagatcttacatttaattcatcttgagttgactttttttatctggtgagagaatacgatccactttcattcttctgcaaatgacaatccagtttttctagcacaatttactaaaaagagtgtccttcccccagtatatgttcttgttgactttatcaaagatcagttggctataaatatgtgatttt

SEQ ID NO: 48458 - DNA, 1756 bp, Homo sapiens
aagaaattagattctgttctgaagtagttttccagctactaattttaacatataaacttctggccctggtttatttttataaatgaagatatgaaacactgaagtgttaaaactaacaggtgtcaaatcattgccttttctctctctttcacccctcaggggggacacagcgattgccacgcgccattggaatgtccctggccaaggagctcatattctctgcgcgagtcctcgatggcaaagaagccaaagcagtgggcttaatcagccacgttctggaacagaaccaggagggagacgcggcctacaggaaggccttggacctggcgagagagtttttacctcaggtatttctcattaaatgagtttattttttctcattttaggaaacattataacactttgactaaaacagcagtcatcttgcctatggaagaagtccctggcttgcttccaagtaaagggatgcgtgggctctgtaaaactagagcagttacacaagataaacactatgatcctgtggaattctgatgacgctttgaagatgctccaagggtcttattgtagccacactttgataaaatatcccttgacaatgcttgtcacatgtgcacaacttcctagcaaggtgttttaatttgctcaccagctgagcactctaatggaagccatagccatggaaagaaagagtgatagggctggctgtcacactgggccaccccaagtcaaaatacattgaaatatgctgttttctagtaagggactgtagtctgttgtgccagagtggacttccattgcagtggcttcacttgaaaagtgaaaagcctgcttgaaaagcagcagttgtttgtctttctgtgtgtttgcctatggtggtgtaggcgttgttttgactccattgtgcttcctcacaactacactttcaaatctagaacatgatgcgtatggctgactcaggagtgatatcagtggccgtgcactgacagtcctgctttaagcaattctttttgtcacccgttcagatatatttttcaaatatgcctttggtctgaaatcacaagattaaagggctttaaattgagagaaagagtcttcttttgctgtgtaagcagtagtgatcttctttattcctagtggagtttgaagttttataaccccctaaccatttctagagtcaaaataatttttctctctaactcagggttgcttaactcaaacaggtttcataaccttttttgtgggctgtggatctttttgggaatgccatgagattccaaattcatgcatttgattctttttaaaaatgcatgaatgctcacatttgttcagagtcttgcatccagtttcagaaagtgttcttggcactcagcacaggagcctttgctgacaaaccagtccccactctgctggtatgcacctgctgaatcggtttttaaaaccacactgcctggcattgatgcttctggtccttcttaattaacttaggagctgttagctcttttagggaaggaccattatataatttattccccacataaggtagtgcagagccatacattcagtagatgctcaataagtatttgttggattgatggaaacagagcaaataaaaaaagatttttgccttaaaaagataagattctcactacaaacttatttattcttcccaaatatgagagaagtctctacctaaagacaaattaaaggtacaagtatcaggagagtataatctgactgaatattggtgttataactt

SEQ ID NO: 48459 - DNA, 1562 bp, Homo sapiens
tacgtcggtaacccctggtctggaccctaggctggtgccctatctcttctgctgcagccgtgtgtggtgggctcacagctcacccatgtgctgaaggaagctgccactccacccacgagtggtttcttctctttatcaaatacttacttgcctttacaacacccaggggatgtgctgatgtgtaatattagaagtcctctagagcagaaatctgtatccctctctaagttgaaggaaacagggagctcacacttggtcatccgcagtctgacagaggcttgtcttgagggcgactctctgccgtcaaaagacggaggacatcagtgattcattaaatattggaaactagaagtttctgtttactgagctttaaatgatgggtgctgtactccagagagaagaaaacataatgagtatgtcctcaacattttcttagggttttagttgcctgagcaataaaatacgggtatgcagattacatagttgctgcaaatatgtagcagtggcaaaaaatactctgtagtgatttagaatcacatactagcaaaaatactgcttaagctaataggtcacacatctggcagctccctgggaatataagagactcacctgtctccgtgtgtggaaaaggcaaggggcaagttctcctgctgtaactgatcctcagtcaggacatgcagtgaacaagaaaatgtaataaatagacactgtgtttgctgagtgatacagtggcctttagggccctttacagaatgctttggtatgagtgtggtatcaagagaatttttcagaggagtgagaaaaacttgcacaccatggcaagctgggatgggtgagtcgtgaggagtgggtgaggtgggtgtgcactgggagggctgccatgtgctgggcagcaggtgcggtctcagacctccgggactccaggctcgccctggcaggtggaggccaggttcttgacagctcctctgtccttctgcctggagacaattttttaagtttttcattttttttccttctttctaaaagaagaatttagtggagaatacaactggaacccctgattttttttttttttcttgagacggagtctcactctgtctccaggctggagtgcaggggcactatctcagctcactgcagcctccacctcccaggttcaagcaattctcctgcctcagcctcctgaatagctgggactacaggcacgcaccaccgtgcccagctaatttttttgtatttgtagtagagatggggtttcaccatgttggcaaggatggtcttgatctcttgaccttgtgatctgcctgcctcagcttctgcaagtactgggattataggtgtgagccactgcacccggccagaacccctgatttaaaaacaattgcaaagcctttttgtttaaaatgaacacaaacagtagttgatgaatacctttttgaacatggtctttaagtgtacttttacctgctgtattcatagtcatgagcaaaggtacagaagatatttgagtattaagtatgctttgaaagtatctcttatattgctgatcttatgtcggtgtt

SEQ ID NO: 48460 - DNA, 1042 bp, Homo sapiens
ttcatttcatcaacataatttccactgccctggaatcaatttattccttgacctgttaataattacacttgatcactagcatttcagtggcagagaaagcctctggaaatggccatagtcatccttttgggtgataagttatgggatttctgttcggcttggagatttggcctgttgaagtggttgacattttatgaaaacaaaggagcaaacttttacctgatgccgtgttaagattcactctgtcaagtggttgagaacacttatttaattatctaactgtacttttgcattacctttttttatggccaactttaaacatgcctagggaagttcccgttctattcccagccagaagcaagtgtttgaaaaatgagaaatcaccatagagctcctctaagattaatttttcacaggtccaagaatgcctaatatttaaaatgagctactttgaaatcagtcatgtatcacatcagtgtttcaaaaagagattgagaaaatatgggctgttacaaaaccactaacctcacctgttgctccgtggtgatttggagccctggagcagggctgcctggatctgaaactttgctctgtggccttttgggaaagtgacttgcctctctgtgtttctgtcctaatccttaagtgcaagagtggtcatgcatattttatagtggcattgggaggatgacaggaatgaatacatgtagaaggctttgaaagggttctggtagatcaccacccagtgtgtgttgtactagtcatcattgttactgtaacttaatgtgttttagtgttaatggatgtccttttttctcttttgctatcccagccccttccttgcctaattgttactctcttctgtgtggttaggagcaactagttcagtttaatttcccttagagagcaagtttcagatatagcatcattttgaactactaaggaagtttaattctcctaggattggtcatatagccttctttagcaaaattgaacaggaaccttaggtgaagcttggttagccaggtttatggatctgggg

SEQ ID NO: 48461 - DNA, 1076 bp, Homo sapiens
ctgagatttgaacccagactgtttggccacagcccacacacctgttacctcatgagagcaacgtagactgatctcccatattcatcgttgtggacactatatccatagagactcagctctgcctgtgtcctcgggctctgagactgagaactgggcacagcagacggcacagagttgtcactgttcttctcttgctttccattatcgtttctgatgtggctgcatgttaaaagcagagctgccaaggcagaaggattgattgaggccaggagttcaagactagcctgggcagcataaggagacctcatctttataaaagattttttaaatttttagaacaatgtagcgtcaacatgattcagtttcttgggatttctggttgctagtccatgtgtcctttttcctccttttcacttcattttaggaacctattttcttgtaatgaaatcattggattttaaattgaaaagctaaggtacatgtaatccatttctgaaagaatacaggttttggaaattagaatatgggaagtagtctaagtatatttggatatgcaaataaagaagttattaagatgttttaaagtagccatgaaaacagacatgaaaagaggaaccctgtccacctgtcagaatagtaaaactatttgtcagaaggtaactaaagacttggtcttgaaaagttgccatatctgatatgacctattaagctctttggtctgggggactatattcaggcaactgaagaatttgggcttgtcagatactgacaagtctgctgatcctgaataattaatagatctatgcctccaaatatgtcttggcaatattgggtctaataatggagttacagtcctggtcttgtgaatcaaaaattaattcactgccaagcagtttttaacagaaaatgttgtgggactctcctaatacatgtcatttagagtgcttacttatttccataacaatgccttttaagtgattttttttaagaatttgtgatatcaatttaattagtaaacaatattttagtatatctcataactttttcaagttgtcatatttgaatgtgatgatatg

SEQ ID NO: 48462 - DNA, 1059 bp, Homo sapiens
aaaacaaacaaacaaacaaacaaacaaacaaaaaaccctcttaactgggtgtggtggcacattcctgtaatcccagctacttgagggggctgaggtgcaaggattgcttgagcctgagatattgaggctgcagtgagctgtgattgtgccactgtgctccagcgtgggtgacaaagtgagaccctgtctcaaaaaaacaaaacaaaaaatggggctcagggagcttctaggttggtgaacacattgattttctaggaggttggcactcctaaagagggcatggaagctctgtactccctcttcccataccttgccctatgcatctgttccattggtctgttcctgagttgcatatagtaaataaagtgttttttttttttttttaaattctgagtcattctagtgaattaagtaacctgaggagtttaggggaatccccaaatctatagctggttgtttcagacatatgggttgcccctgggacttgtgagttgcatctgaagtgagggcagccttgtgggaccccttaacttgtgggatcccactaattttggatggtggcagaatttaactgaattgttggatacccgcttgatgttgaagaattggtgtggaaaccctcagacatttggtgtcagaagtggtgttagaaaaaaagacgtcataattggtctcaggaatgggatttgctagagcatctcacgaaactcaggaaagtgctttatttactattaccagtttattataaaagagaaaactgaggaacagtcaagtggaggaggtacttagagcaaagttagggtggagggttgcagagcttccataccctctccaggtgtgccacttacccagcacatccatgtgttcactaacctgggagctccctaagccctgtttcagggattttttatggaggcctctttacataatgattgattacatcattagccattggcgactgagctcaatctccagctcctctcactccctgaaggtgtgggtagggcactgaaagttctaaccctctgatcatggcttgatatttctggtgaccagcgc

SEQ ID NO: 48463 - DNA, 1022 bp, Homo sapiens
gccacctcattccagcccgggtgacagtgtgagactccggctcaaaaaaaaaagaaacctcaaaaacacagtgtaccgtttattgattatccttttagcctcttctccatcccttgaaagtcatcattttccctcttctttttcttctcccacaaaggtttctctgtatatattaatactgtattccagtgataccttgctcatttctaaatatttaaagcttagcaaatggtcttgcctcaaatttcttgagcataggaactcctcttattctttgagaatcatcttttacattctcagaacacagcaaacaacagggactcagcatttatttgctggaattaatcagcctttaaactgtgctttaattcactgatttttttcaggaatggttgggatataataagcagcttctctgaattgtctcataccactctcctatttactgatagtaaatttggctacatcttttttctaaaatgctaggaaaacagataaacattaaagagattcctacattgcattggaggttgggccaagtgatttctgacttctcagaaatctattatttagcattattaagtacttcacttacattttaagttttttaatcaatttttagtttaaaaaagtagcatggtaggtcaaaatgtatgaaaatgtatacagagagaactctctctaaccctacttcctctactttattcatcccctaatataaataattattatttttgtcctagtattttactttattttatatatatgtatatatatacacaaatacagtcatgtgctccataacaacattttggttaacagtagcctgcattatacaatgctggtcccataagattatttgtttttatttttttgagacggggtctccctgtcacccatgcaggagtgcaatggtgtgatcttgtctcactgcaacttccgcctccagtgttcaagcgattctcgtgcctcagtctcctgagtagctgggatacaggtgtgtgccaccatgcccagctaaa

SEQ ID NO: 48464 - DNA, 1039 bp, Homo sapiens
tatacctacgtaaactccttcaatggttattaggatgaagaccagactttttagaaggtctgtaaggatatttctggcttgtgctgacctctttactttcattggtcactctcttctccccctcgtaggttacaggacattcagtgggaccatgactagtttatgcttttcctgtttcctctgcctggcagtcagcccctctccttcactctcaccttgactcctacttatccttctaaccttcactgtctggggtaagctttccctaaccatctccttttgccccagaccattatcaattctggttacaagttactgtagcaccacttacagcttgtaaagcagtttgaatggattattaatgatatttatgattattaatgatttctatgattattaatgtttgtatttccctcctagactctagttccatggctgctgatcactatagtacgtactcagtatgtttgaatgaatggacacatctagtcttagctgcttgattttcttcctgaggaaactgaagcttgaacagtgtaacacagttttattcaagtatagagttagattaccacttaatagctgaaggaagttacttcacctctccaagtctccatttctttatccgttaactattgataaaagtagtgcccacctcttgggttgtggtggggattacatgagttaattcgcttaaagcacctggagcagtgcctgaggcctactggtggtagctgttgtcagtagtattgggacctacccaaagtcattcagctgtttaatacagatcctgtcagatagcagtcctttatgcttttctctgtactgagagcatttggaattcttgcaaatttactcttgtgagcagaagttcatctttatactttaaagaatgggtctgcacagtttcttgcacagcgaaggcatgtgtacattttgttgtcttcagtttagctcagttgcaaataagaaacatacccaccctgactcagtggaaggtatttctgatacactgtgaaaatttgtctactccaagaac

SEQ ID NO: 48465 - DNA, 1050 bp, Homo sapiens
ctccaggcccttcagtaaccagctccaggagaaaacatgttttaaaaatcttgactttgtatagctggttccagttcaaatttcatattcaaatgttggcctctttacatttccatcacttcatggatttctctcatcccgatttgggtcaactgccgtgtttacaatttgttttgaagcgcctttttttctagccttttcttggtttttgtttaactgtgaggcttttttgtatatatatattttagctgtcttccttccatctttcctttgcttgtgtccacctttcactaaacatacattcagcatcagttttatccaagaaataggaagccttgaaagacaaggaccctcggtcccagtgcctgggaactgctgagtagatgccttggacctgctgagtagatagtatagtgggcatgatgagtgctgtgtaatgacgccggggctggagtccttgtctaaggcagagacgtgaggatcttcgccagggcagtaatatttgtgtcctggggtgaatgtctgagccaagatgatgtttgaggatagcagaaagactaagggttggcactgacaatggttgactcacatttggaagggctggagaacgaggacagggggagtaagtgactcacaggtgagcatgtgggcctttcaggggtgcatggctgtggaggggagctgtggggcagggggtactactgtatggggcagtctgatctgcaggtgttgctgagggagcaggctgctgggaagaccaggcagccaatgtggaaaggagaccaccaggaagggtacagacagcagaatggtggttccatggtggaggggaggtgctttttaactaaaggagttgggcaataataacgaagcaatgcatgcctatcacatactgtatttatttgcacaggctgctgtaataaaatgccacagactgggtggcttaaacaaccgaaatttgctttctcctaattctgggggccagaagtccaagatcaaggtgtgggcagggttggttctcctgagcctctccatggattgcagatgctg

SEQ ID NO: 48466 - DNA, 1025 bp, Homo sapiens
tggagtgcagtggcgcgatctcagctcactgcaagctccgcctcccgggttcacgccattctcgtgcctcagcctcccgagtagctgggactacaggctcccaccaccacgcccggctaatttctttttgtatttttagtagagacggggtttcactgtgttagccaggatggtctcgatctcctgaccttgtgatccgcccgcctcagcctcccaaagtggtgggattacgggtgtgaggcaccacgcccagccacatttatttaacccagtaactaaccactgatttctgcatagttatgctggtacaatggcaggatcatgtaattaaccagtatatttctttttgttgttgttgttttttaaggaacacaaataaaaatgtaaggtttacgtcaaggttaaaaacacgatgaaataagaaagggggtctggagtatgtgtggagatatacctgggtataacaatgaaatggcgtgattgctggtagaatgttcactatgccgcaccatgttctatgctccatacattcagtcctatgaatgggaagggctcatttcccccattctgtagatgagaaaactgaagcctggtagtcacgcttcttgggagtatcctgggtagccctggccaaggtgggctttgaacccagggagcctgggctgttaactacaaaaccacaggatacgtacaacataagacatcgacattccttgtccaaatcgccagcaggcaggggggcgaagccacccagtgagagttcctaagagccagaaaggaggagacccacactcctgctggatcaaagctgatgtaagtcagcattaaagcttttcattggtttattcgccgatggaaggaccttctctttctttctcttgcctcagaatcagtgtttgcccaagacagcaatttgtggaaatggagaaaatctgagaattcttctgtggctttgctaaattgaggcttgtcctccacagtccatcctaccctcccccactttttttccagcaaaataagtgata

SEQ ID NO: 48467 - DNA, 1051 bp, Homo sapiens
cacacacacacacacacacacacacccccgatctgacagcaccaggaatcaggccaggatattggaggaggtgttttggtaaacacgaaatacacccagcctcctgctgccccccagaaccccttcatcttgttaattggtgaattctttcctaagctgctgtcatcccacgcttgtgttgctatgtgcctgcgcgtagccagtgcggagggccttgcatgttgtgtagtgtgtgctttttgtgtctttattttaatgccatttttgactcgttgcccaggattccgttgttagatttccctctctcccaaactgaaatttatctaattctcccttagagtccaccgggaacttctctctagtttctgctgaagcagacttctactgtgtgccgaaagacgattttcttgttctttgtgcccgtttatttaaaactccagaatggagcactgcttttatgaatgctgggtttcacgataactcataacatctgtcatggttaatgcttggacacacaatgcctttactcttttaaaaagggtctaacgggagagatcctattttccgactgcagcggggtctcctgcgccggccgtggtgctcggggtctctattcccaaggggccgagacagccatgctggggtggctgcctgcgagcctggtgagggacccattccccagtggtaacatcagaagcagagggttctgaagatgagatcttaactcggaatgaaaccccgcagtccgatctcagggtgttttcgtgtcttgtctatacaaaagatagcttatgccaaggagagaaaagatagcggctgtgaccaggcgtggcatgactggtgagtcaggaatgtttcaggtgccaggaggggaggggctgcaggagatgcagaagggcgtctcagcccttcactcaacactgtgtgcgcacttggccctggtcccagctctcggggccttcaggttaatccatagtctgagtggctcacttggttcagaaatggcctggtggtgcctggtttaatttgcttttataagctaataggctaa

SEQ ID NO: 48468 - DNA, 1034 bp, Homo sapiens
gttttggtctccggactcaggcctggcaatcccaggggcaaaggcccaaccccaggcatagatcagacccctcatgcctcagccccagtccccagccagtctcccacagcctggctgcctcatcgccttgctctggggctggtcctccacgctccatggtggttatttttaccctcacccccgcccacaacctcgcgctccgccagcctttctggagtgtgctcacagagcatgcgctgaagagggagcaaggaaggtggcgaacgcaggaggggcagccgtgtccagtgctgcactgtgtccggtggcagaggcctgtgccagtgggaaggtcagaaatctcccttctcttcactctcttcagaggagaaagaagtcttcagaaggggaatcccccaagttcttggtccattttcctataggcatccttgtcctcttctttcctgttaggataggaatgatttctttaactttttgaagacagtgccttggcctgttacacggaccctattttttaccgacttcttatggacttacattgtgtgtgtgggtgtgtgtgtgtgtgtgtgtgtgtgtttgtgtgttttccatttatttgtaactctgccctttcaactgaatccagatgggctcaagttccctggtgtgaagagaagacaaaatgctgccctccgcacctctttcaggaaatcctcctgtattatattttgaatgcagctccctccaccatctgggatggagtcattgctttacagcagtcatagctgctgtcatgaaagatgaagctggtctccaggacactaggaggttgcaaagagccacatgagtttattggatatgacagaatttctccaagtggggaagctaaattaagcaaatggtaagtatacattttgtaaaatgataaaactctcattagttgtggttggttcagttgtctatttagaaaatgcaagggactcaactgaaaatgttagcaccaatacagagatgtagtatgttggctggaggattcaggaccaacttagaaacat

SEQ ID NO: 48469 - DNA, 1031 bp, Homo sapiens
aaatgcagtcacattctgagctatgggaggttacagcttcaacatacgaattttggaggtcacaattcagccgataataattaggagctatgctttgtattgtagtaacatctgttgacttctactgtgatgaaaaacttagtattgacctccttaacatttctgagaatcttctcagaaaaaatgagtgcaagcagaggcaaaaagctctgattttaagcaaagatggacacgtggaaggagttggaactagactttctgcagttcttgtctaagttaataggactgtctagatacacgatgaggtgttcacttagtctgctgcacccagactttggttagaccctgggcttttcctgggatttgtttcttggtgggcataccttgatgttgcattacttaatatatagaaggaagagagtgggctcttccaaggcccagctgacctcctgctcaggtacctgcataagtgcgtgagtgtatatcaaaagtgttgaagggtttatgaattatttaaagaaagctgaagttattgcctctgcagtgggggacatgggtggctggggaaaaagagtagaagaaagtctttcactcttgtgacttttgaattttgtttcatgtgtccacacacacacacacccccccacacccacacacccacacccactcccactcagaaaataaataaaagataactttggaaaaaggaagtagagaagaaaaagggatcagcattctctcttactgcttgtcctctgtctttaacattataaggacatcatcactttccctgaacctccaaggccctaccaaggtggaggtcttcctgggccaggcccttggtgtggtgcagtggcccagtctgttccgattactcatctcccttcctggaaatggagccctatgtccgtttggtgatgcacccattaagagatccttttcccatgtttgaccaatttctgtggcttttgggaacaatgttgtttggatttgtcttttttttttttattgtttgttttgttttgtttttt

SEQ ID NO: 48470 - DNA, 1034 bp, Homo sapiens
ttgaaatatggccacgttatgcttggctgggaataagctatcaaccaagtgataggatggccccgtggctcgaagggaagcgcctttgtacttgagttcttagcttacacacagtataaggtggccagacagtggagcgtggcccagcaagcacacgggggcattggcacttggcagcggtggtcagacttggggaataacagcatgagatttttttttggttggcaagagtttctggctggaaactctccagagagactttaccatcttattttgtaaaagtcttttttaacattaaaaaagttaatattcatgcaattgaccaaggggccatttttcagtgtgtacactgggtggcattaagtacagtgttggacagccatcacaaccatccatctcccgaacttttcatgttgggaaactgagactctgtccccattaaacacaactccccacttttcccttcccccaggccctggaaaccacccctctactttctgtatgcatttgattgctgtagatacctcgtatgtgaaagctttttgaaaatcagattttttaaactgtcaagattggtgaaagtacagactggccggaacagaggaggatttggggagtagtttagagagtaaatccattagaggttgaagtagtcccttcccatgccaactatgggtacctgggtttgtcccagttgatgtcaaagtttttattaacggtggatccaggggcagctgttggtaattctgtcttctacctgggcagttttgggtttgagtctccagaaaaattggcaagttcttatctcagctgatacaacatagaattttttgttgttttcatttattagcaaagcaagaatctttttgtctcttctctggaacaaagagagaaaaaaaatcaaattttggaaagactgaaagtgtgattcattccaaagaataaaaatctgctcaaccggtatctactgtgaatcactgttagtggtgcatttgaaggctttgtatcagatactgctgtctgacctgtttttg

SEQ ID NO: 48471 - DNA, 1058 bp, Homo sapiens
ggtgtggcccaggggtgccctctcagtgaggacacacgagcttccctgccctctgcataatgtgtcagcgtccacacctccagtctgggtccttttttgtgacatggatcgtacttccccatgaactccagtctctttcttggcgttgtttctctgcacgtatcttcttctcgcacgtgtctgggtttgagattatttttcctatgttgatttttagatggtattggccaaagtgtttagaactaagaaacctacagacccagcgtaagggggtaaatgacagcacaaaaaatagaacagagagtctgtttgaagagggaatttgaaattcatgccagaccaaaaatggttgagctgaagcattgctcttaaattgtttaagggagtgggaagagtgcagtggggtcaggaggaaattaatgaacttcaacgaaatggttggtgatggaaaacatataagcaacacgtgaataaacacggggaattaattttggagctgctgggaaggagtaaaactaaagaataagcaaggaaaagcagagcgtctgtgggggcagggaacattttccactccagcatgggacaacctcgaccatctagtgaagcctcttctttgaaagctcttgagagaatctttctaccatgttggtggccgacttcacctttcttcctcctttgccagtttcttgggagaaaatggtagttaagtatttttgtatgataaggcttcagattctaagagcgattccaagatttttttcttaaattaccaggaaaaaagtccatatatgaaatcccagtgtcaggacctggaaaagggtcccaaacacattggcatccacttagatgctttgctagcagtctgaattaccataaggaaaaaaccgtacataatggaaccagatgggagtggctggctaatatttggaattctttccacttaagaattatcttaatttgaggaggatctttgaagtccaggggaagttgccaggtggggaagagggagttctgtgggtaaaggtgaggggcagggtgggagcccagggtttccctca

SEQ ID NO: 48472 - DNA, 1076 bp, Homo sapiens
gagaggcaggctgccccagtgtgcacccagaaaggagggcaaaaggctgagcagctggactggggttggatgcagcagctatgcagctgatttggagagcctgacatgagaggacactgaggagtcgacaggttttggagaagattcccatctaatagttttaaaaaatattcttggtcgggcgcggtggctcctgcctgtaatcacagcacttcaagaggccaaggcaggtggatcacgaggtcaggagatcgagaccatcctgactaacatggtgaaatcctgtctctactaaaaatacaaaaaattagccgggcatggtggtacgcgcctgtagtcccagctacttcggaggctgaggccggagaatcgcttgaacctgggtggtagaggttgcagtgagctgagatcatgccactgcactccagcctgggcagcagagtgagactccatctcaaaaaataaaaaataaaaaaattatttaagtagaacaacattcagtatggacatcaaactgttgatatttaacctgtttcttatttgattgcaaggaagatgggactcagagaagacgctgttgatttccaagtaacatttcattcacaagtcttcaatttcttttgggtacatacctagcagtagaatttcggatcacatggtcattccatgtttttttttttggggaactgccagacttttccacagtggctgcaccattttgtattctcaccagcagtattccagggttttaatttctctacgttctcaacagtacttgttttctgtttttgttgttgttgtttgttgttgttgttgttgttgttgttgctgttgtttggttttttggtaatagtcgtcctagtcctaatggctgtggagtggtctctcattgtgattttgatttgcattttcccagtgactaatgatgacatcttttcatgctctttttggccagttgtgtattttttttttttggagaaatgtctattcagatcctttgcccaatctcaccttgggttgtctttttattattgttgttagagtttcatttacttttttttttttttttttgagac

SEQ ID NO: 48473 - DNA, 1050 bp, Homo sapiens
tcagtgagaaaaagatgaacgccccagttaaacgagggacaaaaggtacagtcaggcagtttgcagaagaacaaatacaaaaggccacaaacttgtgaaaagtgtggccttattaggattcaagaaaatgcagattataaaacagttatcccaagctctttgactcattggatcactgaaatcagaagtgggtaataaggagcacgaaaaccatgatgcgggagcatggcattaatggtgcaggactggccacaggtagggccatttggcattacttgttaacatttaatttaatttaattttttttttttgagatggagtctcgctttgtcgccaggctggagtgcagtggcgcaatcttggctcactgcaacctctgccttccgggttcaggcaattcccctgcctcagcctcctgagtagctgggactacaggcacgtgccaccacccctggctaattttttgtatttttagtagagacagggtttcaccatgttggccaggatgctccagatctcctgatcttgtgatccacccgccttggcctcccacagtgctggaattacagacatgagccactgcgcctggccacttgttaacatttaaaatgcacatactccatggcccactctaaggaaatactcatgctcttccttggcaacaccatttgcaggagtgaaacatggaaacatctatgtgtcttttaatgggagccaaataagtggtgctaattctcaactgtgggttattctacaaatgcaagtcaatatggggatctactgatgcaaatagaggaagatttcaaagaagagattctgagtggggagaatgatacagaaggagagatgtgtacttacctatttaaaaactctcgccttcctgctctcatttctgtggagataccaatctctagaataagatccccttcttcctttttgagatgaagtcttgctctgttgcccaggctggagtgcagtggcacaatcatagctcactgtagcctccacctcctgggctcaagtgatcctcctgcctcactctcccacata

SEQ ID NO: 48474 - DNA, 1217 bp, Homo sapiens
gcgggaggggcggggcccggctcctaggtgggtttcctcccggggccccacttcccccgagtccctgcgcggtttcggctgcttggatccggggcgcagaggaacggcggggaggttcggaagtgcagcttgggacctgcctaggttgcctggaggaggcggcgttagctctggcggtgcagactccgggagcacctcccgcccgcgcgcctcgggccggattctcggcaccctgcgggggtggaggagggcgggcggggccttcaggcccaggagcgccagagacctatggggttcgcctgaagcccccggaatgtgtgagacacttcttactagtaaatgggcttcagtatcccccatccctgcactcctgcaggaaggtgagaatcgggacagtcgcaggctgggagacgctctgcttttcctgcgtcctgctgggagctgcgcgctccaggtatcctggcctgccgccctagccggcccaaggtacgcgagtcagaaaggctgcacagtctttcctgggggggggttttagtttaagcagatgttgattacgtcagacattcctaattacttgatttgggaagggagcttgcgtttatctcactgtgcattaaagcataaaccgctcagagtgcacaataaaataagtagaccacattctaagttggtatccatcactcaagacctctgtcgatttctgcaacccctcccccaagaatctcccaggagatccctttgctgggggagaggggtggcggggaggcggcttaaacacgttgctggacgtgctgttgggcggcttttgctgttcaccctgcggttaattgtcctacaaaaactctgccttgcagaccatgagggttgagcgcagcctttgaggggcggtgctgtggtgggggtttttagatgggtgatgaggaaagcatgatgggtccattgcttaagccaaggtggttgtaacaggaaagttccttgagttttgggtgaaggaatttaaacactcatagtttccagtgaatgtacaaatgtcttatatgaacaaagcaattggagtcgttttctttaatttttgaaccctgttctttttctagtgaaatactcataatctttataggagagggcataggatataattctcttcgttctgtatggctaggttaacaaaatccaaagagtatgataatttttattcaaaataataataaaattatatg

SEQ ID NO: 48475 - DNA, 1037 bp, Homo sapiens
atcatgctttttttcacatctgctcctgagtcaaataacatcttctgactgtaattagcactttttaatgtaagtttttcatggtgaagcttgagattctgatataggaggaaattttaagaggagctgtattatacagagaaaatactaaaatagagaaaacaattagccctatatttcagattatgaatattatgatgtttgttttgcaacattgagatttcctaccattacatgtcattaaaggctggttttatagaaaaggcaatgtctcttgataaacagaaattaagtggaaagcattatcgtaaaaagatacatgatagttaaataggaaaaattgaatgacttcagttttgaatttgttcgttaaccctgaaagaattgttgttgttatttttagaaatacaaaaccaaactgacttactgagtcttagtggaaaaacactttgtgtgactgcaggatcggctccctctctgatcaacagttctagtactcttctttgtcagtatatcaacctacagctcctgaatgcaaagccacaaggtatgtgcctccccacagcaggcagactgtggggtgctgggcattgaagttgtctttaatattcaaatatgtgtgtatttctagtcggcttcaaagtattgctttaaagtgtgggctctcacgcaactttggggagcaaccacaggcttttcttttggtgtgttatagagaccctcatccatctggcatggttaggaaatgaaaaaattggttaggtaaaaattacaactaaattgtttgagtgccaaaacattttaatctcaaattttactttcttttctgaggaaaaatgttctgaaaacttctatacctccatgccttaatcaacagactagattgatagtgatttttttcctgatattttaggatcctcattgtgcacatttgtactgaagtcttcgggctcctcacttcactgtgtactgagtatctgctccccaagctgctgggcttttatataagttttttttttttctttttccccttcccc

SEQ ID NO: 48476 - DNA, 1051 bp, Homo sapiens
tgcagaataaatcaacatcaggggtcagatagtatttttaaccatcgtgacctgtgggaatatacatatggcacaaaatgaaaaatgacaatcataaataagaatcatgaatacaaaggtttaaatctagaaaaagacaagaacagattgcctggtagagttctatgcctggaccatagctaccaaggattgccaaaacacatgccaaggatggagatgtgtgtgtgtgtgtgtgtgtgtgtgtgtgtagtgtatatattgcatatacactatatatgtatatatatgtatatatatccatccttggtatgcttttatatgtatataataagctatatatacacatatatatagtgtatagttgggggaaaaggaaaaatattagggcttgaacccctttgtatcccttttcctccaaatgtaacattttctttttagttttatttgtctgattgaggtgttatttttgtggctttttaggtggagtattgctcctggaaaatccaaaaggtgacaataggttggaccttttaaagctgaagagtgttgtcactagcatttttggtgtgaaaaatacagagctggctgtcttccatgatgaaacaggtatgtggaaagtgagaggagcctacgtcctttgactcaagatggattggtgaaggtcttaatttgctgtcagttgtactatacaacttttgcatttttcctaactctcttgagtcagggcccaactcttcagcagtgcctgcctgcagtgtctattcatgcctcctcattgtgtcatgtgactgaaaaccctgggcttaatggatctaatctttccctctcacctgttagctagctggtggacttcaggcttcagagtcctctgttgtgaggttgtttttgtttttgagacagggtctcactctgtcacccatgctggagtacagtgatgcagtcatggctcactgcaccctcggcctcctgggctcaagtaatcctcctgccttgacctcccaagtaactgggactacaggcatgccaccaccatgcttggctaattttattt

SEQ ID NO: 48477 - DNA, 1023 bp, Homo sapiens
aaaatagcagaatataaattatttttgagctctcacagaactttgctgagatacattataacctgggccataaaacaaacctcaaccaattaatacagttgaaaccagagtgtgctctctgaccacagtagaatcaaactattaattagtaatataataatgaaaatctccacactcttaaaaataaacaacatgcttttaaattatccatgattagggaagaagtctcaagagggaaagaaacatagaactgagtgtaaaggaaaatacgacatcaaaatatgtggaatgtggctaaagcagtcctgagacggaaatctgttgcactaaaaactgaaagaaagatggtttcaagtcataacctaaggtctaaactcaagaaactagataggaaaaaaaggcagaataaatgcaaagtaagaagaaggaaaaacataaaaataagagatcagtgcaattgaaaacaaaaacgatagagaaaattaatgatacagaaatctggttcttacccaaaaattcagcaaaattaataaacctctagtgagactaataaagaaaaagaagacacagttgcatatcaggaataaaaagaattattgatacagattgccaaaatcaaaaacgcaaatactatgaataaatctccatatgtaagtttgacaacttggatgcttgtcgcccaggctggacagtgcagtgatgccaactcagctcactgcaacctccacctcctgggttcaagtgattctcatgcctcagcctcccgagtagctgggattccaggtgtgccacaccacgcctgatgaatttttgtatttttttgtagagacggggtttcaccctgttggccagtctggtctcaaactcctggcctcaagtggtctggccttctttggcctcccaaaatgctgggattacaggtttgagccactgttcctggcctgaagtgaaccctgtttctaaaaaacacaaactactacaactcacacaatatcaaacagataattttaatggccctataat

SEQ ID NO: 48478 - DNA, 1496 bp, Homo sapiens
ctcttgaggaaggtagccaggagggtacatgagctttgcccggaaataaaatggcctgttttttctaaaactagaaaaggcagtgtgtggattctggtaattatcattaaaagtaaatagcaattggcttgaaaaacatttaactcttctggtagtgggttctccataaaagtacagtacaaaaaaagaaagattacaatagcatttctgttgttacatctaggaattttagatatacttatgaaagtatgatattaaggtagggaagatattggcttataacttagaagtagatcatttagactgggcacagtggctcacacctgtaatcccagcactttgggaggccaaggcgagcagatcgcttgaggtcaagagtgcgagaccagcctgggctggtgaaaccccatctctactaaaaatacgaaaattagctgggcatggtggtacacgcctgtaatcccagctactcgggaggctgaggcagaagaatcgcttgaacacaggaggtggaggttgcagtgagccgagattgcatcactgcactcgatcctgggcgacagagcaagaccctgtctcaaaaaaaaaaagttgatcatttaaaatatacctcagtcacttgcttaatcatttgctccggtctcattctatgagacaagtaggacaagacaaggaggggctgatgatggctgtttattttttcagtgaggcgagttgcagtgtagtttcattttgtattttgcatattgtgtaattatttgactttttttaagtgagcatatatttttaagaaaccaggataagaagagaagaaaaatgggatataaattgtagcttttgatactttgagtaatgagattgaatatgttatcaattgtgtacagctcttgttgttactgagaagtcactgtgttacacgatggtgtggcacattgcagtcaggtgccacagttactcagtcatacgttctcatgtgctcagttgaagggatctgaactggaaattacactcaccagaggatcttcccttcctggtcctgcttgtgcatatgtcaatcttaacatttgtgcaaatggcagtgaacaaggtaagagtaaattccatgatttgtgtgacttttttttagttatacttatggatgtgaaaaaacaaccaaaaaaacttatggatgtttttaagagaattggaataattatttaatcatgtttaatagataactttttcttcttgtcatcaaaatgaattcactaggcgagatgcagtggatcattcctgaaatctaccacttttggaagccaaggtgagaggattgcttgaggccaagagttcaagactaaccttgccaacataataagatcctgcctcaattaaaaaaaaaaaaagggccaggcatggtagctcacacctgtaatcccagcactttggaaggcggaggctggtggattacttgaggtcaggagttcaagacctgataaacatggtgaaaccctgtctct

SEQ ID NO: 48479 - DNA, 1050 bp, Homo sapiens
aacaagcattttcttcttaccatacaaatcactggtttttaagcatatttatagaatggtacaactatcaccatagttttagaacattttcctcgtcccagaaagaaagccagtattcattaacattcacaaaccattttcccctcaatatctgaccatttcctggcatccacgaacctatttgctatctctggatttgccttctctggacatttcatataagtggaatcatacaatttgtaatctttatgtctggcgtgtttcacctagcataatgtttcacattaatttatgttgtagcacatatgagtgcttcagtccttcatattgccaaatactctattgcatgtgtatgctgcattttgtttatccattcacagttgatggacacttgaagtgttcttgctttctggcagttaggaataatgctgctgtggacctacatttttgtgtgaacatatgttttcatttctcatttttgtttcctcttgtgcattaactgtaggaactcaatgttcgaaaagttacactgtctacagataaaaacaagtatggcattcggctaagggcagaaccagatcacatggtcctggggaagcgtctgaagggagcctttaaggcagtgatgacgtccatcaagcagttgagcagtgaggagctggagcagttccagaagactggtaggtgtctacacagacaagggcaccatttatgtcctgagtctgagggatactttttaggctactgtttgacttttaatatcacatcctttcctttcctgtcctgtcgtgtcccgtcgtgtcctgtcctttcctttcctttccttactctcttctcttttctctcttctctcttctcttttcttgacagaatctcgctctgtcatccatcctggagcacagtggcgcgatcttggctcactgcaacctctgcctcccaggttcaagtgattctcctgcctcagcctcccaagtagctgggattacaggcacgtagtaccatgcctggctaatttttgtatttttggtagaaacagggtttcaccatgtt

SEQ ID NO: 48480 - DNA, 2632 bp, Homo sapiens
atacaatggaaagaagttgggcattgttgatgctgtcaaattgcacagctccgtgtaaatggcacttcctacagttgtgtagtgggcagtcttggactttgatccacacatactggagtttttggcttttctcactgaccaatgggaattcgcatgtggctcacatggtgatttttttgtgtgcacccctaaacactctgactgccatgtagcacatcctcaacaaacagtcattatgtgattgattcattttggttcttttctccttagtaagtggaggcacttggatggaaggagctgccccttctttgttgtatccaaccctctccccaccccagatgcctggtaacccacttgctgcctgattgacttgtcttacttttagcttataggctttatactgtggtgcctcgcctggtcaagtttgtagatattctgaccaattggtatgttagaatgaaccgcagaagattaaaggtaagtgcagactgctgttgggaaaagcaaaaagtgtatgaagtttgaaagtagaagaaatatgagaatagccagaagggagaggaacattttcagttgctctccgtttttgaagctttgtttttcttttccttttacattgcattttaactatatttgtcatttgagggatagggatctataagttctaaaagtcattttgcattattttcacaacacaattatgtacatgtcatattggagggagaatgtcaaggcacaaacaggactacactgagcagacctcttaaaattcaaaataaaatcatgcaaatattttataaaaatactggtagatatggcattaatattgagaggggtacttccttctaccacaagggagtcagatattatttactgtggacagaactcctctgtagctgttgggggtttaggatgagcagagcataggtcctggtctcaggacttaagccaggtacataaataacaatgatgcttaatagagagagcgaggtctctttactgcaggcccaatgaaggctcccactacccattagtcatgtctttttttttttttttttttttttttttttttttgagaaggagtttcactcttgtcacccaggctggagtgcagtggcatgatcttggctcactacaacctttgcctcccaggttcaagcagttctccctcaacctccccagtagctgggattacaagtgtgcaccaccacgcctggccaatttttgtatttttggcagagacagggtttcaccacgttggccaggctggtctcaaactcctgacctcaggtgatccactggcctcagcctctcaaagcagtggtgttacaggtgtgaaccaccgtgcctggccagtcatgtcttaaaaggcattaataataaaagcctgcaacacaactgtaatttcatttttgtgcagatgtatctcacacacacgtatctagaaggacatatgctaagatgcttacagtagttgtctctggataaattaattatgattgtaggaaaaacaaagataatgaaaaaatttcaatgaattggtattttttttaatacacattatatacttttttaacataaatcttatttaaaggtactttaaagtttttggttagcaactgtttttgtctgttgtgggtagatccattctaccttcagccttcgggtcctacagttaggctctacttccctgtcagctcgcctcaggtggggatagtcagtgggacagcaggtgcacatcctggccaggcctcctgcactgccctgaagggccaccctggtggcactgaccgtggatggcctgtggtcgtggccctttctcctttctctgtctcatgtcttgtctgtatgctgcatgttctttgaagattgcctctttttaataaacttatttttttaatgataaacacttatttaacagtttaatgtttatgtttcctttttactcattagggtgaaaatgggatggaggattgtgtcatggccctagaaaccttgtttagtgttctgctttctctttgcagacttatggtaagatgattggcttctttctagtaccctttggcctatgggctgccttcagcacctacttgctgcagcatcctccatttatatccattctgtattattctgccaaaaatagatatagaagttttataacaccttatagctctagttccttatcagaaatcttgttagcttatacatgttaagtaaggactaagaaatactagattctttcttacagtctctggcagtacaatatatgtcagggcccttggctctagaatgaggatctacagttcaaagtaagacatacctcatcttaatgtggattgccataattgtgagtaatgggggaggttcttcagctaatacctgtctgagtaaatatatatatatcacaaaaaatactttaacttagcattgagaggaaaacgtgcaagtaattgtttgatatatgttcttatcagttcagatattagttaaataatataaaagtggaacggctccaactttaattctttttatcctgtttcctttactccatatgttataaggctcctatttattccttaaccgaaggaaaatctgctttgtacaaggtgctgtgcctggtgctctccatgcc

SEQ ID NO: 48481 - DNA, 4909 bp, Homo sapiens
tgtctaatttttctccctcttccagattatatctgattaactcccctgtggtgagagcagaaaacctccgctttaaagaagagggtgtgcgggacgtccttaaggatgtactgctcccatggtacaatgcctatcgcttcttaatccagaacgttctgaggctccagaaggtatgggctgtagggggctgcacatgtacctgccgtgtctccacagcgctcccttcaccaagctgtgaggtggagctctgtgtgagactttagggctgctgttctctgctgcctgatgctggggtaacttagagccatggggaggccatacatgcaggtgcggaaggtatctagggtccgggctatgccaagaccatgggccctagcctgcaaaagagttatgtcatatagttgtttagtcgccagttgttgtttttgtttttgaggtggagtctcagtcttgtcacccagactggattgcaatagcacgatctcggctcactgtaacctctgcctcctgggttgaggcactgcctcagcctccccagtagctgggattacaggcacccaccaccatgcctggctaattgttttatatttttagtggagacttggtttcatcatgttggtcaggctgatcttgaactccagacctcaggtgatccgcccttcttggcctcccaaaagtgctgggattacaggcatgagccacggcacccagcttcgtcagccagttcttggtaccaggaacaccatgttgagtgagacacccctccccttatggaaccaatggagtgggaattgggagatacagtaaagagtcagcaacttttagagagagcacccagtgaaggcggagtcacaggcaagctagggctggccacttgagatgggtggtcagagaaggcccctcagtggggtggcatttgggctaatctgagagtgacagcagttctcgatggagttttcagtgggttgttagggtcacatataatagttgtgatgtatgtggaagtgtacttcaatggcagttacctccacgcccaggagttactttctcacctgagaagcccttgctctagagccaccttccatgccccacaactgaccattgtcagcgtccatcaccttcattgaacatgttcctgtatgggctttcaagacctgatttggggtcagagttccgatactgcacatctgatctccagcaccttacaagtaaaattgcttgtaagtaaataactgttgaatgaaaatgagatattattcctgcttgagcagatgaaaaagctggttggaaaaatgaactcttgttatcccactccagcaggcaggtcaattacttctgctccccttgggctctggttgttctgctaatgaggacacatcatgttcacctgaggctctcagagtagcctttccccaggaattgagaagggcagtcatcttccccaggctcccagcattcctcctctctgcagcctgccacctgtcctgcatgtggttctctgccaagtagggcaaacagtccttgggcaggtgcactctgcaggtctccactggtgtgggactcaggaatacaggcggggtcaaagctccccacagccagggcccatctgaatataccagcaagacacagactccatgatcagggccttaaacacagaggaagagtcacattatcactgccccgctagcctggttgtggtgctgccagagaaacaaagcaggacatgagttctgtttgtagagcaaggacttaagatcaaggaggattttgcaaagcaaaaagagtgggatagaactttctgggtaaaatgaacagccttagcatggaaattatttcccagtactcattttcagtttgtggacaatcattcaatcctagacagttctactgtccttccttcctgaggtttaaagtaactaaaccctacacttttctgacaagattttagaatatctttcaattcataattactctttggtgcagagaagtaatgttttcctaaactctcttcagtttactcaaaaacataataaattaattgaggacttaatgtgccacgttggtgcttatcttgaaaatattgctgaaaatcagaaattcacattgccagtagggtctgggattttttctttttgtttttgtttaagtgatttaagaagtttatttcctcatagtaactttcttcccaagtgtgccagtgtttcattaattgttccttcctaggaggaagaaatagaatttctctacaatgagaacacggttagagaaagccccaacattacagaccggtggatcctgtccttcatgcagtctctcattggcttctttgagactgaaatggcaggtgagtctctcttggtctgtcctcccaggaataaggactattctctttgtaactgcccttttgatatttaatagtggaaatattgagagatacagaaaattaaataattgtttccttttacctctcatatagttttgttaaggcttgttaattgtcgtgatatctttgtttcaagaccctggggacttctggcctggtgtggtggctcacgcctgtaatccccagcattttgggagaccaaggcaggcaggtcaccttaggtcaggagttcgagaccagcctggccaacatggcgaaaccctgtctctactaaaaatatatttaaaaaaaaaaaaaaagttagctggccatggaggcgggcgcctgtaatcccagctattcaggagactgaggcaggagaattgcttgaacctgggaggcggaggctgcagtaagttgagattgcaccactgcctgggcaataagagcgaaactccatcttaaaaaaaaaaaaaaagccctggggaattctgtctttagggggtgtcctcgtggtctcaatgctccacagaagagctttagagctggatagccatgggttcagagcccaactctaccacttgttcccaatccagagagttgcctgaagtctgaccgtcaatttccttttttttttttatgggtacatagtagatgtatatatttatggggtacaggagatatttttatataggcatacagtgtgtaatagtcatatcagggtaaatgggatatccatcacctcaagcatttatcatatctttgtgttgcaaacatctcggttataccctttttcttgtttttaaatgtacaagaaattattgttgactgaaatcaccccattgtgccatcagatgccactcttattcagcctatcttgaccttcagtttctttatctgcagaatgcccagtagtgtttgtaaggcttaagtagagacgatttacataaagtagctggcagatgataggtactcaataaataatacttgttattaatgcatttataacttatttttagttctattttcattactaaatagtccccttcttttccagaaaaattagaaaagtcagaagagcaataatgaaatggacattttgctgttatttctattaactaacaacagtgagttcgttgggtaattttacagagattcaaaaagtacattatgttggcttccttaaggtttgagataatcacaactgtaggtccaggtgagaaatctgggacacctcagacagtcagttaaagtgggtggacagaggccctgggtcacagtgagggcaaaagagggcaaggcaaatccaccctcacagggctctgcggttcctgctgctgttgggcaggagcagcggccgccacagacctgggattcaccattagcctagatacgggcacatgctgctccctggagtaggcgctgctgccccatttagcacagaaggactgctacaggatttgtccaccttgttaaacatgtagaaggatcacgacagtccagctgttgctcagatagacacagatgaagatggaagtgagtgtgaggctgagtgctgccctggcgagggcagcactgggagcccagcacactccccagacatgctcacacctgtgtctgcttttccctcctgagtgatacaagtgggtgggaaacgtggggattgttgcccggacccccttcaatatttgggcaccagctgccatgacctcctgtgaagctgggtctggagatgcgcattctggctggagcctggtctgcctggaaactggagatcggcagccacgttttgtgggccgtgtttaagtcccggttctgccggcctgtcagcttcatgtcctccactccctcaggagcactgtgggtatgagaggacctgcctcacagggtggtggtggcctgggtagtggctgctgctgctgcccctgtgtgttgtatgtttatccattgtatgtggagttctatttgggttcatttactccctcagagttgaaaccagaacatagaaaacctgagcttcctggaaggtaaaaagtgccgtgaaccctagaaatcatttagacaggtctcagttactgaaatcacatgtctaagaaagtgtgaccagctaacgactctggcctggggctcagcccactgacatctgagttctggtctttgtgaaaagcagcagagagcagctctgccggttgcaacttctcgtctcttagcttagaccagaagcctcattaacagtccctggactcttttcattattataaattgtatttgtttctaagtatcggtcttattctttttgttttttgtgtttgtttttatgtaacaaagagtattaattaaatgggaggtgaatgagaatccttaaaataagccttgcctcagacaattggctaaacaccctttctttcctacttgatctctgagtttctcagggaactcttcaaatcctcctaattcctcaagaccttcactacctctgatgctgtttttactcgactgttttaatgtttagaaggccagttctattttattcatagcctgtgccag

SEQ ID NO: 48482 - DNA, 1023 bp, Homo sapiens
ttgtcgtttccagaatgttatataaatagaattatacagtaactaacttgggggaattggctttttttttcttttttttgagacagagtctcactctatcacccaggctggagtgtagtggcgtgatctcggctcactgcagcctccacctcctgggctcaagcgattctcccatctcagcctcccgagtagctgggaccacaggcatgaaccaccacacccagctaatattttgtatttttggtagagacagggtttcaccatgttgacaggctggtctcgagctcctgagctcaggcgatccacctgcctcggcctcccaaagtgctagtattacaggcatgagccaccgcacccagctggctttttttaaatccacataattccattgagattttagatgactgcacctaccaatagttccttcctttccatggataaatagcattctgtattatgggtatgccatggtttgtttgatcatccacctcttgaaggacatctgggttgcttctaacatttggcaattgtgaataaagctgttgtgaacaattgataataggtttttatgataatgtaagttttcatttctttgggatatattctgacacatctttcttcttcagtctaccctgaagcttcctcatggacttagtatgatattcaaaaagaagtttgcaaatattaacaaaatatcttaccattgtaccttaacactgtttgtttcttttttgagacagagtcttgctctgctgcccaggctagagtgtagtggcgcgatcttggctcacttcaatctctgcctctcaggttcaggcaattctcctgcctcagcctccccagtagtggggattacaagtgtgcgcccccacgcccagctaatttttgtatttttagtagaaacaggtttcaccattttggccaggctggtcttgaactcctgacctcaggtgatctgcctgcctcagcctcccaaagtgctgggattacaggagtgagccaccgcgcccggcctattagcac

SEQ ID NO: 48483 - DNA, 1046 bp, Homo sapiens
tagcaattaaactgcaagttctgttatgcttacagttaatagaaatgactacttttctgtttgttagtgttgaccacctgaccattccttcacgctgtgggaagggatccttgcaccgcatctctgaagtgtttgactgttggtttgagagtggcagcatgccctatgctcaggttcattacccgtttgaaaacaagagggagtttgaggatgcttttcctgcagatttcattgccgagggcatcgaccaaaccagaggatggtatgcctccttgttctttcatcacgtgttttattgattttattttatttagggagtattttactaagtcactgccatttatctactgggtgatggagagattgtggcaaataagacaggctacattcctgccctctcccctccaccaccaagcacggacattaaagtgccttttgagtaggactctcccactacaatagggctgtagttttacaatttcaatgatctcactggcattttggaatatatgtgttacactggatgttaaaatgataaaaaaagttatgtgttcttagcttacgtcagatcatttactcaaatgtttgagtatttgcataaaagacagtagtttgggtgctagaaatttgagggatagttggtaatgtgctcagatattgaggctagccttataaatcaacattctaaaaaaatccagatttttaaaaaatatacatatgagagaggatttgggcattgatttttatctggtgccttatgtaaaacagttccttaattggaagaaggtgaattactttctttccatggattggctttgctggcccaggctttatttacttttttttttttttttgagacagaatcttgcactctgctgcccaggctggagtgcaggggtgtgatctcggctcactgcacccttcgcctcctgggttcaagcaattcttctgcctcaccctcctaagtagctgggtctacaggcatgcaccaccatgcccagctaatttttgtagttttagtagagactgggtttcaccatgttggc

SEQ ID NO: 48484 - DNA, 1052 bp, Homo sapiens
ggaagattctagattaatgagccagattcaggtgccaggaggaaactaaaatgccttagagaaataatctaagatgtttcacttatgccagttactttgacaatttgcacataataaacccttaatatccattgagagtatggctatgaatgtttaagattctctctaggtagggactccctctgatactggggtggaaacagaggagcagtggcaaccctggcctcttcagagactaagagtaggctgtgtctttcatgagagagaagccacattagcaaatactatccttcggcccagattggtgtgttaatgtgcctttaaatcatcagtctcaggctgggtggctcacgcctgtaatcgcagcactttgggaggctgagggtggctgatagctcgagtccaagagtttgagaccagcctgggcagcatggcgaaaccctgtctttactaaaaatacaaaaaattagctgggtgaggtggtgcctgcctgtagccccaggtacttgggaggcttaggtgagaggatcacctgagcccaggaagctgaggctgcagtgagctgtgattgtgccactgcactccagcctgggcaatggtagtgagaccctatctcaaaaaaaaaggaaaaagaaaatcatcagtctctcaaagtaaacatgcatgctatataaattaactcagtatgctctgtttggctctaaggagctcctgctattgaactttgtttttgacaggtggtatgcattgggtcagtggcggaacttgaagaactgtcaggagcaaagatctcagatctccacagagagaggtcagtttctaaatgttcgattcacttcagttttacgattctcctattaagacctggtctctagcagattacagagccacacatggaagtgactagcttgctgaattactttgctgatgactcatgtcatattgcagtattgtggcctctgtccttgtgaaatgtgaggtgaatggtgcataacctttcagatggaggattcatggtgctctctgaaagcctttgagaattgctgatattt

SEQ ID NO: 48485 - DNA, 1172 bp, Homo sapiens
caatgacatcaggcgaggacttactatacagatagatctgtgtgtttggccttctgtccaaagctgacagcattgttgcagtgatgagcggcagcaccctggggaccttggtgaatctcccatagggacctgaaaggcaacagtgaagtagctgaatcagaagacttttcaggactgaacaggaagggcagagaaagaggccaccagtgttcactaggatcagaagctccctgggtgagaacgcacagcagttcctactggtgtggcccttgtcagatgatccctccattctgagtgccccagctagccccatctctcagctctttacctggatataatcctagcatcctgtggctttgtctgattgctttaatcgggtccaagcataatatagtcatgcaccacataatgtcattcagtcaatgacagaccgcatatacgacagtggtcccacaagattatgataccatatggttactgtgccttttctgtgttttgtaatgtttagaaactcaaatacttcctgttttagtctgtttagtgtagctacaaaggaatacctgaggctggataatttataaagaaaagtagtttatttggcttatgattctgcatgactggaaagttgaagactagacatctgcatgtggggaggacctcaggctacatccacttatgatggaaggctggacaggagccagagtatgcagaaatcacatggcaagagaagaaacgggcggtggggtgggggcaggctcttttcaacagtcagctctcacaggagctaatagagagagaactaactcactgcagaaggagagcattggtctcttcacgagggatccaccctgtgacccagatgcctcccatcgggctccatctgtcaatactgccacactggggattaaatttcaacttgagatttgctggggacaaaccatatgaaaactagagcatttaccattgtgttacagttgcctgcagaattcagtacagccacatgctgtacaggtttgtagcttagaagtaataggctccaccatatagcctagctgtgttttaggccatcccatctaggtctgtgatgtttgcctaaggaaatcaccctaacaatgcatttctcagaatgtattcccaccattaagcactgtatgactataatttagctctag

SEQ ID NO: 48486 - DNA, 1495 bp, Homo sapiens
tatcaggtggcatgtgttgcggctatgtcacattgatggtgataactttgttcacttggttaaagtgctgtcagctttctgctttgtaaagttgtagtttttcctttgtaattaataagtatcttgtggggagattctttccaaatattcttttttttgtcatacattcacttattaattttaacatccatggatggtttttgccagtaataattatgcctgtgatatttgccaagtggtggttttggtagacttttataagtgaatatttatacttgtaaataacattttgtgcatgtaggatgaatgccgagaaaactggttcttaaccttacataatatgttgttggcagtatagatttacttgtaccattgattattctgttttcccaaaattttcatttgtgatgacaacagaaataaacacacattgatgtacaattataaatatcattgtctaatactgttctaatattaatattttaaagtctactgttagcagacttggccgatggattgactttgacaatgactataaaactctgtatccacaattcatggaatcagtctggtaggtttatttaaaattgtaaatatggtaaatattctattctgttgtattgataattggaaaaatgcactagcatgaatcagtttatttttgagtccatcgttatttctctgaaaatctttgggaacaggtttgtttttgaatgtagaacttttatttttatttttttgagactgagtctcgctcagttgcccaggctggagggcagtggcacagtcttggcccactgcaacctccgcctctcaggttcaagcgattctcttgcttcagcctcccaagtagctgggattacaggcgcccgccaccatgcttggctaatttttgtctttttagtagagatggggtttcaccttgttggccagggtggtctcgaacttctgacctaggtgatccatccaccttgatctctcaaagtgctacgattacagacgtgagccactgcgcccagcctgccagttgcttttcttaacattatgtgttaaatatcattcgatatcagtagatattagcattttaatgtctgcctgatgtcttactatattgatctgttataatttaccagccagtctcccaatgaaagacattgttttttcacttatttggcagacagaaactctaaaaagaaaatggcataaatgtttgcattttcagaaatagaattttgttctgtaattgtgaaactccatctcttaccaggtgggtcttcaaacaactctatgataaaggccttgtttatagaggtgtgaaagtcatgcccttctctacggcatgtaacactccactttccaacttcgagtcacaccagaattataaggtacgtgaaatgtagagacattattcagcattgagttttgtaggtggaagctgagtagttatgatcacagtaggtattcccaagtagacccagtgtggaatgttgcccac

SEQ ID NO: 48487 - DNA, 1027 bp, Homo sapiens
catggcttacctgtggtatgtttgagtatccagctttataattttctgattttttttataagcattagattttgtcatataatatgttcaagtatgatgaacgttgactgtcagaccttctagttcatttctataatatttgtagtttgatttgttttgttttctagagttgcatagttgcagttgttttcatagggcagcgtggtaacagtcttatcacaaattttcaggaatatgaaattgataagacactgggaatcagaggaccagaggatgtggccaaaatggggattacagagtataacaatcagtgccgagcaattgtgatgagatattctgctgagtggaaggtatgttgggtttttttcagtagaatgaacagcaaatgtagttactaaatgggcattgaaatggtttatggtcccttgtgctttttttattaatttattttttgtagaaaaagtgttagcttccaccttcaaccctattacttaaacggttagcttaaactgaaccatctctcttctgacttctgtgtgcttaattggtctaactttcttgcatgatcaccaatagggaaaaattctaataagtataacatgatatataggccttttctttttttctcaaatacttttttcaatttttttaacttttcattttgaaataatttgacttattaaacaattgaaaaagtagtatgatgggttcccctatatccttcatccatctttcccagctgctaacatcttcggtaaccataatattaatagaattttcaaaagcagttgccccattaatttttatttctgaccaatcacatattgcatttggttgtcatgtctttttagtcttcttaagtatggaacatttatttagtcctttgtatttcatggccttctcacttttgaagattgcagaacagctattttctataatgtctctcaatgtgtgaggtttcctgatttaatttaggttatgcatttttggtgacaatgccacagaagtgatgctatgcccttctcaa

SEQ ID NO: 48488 - DNA, 1047 bp, Homo sapiens
gctttcctaccacctctagggattcaactctatctttcctacctcataactttacctagtttataaagcatcttttgattcagttaaacactatctcaacttcctttgaacccttagaaactttgggggcatccctgtagagtacttaaattagcattttattctagtttctgttagttggttatttatatcctgcagtaagttgaaagagtcatacaggcttagactacttttgtatttctgtaatccaaactagctgtttaactttattctgtgatattttgtctgtttgtagtagttgaggatagtagcttgtaaaagtccatgatgccttagtatgtgtagggcatatggtttttttcccataatacttgttattgaatcaaagactgaaacaactatccactaatatcttatattgtcagatataccattaccatttttcactctttatcatttttagatttacgtaatttagattatgtttagaatgttaaaaaaatcaaagagtctataatcactgtagttattagtatcttgctctattacatttgtcgatctttaccttaaaagttttagacttgctactgaaagccattaaattcagactttcataattaggaacagaagtaggacttttcattgtctggtcacgcagactttctgagtttgctatgactgagggtctttggttatggaggttagtgaaatgaggttaaagtttcttcttcctgtcttaatggattttgaacatgtttaggtacttggtaaatatttgatgattgagacttctcaggctgtgttttccaagagagtattaattatcccttttcctcaaagaggtaaatgaaaagaaaactgctgaggaagaagagcttgctgaagaaaaaaagaaagccctgaatgttgtacaaagtgttttgcaaatcaacttaagcaattctacaaacagaggatcagtagctgctaagaaatttaagtatgttttatgttccatcccattctaccatatcatcctttgccataaatgtcttcttgaactcaatt

SEQ ID NO: 48489 - DNA, 1014 bp, Homo sapiens
agaaaataaaacaaccccaagataaatgttagctctgaacaccaaaagttttaagtgatgttgtggaggtataatgtgtgatgtggaacttgaccagaatttgtttctgaaataagaaaaaattccaaattctaaaacatctgatttcagaaacatattaacttccagttttgagaactagaattttctaacatggattaagtgtcccgttaagtagactatcactagcatacaatcaaaatgtttccttatctgactactggacattttcttctttttttttttggaatattttgataattatgcttatttttatagccaataaaaaacaaggtttatctttgaaataataagttttcaagagctatttttttttttaatttagaaacaaccgtttttacattgctctctggataagaatttaaataaattgttttgtttgtttgtttgtttgttttttaggaaacccacagaaagtttttgcatatatcaacatcagtgtagcagaagcggacctgaaaaaatgtaagatcatcatatattttctatactgtttgccagtttgtatgactctgtaacttggaataactggttctaaatctaaacctccacagccatttttcacgttatccagagggacagcagtgatgaagagaattccagtatcgtataactcagcaggtttaggtccattccatttggcatcagcagacatggtagcactttactggtgggtttacttaaaactgctattctcaaatattttggacaagggaccaaactttcatagaaactgcctgttacatatatcccactgaatatcatgccacattccccctcagtctgatcatttctttgacagctaatccttgtcactaaacactcttgagggggctttaaaatacacccttgtaagaccgtatccttgaaattgtgaaatctcttgttgataagtttagtaaagtcaagggcaaacagtggccttcaatgaagaatgggagataatccatactg

SEQ ID NO: 48490 - DNA, 1069 bp, Homo sapiens
cccatggtcttgtcaggtgctgcttctgagaaattggggtgtcctttaaaatacgtaaccctagtcatgggctggggatgtgactgttccagcccaggtgcacccagcttgggtctcaggcctcagaactgagcagtaccttgggcttctgaggttctcccaataaaatgtggccccttgggatgagctgcaggcacactccagcttctggagcgagactcatgaccttaatttgtaaatgagttatttgctgtttactcttcagatgagaatagttacttaccccagcagcttagtcagggatttgttttttctacaaacaggattctggggcagggcagcagtgagcgccaaggccatggtgagcagcgtcagagcagggacgtgctgatcagtatttcctctcctcggcaggagcttttgaagttggggtttggcttgttgatttctaaatctcaaagcgtagtaaacattgggacaccagaacccaggatacttctcttggactgaactgagcttaggtcacttgtttagccagtgtcttgagtgctgtgcgctgagtgcccggagacgaaaagcgggacacacagcagtcagagctcaggactcggagtaatcctaaatgtgtttttcagggcaaataattaatcacatcttgttataagcacacgacttctgaggttaaaaccacaaaactaagccctgagaagcaaaatacaaaggactgaagataaaatttgagaataaaatgagaaaccagatctcttcaaatgtgaaccaaaggagcttgcgtttctcagcagacaggagaggcaaagaagaaggcttgtcgacattccatccatttggcgctggaatggccagatctactttttactttttgttgggttttgtaatacttggctcatgataaagtgatttttcagcgttcgtttataccactgggctgggggaacatcgctcacatgttccacataattacttttccatctttcagtcctttaaccctctctcgcctggtatggtggggtgcactggcctgaggaagctttgcacgctggtgcacaca

SEQ ID NO: 48491 - DNA, 1050 bp, Homo sapiens
cgtgatcacacgggtgctgctgagtggctcggacaagggccgggcaggcaccctgagtccggggctcgggcctcagggcccgcgagtctgcgaagccagccctttcagtaggagccttcgctgccaaggtagggcccagccttccccaggtaggcggtgggggccgcaggggccttgggactctgcagtccccatgggtggccaggcggtcagcacagcctcctgggggctctgggggatgccacctggttacgccagggctcccagcacggggcctcgctgcctctcacccccagatgcagactccctttcttgccttttatctgcatctgtaaattgcaggacacatttgggctgtaggattttcccccagaatatcatccatatgttgtggtcctctctggtttgttgaatgttttcaaccatgttatatatcctgttggatcctcattgcaacccgggggacaggttttccttggcttgttccttagacagagagaattgaggcacagaaatcctgcagggctgggtcctaccacaatgggatgtcttcacaagtctggggtgaagacacagacccatggggcctttggactgcgggacgccttccttgcagacaggagccgggcctggccgctgccacatgtcctgacatctcatgagctgacgctgcccgtgattcttggcagcccatagagaccccatggtctctgggagcctgagatggtttgaagacagcagtcctgcttgtgtgcaaccagaaaccaacccataccctaagccctgccttattatctgtgccaattttttcttttgttttttcaagacaggatcttactctcttacccaggccagagtgcagttgtgtgatctcgactcactgcaacctccacctcctaggttcaggtgattttcctgcctcagcctcctgagtacaggtgcgcaccgttacacctaatttttgtattttagtaaagacagggtttcgccatattggccaggctggtctcaaactcctgacctcaagtgatccgcctgccttggactctc

SEQ ID NO: 48492 - DNA, 1068 bp, Homo sapiens
tgccccaactcaggcacccccacctcacacccccaggagagagtccttggccacagagcgatgtagatttgtgtgcctttgttgtcctttttgatcagcacagctcctctttccaatctcctttccctccctgggacccctgttactgcagagctgttctggtgagtccggtttttctcgctccactgtgtgagtttctttcctctttcttcccctgctgtcctccagccattcatttcgtgcccctgcctttgtcagtgctcagcactgcctctgagtgcgtgcctggtcatcatgtcagtgcttttggttagatgctcttttaaacttccgggaacaaagatcgaacgcggagttgtctttggaagttaaaaagttcacaaacattgggaatgctcattcagaaggtggcaccaacaccgctcactccatggcttcagcgagtctggcggtgccctcacctgtgggtcccatgtggatttccctgtgcacctaaaggctgtgaattgtgaagcattcagtaataaagattcattgttgagaatttattaacgtgtcagaacataagtagggaaacctccctggaatgttgtagaatgcaggcttttgggagtcagctagagtgcgtggatactggatgcctttctgaatgtgtgcttgtgggctgtccctactggcagggtcaggctcgtgtgcttgcatgggcagcttggcctccagaggttcctccgttgggggtaggggaggaggccatccttgcagctcgtcgcttggaggacgagggctccctggggctctagcctctccttggctcccagcactcccttcgtggcccatcagaggtctcctgctgcccctgagcctttggaagttgcggcaggaggaacaagggaggcatagcagcccttaacccgtctcgggttgggctgtgatgcagctggtggggttcccactcctgtgcctcagttgggtccctcacatctcccgaaagtctggggtcagggccaacccccacatctctggtgagtgcgtgtcaggctgtggagctgcatctgtgaccctccgggg

SEQ ID NO: 48493 - DNA, 1032 bp, Homo sapiens
ggctttcacctgaattcaacgagggtgaaagttttagaaactgcagtaagatctcgcaaaggtgaatcccaagagtgaagcgtgtgggtttctgtgagggcccagatctctctgaccttttgctgtctggtacaaccacgcaggaatgtggccggctggaacgggggaggggggtgagggaggcgaggataggtgtcatgtagggaggagttagagcatgggtgttaaaggcacaggaatctcagtgtctacatttgtgaagtggaactagtagtagaattcactttgtgggattgttgcaaagaccagttacgcaggaacccatcaagttatgcttagcaagtgataattgtcatcccttggacagataaataaagtgaaaatcagagaggttaagggcattgcccgagtcgaacagcttgtcagggatgatgtaggcagtggagtcctgccttgcttctgttgttcctatgctgggtgcattggtcagctgtagtgtaagctgcaaacacccaggtagcccctaggttgtgcctttggattttgttgctcattagcacagggaactaaagaacagagactacaagctttgctcaagatctttaggtgaattaataatggaccaggctaacctaaagctgtccttctcttgtgtagtccactattggcaaagtgagggatgtttctgcgtgagtccttttgttgttgggttactgtgctgatcccctgaatcctttcccaaaacaaatactaatcttccaattccttggtaagattagatgtatctctgcattttaggtaaacctaagacttttctttagtgagggctgatacattaaatttcaaaagtagtggcagatgaagcagcaagtttcaggcttggagcaaaaggacacccatgttgaaagagcagaggctttgacgcagttgcctctggcacttggatctctctgcacgttccagacaagtatgtgtccacccccttccctgagtaggcatctccagggcagcctggccctaccctgttgcaca

SEQ ID NO: 48494 - DNA, 1025 bp, Homo sapiens
taactccctgactctgtcaatgcaggccacttttgcctatttctgtacttgtaagtggaagcatacaatagacacatggagctttgatagattttcttaacaaaaaactgcattgatttagcacaccatgatccaactgtgtgtttagaggtgtctcattttagattgaaagacacaagagtaaaaggatggaaaaagataccccatacaacagtaaccaaagaagagcacaggtggtggctatgctaatgttggaccaaattgactttaaggcagaaattattatgcaaggcaaaggaggacatcatgtaatgataagagtcaattcaccaggaagatacaacagccatacacatatatgcaccaaacaggaaccccaaaatatgtgaagcaaaacttggccaaattaaagggagaaatagttcaacaacggtgggagtttcaataccccacttttaataatggctagaaaaacaagacaagatcagaaaagaaatacaatacttgaacaggactataagacagttagagctaatagacatctatagaacactccgaacagaatacatattaaatgcatatgtaacattctccagtctagaacccgttttaagcaacaaaacaagtctcaataaatgtaagacgattggaattatacaagttatagtctccagtgacagtggaataaagttagaaataacaaggagatttgggaaatttacaaatatgtggaaataaaacaacatacttcctaataaacaaggagtcaaagaagatatcatacaaaaggtagagagatctgaaaaataacctaacctcccaaccttaaaaaactagaaaaagagaaacagcccaaagcaagcagcaagaaggaaatagtaaagattacaacagcgataaatgaaatagggatgggggaaaatggcaaaagataaacaaaactgacaaacctttaggtagaacaagaaaaaaagttactaaaataaaaaataaaattgtgacattactactgattttacagaagt

SEQ ID NO: 48495 - DNA, 1030 bp, Homo sapiens
catcacctgcaaaaaataggaatttagcagtacgcttttttctcttctgatgtcttttaagtgtggtgagagtgtagtcctgccttctccttttaaggggagagtgggtaactcaaatgcatcttcatttaccaatgcttctccattatttattaatgcattccattatttgttatgtttgcttttgttttaaatctatccaggtaagatttactctattgatgctctttttatgacataaagaaaaaaaagaaaattaccacatccacttttcaagtgcttcagttgagaagagttcaggctaaattatggtgaaagcatcttagcatagatgacattttaaattcctttaaaaatattagtttgtggcagaaatattggtagtttgcctcaggcaatctatatggtttacttacttgttggcttatcttgtttcatagcagatgctgaatatagattttaaaaattgaattggtttaccctggttttatgttcctgggcaaggtcttctgatcacagtgaataactcttaaggtaaatggttacttctgtttgctgagattttgtcaggtttttgcatctgtgttgggcgtggagttggtccatgagtccctgccctttggaagggaagatctgttgaaaccagcagataagttcatgacatacctgctgaacattcccgttgagtttgtaatgtcttttcttctcccttagagaggacattacaaactcagcaaactgaacaggagtgttcaacagatacatcaggaactgatagggcatgtctttctgttttcctttctcattatttgtttgagtggatatggttgtggacagggacactttaggccgagacctgagctcaagacctgctgtgctacacagcacccagactccctcctgggcatgcactccctgggtcagttctcctgtgaggcaggcctgctggtgccgatgcccatcttgccaatggctgtggggtggaaccagcaatgcagtagctcagtcctcacgttgcctgtggggactg

SEQ ID NO: 48496 - DNA, 1050 bp, Homo sapiens
attccagcccaggatcccttgatctcccaaatgaatttttaaaacaattcacatactaatattaaggttcactttttgtttttataaatgcagtggcatttatctaccattacaggatcatacagaatagtttcactgccttaaaaaaaaaaccctatgcttcacctgtttaaatccacccccgtcaacctctggcaaccactgatctttttaccatcattacggttttgccttttccagaatgtcacataattggaatcatacagtatgtagcccttttcagactggcttctttcacttagcaatatgcacttaagatttatccatgttttttcatggcttgattgctctttttttttttcttaaatcacaataatatgggtgaaccacaatttatctgttcacctattgaaagacatcttagttgcttctactttttggcaaatatgaataaagctgctttaaacattcacgtacaagttctagtgcaggtaattaccatttgggtaattacctgaagagtctgatcgctggattgtatgataagactgtatttagctttgtgagaaactgccagactcttccaaatgcgaataccattttgtatttccgccagcattgaacaagagttccctctcctcaggctccaccctcatagttcatcctgtggtgggaagaactctggggattgcgaggagatggcgtaagattctcctgccacttgctgactgtgaaccttactggtgtctctttctaaaacagtgctaataaggtgaagaagtgtgatgagggtttgagatgaagtcaggagaaaacccgggctgcagccatgctctcctgtggctttcagcccagcctggcccagactgctgtgcccactgtgccatcctcccctcgtttggaacagatgccgtctggacagctgcgtggcagggcccccaagctgtcccctcttgccctgactacaagctgttgaatggagatttgtgtcagggcagccagctgccatggaagatgagggctggtccccaggccccaggactggcttct

SEQ ID NO: 48497 - DNA, 1028 bp, Homo sapiens
tagtagagacagggattcattacgttggccaggatggtctcaaactcctgacctcaaatgattcacctgcctcggcctcccaaagtgctgggattacaggcgtgagccaccgtgcccagctgctgttactctaaccttgagaaattttacaagttccaagtgataactaattataatttgtatataaatatgactccaaatgtgtcttggccatttgaatttgctattctgcaaattgcctttataaagcatttatttatacatttctctttttggattgtttatcttattaatttaaaacagctgtttatgttaaagggagtaactccttttttaaaaaacatccattccttgtctcgactttgcatgtgatattatcccattcacataattttattttctacatgtttaaatgtgtattcttttacagtttctgaatttttaatcttaaaacttaaacttcacatataatattttaaagtggtcttctgtatagtttgtgtatcttttgggaaaatgttgctttgctgaaccagcgtgcaatccccaaactcctctctcactgctttatcttttttttttttttttgagacggagtctcactctgtcgccaggctggagtgcagtggcgcaatctcggcacactgcaacctctgcctcccgggttcaagtgattctcctgcctcagcctcctgagtagctgggactacaggcaccctccaccacgcccggctaattttttgtatttttagtagagacggggtttcaccatgttggccaggatggtcttgatctcttgaccttgtgatccacccgtcttggcctcccaaagtgctgggattacaggcatgagccaccgtgcccggcttactttatctttttttaaatttaacttttattttaagttcagtagtacctgtgcaggtttgttacacaggtaaacccatatcatgggggcttgttgtacatattatttcatcacccagaacccattagttatttttcctgatcctctccttcttcccact

SEQ ID NO: 48498 - DNA, 1029 bp, Homo sapiens
taaagcagagaaccccaaatgattaatgaagaacaatgaatttttgatagaaacaaaagatcagaaaaaggaagcttaaatggagaaaatgaaaagactgtatgtttgggttcattgataaaatagactgcagtgactaatggaaagatgtgtgttagtcccttttcgatggccataacaccgggcaactctgtttccatggccgttcagggacaaagtttctagaaagtcattgtaccaccatcccctagggcaagggctgacaaattttttgtaaaggcacaaaagtaaataggctttgtggaccatatggctactgtcacaactgcttatttctgcagttgtagccccaaagcagctatagacaatacatcaatgtatgggtgtggctgtgttccaataaaaactttatggacactgaaatttgaatttcatataattttcatatgtcgtgaagtagtattcttcttttaattttttgaccatttaaaaatgtaaaatacattgttagcttttggatagaggcctggatttggcccaagggcttcagttttctgacccctgccctagggcattgccagcttcatagaactgggtgctgccaagttggaatatactggtgggaaaagaagaggtttgtaggagacaaacccactttcttaagacattggccttatcacttccactgatgagtgaaaaagagttactcagtgccacctagtgacaaatgaagctgaacaaacctagtgttgtgaagcagccatgtgcttggctacaagcttaatattgtgaaggaagggcacaggtttgatgaacaactttcagtcttctcttctgatgtctagttctttcctgttatgtcttctaccagatgcatttatcacatcagtaccccaaaccagggatgaagaattgaaccataggccagacacggtggctcacacctgtaatcccagcactttgggaggctgaggcaggcagatcacttgaggtcaggagtttgagaccagcctggccaacatggtgaaa

SEQ ID NO: 48499 - DNA, 1070 bp, Homo sapiens
atattttaaaatcagttacatgtcactgataaaagacttagtattaccatgatgttatttttcttgaggcaacatgatgaaacccattgtctacaaaaaatccaaaaattagccaggtgaggtgtgcacctgtagtcccatcttctcaggaggctgaggtgggaagactacttgagccaaggtggtggaggttggagtgagcccagattacaccacttgcactccagcctgggcaacagagtgaggccttgtctcaaaaaaaaaaaaaaaaaaaaaaaacaacgatttttatgaaagttggagaaccaggattaagactgggtgggaactaagaatgacaggtacttttaacaatacagctgggatgctgttgatgacatgaatgaaccccactcttactgtagtcatttgctcaagattcaaagtcatgaaaaagagtagaatggaccaaacttaggtactaagagtccccagcctggcagtgaaaacagtatagttcctttgactttaatatggggaaacaggttcctggattgacgatctcaccaaaactatacacaatttttttttattttttctcagacctttcagggatgaatatatacaatttctgagaaagaaacctgagtacctttaggaagggaaaaggaatgctgaatatccccaaataacatgtcttacatgtttggtaagacttactgtaccctgtcctagaagatagaagatgccctgcccttagaagacaaagagactgtagagctatgccttctaaatcttaagccactcttcagataatggatcccttcatggtcagcccaaacatctcaagaacttttaatttgtaccgtttgtctttttttccatttatttaataccacaaattcactttattattatgaagccaatatctacatcttctcacaaagattctcttaagaaatgcagaactggccgggtgcagtggctcattcctgtaatcccagcactttgggaggccgaggcgggtggatcacctgaggtcgggagttcaagaccagcctgacaaacatggagaaaccctgtctctacta

SEQ ID NO: 48500 - DNA, 1041 bp, Homo sapiens
atttttctctcagggcagcccggagagaaatgaggccgtacatggtaaactgaggcagaggtgggaggggtgcacaggtgccgctaccgctctgccccttgcatccctgaacgctgcctcacccttgccgggttggcggtgttgagcccgggactggaggctgcttgagaccacctccttcccagctgaggagcgcggcctttgcccctcctcctcccgacctttccggggctacctaaaagccgatcaagccgccggttttctagctgttcccatttctttaccgcccccttcctctgccccgcctgcctctgtgccctccgtcacgtcacagcccgctggctctcacgcctcttttggtctctctgcgcacatctcggtggcgtctctggtgccctcacatcactgtctggaatcttgtttggcccacgccgtctgcctctgccccttctctcacctgtgtcgtttgatccctccgactctcgtctctgggggtcttgcctcccgaactctccggctctctccttccagggcgtgcgctccgctcagtctccctcggtctcggtcggccggcctctttcacgtggccccctcctttttggcctcccttccgcctccctcccttctgggtccctccctccggctcagcctaggggttgggggcggcggcgcggggcggggcggggcggggcggtgacgcggggctggccgggcaagaggcgcggcggcgtggggagggggcgcagtcccgggttcgaccggccgagccccgcgcgccccgcccgcgccctgcgcctccgcccggccggccggcgggggagggggcatgagccggcgcccgcgcgccgccccgagctgcgggccggcctagagccccgcgcgggccccgcgccggagccaagccgtcgccgccgccgccgccaaaccgcgggcgcagcagtgggcgccgcgatgcagcggccgggggagccgggcgccgcgcgcttcggcccgcccgagggctgcgcggaccaccggccgcaccgctatcgcagcttcatg

SEQ ID NO: 48501 - DNA, 1075 bp, Homo sapiens
ctattttgtcctatctattgataactaaattcagaagctgtactaaaagtaaaagttataaatacatcttctcttaatttatttttttttgagatggagtctcgctctgttgcccagtctggagtgcagtggtgcaatctcggctcactgcaagctcctccttccaggttcacgccattctcctgcctcagcttcccgagtagctgggactacaggcgcccgccaccacgcccagctaattttttgtatttttagtagagatgggatttcaccgtggtctcaatctcctgacttcatgatccacccacctcagcctcccaaagtgctgggattacaggcgtgagccaccgtgcccggccccatcttctcttaatttttaaagagcaatgattacagtcagaaaaactcatttgatggctagtattcttgaattaaaagtacgatgccaaagtgaaatctttttggttttcaacatcgagctttttcatgtcacaattatcttgggattcttttccacttactgcatattgtgaaaactcacctgaactcaaaactctaggtaaatctaaaaacctttatctaggaatccatctttaattcatttgtaaaacatactttctctgcacacatttcctttctcttcttttaaccttaatatttggatttagggagcattaagttctttgactgtaaagtgaagaaaaagatacgagatcaaaggaatgggagataataaagaagaggccactagttaaaatgtaaaatttcaataaagagtaagttaagacagttgttcatgttattaccaagggtttcaaacaccaagggtttcatccaggtcctgctgctcattggagaaaaagccaatcactgaggcgacaagcactgccaaggaagaaagctttaacctggtgctgcagcccaggagctgggaactcagtctcaaatccatggcttgactaataggggcaggaaagaaatgtaacaatgtataagagaacagaaattagggaggagcaggaggcatatggtgctgtgatttgttatgtttgttatttgatacttcctgaaggtc

SEQ ID NO: 48502 - DNA, 1084 bp, Homo sapiens
tatctttatgcaacttgctttcttcattcattcaacttttgagatttatgtatgcagataatgtaggtacagtttattcatttaaactgccatatagcattccattctgtaaataaataatcatttattcatttctgtacaaattcacagcaagattgaatctaccttttacaaacagtcctgtttgtctccctaacctgtaagaagaaatggtagcacgttgctaccagttgttctccaaagtgtttgtgcttatttatttatgttcctatcagaaacatcctggagttctcttttctctgtaatctgatggatttcccactacaattttttttttttttttttttttttttgagacggagtcttgctctgtcaccctggctggaatgcagtggcgtgatgtcagctcactgcaatctccacctcctggattcaagcaattctcctgtctcagcctcctgagtagctgggactacaggtgcccaccaccatgcctggctaatttttgtatttttagtagagatggggtttcaccatattgatcaggctggtctcgtactcctgacctcaggtgatctgccctcctcggcctcccaaagtgctgggattacaggcatgagccaccacacccagccctcccactacaaatttgatgttatagtttgtattgaacaacaaacaacacattgaagtactaaagaattaattagggttgaaagtaatttctggacatcagaaaatggggataggaatgccctttcaaaagctactattttgattaactttgaataactatttgaccatttcaagtagttacatcaaagaaataaacagacaaccaacagagtgggagaaaatattgcaaactatgcatctgacaaaggactagtattcagaatctacaaggaactcaaatcaagaaaaaagcaatcccatcaaacagtgggcaaaggatatgatagatatttctcaaaagaagatgtacaaatggccaagcatatgaaaaaatgctcaacatcacgaatcatcagggaaatgcaaattaaaaccacaatgagataccaccttactcctgcaagaatgg

SEQ ID NO: 48503 - DNA, 1002 bp, Homo sapiens
gaataaatttgttccatttttttaagttagagcaattggcgtatttaattgatattcacagtatttgaatagcatcccagaatgcacaaataatatgctatcatgagaaaattacatatactgagatgtaaatgaaaggaaattctttttttgaacttaaaatatcatttgtaacttatgtgtaattttttaattaaaaatcatagggcacatcatactgtaagtttgagtatgcagagtgaaatgagaaaaggattcaggcagattaggcttgaggacaggaggcaaagccccaagagtcagtccaggtagggattataaatggcagggttcgggaggagtggacataaaaatgcgagagaacaggaaactgcaggaagtaacagttagtgggaaacaaagagagaagttactgagaaaacagacacaaacactgacgtgtttcggactgccatgtgaccaccactgaaggatgataaggtttactgagtaggaagatttgaaattatggacaggagcaatatgtaccaaggaaagcaaatattttgcttttcactggatggaaatttctcccttctaggaactcctgaccttctttatgggaccaagcagtgtaagttgtaggcttgtggttccttctgacttcttgtgtcttctccctaggggcaatgatggtgctggggtgtgatgttttcagtatgaagttgtgcttggaggcagtggcaagagccagtgggagcttttcatggagcaggctgcattaacccacgcgctgtgtgcctcctgaagctgtggcagtagtggcgtgacacctgccttcctgggagcctgggaagaaccccaggaagagacagtgaagattgcatctcttgtgggagatagaaaagagttcagtttagtattggcagtgataaatgcttgctgtgtaggcaaacagaatgatgaaacagaagacattaaagacctctttctccccctaattaggataggttctagacattt

SEQ ID NO: 48504 - DNA, 1049 bp, Homo sapiens
ttcctaggtaggttttaattttgtttggaagttttgttttattttgtttttttcattttatttacatggagttctgcttattataattctaattgtatcagattgtttcttagtgatttgccagtgctcagatgggccagatcaagacatctattgccaattaggaacaggatgtttatggtatttactgatgttctccggatgacctgttttatgttttcagtttgttttgttttatgatcatgttggcttttccattaaactataactttaactgagttggcttagttagtaaaacattgaccagctccccttctctatcctccaggccccttctgatgcctcttcccctattgtgccccagcctcagtctgaagggaagcgaatttttaggtctctatgttccagatgtaatctatatttccaagacataagctcactgtatttcaacctaaattgcctgagtaatgctccttggaacatttagggataaatccctgtgaaaagtaaatttaaacagtgacgtctgtagtgggaggtatttcttaatgaatagccactagtgaggatgtgtggatgtctgcactacacgtggctgcctgatcgctacatctgttttgaagttcagtgatttcccagaccacatgttcatttctttagggggctgacatccctcccaggatccagtcattgtgagctggtaactgtaactggcttactctttttgacctagagattattatactttgtcttagtttgactattgttcctatcagatctgacaatattggagtttctataaattagcagcatggcagaggaaccaagtgtatttaaacccataaatcatgatttccaggtcttttaaaagctgtgtggtttgaatagtactttactctatggtagacataaagagtggttataaaaattctggctaatcaggaggcttttgtagttcagctgaaactacaaaataacctcagatgcgtcactcctttgggaatcagaccatccagatttgtcctggctctgccagtgagatcttttac

SEQ ID NO: 48505 - DNA, 1030 bp, Homo sapiens
aaaactactgaatggataaaattatttaaaatttaataattcagaattttttcccttctctttttctaaaaggtaagactacccagaattttgttttattttgaactgatctgttacaagatcactggaaagagccatgaaagaattacaatgtgtgtgtgtgtgtgtgtgtgtgtgtgtgtgtgtacatgtgtgcacacaagcactgacaggtcctaagtccacatctccaggtcgaacctttcccctgagccccacattttcagctgcctgtgtgacatctccacttgggtgaccatgagtatctcaaactaaacatgttccagattaattcctgatcttttccccaaaactttattctccctccaggcttccttaactcagttaaaaagcagcttcattcttcctgtttcctcaggtcaaaagccctggcatcatccttggctgctcttactctcccatctcacctcaagtctatcaatccatccagtctgttgattttatctgtgacacgtgtccagaatctgaccacttcctaccagcctcactgcttctacccccatccacgccactgttgccctctccaggaacattgcagtatctttgtgtgtgctctcctagagtctcaaccagaaggatttttttttttttttttttttgagaaggaatctcaccctgtcgctcaggctgaagtgcagtggtgtgatctcagctcactgcaacttccacctcccgtattcaagtgattctcctgcctcagcctcccaagtagctgggattacaggcgcctgccaccacacccagctaatttttgcatttttagtagaaatggggttttgccatgttggccaggctggtcttgaactcctgacctcaggtgatccacctgccttggccttccaaagtgttgggattacaggtgtgagccatcgtgcccagccaagaaggatctttttaagtgtctctgttcaggagcctcgggtaggttcctgtcttattcaaagtgaaatgcaaagtccatgcttggctc

SEQ ID NO: 48506 - DNA, 1043 bp, Homo sapiens
gcagaggcaaggtgaaattcagagatgaggccagggatgttagcgattcctcttccacagctccatctactatttttattacttttaagtaacaaacacattactgatattttttttctacctgcgttctatttgcttgactttctacaacctcagggtttttttttttaaagattaattgataattgaatttttgtatttgcctgtataggggatatttattcattgcttttccagtatccatctcccctcctttcccgccttcttaatagtaccctgaatttcccagctgtgcatgattcattctgggtgagaggtatcttatgtggctcctggagtgggtcctacctggcttaaccaacacagcttctctgttcctctggccacactggttggtcaagatgagccccgtcaaggctgatgagattcagggctgtaacatttgtttgcaagattgggaagtggattgtatctttcctgatgaacatgaattaagtagcacataatccctgaagttgctgttggtcatgtggaaccatgagatcagagcgtctctggaaatggagttagtcctgacaaaacatagctgagaaaaacagcaagagaaaacaggtcatattcacattgtgtggaccctggatcaagtcttttccaggcataaatgctcgaatttctttccttttctatttgagctgtttggttcaggattttgttactaaaagccaggagtgttttgagataacattgtttggggcataaaaaaacatttctttgaaggtttttgaaactcagggacacatggacacaattgcaagaaaaaaatcttatttattcaaggatgttatgaataaatagtgaatttaataaagtactttcagtttcttaaaaattgctctaatttgtatttgttttttcactgccattcattgtagaagatatatgcattcaataaggcatccttcttcccagcctcagttaattttactcctttgcacaatcctgaagtgagttcataatatatgtttgtcactgatatggtttgg

SEQ ID NO: 48507 - DNA, 1035 bp, Homo sapiens
taatataaatttttctaaaaaggaaggcatttatttcaatagacgctcacctgtccaaatccaatttttttgtttactgataaagttgtaggtggagtaattgccatagagaagagaatacaccctatctacacttccaaaaatgaggattgccacatttagcaaataaaaatatggtatccccagttaaatgtgaatttcagaaaaacaatgaataattttttagtgtaagtatgtcccatgcaatatttaggacacacttgtggcaggtagaaaaggggccaacaaagatgtccatggacagatattcctaacacttggaacatattcccttacatggcaaaaaggattttgcggatgtgattaagttaaggcttttcagagggcaggtcgtcctgggtgaagtgactggtccaaatgtaaccacagagtccttagaggagggaggcaggagagccagagttagaaattgaaggtggaggaaggaccaaccagctgaaggatgcagtcgtcttctagaagtgtgggaataggcaaagaaacggactctccttgaagtcttcggaaggagcatggccctcctagacactgatttgagccccaggagaccccggggctagctacctgcagcagtgttagattaatttgtgttgctttacaccactgtaatttgttacggaaccaataagaaactcagataatgcttatactgaaaaagttatttgttgtttatctgaaaatcacatttacttggggcatcctgtatttgtcctggcagcccgacctagaacgccagagcaggaagcagccggcagtggtgggaagcactgaaacagcttcgggaggtcccactgtctcgcctggggagtctcttcagattcaggcctccagtccctccagggaaatctgaggagctgtctggcctgggtgatcactgaggctccctcgcagtccgtgagcctatctaagaaaaagccttttgccaatacgaataaaacaaccagcctaattagcgaatgttcacagttcagacaa

SEQ ID NO: 48508 - DNA, 1089 bp, Homo sapiens
atttatctctgggttctctattcagttccactggtctatatgtctgttttttatgccaataccacgctgttttggttattatagctttgtagtacgttttgaagtcaggtagtgtgatgcttcctttgttctttttgcccaggattgctttggctattcaggatcttttgtggtttttttataaattttaggactgtttcttctatttctgtgaagaatgtcattggcattttgataggaattacattgaatctgtacattgctttgggtagaattgtcaatattaattcttctgatccatgagcatggatgtctttccatttgtttgtgtcctctccaatttctttcatcagtttttgtcattttccttacagagaaatttcacctccttggttaaagttattccttgtgtgtgtgtatgtgtgtgtgtgtgtctattataaatgggattattctcttgatttctctgtcatattctttgctattggtgtatataaatgctactgattttttttttttttagacggagtctgtctctgttgccaggcagatcgtgcagtggcgcgatctaggctcactgcaacctatgcttccccaattgaagtgattctcctgcctcggcctcctgagtagctgggactacaggcccactgccaccacacccagctaatttttgtattttttaagtagagatggggttttaccatgttggcaaggatggtcttgatctcctgacctcatgatccatctgcctcagcctcccaaagtgctggggttacaggcgtgagccatcacacccagcctcagtgatctttttaacgagttgttgaattcagtttactagtattttgttgaggatttcccaaccatgttcatcagtgatattggcttgtagttttcttttttggtctggttttggtatcagggtaatgttgaccttacagagtgagtttgcagttattccctcctgtccaattttttttttttttttttttttttttttttttttttaggagtttggttagagtttggtttagaattcagcactaaagtcatcaggtcctgggcttttctttgatgagagacatt

SEQ ID NO: 48509 - DNA, 1006 bp, Homo sapiens
gcctcttttatttcttgaaatatatttcttcaaatatattccaactggtcattgtgcattctgtgcatgggcattctttttttaattattatttcaataggtttttggggaacaggtggtgtttggttacatgaataagttactaagtggagatttctgagattttggtgcacccatcacccaagcagtgtacactgtacccaatgtgtagtattttatccctcaccccctcctatcctttcccccaagtccctgaagtccactgcatcattcttatgcctttgcatcctcatagcttagctcccaattgtgagtaagaacatacgatgttcggttttccattcctgagttacttcacttaaaataatggtctccaattccattcaggttgctgcaaatgccaatatttcgttcctttttatggctcagtagtcttccctggtgtatatatacaccacattttcttcatctactcgttgactgatgggcatttgggctggttctatatttttgcaattgcgaattgtgccgctataaacatgagtatgcaagtatcttttttgtaaaatgacttcttttcctctgagtagatacccggtagtgggattgctggatcaaatggtagatctacttttagttctttaaggaatcttcacagtgtttaccacagtggttgaattagtttaccttcccatcagctgtgtaaaagtggttcccttttcaccacatccatgccaacatctattatttttcaatttttttattatggccattcttgcaggagtaaagatatcgcattgtggatttgatttgtgtttccctgatcattagtgatattgagcattttttcatatgtttggtggccattcgtatatgttcttttgagaattgtctattcatgtccttagcccactttttgatgagattgttttttcttgctgatttgtttgagttccttgtagattctggatattagttctttgtcagatgtatagattgcaaagat

SEQ ID NO: 48510 - DNA, 1021 bp, Homo sapiens
ctcaagcggcctcctgttcccttgggaacttgagggggtgtcgggatgtgttccctttctgcactcagctgggaaagagctggtggagaattttcccttctgagcagagagagaattctcttcacctcccccgccccgcccccgcccactcccacagccaccagttctctgggcaaccctagttagcagtttgggcctttctttctgcacacaattgacctggagggcctgagtctggtccattcagaggccacatggaacactctgtttttgtcactgccctctcatcttctagaagcataaccttatccaacagaaagaggcaaaagcgattgggcccgacctctcccagtgacagtgtttgcacttcattccatggcacagcgtcttctgtaactttaagatttaacatttcagattattttccactggggctcccatcgatgctgagttctggctacttttttcccctgatgctgaaaggttcgattcttccatctatccatcaacaaatcacattgaatgacggtgctcagtgacccaggatgccactggagacaaaacacactatacatattttctggtctccctggaaaattagtgcaaacactttcatcactgcggagaagggaaatatgcgcggagctgtgaaaatctgctttgttttttgtttttctaagaggagatttccccctccttcaaacagtgaaatttatattgttctttgtctgcaaattaaccagttaagtagaattcctgtatgtctctttcactttctgcaagccaaggcccctctttctctccaccctgtattcatacatagtccaggatcaccccctgtccccctccaatgctgcttgaaatttcattccattttcgtcctgacttgttcaaagtaacatttaaaatattttaattcaaattcttatctcatccatcctgtttaagttccattttaaagaatcttcttttcttatgaatggtctgtttttgattcagtggaaaacttgggctgctcaac

SEQ ID NO: 48511 - DNA, 1034 bp, Homo sapiens
agctagactctcctcgtgtctacggcatctcttatgatcattggctgccatccaggaccccaatttgtgcttcagggggataatctccttctctcggatcattgtgatggatgctggaacctcagggtatggagctcacatcagttcatcatggtgggtgttagagaattcggtgacatgcctagtgctgagccttggctgggccatgagagtctgtatactctaaaaagcatgcagcatggtgcccctcttctgaccaacacacacacgacccctcccccaacacccccaaattcaagagtggatgtggccctgtcacaggtagaaaaacctatttagttaattctttcttggcccacagtctcccagaaatgatgttttgagtccctatagtttaaactccctctcttaaatggagcagctggttgaggctttctagatctgtttgcatcttctttaaaactaagtggtgagcatgcattgtggtgtagaggcaggcattatgtaggataagagctccggggggattcttcatgcaccagtgtttagggtacgtgcttcctaagtaaatccaaacattgtctccatcctccccgtcattagtgctctttcaatgtgatgtgggaaagcaggaggatggacacaccccactgaaagatgtaggcaggggcaggtctctcaaccaggcatatttttaaaagttgcttctgtactggttctcttcttttgctctgaggtgtgggctccctcatctcgtaaccagagaccagcacatgtcagggaagcacccagtgtcggctccccatccaaatccacaccagcaccttgttacagacaagaagtcagaggaaagggcggggtccctgcagggctgaagcctaagctactgtgaggcgctcacgagtggcagctcctgttactcccttttaaattacctgggaaatcttaacagaaaggtaatgggcccccagaaatacccacagcatagtgacctcagaccctgatactcaccacaaaacttttaagatgctgat

SEQ ID NO: 48512 - DNA, 1072 bp, Homo sapiens
taccaagtagagagttgcccaactgagttaaatgttttggtctgtgttttattttagttcttagtttgattttagcttttcctttgttcttagtatacactttttcaggcactaacgttatcattatgatataaaagctcaatgtcaagtagagtttcttttgcatatttactttctcgtttaacacaaatataacaagcaccccataagtgccatttgcacaacagcaaataatggggacccccatatccctctgtgtagcctaaggtcttttaggggagagacaagttcacaggcaaaaccaggggaaatgcaaggtgtgctggggtctcatgagttacaggagggtctcgctcagccttgtgggggatgctgaatgaggaaacttagcctgaattagagcccccagctggaaacctggcagctggaatcccagcgctctcctctcagccggggttgttcccgcccagaaatatcagggttcctctttcaagcacttaaaagggcttcccattttctaggatgggatggattaacctgataaaggcctcaccaaggtcaaataaatgagcagacactgtatatgctaagccgtcagaaatctaattggcctgtttatgcttcagctagatggatgggatgcaaatgtcttaatgtggctgctgatacatgccccagccgaaagttccagcagtttacattagaccaagacattggctgcttggtttttactaatgtagttcagaagtttctagtgtttacaatagctgtgaggtatttgtatttttatggggattctctctcctttcatctgatgtcaaaacatatatagacatggcagcactggttgcctgttccattttatgaaccagaggaccattaacagatagatatcttgccccccccttcccagaacatcctgagcctctcccctaccccagcccacttccatcagagttgccctagaaatcattagttccagaaacgcatccctgcgtggagtctgtgccctccagccatgcagagtgtctgccagaggctgtccctggctgacaggtttaccttggtattc

SEQ ID NO: 48513 - DNA, 1033 bp, Homo sapiens
caacatggtgaaaccctgtctctactaaaaatacaaaaaaaaatagccaggcgtggtggtgcacacctgtaatcccagctacttgggaggctgaggcacgagaattgcttgaacctgggaggtggaggttacagtgagccgagatggcaccactgcactccagccttggcaacacaagactgtctcaaaaaattatatataaaacaaaacaaaataaaaatgcgattactatgattttatcctttttcctatgggagaacaacccctacaagataaatcagtttaagtgtggtggtgaaaacaaggtattaactagacagcttctctttgtccaggaagagtcagtggtgctccctggggtctgaccttgtgcctcttctgttccaggtagtggtgatcttcctttttctgggcttgctgggggtcagcctttatggcaccacccgagtgagagacgggctggaccttacggacattgtacctcgggaaaccagagaatatgactttattgctgcacaattcaaatacttttctttctacaacatgtatatagtcacccagaaagcagactacccgaatatccagcacttactttacgacctacacaggagtttcagtaacgtgaagtatgtcatgttggaagaaaacaaacagcttcccaaaatgtggctgcactacttcagagactggcttcagggtaagacggcgtgggaggctctcgtcctttcggtcttttgcgtgttcagcttcaacaggttcctttgtcatgattatgagagcgttagattagaatgtaacactgacgtgtttcatggacttttaagagttgctcaagattcttacatgaactgtttctgcagcagcctcccagatctggcttttacctataaaatgatgcagataattcagatgagcttctgtgagaatgtacaagtgcacgtcaggaaaaggggagcatgttgtaacaggtggagccgaggcttctggtgctctttcctcttggatagacggtggctagtttggtgaccacata

SEQ ID NO: 48514 - DNA, 1046 bp, Homo sapiens
ctcactgcaagctccgcctcccaggctcacgccattctcctgcctcagcctcccgagtagctggtactacaggtggctgccaccacgcccggctaattttttgtaattttagtacagatggggtttcaccgtgttagccaggatggtctcgatctcctgaccttgtgatctgcctgcctcaggctcccaaagtgctgggattacaggcgtgagccaccgcgcctggctcgtacactgttttatataccacttgcagtatcatgattgtataaatactaaatatctattgatctatccaaaactacaacataagtatttttggaatatggaggagtgggtgctgagtatgcatgggagaagggaggctgaggtgaaggtgggagagaaggagacagtgaaatattcatcttccaaattggaaactcaaatagataatgcctaaacatgaaatatcaatagaaatgtaatatttaaacatatggtggtgcttctgggaaaaagaaaagaggatggagaagactgtttgtttgtatgtttgtttgtttaaacaagcaatatggatgaaattacaggctaagctgctttagcaaaaagacaccaaaatacagaagcttaaatgaggtaggtataagtttctctgtttgatatgatctcaagagaagcaatctgggttggaaagtcacctttatgatcctcaaaacgtagcttccacctgtgggactaaggcagccattctagttttgtcttcccagccagagggaaggaggacagggtcaggagagcacatgtgcataactgataggaacatgccccagaagggccacacatccatcggtcaggatgtgggcataaggaccacagctgcatgggaggctgggaagcatagggtctagctgttagccacgtgctcagctaagacactggagccctgatattaaagaaggtgaggaatgatgctagtgctcaaccagcagtctctgtcacatcagctttgcagaatcatttgattctttcaactaggtgcatatacaacttcaatacaaatg

SEQ ID NO: 48515 - DNA, 1049 bp, Homo sapiens
cctagatgatcccagtgggcctcaaaacccaccatgggtgatgtgcagagtgcctcagggcagttaggactagaagacctggcatgcacggcagtctaacaggaaggagtttagttttctatttacctgcaactgaatatagatttccaccttgcatgcaaaagcccgcttttcagtcagcggcattcagagatctgatgctggataacagcttcttcgaaggaatgttcttatttttttgaaaatctgaaacacaagaaaagtattattcttgggcaccaaataaagacctggtaaaaatccttattgccacagaaagtcatcatcttctaacattgtgagagatagaacttggaggcagcaaacactctgcaataatacatcaacattcagatctctttgaaagaaagtttcccattatagacttggctacttgttatactctaggtgaagaccacctggagggaaatgtctacacagcgactcatttcttctactagaagatgtcaaaagtagaagctgcttagtcatagcaagattgctgtcaccagtgaacatgtcaactgagtcatacaaggaacgtctaaaatggacttctcagaagttgaaaatgttgcttctcttgattagtagcgcaggaaggggagaaataggtattccttgattaatgggcaaacacaccatttcccagagactcagacagttggagaaacccatgaatgaataagtcagagaggaaaaaaaatagtgccgatataaagaaccgtttattttctccttgtttccatgaagagtgcctttttgtttgcagatcctcactactgcagcaacccagagaatagaggaaattatgccaatagctaaagcaaaacttgaagatttctttaaagtacctaattatggttttaaaaaattctccatctcgatttgctggaagttgagacccaggtcttttgcaagcttgtgaagtgaaagaaatttctaacaaccttccctggaccaaaccattctctccaatctccgtcccttcctgtcttttcattgctggt

SEQ ID NO: 48516 - DNA, 1049 bp, Homo sapiens
aggcatttcaaaacaggctcatggaaggatgattaaacccaccaataatttgccaaaaaatagtctctctttatcttcacactgcaaaagtcaaatatatatctgtatgtggttgacagatctccagaattgtgagttaatctagcaaaaaggctccagaaaaaaatagatatgaaactctaagacaacacaagaaattaagtcttttgagttttagttagatgattttaggttgcagcatttctcccttcatacgtcgttccagccaataaggaagcaaagatgagtgaaggcaagagaaagaagataaaatagacctgtccttccttgccacaaataacctaaatcttaaagtttaaaactcaacgttgcacaacagtgtgaacatacttaacactattaaaccgtacacttaaaaatggttaagaaggtacattttatataatatgttctttcttatcacagtttaaaaagcaaaacacaacaaaaaagctccggccaaagaaaggaaaatttgaggcttgaatgaggtatagtgaaagatatatagagtcagtgttagaagtatatcatggtcccatataatgaatatcattacaccttgaatattcaccaacaccatttttacttcatagactcaataaatagactcaaataatagaacatttaatacctcatgtcagataagtataaaaatcctgcaacaaaacaccaagaaatactggttgaaacatgtttataaaaactctcaaaatataaaagcgaatgcttatacactgttgatgggaatgtaaattagtacaacctctatggaaaacagtatggagatttctcaaagaactaaaagtagaattaccatttgatgcacgaatcccactactgagtacccaaaggaaaataaatcattatattgaaaagacacccacacttgtatgttaccacagtaaagttcacaataacaacgtcatggaatcgatctaagtgtctatcaagagatgactggataaagaaaatgtggtatataaacaccatggaatatattgcagcca

SEQ ID NO: 48517 - DNA, 1051 bp, Homo sapiens
taagtttgaaaagcacttgtcatccctagcatgttaacttgggaacttttgcacatttcatatttctcatttgctgaaattgagtgattaatcttgcaaagtctaggtaacatagtaattggtaattttaaaaatacatattaagggccctgtaatgagatttggcacttggatttttactaaagggacacctgcagggttgttttgtagtgaaatgttttagatcttttgttagcaaacactacattttaattgtactgcttgtttagaattattagcaaatggaagcctccatatttatattttcagtgcataaagccaccttcttgctttacttcagagtaacatgccaagctattttgtgttcactaaatttagctatcagttaaacactgcagaaaatattagctactcaaataagtaggcttctgaaatagttttaactgcaagtgtgttaacttgtgtggtggtttgaagccatttttccaaataaagttattaaacaccactttatgtactgaagcatgaacagaaaaatcaagagctgagcagaccacctcctttatgtaggcaaaacttccatcattttggcttttgttctaaacagaactaaatgacatgcatagcatggtaacttacagatcgcttaattggagtaaaactcagagtaatagagggaaatatgggctcttcagtgcctttttagcttttttgagttgaagacgttcctacagatgtagtttaaacattacaaagtaggcttctttatccaaaaatcccaatgtgtcatagtacacagatagtttaaaatatgtagccacggggaaggggaggcatgtaaatgtcttgaagaggagaaaaagtatgaaagaagatacgatagttacgaataatgtgtatgatgaggacatactttaaaaatgtaattcctctgtacagtaaattacaaatctttagggatttttttgtaataagagaatttatatttgtaatggtctaagaatttttttgtaatgtggtatatagaattttaatttggagcacttataag

SEQ ID NO: 48518 - DNA, 1050 bp, Homo sapiens
gctgagttgctataaatgtattttctggagttgtgacaaagctgatctgacagtttttgcttgattttttagtcatctgtggagggatgggccattggagttacctgcctcaccatttttactgatgtcccttaagaaaggcttttgctttgtttttagagacaaaacaaaaatgttttgtgctatgttgcttcgaactcctggcctcaagtgatcctcctacctcagcctcctaaatagctgggactataagtgtgtgccgctgcgcccagctcccaagaaagatttttgaaagttatattatgatacgttgctttaatgagtagcgttaaataaattatattaatgtttataaaaattatcaacaggatggaatccgacgtggtaggcccagagcagatactgtccgcgatttaataaatgaaggagagcattcatccagcagaatccgttgtaacatctgtaatagggtgtttccacgggagaaatcgctccaggctcacaaaaggactcatacaggtaagttgagcaaattttatagagactgccagaagtaacactttttttttttttttttttttttttttttttttttgagatagtctcgctctgttgcccaggctggagtgcagtggcgcgatcttggcttactgcaagctccgcctcctgggttcaagcaattctcttgcctcagcctcctgagtagctgggattacaggtgtgtgccaccacgcccagctaatttttgtatttttagtagagatggggtttcaccatgttggtcaggctggtctcgaactcctgaccttgtgatccgcctgcctcggcctcccaaagtgctgggattacaggcgtgagccaccgcgcctggccagaagtaacacttaactgaatgctgatttgatattgagtaataaattaactttttagttgctttatattttcttattaccactattagttgtgaagttttttaaaaaggcagtatagtcagtttctttttggtggagagtggtggttttatgaatactggttacatgtgatttctaa

SEQ ID NO: 48519 - DNA, 1050 bp, Homo sapiens
tggtaaatgtgttgatggaaaatcctctcaattctcaagataatttgcactaaagtgcaaaaatactttcctctgtcaagtatttgcaaatggtttcagtgaatataatcttatttttttccaactattttcagagtaattcttcaatccagtgttcagagctgtaaaacatctgaacctaacatttctggcagtgcaggcattactaaaagaaccaccagatctgcttcaaggaaaagcagtgttaaaaggtgagaaaagaatcctactcttctgaaaagttgcaagcgtttgttttccagtttaatatttggaccctacctctggagactgacatgaaattaggagaaagtagagtctctgtgatgggaaattcatcaaatgtgtattccttgttcattatctaagaaaatctggaccattttaatgtaggcttttgttttgttttttagaagtaattctcaacactggaagtatggtctctgggtcatgatatgggaaagttttaagttaagaatttccaaagctggctgtcaggacttggaggacatttttctaggtgtatatcagatacagcatcattgctggacgattagctgcaaatgaatgtgatggtagaaatgagataaccagagagtttgaagatccttctctacctagtgactctttgtcctcttggccacagcccacacccgaggcactagttctttcactgtcgtcactgtcttcagtgagtgtaggcagaatttcacaaggaaaccaatgtgttctgtggccacgtcggtgactctgttgtctttggatatttctcatgaagtggacatgtcatttttaaagtattctgaaaacagatcccatctgaagagagaataaatagcccaggagtggaagtggggatagatggctcaggagtagaagggggcaccttttcatcgttgcctggtgttggcagcccatgcagtcctgtttctgtcctcctggtaaaaacgatctcttctaatagacatgagcgacctgaagataatcagaaccagactttaaaatgtcctg

SEQ ID NO: 48520 - DNA, 1076 bp, Homo sapiens
cccagaaggcgggtgtgtccgtgtcacggggtccaccgccacccttctgtgtctgagctgcgttcttccttctctgaagctttttccttaactcatattttaagaatttcttctcttgtctcctcttggacttggaagttatgaaagaatgcaaaagttccttgcaagatctcttccaaagaaaaattccattgcaaccaactctggtactttgtggtttcactgagtattttcacatagctgagaaagatttaaaaatcaagctgatttcactcttcagaattaggcaaaacctgcttaacttgctcctatttatggcattttcttgaatatcttacaaataaaagcttattgtcgcgcattcagacctgctgtatttctgagatagattaaccttttgggtgttttcttctttacttctcttagtcaactacgattgccacatattctgactcaagagcatcatgcactacatagagttattcttctcaaactgttccaagtggcaaagatgttctgaatgggtggagcagttgcaaataatgcttaggcactttgtggttgaatgatcattcccagggtaagtttaaacatggtctctatcaggctctcttcttttcagtattccatgtaaactataccttctgttgttattggtaatgacgtttgccattgtatttctagacccaagcagagtattcagttcagcctgactaattatttggaattttgagaagcaaaaagcttgtgacagttacagtggtgttaatcagtatcatctttgtagcacccccatgtctttctctcaaaagggttttatttgtaaggtggtgactcctgagctccaccatcctctgtcatcaccacccacctctgctggcagtggacgcaggtggtgtggcatcgtctgctaagttgtttccagtgaaaagctcctgttatgcagcatgcctggagaattaggccataacaacacttcaggcttctgagtcagactcagagatagtgggaaagccttctctggaggctgcagggcctcagggtcacctttgtgcacgctcttgtggtgtccggag

SEQ ID NO: 48521 - DNA, 1034 bp, Homo sapiens
tagctgggagtggcggcatgtgactgtaatcccagctacttgggaggctgaggcaggagaatcgcttgagcctgggaggtggaggttgcagtgagccaagactgcaccactgcactccagcctgggcaacagagcgagactccatcaaaaagaaaaaaagaagagccctgtttctggttccaggttcctaataaatggccctcaacccagcaccatagtctctgtagtactttattgatgtgttactctaacaataaaatattggcattatgtagagataattgcacatcagaaatcagtgatttcccccgacctgtaatatataaaatactccttaaggaattgaacttaaggtttgggctgggagggaaaatttcttcccatttccatctagctacttttctagtttcaattgggttttttgaaagaaactggaatttcaagagataggtagaacccaaaacttgttactaaccagttcccttgtttaaatgcatacgaaggatattttccaggttgcctcatactgtgctcattatatgcttcctatcttgatcaagagtcggctttggaaaaacactgttagcctgcaagttgactttttagaagcagtgtaattttgaataggtaatacatcgtacaatgcaaaagctgtaaaaaggcataaatctctcttattccctatttctagacaccgactatgaaggcattgatacgtttcttgtggctgcttccacagacttgctacctacgatttcatccacaatcgtatacatgtgtatataggatttaaactcacacatagaagtggtagcgcttaacagtccatcttggctatctttagttttcagttttcttttttttttttcttttgagatggaatttcatacttgttgcccaggctggagtgcaaaggcgtgatcttggctcactgcaacctccacctcccgggttcaaacgattctcctgtctcagcctcccaagtagctgggattacaggcatgcaccaccacgactggctaactttttgtatt

SEQ ID NO: 48522 - DNA, 1034 bp, Homo sapiens
tgtgatcttctggattaatttacatgtattaacatgtcatattccatgtaatttattacatgtaacatgtaaatttattacatttaattcatacatcagcatgcaatttacatgtattagcatgtcaggtttcatgtagtttattacatgtaacatgtaaatttattacatttaattcctttattagcatgtaatttacatgtattaacatgtcaggtttcatgaaaagacctgttgagattttgattcgaattgcatttcttttgagggaaattactatctttatgatattgagtcttcctgttgataaacctgctttatttctccatttatccataagggatatgcacatcttttttttttctattacatttcgtaattgcttattacaagtagatagaaaagctattggtttttgtgtattaatcttctgtatctagaaacattgcaaaactttattatttatttgagtagtttatctgccgattctcatctgtattttttttgttttgttttgagacagtcttacttggtcacccaggctggagttgagtggcatgatctgggctcacggcaacctctgcttgccaggttcaagtgattctcctgcctcagcctcccaagtagctgggattacaggcgcgggccacccatacccagctaattttttgtatttttagtagagatgctgtttcaccattttggtagtgctggtcttgaactcctgacctcaggtgatccacccgcctcggcctcccaaagtgctgggattacaggcataagccaccacgcctggcttcgtgtctgtattttttagtagacagtcatctgcaaacaaggacagttttgattcttcctttccagttttctctgatttcctttctgtatcttgatatcagctagcacttccacttactacattgttaaaaagaggtaatgatagtgggaattttttcttgctttttattttataaggatgcttccaaagttaaggcataaagtgtgatattggctgttggaacagtctttatcag

SEQ ID NO: 48523 - DNA, 1019 bp, Homo sapiens
cacacccggctaatttttgtagttttagtagatggggtttcaccatgttgcccaggctggtctcaaactcctgacctcaagtgatctgccgcctcggcctcccaaagtgctgggtttactacaggtgtgccacgcccggcccttttgtaagttttttttttgagatggagtctctttctgtcaccaggctggagtgcagtggtgcaatcttggctcactgcaacctctgcctcccgggttcaagcaattctcctgcctcagcctcccaagtagctgggactacaggcgcacaccaccatgcccaactaatttttctatttttagtagagacggagtttcaccatgttggccaggatggtctcaatctcttgacctcatgatccgcctgccttggcctcacaaagtgctgggattacaggtgtgagccaccacacctggccccacagttaggtttttagattgttcagagcatgtttagatacacagatatgtctatagagaaatacacttttttttttgagagggagtcttgctatgtcgcatatactttcacatcaacaagataaatattccaagtactatcatatcattagtttcttcctatttcatataatgtagtggaatattttattgtcataaacacttctaaacatggatatctttttttagtggatgcatactgttccattatatggttgcataataatctgtttccttatgtatcctctactgagaaaaatgtacataaattcatttgcataacattgggtagagaattttaggagttgtggacaccatccctagccaagccatggattgctgttatagtttataggttataaacacaaacgctaggccgggtgcggtggctcacacctgtaatcccagcactttgggaagctgaggcaggtggatcacttgaggtcaggagtttgagaccagcctggccaatatggtaaaactctgtctctactaaaaatacaaaaattagccgggcttggtggcgcacacctgttatc

SEQ ID NO: 48524 - DNA, 1409 bp, Homo sapiens
atgcttaatgtgtagcagagagacaagttatttggaaaggttgggaataggatataaagaagaaatgagatctttaaatctattttttattaccctgggaaaaatgaattttagtagccagtattttttgttttccttcccatcttagctactgaatatttgtataacctaagtaaatccttcacattaacattgttataaggatctgtaagttgacatgcaaacatggacagaccatctgaacatctcaaagccacgcctcatctagatcaggcatctttatgaatgaggtaagtaggtgcggagttgttgaggacaaatatggaagagattgtattagagacaaacagactggttcgcaggaactaactaatcttcaaatattgtttctttccactatttcatttttagcttccaaagtgagtcatttgatttctagtgttataagaagaattgacgtccatattaggcagggattacttttgaaaacattttccaaaattgattgtaaccttcctaaactcaaggatattgaactggaatgtgtagatctcatctggactctctagtttatatgaaagttttacgcccttttctctctctcttttttttttttctatagcttttcatggatactgctccaacaaaggtattcagatcattgactactttgcagttcttttatatgactttaaactgtagaatttaatctgttagttgtcattcttggttccgtcctttcctgtttgctggtcttaatcttaggtagcagattcagttttctgtaactgtagagcagcattggtatgtttatgacttaagttgaaatttgtctttatatgaaaggttttgttggtttctgtgatagttaatactgaaagtagtttctgcgatatttcattggattaatatgaatgccaggttttgggtggtagatattttttggtaatattcagtttttctttttaaattgaatttcactttcataggctcttgtggaaagggtactcacaatgagttgttataactataacagctactcctgtttttttttttttgtggtcatttagttctttctagacatttatttgactaatagacagatttatatcctatttactgaatttggcaagagggaaatgtcatgaaatgctaacttgggaaacagggaagtgcttctatattctttttttaatttaaaaagtattcttgccgggtgcggtggctcacgcctgtaatcccagcactttaggaggccgaggcgggtggatcacgaggtcaggagatcaagaccatcctggctaacatgctgaaaccccatcactactaaaaatacaaaaaattagccgggcgtggtggcgggcacctgtagtcccagatactcaggaggctgaggcaggagaatggcg

SEQ ID NO: 48525 - DNA, 1043 bp, Homo sapiens
agcattgtctcctccctccttcctttttaagatctttaaaattcacagcagacattagacagggaaaatttattcattaattcaagaagtatttattgcatgcttactatgtaaaatagtcatgcatattcattgcagtgatggaagtatatttttcttgatagaaaaggaatgctgttatgtagaacactgagtcaaggaaaaaaattgctttttcttcaagagttttgtgttatagtagattatccagtttcaggaattgaagcccatcatagtgtgtagtgtgcatttttcttcttgcctatgtcttggttctcctttacttacacttaaatttgtctgtaatgtgaatttgttttcttgatttctatgcttgcttaattcttcaacatcttcacttctgatattcatgttagttatctgctttaaatctaattcctcaggcactccaacaccacgtggaggcaacagtttgacagtttcaaatgtcactccttaagtggacatacagagtagttgggcacagacatgaatggaaggtggaataattgtgttgcagaaatggtactgatgccagggagttgccagtcagtgcaaattgtaattgctctgtgcttttgaatgggaaggaatgttcccagtttctgctggggttaggaagagctggactgaaaccacactgtggatttttaggatggaagaaaggcattgatgcacacaagtgacatttcttggaaatttctgagatagtctgtgggaatcactgaattgataggacaggggaaagaatttcaagagatcaaaaccctccacattcccctgtgaagaagccaaagggccagagataaaattgggccacaatgatgtagtttctttttggcaaagccatgactacctgacttttactgttgccagcagataaagctgcttcacagagttgtacataaatgatttattggatatctcctagttagtcctgtgctacttaggctaggagatgaataattacctactgaatttgaggaaaatgagcaaaacaagta

SEQ ID NO: 48526 - DNA, 1030 bp, Homo sapiens
acaaggtcgggagatcgagacaatcctgactaacacggtgaaaccccatctctactaaaaatataaaaaattagccgggtatggtggcatgcacctgtagttccagctactagggaggctgaggcaggataatcgcttgaacctgggaagtggaggttggcagtgagccaaaatcacaccactgcactacagcctgggcgagagaccaagacactgcccccaaaaataaataagtaaagaagaaagagcacatggagagcatcatttgtgtgccaacttgggaccattcagtcatccctcagcatccatggcggattggttcctggacctgcagtggatcccagaatctgagatgctcaagtgtctcacataaaatgctgtagtatttggatctaacctatgcacgtcctcccctgcactttaaatcatctctagtttacttataataccaaatgcaatgtaaatagttgttgtactgtactatttagggaataatgaccaggaaaaaaaaatgtctgtacatattcagcagatatgcagctatcctttttttctgaatattttcaatccgtggtttgttgaatgaggatgcggaactcatggatgcagaagaccagctgtgcttagaaaacatgcctcatggccgggtgcagtggcttacacctgtaatcccagcactttgggaggccgaggtgggcggatcacaagatcaggagatcaagaccatcctggccatctggtgaaaccccgtctctactcaaaatacaaaaattagctgggcgtggtggtgcaagcctgtagtcccagctactcgggaggctgaggcaagagaatcgcttgaacccagaaggcggaggttgcagtgagccgagatcatgccactgcactccagcctggcgacaaagcgagcctccgtctcaaaaaaaaaaaaaaaaaatgaaaacgtgcctcatacacttaatctaatggtttaagttaaaattctggtcttgagttcaagaatcaaacagaaactagattgtaaatttat

SEQ ID NO: 48527 - DNA, 1097 bp, Homo sapiens
ggtggaactgattcaccgaggtggcctgagtcattgggaggccaggtggcaaagccccatgactggggactcaggcttcacctgctgtcccttagcagagggcggcccacaggatacctttccatacaatacatcaccaactggagaccatggtctgtgctctagtcatgtatgctccctctccttgcctggttgatctccttagcaactcatggtcttttactctagcagatggatgcctcatctagagactctggaggagctgattttctgtctgcccacccactaagggccttcaagctaataaagatagaaaacaaggcaggaatttttgtctgttttattcacagtgtatctcaaacacatgaagcagtccctcttcgtattaggcactcagaaatacttgctgaaggtacagttatcaaactgaaatctgagcatttttccttttgatgttccaagttatcttttgggtgattattataaataggtaaaatattgctataagttccctattcacgggtattttataaatttttaaaacttgttcttaatcttcagaagtgtacagaactgttcttcagatctttgtcaaccaaaacatgtattttcaataaattgagattcccagttcaaagttatgtctacacatttaatcagtttattagtattgtagagtataaccttttttttttttctgctttgcttccacacaaatactttgtaagtaccagtctaagcaattttgcaaaacaataatgtaaaatcctatttccaagatcaaccagatgggcatgcaaagaaaatctggggatcatcactttaatccaacttaacaatagttcccctcatttttactctccaaataatccttctcacagttcaaaagagaagttttttgttacattcagatatctttgcccttggagagacatgttaccctgaaagaaggggtataacaccttcatgtgacttcctgcctctatgtttgtcttctctgataccttgtcatattaaatgtcttcccagaaccccagaagaaatagtatcttctgtccttgtactagggtagccttttataatgggagagaaatttg

SEQ ID NO: 48528 - DNA, 1050 bp, Homo sapiens
ggaagtgaatttgcaaagtatttctgaatttatcattaataatagaaactattcaacaaagaaaataggttgcggtaatgtatgtgagaattcacctttcaaaattaactttgagaaaactcagactggagagaaattttatgaacataataaaaacatgaaagctctcaattataatgaaaatcttcccaagcatccaaagtttcaaactttggagcaagcttttgaatgtaataaaattggaaaagcctttaatgataaggctaactgtgttaaacataacagttctcacacaggagaaacatcctctaaagatgatgaatttaggaaaaattgtgataagaaaactctctttgaccacaggagaactggcacagggaagaaacacctgcatcttaatcaatgtgggaaatcctttgagaagtcaactgtggaggaatataataaacttaatatgggtataaaacattatgaattaaatccaagtggaaataatttcaacagaaaggcacacctcactgatcctcaaacagctgtcatagaagagaacccattggtaagtaatgacagaacacagacttgggttaaatcctctgaatatcatgaaaataagaaatcctaccagacgtcggttcacagagttcgccgaagaagtcactcaatgatgaaaccctataaatgtaatgaatgtgggaaatccttctgtcagaaaggacatctcattcaacatcagagaactcacacaggagagaaaccatttgaatgtagtgaatgtggaaaaactttctcccagaagtcacacctcagtactcatcagagaattcatacagcagaaaaaccctataaatgtaatgaatgtggaaaaacatttgtccagaagtcaaccctcaggggacatcaaagaattcacacaggagaaaaaccctatgaatgtagtgaatgtgggaaaacttttgttcagaagtccaccctcagagatcatcacagaattcacacaggggagaaatcctttcaatgcaatcaatgtggaaaaacatttggccagaagtc

SEQ ID NO: 48529 - DNA, 1049 bp, Homo sapiens
acataccaccatacctggctaattttttaaattttttgtagagacagggccttgctgtgttgcccagtctggtcttgaactcctgggctcaagcagtcctcccaccttggcctcccaaagtgctgggattacaggcatgagccactgcacctctcctataaaaacttttaccaatttaataccttcaaagtctaagattaaattagattcaaaataggcatcctttacattcgtttaagctttttagagttaaacctgataagaattgttttcatggctattttctacatcatctaattctgaacccttcagattgaatagaaatgtactgttacaggcatcagtgtcattcaaggacgtgactatagaattcacccaggaggagtggcagcaaatggcccctgttcagaagaatctgtacagagatgtgatgctggagaactacagcaacctcgtctcagtgggtaagcatgtaaacataacttacccttgtaactccatatagaaggtatttcttttttaagtgccaatacatgtgaacaatttacttaaagtttaaattatttaggcttttcattcaggattccaaagtaactatgccctgtcgaggactagaaagaatgtgttgtcaactcccagtgataaatgcaaaggagcactttcaggatactgcttccaaagctgtattttcttccacttttggagactaaaatctcatatatctggtctaagtcctcgattgtgttttattaacagggtactgctgtttcaaaccagaggtgatcttcaagttggagcaaggagaggagccttggttctcagaggaggaattctcaaaccagagtcacccaagtgagttactgagcagtagtagacataattctgcaggagtggttagactccaggtcactttaggggtgaacacctaaatattgcaagacttttcttagaaagcctaaaggcacaaaaagcagcagttaaaagaaaataattaataaagttgattccattaaaagtaagaaatttgttaatatattattcaaaaggtg

SEQ ID NO: 48530 - DNA, 1034 bp, Homo sapiens
catttaatgaagaaataataccagttctacacaatctctttcagaaaacattagagagcaacaacttcctattcgtttactgagtccagcatcaccctataaccaaaccagtaaaaaacattcacagaaatctatagaacaatatcattcatgaatatagatgcaataaatacagcaaatgatatattagcaaatcgaatacatcacaaccacatggggttcatcccaaaaatgcaacctagttcaacatttgaaaatctgcgttcaataaaagtggttgggaaaaccggataaccacacgcaaaagaatgaagttggacacttcatttacacagtatacaaaaattaactcaaaatggatcaagggcctaaatataagagctaaaattataaaacacttagaagaaaacataaaggaaaagcttcctgacataggatttggcagtgatttctcacatatgacaccaaaagcacaggcaacagaacaaaatgattaataaattggaccttgaaacttctgttacattaaaggacactaccaagtgtgtgaaaagacacacaatgaaagaaaatatttgcaaatcatatatgacataagggattaatatccagcctatacaaagaacttctacaactcaacaataaaaaacagcctacttcaaaaatgggtagaggacttgaatagacattactccaaagacaaatagacaataagcactgaaaagatgctcagcatctgtattagccaggccttttattttctctattctgatgatttgacatcaccccttgctgacgttggggggactgccctcccagggctagaaaatgtcttgaaatagtagtcaatttgacatgagggcacttttcaaatacaaacggacaagtctagaactcatgctccaaacacctcctttatcaggctgtcacactctgagccagtatcccctgcacaaaacacctcagagctgagtaccagaaaactagcggaagtccctctgtcccaaagcctgctgaaatgattcaaactagcc

SEQ ID NO: 48531 - DNA, 1079 bp, Homo sapiens
acattcttcacagaactagaaaaaacaatgttaaaattcatacggaacaaaaaacaagcccaaatagccaaaggaatcctaagcagaaagaacaaagcaggaagcatcacactacccaactacaaattatactattgggctacagtaaccaaacagcatgttactggtacaaaaacagacacattgaccaatggaacagaatagagagcccagaaataaggctgcacaccttactgccatctgatctttgacaaagcttagaaaagcaatggggaaaggattccctattcaataaatggtgctgggataactggctatccatatgcagaagattgaagctggaccccttccttataccatatacaaaaatcaactcaaggtagattaaagacttaaatacaaaatccaaaactataaaaaccctgaaagacaacttagggaataccattctgatcataggagctaaccaaaatttcatgagaaagactccataagcaattgcaacaaaagggaaaattggcaaatgggatctaattaaaggacttctgcacagcgaaagaaactataaacagagtaaacagacaaccaacagaatgactgaaaacatttgcaaactatacatctgacaaaggtctattatccatcatctataaggaacttaaacaaatgtacaagaaaaaaaaacctcattaaaaagtgagcaaagaacatgaacagacactttttaagacatacatgtgaccaacaagcatattaaaaaagctcaccaatattaccaatcattagagaaatgcaaataaaaaccacaatgagataccatctcacaccagtcagaatggctattatcaaaaggtcaaaaaacaacaaaggctgtcaaggttgcagagaaaagggaacacttatacactgttggtgagagtgtaattcaaccattatggaaagcagtgtggcaattccaaaaaaagctaaaaacagaactaccatttgacctagcaatctcattactgggtatatacccacaggaatataaatcattccatcataaagacacatgcacgcaggtgttcattgcagcacta

SEQ ID NO: 48532 - DNA, 1110 bp, Homo sapiens
caacttataacactctatagaatgttataacttgtaaattaacatacatacaaaacagcttaacaacatacaaaaaacttgcccctataaagctttattttcactacttttcagttgttgatgtcacacaattacatattaatgcattttgtatctaaaaacagactagtaattttttaaatattagtctcataagtcatgtagaaaacaaaaagagttacaaaccaaagttatagtaacacttttatgattgtatatttccctttttcagagatctttatttcttcatatggctttgagttactatggttcatttaagcctgaaagagtcccgttagcatttcttgcagggaggcctatttgtaataaatgcccatagtttttgtgtgtgtgtgtgtgtgtgtgtgtgtgtgtgtgtgtgtatgataacctggttttttatatacagtgaaatgtttactacagtcaagcaaattaaaagacccatcatcttacatactctctttttgtgggaatagaacttaaaatatactctctcagcaaaaattccaaatacattaaaatattattgactatactcctcatgctgtacattaaatctctagacttattctacatacctgcaaacttggtatcctttgactcacctcctctcatttgctcctcactcctattaaccccctggtaatgaccattttattctctgtctctattctactttttttttttttttttttttacattttacgtataagtgagtgagatcatgctgtatttttctttctgtgtgtggcttatatcacttagcataatgttctccaggttcattcatgtgtggcaattggcagcatcttgggctaatattccattgtatgtatgtgtatacacatgccacagtttatccatttacccattgacatttgggttgtttctatattatggctattgtgaataatgctgcattgagcacgggtgtgcagatatctctacaaagtgctgattttgtgttcttcaggtatataccaagcagagggatttctgagtcaaatggtaattctatttttaatgaaacctccaatacttgttttctgtaatggctacactagtttt

SEQ ID NO: 48533 - DNA, 1026 bp, Homo sapiens
tgctgtaaaagaattgtgttccccttgctttataactactttgacatcagctacaatttgccacatgaatattaataacaaaccttttacagaaaatatctgataccacattccctttctcctgctgccttctaacatgtctgtctagtaaaggccattgttactaaactgccttttttcaaagaagccagtgtcaaccaatatatttctctctctctttttttctatgtgtgtctctcacacacaaatacacaagcaaatatatatatatatatcttcaacatcactgattctttcctagcagtgttgagtataataatggacctttggaaggcattcttcatttatggtactgtgtttttcatttttagcattgtaattttattatagtttttatctctctgccacagttacctacctgatactgcatgttgtctagttttcccactggagtcactttatatggcatttggcattctttctctcagttaaaaaactgcttggatctttgtttctctctacaaccacctagttttccagatagctttttgccctgtggcttcagatatttggtgcattgaagaaaagttaaagtcttcccaactattttcttgttttatgaatagaagcagtgctcttgcctgctatttctctgagttgtaactgaacatcatcagttgttttttgacaaatgttccagggtaatttgatgggaaaatgatgattgttttcaaaaatgatgccgctgggcgcagtggctcacgcctgtcatcccagcactttcggaggccgaggcaggcggatcacaaggtcaggagatcaagaccatcctggctaacacggtgaaaacccatctctactaaaaatacaaaaaattagccaggtgtggtggcgggcgcctgtagtcccagctgctcaggaggcagaggcaagagaatggcgtgaacccaggagggagagcttgcagtgagccaagatcacgccactgcactccagcctgggtgacagagcaagactccgtctcaa

SEQ ID NO: 48534 - DNA, 1069 bp, Homo sapiens
agattcactattggccggatgtggtggctcatgcctgtaatcctagcactttgggaggccaagacaggtggatcacctgagatcaggagttcgagaccagcctggccaacatggcaaaaccctgtatctactaaaaatacaaaaattagccgggcatggtggcacatgcctgtaatcccagctactcgggaggctgagacaggagaatcacttgaacccaggaggcagaagttgcagtgagccaagatcacgccactatactccagcctgggcgacagagcaagactctatctcaaaaaaaagaaaaaaaaaaaaaaaagattcactattgaacaaccctgacataataaaccaagtcaccagagctagggcagagcagtgaatccagtctaggtggaaaaatgactttaactcccatcaattttacatttccacttacacatgtgtgttcctttgatgataatgcagacagaattaaaatgttgtctatagtagtatttcttttaacatgaggaaattggtgtcattataaatttcttttgtgatgtgtagaatggaaatggagctccaactgaactattgcaggctaatgattatcctaccattgtaatttatatttgtataagaatctagactagcgttactccctacggcaaaccctgtctcagataaaaccactaatccattgatttttgttgttgttatctacttcatgttggtaatctttttttattcatcccattctctgattttcctgttcccaggatccaatgctcttacgtatacaccattctcagtcattttgttgatttatatcctcttctctattcagttttgaaaattctattttaagatgccaaatatgtatatatattcatttcccatttctttttctactacaaaaaaaaatttaagctaaaaagggaatatggggaatatgtacttgaaattactttattgttgagaaactgagccagaaactaaggaatcaaatacataatagggcatatatatacatatatgtcccattccataagaaatgtgttaaatatcataaagtttgtttaat

SEQ ID NO: 48535 - DNA, 1042 bp, Homo sapiens
ggcattttgataatgctaaaatagacagttttaaaaggatattttaaaagtagagaactttaaaatatatttaagagttttgaatatttgtgcactaaattttcatcaggtgtcataaaacaaaaaactgcaagtgttctgaggaaaaatggaaacatattaggtcacatagactttaatttacctctttgatttcataccagagccagtggatcacaactgagttcctagactagtgctcagcaaatgaggacacaggtgaaattctacctgctgcctattttggtcaggaaatatttttctagaacacagccatagctattcatttatgtgctcatgctacgaggtagaattgagtagttacaacagagaccacatgatcagcccagtggaaaacatttactctctggccttttacagaaaaagtttactgactcctgctctagaagttataaataacatattttataaaaatgaatctgatgtgtctttcacaactctgctctggaaacagaatgaaccctttttaaaatgaccatgggaccctgacaaaatataaaagtattttgtgcaaaaatgaataaatccacaaagatattattgtccagtaaaactgcaaattgcaaacaatgtaagaagaattaaagtctatcttaaactcaataaggaatatatatctttaaaaacatatttaatcaaagagtaaatgaaaatcaaaattgtctaatatccagaaaatttcaaagataaaaaacatgcatattagaacctttgggatatagataaagcagtgcttagaaaaacttttagtcttatattagtcttatgtacttgtttttaaaagtgaaaaagttttcaaagaaaactaagcaaagcaaaagatgtaataaaaataagactatattagtataaattttaaagccaaaagcggttcttgcaataaaaataactgaataaaatagtctcaattcgaaaaagggggaaagcactattactcaaagttttgatttaaattcctacttctgtggtatagtttgaaata

SEQ ID NO: 48536 - DNA, 1055 bp, Homo sapiens
ttattcttccagtttcatcaggatttgctttatgtattttgaagtagtgttataaaatggaaaaacatttgtgattgttatatcctcttgattaattattccctttatcattatgcagaatttctctttatatgtgctatttatatattataaaacccataataaataatattgtctaaaaagataacttgaaagataatgttctatttaaagaaaagaattccaagaatgagaaaagtatattttgttttcatcctcttttttccagtttatggtgctctttatctctataaatttttttatataaatcagaaattttcatagtaccatttttcttctgtctggaaaatttaacatttctcgtaatacacatcagttgctgataaattgtttcagctttttttttttttttttggtctgaaacatcttatctttgccaagtataaaattttaagttgattttttttctttaagtactttaaaagtatcacttcactgtcttccagactgtaaaatttctaacaagaagtcagctttaattctctttgttcttctgcatatattatgtctttttctgtctacataaaattttctttttttcagcaggttttagcaatttgattataatgtacattggtgtgattttatgtttcctcttggcatttatttagcttcttggatctgagggtttatataggtcattaaaattaggaaattttggccactgttgcatcagaattttctctccctttcctttttttcttctggaatgctgattacatatatgttagactacaaatttatttaaccacaggtcacagataactctgtttattattttccagtctctctatgtgttgcccaggctggtcttgaactcccagcttcaggcagtcctcctgccccaccctcccaaaaaactgggattacaggtgtcactgtgcctggccatatgggccatttcttatttggttgttactgattgatttttctccttgataagagtcttgtatcactgcttctgttcatacctagtaattttgtgttgggtgcta

SEQ ID NO: 48537 - DNA, 1035 bp, Homo sapiens
tcaaagttatatcatttcaatgctaaatacttcagtagtgatccctttttttaaaaaaaaaatttctacaaaattcttaattttttttcacagttcacaaaagtaatggtactttttttcaatatttgcaattcccaatccatattcagcttcccaattgtctccgaaagtcttacggaaaaaaaaaatgttggttcaaccgggaaccaatggagggctactctttgtatttgtcagtagcgtttaagttttaacctttaacttctccctgttcttggagagcctgagcgggagacttcataaaaactccatccccgccaattctgaatcgccgaaacgtgaggagtcacgtcgaaggcggacgcaagagcttatgggaaatgtagtcctgaatgagtctggttcgccgcgcagcactctgggatggggctcctgggctccttctgcgcctgtgcagccagagccccgcctcctcatttgggttctcgagactcccgggaagcggtttgggaagctcgggggtcggctcggaaagtagagggggcgcagctggggcgggaggacagcgtttgtgcccggaagcgggagaggaagcgggaagtttgtgggatccccgccccctgtgtcagtggatgcgaccgggcgggccctcggccttcccggccgctggagagggacttcggccgctggctcccggggcggctgaggctgagcgttggtccggagcaggtgccgggtgcgggccgcggtgtgcgggaccggagcccggcgcgagcggcggcgggggtggggaaagcgcatttgtaacgcgggcgacaacgtgcccgaaatccccggacggtgggtctgcatcgagaccccgagctctggagctggaaaaacccgggtaagttccatctctgtcaactggaagccgaggcgaatgtagggacgtggatgagagtcaggtttctcatctgaaagtgagggtattaataatgactgcttcatggcgttggtttaaaactttaagtcaccacctgtaaagcaaacagc

SEQ ID NO: 48538 - DNA, 1038 bp, Homo sapiens
ttaaccttaagcatttctataaatcggttaccaaaaatgcttgctatctggtgttggagtggatgtgaggaaacagcataaactgatacaagcctctttgaggactccctgttagcatctgttacatgttcatttgtacacattttaactgcacaattctatcattttggctcttgtgcaaagaaataatctcacaaatatcaaaagatgcatgaacaatgctatttgccacatattatttataatagtgaaaactggaaacaaacatccatcacaaagaattgattaaataaacatgatattccctacaatgtagttaaggaacagaaagatttccttctctatagcctgatcagataactcgattaggagacaattttacatgttaaaagaaaattgtaaagaagttgtaaccatgtttttaaaaatgcattgtttgctgtagcctaaagtgcagagttaggcatcagtggacaattggtcgtacttgggaggtgggctggatattaggagggggagctacattatagctttatgcactgctataatcaaatttgcagtgtctaaattttttaaagaaacgtttaaatgtatttactttaaataataagcaagggagtccggacgcggtggctcacgcctgtaatcccagcactttgggaggccaagacaggcggatcacctgaggtcaggagttggagaccagactggccaacatggtgaaaccctgtctctactaaaaatacaaacaattagccgggcgtggtggcgcgcgcctgtaatcctagccactggggaggctaaggcaggagaatctcttgaacccgggaagcagaggttgcagtgagctgagatcgcagcattgcactccagcttgggcaacaagagcgaaactaggcttaacagcctttttcagtacagaacttaaggagaataaaataacaagttaacaagttgccaagttgccaagcttactacaaagcgaacaaatatggttgggttgactgtttattatactgttacctttagtctttacga

SEQ ID NO: 48539 - DNA, 1025 bp, Homo sapiens
atctcaaaaaaaaaaaaaattagttttgggataccagtaatttcagtattattaacaacctgacttgggcaccccaaaagtttgcaataatggcattaaatggctggatagagaaagagatggtggcgtgaatgcctgcttcctggtgtcatgtctggaatttcatgtccagtcctgaaagctgcattttaggaagggtgctactgagcgtccagagaagacagcatttcgcttggtgaagggagtgggcttatgatgcatggcaggaggagtaatgtagaaagaaataagctttgcggtgcatagtgtagagaaattcctgctttgcgtcaaacagactgaccaggcaggcctcacagttttgcaaagccctggaagcacaggcttggctgcagatgttggatgactttccagaccagttttggaaaaagctcttgaggatcagaagctcctgggatttctgttatcacctgatttcatggagagagacagtccagggccgggaattatgtggcatctatgtgttccccagttgtgggatccatctggccgatggttatggtggtcagtgactttcagaggcctggaattcatgacagatgcttttgctaatgtgcttggtgccccactgaggctgctgagcagtgcttaccatgcgcccgatgtctcttctgtgtgcctctgagagcaaaagtggcctcagagtctgaaggagggcaaagtggccacagctgcagacacaaagtccagactagctcttgaccacatccaagtgcatcctgcattaagctcaggcacatcaaacctgcccaatcaaggtctgccaaaggaaggagtctgcaaatgacatttctcataatcaaacacactcttaatttgtttttatattattcactccattttttgattattataacttttaaaattatgtctagtagttttatcaattgctgagaagagtgttgaagtccaacttacaattgtggatttgttgatttcttctttcagctttattggttttggtt

SEQ ID NO: 48540 - DNA, 1034 bp, Homo sapiens
atatacgcatgctaaagtatttaagaggaagtactggtgtctgcaaaacaaaaattttttttccattttctgtggtaaaatatacataatataaatgtattattttaagtgtacaattcagtggcattaaatacactcagaaagttgtgcaaacatcccatttattcatttccacagattttttaattctcattccaaacagaagccctgtacccaaagagcaataactccgcatcctccaatccccactctctggtaacctctattctactttctgcctctatgaatttgccaattctaggtacctcatataagtggaatacagtatttatccttttgtgtctggcttctttcacttagcataatattttcaaggttcattcatgttttacatgtatcagaatcttgttttttcaggtggagtaatgttctattgtgtgcatatgccacatttggtttatccattcatcagttgatgcacatttcggttgttcccacctttgggctattatgaataatgttgctgtgaacactggtatacaaatatctgagtggaattgctggatcatatggtaattctgcatttaactttttaaggaactgccaaactgttttccacagagctgtaacattttacatccaaaccagcaataggacctggataaaaggtggctaaggcacagttaaataaaatactgttagttactgcccatttgcattgggtttctagtggcaaataatctagccgtgtccttgactggatctcccaatgattcttttcagtcatttgaatgagtatggtggtggtgacactggcaggaggctggagggtactttaattaacacgcgaacacacacaaatccattgcaccccactaagccgcccaaacacacatgaaacacaaaaactatccttgctagggaaacacagccctggaacaaaccccctggaccccttgtcaccaccagcccatcctgtaagaaaatgatggttgaagctgcagtgacagaattggagagatgctctgttagac

SEQ ID NO: 48541 - DNA, 1193 bp, Homo sapiens
accgctcccggctaattttttgtatttttagtagagaaggggtttcaccgtgctagccaggatggtctcgatctcctgacctcgtgatccacccacctcggcctcccaaagtgctgggattacaggcgtgagccactgcgcccggccttgaactcatcattttttatggctgcatagtattccatggtgtatatgtgccacattttcttaatccagtctatcattgatggacatttgggttggttccaagtctttgctattgtgaatagtgctgcaataaacgtacatgtacatttgtctttatagcagcataatttataatcctttgggtatatacccagtaatgggatggctgagtcaagatggtatttctagttctagatccctgaggaattgccacactgttttctacaatggttgaactagtttatagtcccaccaacagtgtaaaagtgttcctgtttctctacatcctctccagcacctgttgtttcctgactttttaatgatcagatagcctcctattttttaactatgagttggaatttgctgcttttgatatgataagaaagttcaaagtttctcttccttgctttgttgtgtgttctaattcttttctgcccatcccccagtaaagaaaaggctcagtatgatttcttgaatagattgtttaagctattttcaaaacaggacttggtcaggggcaggtagtcttaaatgttcagaagccactggatggaaaattgtgagcacataagtgtttttcttggtcaaccatgtcattttatagccaaagtttgacttgacatactggaattaatccacacgactttgaaaagaataaactctttaaaaagagagtgagcgctccgagggtgttatgagagtcactgtctgaaaccctattgatcatattgtggcagaagaaatagagtcctgccatgaattatacttttcaggttaaaaaaaaaaaaagcaatttgtaggacagtttgaataatttagtacaattgttaaaaatacagacatgcacattcctgtatgtgcatttttaaatgttcacgaatgatataagccagatatatttcttagaggtgcttgaaaaaagttatttcttcttgggctttattatctcaatttaaaaaaattaagatgcataattctcataagataacagattcagaagaatatag

SEQ ID NO: 48542 - DNA, 1033 bp, Homo sapiens
acctttgcctgttggtggcacttgtgggagaaggggagatgatatgaaaagagccacaacaggagtcacctggacagggtggagcttgatggaaactgacatttgtgcccattggaggcaaatgtagaatttggtatcttccgtagcgtcaggcacatgaaactctccagtgcccatgacttttgacagtgacttcagagcacatctgggagacccatgtggcccaggctccacacagaggatacagaggaccaactgtataccacttcatgtgatgttggagtgctgttctgcacgcctaactttatggcttggtggatcagacaatgcccaatgtatgatggaaagctcaggttgcagggtagctaggtggcccatgcttgagcagtctccactaagtcccaggagcaagccaaaactgcttctgaaaaggagagtagttatcagcggaagatggcatgctccacagttctagggtccacactgatttgcctgtagaggcctgccagtggcttcagatagtatccctatctgccactgacacttcaagcaccattggatctcctgaaacataaagcccaagtgggagagcagcttgcacagcagcctggacctgttgcagagcctgcttttatcctgggcttaaaactagcagctttttgggtcacttggcaaataggtcagagagtaacacactcaattgaggaatatgttgcctctaaaatccaaagagggcctaatggtgttatgcctctttttttggttgtacaaggggctagatgcaacaacttattcttcactttagaagggatatctcgaccactagactcctagaaatttcgctgaagtgaaaggcccttgaatttttataggatttattttccaccctctgacatgcaaatgtcttagtagtaagtctagaatagttgctacttcttactgcttccagtcagcattatgtcatcaatgtaatggaccagtgcgattgatatagaagggaaaggcaattaagatcccttcagattaaattatg

SEQ ID NO: 48543 - DNA, 1130 bp, Homo sapiens
gagtttgcccaggctggggtgcaatggcgcgatcttggtcactgcaacctccacctccctggttcaagccattctcctgcctcagcctcccaagtagctgggattacaggtgtgtgccaccatgccccacgcccagctaatttttgtatttttagtagagacgatgtttcaccacgttggctaggctagatatacagatgattcttatacttaaatggtcactttgtttatgatttccagcaataaccagccctaggaaccttaaaaaaccttccataaagtttttttatcaggctgggcgcagcggctcacgtctgtaatcccagcgctttgggaggccgaggtgggaggatctccttaggtcaggagtttgagaccagcctggccaacataatgaaacctcgtctctactaaaaatacaaaaattagccaggcgtggtggtgcacatctgtagtcccagttactcgggaggctgaggcaggagaattgcttgaatctgggaggcagaggctgtagtgagccaagattgcaccactgcactccagcttgggcaacagagagagtctctgtctcaaaaaaaaaaaaaaaaaaagttttttttcaattataggacagtagatgttttcatcatatgagagtaatgacttacaaattatttactgtcaaaactgtaacatagccatttcttttttttttccaccccgagacggagtcttgctctgttgcccaggctggagtgctgtggcctgatcttggctcactgcaacctctgcctccctggttcaagcagttctcctgcctcagcctcctgagtagctgggattacaggcgcacaccaccatgcccagctaatttttgtatttttagtaaagacggggtttcaccaggttggccaggctggtcttgaactcctgatctcatgacccctgacctcatgatctgcctgcctcagcctcccaaagtgctgagattacaggcatgagccaccacacctggctgccatttcttttttaaaatgaataatgggatttcttgtaaggagtggcctatcatgggtgaaaagatgcttgtataccccatttcaggttatactgcagtgtttgttttgttttgttttgtttgagacaga

SEQ ID NO: 48544 - DNA, 1028 bp, Homo sapiens
gccctgcaagtgttaggggaaggtctgaactactctaatggtttgattttatttttaaaattttttgaaatggagtctcactctgtcacccagactgtagtgcagtggtgtgatctcggctcactgcaacctccgcctcccaggttcaagtggttctcctgcctcagcctcccaagtagctgggattacagatgtgcaccaccacacctggctagtttttgtatttttagtagagacggggtttcaccatgttggccaggctggtctcgaacttctggcctgaagtgatcctcccttctcagcctcccaagagagctgggattacaggtgtgagccaccgtgcctagccatagtttgattttaaataccaataaccttgatatttttgaaagcctacttgtttattttctctctggtatattgcaactatttttttaagaacaactcagcaaaataaaattcctgtttattgttggacaacattgtttcatgcatatatcaaacaggccaaaaaaaaccccagcaactttataaacaaaaaaacggaaaaaaaaggccgggcgcagtggctcacgcctgtaaccccagcacattgggaggctgaggtgggcagatcatgaggtcaggagtttgagaccagcctggccaacatggtgaaaccccgtctctactaaaaatacaaaaattagccaggcgtgatggcatacgcctgtaattccagctactccagaggctgaggcaggagaatcgcttgaacccgggaagtggaggttgcagtgagccaagatcgtgccactgcactccagcctgggcaacagagcgagactccatctcaaaaaaataaaaggaaaaaaaagaagccttttatctctggcctttttgtttttgagatggaaactcactctgtcgcccgggctggagtgcagtggcacgatctcggctcactgcaatgtccgcctcccgagtagctgggattacaggcgcccgccactacgcccagccaattttttgtatttttagtagagacg

SEQ ID NO: 48545 - DNA, 1050 bp, Homo sapiens
cttctaaactgtgggcttcacataatgacatcctaccaagaaatcagtatagcaaaggaggaaaaagagtaacttcgcattggagaaacctaacaaacactgtctcagccaggtgatcaaggccactgtgagcagtgatcagtcaagtcgaaagtgcatatcatatgacaggatgagaatggcattttacctcgacatcttccctcccaaaactaataatcctactacatcagacaaacctcagctgagaaacagtttccaaaaacacctgactagtaccccctaaaaccatcaaggtcatcaagaacaatgtagtcctgagaaatgatcacagccgggaagaacctaaggacttggtgtcctttggtatcctgatatggaatcctggagcagaaaaggacattaagtaaaaaccaaggaaatagaaataaagtataaacttaataatatatcaatattaattcattaattgtgacaaatgtaacatagtaatgtaagacattaaaatggggaaaattgggtatgatgtggaggagaactctgtgtattctatttgcaactcttctgtaaatgtaaacctatttgaaaattaaaaatttattttttaaaaagaaaattaagaaacctatatacttaaatttgaggaaacaaaaattactttccttgcctaaagtatgtgttctacattttaggatttacctgacatcctaatgaatagacttttttaatgtatacaatcttatgtcactaatttaaatgtaaatgtttaagagttacaaggttcagtctattaattttattaacttggcccttgaagaagactcatataagaaagaggatgttttgacctgaattatttctatacaaagcactctttgatgaggacagtacacacttcatataataaccagcacaaaataaaattccagataaatattcatactatcaagcatgtaagaaaaaaagcaacgcaggcttctgcttaatatgctaaaactttctaagatttcccagagccaagcacatttgtctgaagttcagtttttaaaa

SEQ ID NO: 48546 - DNA, 1051 bp, Homo sapiens
aggaattcttaatgcctgaacaatcattgtaccttggaagtagttaacttgtttgtatttcagaggctcaggggcagaagagactgcctcatctcagatgagactttgggcttcagacatttgagtaaatgctggaatgagttaagaccttgtggcactgtaggtaaggcatcattgtattttacaaagtgagaagtacatgagactgggggaggcagggacagaataagatttggctgtgtgtccctaaagaaactcatgtggaattgtaattggaaatgttaaaactgggacaggtggaaggtgatttaatcatggagagcagtgggtgttggaaggtggggattggggaggatggggggattttggtgggggtgaggggtgaaaatggctgttgggggaggatccctcccaaatggttaaacaccgtctccttaatgctttcctcatgatggtgagttctcgtgatgattctggagctgtaagattaaatggatactgtcctgcttggttttggacttacactgggcctgtgaccccacttgtgttactttcctgacaaatctcttccttttggattgagaaaacttacccgatgcctgtaccatcattgtaccttgaaaaaaagaactcccttttaaattcagggactcataggcaaaagggactgtagacttttctcagatgagatgttgaaccttttacatttgtgttaatgctggaatgagttaaggcttttggaagcttttgaaaaggcaagattgtattttactcggtgagatggatatgatatttgggggatcagggttggaataatatggtttggctgtgtgtctctaccaaaacacatgggaaattgtaattctgaatgttgcaggtgtggcctggtgggaggtgatttattcctgtacttgagaggggtggagttggaagtaaaaagaagtgggtaagttcggagcagtaggttgactgtagggtggtgtgagggtggtgggtagtaggaagggggagtagcatgctacagaggcagaggctcatggaaaacctgcac

SEQ ID NO: 48547 - DNA, 1169 bp, Homo sapiens
ccacattaccaggctgtgacaaagatatctgagaatgtagaagcaggttcagaagtgggtaaaagagagagaggtcgggagagttgggaacccttagaagacagcaagatgaggaaaagtttagaccactgaaaataactgttaaatacttgggatcagaagtctgacagaaagatggacagtgaaggccagacttaaaaggtctcagatgaaaatgaggaatgtcctgtgaacaggagccaagggtacatttgattggccttagccctggagatctctgaaactgtgaacatgggggtgatgatttaggatgtatctggtggaatgaacatctaggcagcatagctcaagaggtgtcctctctacatccaacagcctgtgttcttatgtgtgacctaagaaatgacctcaagttgcaacttctatttaaatgagaagtggagctcaaaaatttgaaaaatttgcagcctagccaagtggtcaaaaagaaaagctgattttcaggggggaaattcaagaacgcttagagtgtttgcataaaaaagagcccagtgcaaatagccaagacaatggggaaaaggccttgaaggcatttcagagatcttttcagcagccgttgctgtcacaggccctagggatgaggagagaatggtttcctgggccagctccatggcctggctgctgtgtgcatcctcaggacaccgctgcctgcatccctgcagctccagctccagccatggctgaaagatgcacaggtacagcttgggtcactgctccaagccctgatggcttccacatagtgttaagccaggaggtgcacagagcaagagactagaggcttaggagcctccgtctagactccagaggatgtacagaaaagcctgggtgtccaggcagaagcctttccaagaggcagagcctcatgggaaacctttactagggcaggaaagaagggacatgtcaggttgaagccctcacacaaggaggcaccatccttcaaaccccagattcatagacccaccaacagtttgcaccctcagtgtgggaaagatacagacactcgacaccagcctcgtccatgagggcagctgcggggacttatcactgcaaacccacaggtggagatctgcccaaagccttgggagcccagccctcacacccctgtgccg

SEQ ID NO: 48548 - DNA, 1005 bp, Homo sapiens
ttactcctcaaaacacactagatttagcatttcatggatgacttgtgtttgaacaagtgttactgtgatggttgccagatgattatttttcttattctcttctttgttctacatggtgaaataaaaccaataaataaaggtgaaggcaaagctcatgattctggtgctccaattccctgagattaggccagtggtagacatttcaagctgactttatgtctttttgatttgtccccgttactctgtcagcacttttttaatttctggcacaagatgttctaaactaatcttgtgttttctctgccctagccctagaatgagtaatttttcttataagcagagttggagccactgaggaagcacaggagagccctccccagcacgcgctcactagtccccaacagaagaaccgctgccccatccactgaggtaccaagaaactagcaaagggccttctagctgtctggggacagtcctcatgtggtccctggctcagcctcaagggttctggattagtttccctgcagcctctgtgctgtgtctccagatcagggctctgcgggaagggccctgggagacccagcagcacagggtgtctcgtctgccaaatgtccctcccttcctcccactctgacactcaggaataggctacatggcatgtctaggcagtgccaggccacctcactgtctcctttgagatgggcccacacggccttggggggcgagtgtgaagctgggtacctggagcctgaggctgactgtccctccctgtgtcttggaggagaggccttacagcccaagaaaacccccagggcctgacctctgggcacacatgcaggaaggaagggtctgtgggctgatgggggcattgtaatgagactttgaacacagctgctcaagggcctcatcagtggaccatggtcagagatgacctagccatcaggacctggtcagttgggacctgatcagcagggacctggttagcggtggcctcctcagtgaaga

SEQ ID NO: 48549 - DNA, 1052 bp, Homo sapiens
cctattttaaaggagactcttttctgctacataagttatgtttcctgttgtctcttttttaaacttatttttctaacaattacccagagttttgtggcttaaaagaaaaacatttatattgttcatgaacctgtggtttggaaaaagattggccaggacagcttgcctctgctcccctaagcttccctaggaagttggagaaattgaatcatctgaagctttgctcacccatgtgtttgatggttgatgctggccattggctggaaccttggctggggcaggcagcatgaacactgacactggcactcccaggctgtctttgtggactgatctctctcacaatctgggggctgggttcaaagggaaagcagtctgagatgagatagggaagccacatggtatcccttgtactgcattctattcatttggagaaggccatcagtaaggatgacccatattctattcttttaatgggatgaatatagattctcttttgttttaattgatatgtatatacataattatgggctatagagtgacattttgatacatttatatggtgcgtaatgatcaagctaactagcatgtttactacttcttactacttcaaccatttttcatttctttgaattgtgaatattcaaaatcttctagctttttaaaaatattcaataaatcatagttaaccatattcaccctacaatgccacagaacatcagaactcattcctcttatctaactgtaattctgtatccattaaccagactccctccctctacttctatgagcttttttgttgttaagagacagggtcttgctaatgtagtctgggctctgggcaactgtagtcatccagactagagggtgatttgatcatagctcactgcagcctcaaactcttgggcccatgtgatcctctgacctcacccctcctgagcagctaggattatgggagtgcaccattgcacctgtttgattttttactttgtagagatgtctctctatgttgctcaggctgctctggaacttttggcttcaagtgattctcctgc

SEQ ID NO: 48550 - DNA, 1047 bp, Homo sapiens
gggcaggaggattgcttgagcctgcgagttccaggctgcagtgaggcataaatacaccattgcactccagcctgggcaacagagcaagactgtctcaacaaacaaaaatctaacaattattgagttgttgcttgttctggaagtggttctaaatgctttacatagagtctcatttaagcatcacactggtgtcttgtgagctagctgctttgtcatctttattaatgaggaaattcaggcacagaaaggctaagcaatagctggtatgtgactgagttcaaagtggaactcaaaccctagttgaactgaatccaaacaccaagcttattctatccaaataggctgctgtttcattaaggtagggagcagtaagagctaataaatattgtactttcttcaaaagaaaattgtttgttttgaaggcagaggaataacatgccattcaatgtatacaattacatgaaccattgtaggttttgagatactgcactacatttcctgaaaactcctctcgctcacttaggactgttctacatttggcctgtgcccatggccatgtggaagtggtcactctcttgctggggagaagatgcctgattgacatctgtgacagactaaacaggacgtctttaatgaaggtacatagtagccaactctttcagcatgaaatgcatttgatttaaatacatagaattaaaatgaattttattttattattattatactttaagttttagggtacttgtgcacaatgtgcaagttagttaacatatgtatacatgtgccatgctggtgtactgcacccattaactcgtcatttagcattagtatatctcctaatgctatccctcccccctcccccaaccccacaacaggccctggtgtgtgatgttccccttcctgtgtccgtgtgttctcattgttcaattcccacctatgagtgagaacatgcagtgtttggttttttgcccttgcgatagtttactgagaatgatgatttccaatgtcatccatgtccctacaaaggacatgaactcatcattttta

SEQ ID NO: 48551 - DNA, 1030 bp, Homo sapiens
tcacaggggatgcgacgggttagcttgggctcagaggcctgacattcctgccttcttatatttataagaaaaataaaacaaaatagtgttgaagtgttggggcggcgaaaattttttggggggtggtatggagagagaatgggcgatgtttctcagggctgcttcaagcgggattaggggcggcgtgggaacctagagtgggagagattaagctgaagggggaggtcttgtggtaaggggtgatattgtggggatgttagaagaaacatttgccatatagaatgattggtgatggcctggatacggttttggatgaattgagaaactaaatggaataacagaaggagaaaaacaggtataaaaggtctaagaattgggactactcaggatatctgattagagagtgcctaaggagattcagcatagtcctgccagcaaagattatttatttacttcaagagttaacagtggcagtttggggatagcaccaggagatataagctgagatggcttggaaaaacagtgtaaaccggcagtgtaaacaagagcagggcatgtatgagtagttgagaacagtgaataggagtatgactagacagaagatagtaaggatgacaagtttttttgggggcacagtctaagttggtctggtgtctggaatgagactggggcctaataaaaaggagcgtctatataggagctcaaatgggctgtaccctgtagcattccgaggacaggcctgaattctgagaagggaaagtggtaaaagtattgtccagtcctttttaagttggtggctgagcttggtgaggtgtgtttttaaaaaacctttagtccattttacttttcttgaagttggaggaccataagggatataaaggtttcactgaatactaagagcctgaaaaactgcttgcctgatttgactaataaaggctcgtctgttatcagactgtattgaggtgggaaggctaaactgaggaattatgtctgacagaacggaagaaatgactgcggtggccttctcaga

SEQ ID NO: 48552 - DNA, 1081 bp, Homo sapiens
tgaaacaaacagatatagctaaaaagccagcagaagagagaaaacagaagactaaaaaataatcacactaaaggaagaatcgagaaaaaaagaaacagagacagaaaacaaatagcaacagggtacacttaaatctagtcatttcaaccattacattaaatataaaagggcccagccttcatagctcatgcctgtaaccccagcactctgggagctgaggtgggaagatgagttgagaccaggagtctgagaccagccctggcaacatagtgagatcctgtgtctgcaaaaaaagaaaaatttaaataataaaaaattagccaggcacaatgccatatccctgcattcctagctactcaggaggctgaggtgagaggatcttttgaccctaggagttcaaggttacaatgagctatgatcatgccactgcagcccagcctgtgtgactgagccagaccctgtttctaatacatgaatatagaaggactggatatctcaatttcaaagttcagattttcagatgagattaaacaataaataaataaacaagacccaacactatgctgctcacaagaaccacattttagatacagacacaacatttaggcaaaagtatagatgtaaatgtgccatgcaaatactaatcctaaaagagttggtatgcccatattaatattagataaagtggtcttcagaacaggagtactgccaaagataaaggtgtcgagtcataatcaaaataggccagttcataaaattaacaatcttaaatgggtgaacctagtgaaacttcaaaatgtgtgaaacagatatcaacagagtaaaggtgacgatcatcagatctacttttcaagtgtatgtggaacattaatcaagatagattaaatactggaccataaaataattctcaataaatataaaaggatttaaatcatagacagtttgtactctgagcaaaataggactaaattaagtcaataacaaaaatatattcagaaaaaccttaatatttggcaattgagcaaataacttttaaataaaaatggatataggaattctcagatctatatttaaattttta

SEQ ID NO: 48553 - DNA, 1057 bp, Homo sapiens
tcactatgtctctacaaaaacttttttaaattagctgagcatggtggtgtgtaccagatactcaggaggctgaggcaggaggattgcttgagcccgggaggttgaggttgcagtgagtttaaatcatgccactgtactccagcctgggtgacacagcaagaccctgtctcaaaaaagtttttctaggccaggatctatagtcttcaccagactaccaagtaaatccgtagcacacatgattttaggaactcatagctctctgtggacccaggtggcatgcacatttgagtaagatttgcgtttgattgtcctctcctactttcttggtcttattttcattttagtggttttgagttgtctcttattgatcactacttcgatctgttttggagctagatggagtataaattctaaacaagtagaaagagtagatttgattttacagaggttatattggctggactcgatgggtacctgcgtgtgagtatgaaggagagagggaaggctcagaggtagcttagataagcaaggtaaggaaaagtgaggaagaatgatgttatcaatagtaacaggaggtcatcagggaaaaacaggtgaagaagatggtgtgagttttaggaatcagatggtcaagtgccctagcaacagcaggagagacacaggcctcggggagaggggtgtggactgcgcatgttcactgtaggtgggttatcgcctgtatttaggtgtgttgtcccccctggaaaagggaacaatcaaagaggaaaagaccacttaacaagggggttgggaggtagttggccagctttggaatagctggtgagagagagaaactttcattaccatctagttaccacctgttctctagatgggaaaaagaaaaaaaaagtcagtaaatactggaagcagacagttaccagaagtcacccccacaaaaaaataagctgggtggtgggggtggtggttagttgttgttgctagaagacagaagacttactatttggaaaccttccccgggttccacaggatctacgagattctagtcagcaaagggagc

SEQ ID NO: 48554 - DNA, 1027 bp, Homo sapiens
aactgggtggatcactggtgagaatagaagtgtaaagtgttgctttttattaaaatatgatttacttggttgctttcaaagaacccaatataattttctttgtaaaatgattttgacacgaagtagcagaaaaagctccaaacattagaatatgaccagtgtcctggcttcacagttaaactatctttgctcagtttccctacttgcaaaataaagtgaagtaaaatcaaaactctgtggttctttccagctcttaacattctgtgattcttatttttagccctctcctaaaataatgctgtcatcttataagaacttcaacagacttgaggtcttattgcacaagcactttttctaagatgaaaacataccagcatagtggtagagttctctactttctagttttcttgcaaagcttgacttgatgcttattgacgtagctcctaacaggaacttaaaaacactcctttttcttaattatttcagctgactccttttcctactgtggcattctgttatctgaagtcaaacgtacctgaatgtgtcctattgtgttactcaactcacttctgaatatggttctgttttgcataccaccaacccacataaccatttctgaatctcttgtttcacactgctccagtgacaacttgattcacaggccgaactagtgaggtaagaaagtaagtttgccaagtttgtataatcaactttgttataaaattaaggtaaactatatatggtttaaatacacatagacacacacacatgtacatggctgaaagcttgatggagttggatttttggattcacctgaatagcaccactgaaaagatgactttaaaatttttttttcagaattgcggcgagcagtaagaagcagcgtgtggaaaagggagacgattgttcatcaacatgagtatggaccagaagaaaacctagaagatgacatgtaccgtaagacttgtactatgtgtggccatgaactgacatatgaaaaaatgtgattttttagttcagtgacctg

SEQ ID NO: 48555 - DNA, 1055 bp, Homo sapiens
cagtaacaagactgcttacactgaaaattgttataaatttccatgaaaggcagtccttagttaatagcttccagcattgtgaaattctaggccaatggaactaggaggttggaacgtggtaaaccactgttttgtctccagcttcaattaggccttcagtactgcgtaggacctgcacccaccccaggtttcctcagctccccgaaagtcgatttcagacctacagaccttttttcactcttctaaagccttaccttgtttttaaaactacctccttctcattctcagcagtaggtagttgatttctgctttcctaagttttaagttgttaaatgaagtaatgtgaaaaaagtatttatcttaaattttttttatttacctgatgttgacatttgccatatttactttttctttcacacacacatattttgccaagccatttaagttgcagacattgtgattcttataaacacttcagcatgtttctcctcagaacaatggcattcgactgggagcagtggcttatgcctgtaatcccaacacttctgtaatcccaacacttcaggaggccgaggcgggtagatcacctgaggccaggagtttgagaccagcctggccaacatggtgaaatcttgtctctactacaaatacaaaaattagctgggcatgatggtgtgtgcctgtagtcccagctactcaggaggctgaggcaagagaattgcttgaacctgggaagtggaggttgcagtgagctgagatccccccattgcactccagcctgggcaacaagagtgaaaccctgtctcaaaaaacaaaaaacaatggtgttcttctacatagctaaagaacaacgatcatactcaagaaacttagcattaatataatgctgctaccttgtgtataatttaatattctccagttgttttggtgtcctttacagctttttgtcggatccaggtgttattcaaggatgatgcatattgatagctgcttttaaactagtccctcagccttttttgtctttcacgacattgacattttgcagtgcccaggcc

SEQ ID NO: 48556 - DNA, 1007 bp, Homo sapiens
gcgacgcggcgcggcagctgctcggctccactcggccccgcgcggcgctgctcggctcggcggccgcggctgcaccaaggcggggcggggagactcgcggcgggcggggcggaggctggggaaaggcgcagcccgaatagaggagcgacttcctccctctctccgattgcacgtggggcggctgatgtaagacctttctcgtgggtgggggggcttccccgccccccggcccccgccgcgctgagactccttctacctccggccccacgtcgtcgcgcccggagctgggcttgcggcccgggctgggaggttcgcgggaagggttggtgggaagctttgcagtccggctgcgggggtccctaaaacccagtccatccggggaggctcacgggggcggcccgacgcccgcggaggcgcgagatgtgaagaagccggggacaggctttgacgttcaccttttgcctgccacacagtctggggccaacaggccgaaccccgctgcctccttggcagactggcgtccgtagtgccgccgaggatcccccccgtcgggacggaatcgcggccgaccggccctggcagggcagctggggtcgcttgctaagccacagagcagccgagcatccccaccctgttcaggagagtctccctcggttttctaacattttaataggagctagagaaggaaacgattagcatttctaatagggcctcagggtttccccgcagacttttttttttaatctcatttattccttagggcacccctgtgaagtgtgtaaattcttggtggtctaagtttcgctgaaacctggcaggcagcctttgtcatggtctggcccaaagggtcccaggggttagagcaccagatcgggatgagtgttgtgctttgcagaacaccggggaatgacgttatattcagcgtacaataagtaaatacataatgtgtcaaatcaaatacaatctaagaagatcgtactgacaagaagcaccaaaaactaagaaca

SEQ ID NO: 48557 - DNA, 1047 bp, Homo sapiens
aacgctttgcagagttcaattaacaagagcgaggtctggtataaagaaagtggttttattctaaagattagcttaggggaagaggtacaggctcctcctgcccttaacggtaccgcctcacttttggggcagaaagcagaggcttttaaatggggactttgtatgaatggcatgcagggaaggagcaagcagatgggggtctatatgactcattttgatgcgttttctaccaagtggttgagctggtgccattgagggcagaactaggttgtaatgtggccgttgtcttgagatgctgtccgggtggaagagttctgttgaaggcatactttatgttgtaaattgactgttgtctcttaaggcaatctcctggtgggagaaagttctggttctagaccctctaagtaggtagataagtttgccctgtagggactatctggtgaagggaaggtaatggttataattacatttctaaagagctaagtagaggcagggcacagtggctcacacctgtaaccacagcactttgggaggctgaggcaggcggatcaccggaggtcaggagatcaagaccagcctggccaacatgatgaaaccctgtctctactgaaaatacaaaaattagccaggcgtggtggcaggtgcctgtaatcctagttactagggagccttaggtaggagaatcgcttgaacccaggaggccgaggttgcagtgagtcgagatcacaccactgcactccagcccgggcaacaagagtgaaactccatcttaaaaaaaataaaaataaagagctaagtaggaagtgggagacaggagaaaaagggggaaaatcttaaaaataattcattctctttctcttagaaaaatgctctttttcttagaaaactcagtctctgttacacgtttacagttatagcaacattagtcacaataggcaacacggaaacaatccaaatgtccatggaaaactgtttggccttgtttatgaaagctgaatatccacataccctgtgatccagacttaaaaaacaacaacaacaacaaca

SEQ ID NO: 48558 - DNA, 1069 bp, Homo sapiens
tgtatagatacacttccattccttctgcatgaggctttcagcaccggatatctgtaggcacattattacagggaagcattgatttttgcctagtacaatatgccttctctttgaggaaatgaaaatcatgacaaataaaaagccatttttcaaaatgactttgattcttgcagtttatgattcagaaatgaggcctgggagaagggaccttaattttctgggctaattatttggctcccgttgtaaaggagcatgtttttcctgaaggagcccttagtaggcccacagagtctgatagcagcagtggctgctttcagtctgcagaatgcgtcgcagttcacagcatgcctttctgttttgcgctctgtgaacactagctgactgacgaggtggaggaatcatattccatctgtggtaggggacaggggctctgagaagcagagtcacaaagtctgtccagactgaaataagacaggatatgtgttctcaaggcaagaatggatggagaaccacacgatgtggatgccatggatacagaacaagaacttggaactggagggtgggatggcagtggtgcccctgcttcactccgcaagtcctggttccttctgtaaccagctgtaacctcggccaagctgttcaacctctctgagccttgagtcccctctctaaggtggggataattgtccccacgtggcccacttccctggactgccatgccttcaacaggagataatggagaaagtgcttcataaattgtgaagggctctttataagccaagggtaattgctgcgcagataagagctttgactgtagagtctataattcctgcaacattaataacaataatagcttttttttcccccactgagccattgctgtgcctgccgttgtgcctagtgtttcacatgtttaattctcatgatggctttaggaggtaggcacaaatactagtgcacccattttgtagctaaggaaactgagactcagaggtggaaggtagtttgctgagggccccgcagatagcgaagtgggattcagactgggctctgtgtgactccaaaagcc

SEQ ID NO: 48559 - DNA, 1902 bp, Homo sapiens
ttaccttcttagccattttaagtgtatgtacagttcagtggtattaaatacattcataatgttgtacagtcatcaccaccacccatgtccataactctttccatattgtaaaactgaactctgtatccattaaaccataactcaccattcttcccaccctctagtcttggcaaccaccattctactttctgtctctacaatattgactactccaggtacctcagatgagtagaatcatacactgtttgtctttttgtgactgacttctttcatttaatacaacgtcctccagtttcatccatgttgtagcatatgtcagaatttctttcctttttaagctgaataatattctcttgtatgtatacactccattttgctattcactcatctgttgacaggcatgtgagctgcttccacatttcagctattctgaataatgctgctatgaacatgaacacacaaatttctgtttggaatcttgctttccattcttgcgggtatatacgtagaggtagaattgctggaccatatgataatttttaggggggaaccgccatattgttttccatagcatctgtatcattttacattcccaccaacagtgcccaagggttccaatttctctatgtcctcatcaacacttgttattttctggacttttttggtagtggccattataatggatgttacatagtatttgggttttttttttttgaggtgacgaaaatgttctataattgactgtggtgattgtgcatatgtgtgaatatactagaaagtattgaattgtacactttgaaggggtaatttgtatatgtgaattatatctcaataaacctgtttattttttaaaagctttccatggcctactcttcctagcagaaagtccacagtccttcggctggcccttctgcctggccctcatcctcccctagtcccatctcagctggagactgcacacgtggcttgctggcattctgccctttgcctggctgcatcctcccacccccgccctggtcgcttgcttcgttctcctggttgcgttctcttggttctaccttgttaagattcgagctcaaacattaccttctcaaggaggcctttcctgactccttggactagattcctcatgatgtgtgcttctggtttcctgcatgtacatgccccattgactgtgccagcccccagcccctgcccctagtctgttctgcatcctcaatcccagcaatagtcttccacatgtatttgtggagtgatgaatcaataacatcctaggtcttaagacttatggtattaatgttctgccattttcctaaaatgatttgaagcaacataaagcaaaacaaaacaacagctaataggatgacttataaagctatgttaattaaaacattgtgctctaaaaccaaaaagagatagccagtcagtggaacagaatagaaactctagaagcgtgcctgaataaatacaataatttaatatataataaattagaatgtgaaatgattgagaagaactgaatttatcaacaaaaggtattgaggatgactggttacatttaaaaagtttaaatgtcagaacaacctaattaaaatgaccaaaggacttacatagacatttctccaaagaagataaacgaatggccattaagcccatgcaaaaatggtcaagttcaccaacctttagggaaatgcaaatcaaaaccacgagtcaccgctttacacccattaggatggcttttattaaaaaacaaaaaaacaccacagaagcaaacaaaatgacaagtattggtgaggatgtgaagaaaatggacctttctgcattgctggtggtaaaatggtacagccaccatggaaaacaatatggcagttcctcaaaaaattaaacatagaattaccattg

SEQ ID NO: 48560 - DNA, 1060 bp, Homo sapiens
aaagaagctgatgtataaagatgaaattggatttataccaaaaataaatcagttttaggtgtttagcaaaagagagctgtaatggctttgggggagccctggggaaaggaaggatgtgttcagaatacggggttggatcttggaaggcttggtcctggttcctgaaatttgggttctctgagactcagtttcttcacctgtaaaatggggaaaggcacctgctccaacctctctcagggtgattttatgcttaaattagataatgacactggaaagtccttgaccaaagttaagaaaggcatatctgggattgctgagtgtttccatgagagccctgctgtgataggtgtctgaacgtgtgaaggaggaaatcatggaagctgcagaagaagcagtgttgcaacgataatggggactaaagtaggtctcatttcagttttaggaggaaatagggcagtagatggaaagattgagctatctatttttgtttttaagtcactttgcagggaagaaattgggcagttggactctttcattctctatagtcagaagtcagaagtcagaatgtcagagtagatttaaggcccacatgaaaaaacagataaatatatcctgaaaagagtttcttgtgtggtttggatgtgtataagaaaccaatttaaaagcgttcagatctttgtatggtatatgtaatgataactgacataatagcgttaggaagaacataaccgtgccataaaccctgtcattttgactcttttgaagaaaagctggtcagagacgtcggggatagaggacgatcctggcttttttacttgctgcaaaagctgctttctgcagtccagctcctcttgtttggagctgtacaagatccttcagaaacctggaatgtgggaatcctgggttattgtctacatgcactaggcacaggcatgagcttgtctaagtgaaaatgcagtatatcctactattagcaccgccagcattgtcaaagcaaacacattccccagtcttagcctcttctaaggactttataggtagtaaatcatctacttctcac

SEQ ID NO: 48561 - DNA, 1014 bp, Homo sapiens
gttagggcagagagaatttggcctggtttccctggcgctgtccaaggtactctctagtagttctgctcagcctccactcacatctttgtgcttcctaacaactcagcctggattcagagctgcccttgcctcactccagtagagctggtgtgtggccatcatcatcatcatccggtccaaatccctcaccatatgccggagggaatcgatgtccagagcaactgagtcagggcagtgctcctcctggagaggaaacttgcagtcccacatccctggctcccactgcactgtgcacggagttcctgctggctctgggttccggtccttcagtagctctgtgtgcttccactagctacagaacctctctgagcaccagtgtattcgcctgtaaagtaagggtgagtaacacagtatgcttacagggcagttgtggggattacatcataaggcacacagtaagtactcagcgaaggtcaaacttccattcttgttacaaggtcgtcgatatcttccacagtccctggttcaggctcaagtatgttttgtgatttgatgtcctactgtgttcctcgcattaatcagcccctgggactttatagattaatgatcacgtttcctattcttgaagtatgcagaggcacaaggaacccaaggtcttaggtcagctcactcgggtacatctggctcgggactgctttggctaagattggccagtgcgacctggcagagagagggccaagtccaggggcgcgcggccccgccctggcctgaggatagtgctcccaccccgggagacttctagggcggggcccatcaagaatggggacgcggggaggtcaaatgcctggagggggcggtagcgcacgtaaggttgggaccccagctttgcttggggttggcaaagggcggtcgctccgtctggtggggaggaaaggggtgtcctcagccaaggccctaaaggccgggcagcctggcaccaacgggcgttcgagcacccgtgggcgtcttcagcga

SEQ ID NO: 48562 - DNA, 1047 bp, Homo sapiens
gtttactgagcatctaccctgtgccagccctactcgtacgctctgtctccaaagatgaaaaaggacttctctgccctcaagggaaccccacagtatcttagaggagacaatcatgtcggtgagatggtgtggtgatgaagcctgctgggtatacagctcagggaaagtcatcgatgatggctcaggctcagcctgggcacgccccagaggagagagatggagtggggcctcaaagggcaggtttaggcagaaaagaaaaagggcattccagctggggcatgtgcaaaggcagcacgtaatgtgtaagttctagatcgtcagggaggaagggtcagttgggtgcctgtttttctgtttttagtcctttaaaatgagtagaagcaacctgttaccctggaaagagcactggacatagacctagtgctgcgtgatgttgagcacgtttcttcttccctttgagtcccagtttcccttttggttacagggggatagtagcccccagggatcatgtgaaagtgagaaagcccttttcacactgtggagcggtgcagatgtgggaaacctcaaagatggttgcccattttaaatcctttcatctctcatctctctttcttctctcccttctgccctgacgtagccatggttgggtgggtgaggccagaagaaactgcctccggcaagaggtagcagccgctcaggtggctctgctggcatcggagcccacagaagtgaggagtggccgatggacctgccctccaaatgtgcctgactctgggtcttgctgtcactggatttcctggcatggcagacagaaagaaagatagtttgaccaagtcgtagaagctgatccagcgggtaaaaagggggcagggaactcgtcccttttattcttgcctcagagctgcctgaagacatgggccaggccggaggctggacaactttggataacgctgacctgtacttccaagtaaatgcctcctgaagagcccgggacccttcctgggagaattctgcagccagaatgaaggtgccatcagcaggaggcac

SEQ ID NO: 48563 - DNA, 1032 bp, Homo sapiens
actcctggagctagaagcacttgtgattcttgttttaatttactgatggcttcaggggttaacagtaggcctagaattgtttgcctctgaaattcatggcccctgacgttatgtgctttgaggttttgtgcctgctttttgctgtggtcctgtttttttcataacaatatactggtatagcttccactcaggtaagtttgattgaacaatgatacacagctgcaccggggggtcaccttttcacaaatgtagacctccatgaactcattggatgaccctggacagagcggggctattcccattttgcagacaggacagcagaggctccagacaatgcctttcctttctttttcactggactcaagtgtccaaggcttttcatcctaggaagtttgtgtgctggttcacaagaggtccctggcaccctttctggggatgtttggatgcggctggtaggcagggaagagaaagggcaccccagcgggggcatgtgtggaggcagcacggaacatgtaggttatagatcgtcagggaggaggggtcagttgggtgcttgtttttctgatttttggtccttgatcacccccttcccttcccacacgtgtccccagcctgcctgtggctgttccccccacaagaagcacctcccttgcttggcaaccttcaccagcatttcccaaaagtatgctcctgggaaccctagttccacaggataataggtttttcataaagaaacgtagggtgtgtatgtgaaagtggggtgaggttccctggttgagtaggtttggcagacactaaagcgagctacacgatcatctttgctacaggcctctcacaaccttcagcatgccagcatgggtcaggcctcttcacagggccaagaaactcatagcatctcccacattactctcatcacttctccaaggtgcttttgcaagactggaattccttggacaccattggagaagccccgctttttctggaacagcggcaaccaagaggccttgcagccctggaagtgggtcagggccc

SEQ ID NO: 48564 - DNA, 1039 bp, Homo sapiens
aaggtcagaccagatgatgctctggtactccacagtgctcacctgtatcactgcagggctttctgcactgaaagtggaagcagaaggctaatgggtcacattgtgtaaaggtctctggtgctcaaagtttctaggcaaagaagtgaaaatttggaattttgtctacatcctattaatgctgtgttcctcaaaagggaattggcttgtgtagtttcctaccatatcatattttattaaattagaggggccctgacttttaaaacccactggctttctgaagtgttttccagtgaatgactcattcagccagtgcttgttgcatttatgttagctaccaggtgccaagtgtgcagacacaatacagagccttcaggctctcgacaggcaagagaacacctgtaaatagatggtcccgacattgagaggcagcatggtagagtgggcagaccttgtgctctggactcaggttcaaagttcagatgaagctcaatggcctcttagttggagcttagaaccagtatgcccaaagtgctgggtctgcaggaagtacccagtcgatggtaggctgcacagaattctgatctctaccttgagccatgctgagccacaagttggtctccttgggaggtgccatctctcatctgtccctcccccagccatgaaagcccattcccctatgctggctttcagaggctgtcgttaacttactgcccagagcctcgtagttttcttcccctgccctgatggttgggtgtttttcctttaaattctctcagccttacactcacagaagccaactttccacaggactgaagacaaagtgtttcatttagctgttactgatagacacctttacaaaggttactaatgtcccagcctttttaaggagacacactcattcatcccctactatgtgctggcagctttacctttgtcatttcatcctcatggccaccctggaggtggcattgtgtaacctcatcttgcacattcgggaaacggatgcttaggagagggaagcagcttgccagttaaacag

SEQ ID NO: 48565 - DNA, 1026 bp, Homo sapiens
gggcatcccaaggccaagtagttttcctccagtctttactagttccttctcctctgtaaatggctggattctaaacatttcttggttgttgcgtgggcctagaccacctcactttacatatagggaagcccaggctcagagttgggcagtgatgcctgacttccggaccagcaccgcttctgctctgctgttagatgtcaagggggagggcaggggggtaaggcaggtatggaggttgtcagaggcgggcagatctcggctgtcaggaagggcatcgtccaggaaactgaagcctgagggtggctcacagaaggtgaatcaaccaaaacagtctctaaagactggggcattgatttattcatgaagaagagcctttatgtctcaggcaccatgcgggtattgaccattcagaatcactctgtgccaagcattgtgctctgagcatgtcacacattatagtcattcatttaatccttacgaaagccacagaagtcagtttcagtttgtagatgaggaaaccaaggctcagagaagttgaggaattcacccagggtctccaactgcctcagtgtagctaacccacagcacataaaggagaggcaggtggtgctgtgagagctggcttagaatcggggctgaaaagacatccctgaggaagtggcaaggcagctgagacctgaagcaagagtggaaaccactggttagaggggtagtagaaaagtgcggagcaggcagagggaagcacatgtgcaaaggccctgtagtgaggtgtgcagtgtgtttaaagaactaaaggaatggttggagtgcagagcaagagacatgacatgtggggaggcccaagggacagagcaaggcccccagggtggtaaagggtgactcagtcaagtaagggaaagggctttggggaggggaggtgggtgagtgatggtggggcgggggagggctgtggcccaggcgttagaggaccctttctcctcttcgcctccagaggccagatgtgtgagccaaggagaggatggagtg

SEQ ID NO: 48566 - DNA, 1052 bp, Homo sapiens
gaggagtataagtcagcagggaggaaaatctgattgtgttcgtggccctcacaaatgcgtttgcgggcagttcgctgcagctgctgaggagtagggtgctgagcaggttctgctgagcaagataagttggaatcacttgcacaggctctagtctgtactaagttgataaatgcatgctgccactggtgtcctccttatttgggggctgcttttattgttttgtgatatccagtgtgatcatttatcaaggcctcagagattcaccagcaaactcattcctccccaaccatattttctatgtggagtcttgagttccacactcgtgaattctcccacctctgaggttttcaggaattgaagcccctagagattcagttaggtatttgtgccccattgttttccaaaaaagagtggagacagtggatgtctgtatggactgtttgtacccactctctttccctcttgttcattattaaaaatggtttgcagagtcctaattgggatgaaaaaagaagagggccaatagcactttctttgtagaataatttctctggttcataaagcttagttttcctgttgagagttcctgggtcctgaggcagcgagccctttgtcctgtgggtatatgattgttataggccgggggctgcaatccatccccgaagagcttttttttttttgagacggaggcttgctctgtcacccatgctggagtgcagtggcgcgatctcggctcactgcaagctcctcctcccgggttcacaccattctcctgcctcagcctgccaagtagctgggacctcaggtgcccgccaccacgcctggctaattattttgtattattagtagagacggggtttcaccgtgttagccaggatggtctcgatctcctgacctcgtgatccgcccgcctcggcctcccaaagtgcttggattacaggtgtgagccaccacgcccggcccccaaagagctatttttattatattcttctgggaaatatttggtcccagtcaaggacacgtgagcttttccctgcctcatgtctccatct

SEQ ID NO: 48567 - DNA, 1137 bp, Homo sapiens
atgcagtgtttcactttccattcttggcttatttcacttaacataatgtcctccagttccatccatgttgctttgaatgacaggatttcatcctttttatggctgaataataatccatataaacccataaatgtaagtaagtgtttccctgaattctgtgagccactagccaattaatcaaacccaaggagggagttgtgggaactctgatttatagccagtcaaaagcacaggtaaaacaatctggggctttcagttggcatctgaagtgggggcagtctcctgggactgagccctcaacctgtgggatttgatgctgtgtttggatagatcatgtcagacttgaattggaggatacttagctggtgtccactgcagaactgattaattgattggtgtgtaggggaagaaagctccatacctttggttacagacacattctgtgttgattgttgtggggtaagaatagaggaaaaatagtttatttttttgtctctagtcacaggatggaacatagagcgctgtttttatggcttgggattaggaggagggattagctagaaaaggaccacttaaggacattcagaggatgatggaactcttctgtatggtaccctcttggtggatacataacactatgtgtttttcagatcccatggaattgtgtacaacagagctattttttactgtatgcaaattaaaaaaaacaaaatcaaccaggaaccaaagatagaatgcaaactatgacagaagatctaagtgtattcaaatgaatgacctaaccacattgtaggaggtggaggagaaaatcgtatgttgagtggatattaggctaaagacaaaaagtactgtatacaagtactgtactctagttgatattttttttcttaccaggatatgggctaacaattctgttatccttaccaggatatgggctaaaaatttttttgtgtacatgtacacttaacatatataccaggattgaataaataagtagcaaagtttttactgtcagagacagaatcaaaggaaaaatgctagaacaaactctgtggatgttgggttgaagtcagaggtatcggtatgaatcagtatgagtgcatgcttttaaatacacagagagttgcacacacacag

SEQ ID NO: 48568 - DNA, 1032 bp, Homo sapiens
ataaaatgagttactgggagggtgtgagtagtgagctccccgtcactcaaggtattcaacagcttggataactttgtcagtttgctgaaggagattcccatactgactggaacatagataagatcccttctaacagtcagattccccatgaccagattagctactttggcaccactgtctgagacagactattgagctgggggcaccactgtctgactcagtacggcagtggtttatggaaaagctgaaaacatgctccaatataccttttaaatgccttccttctattaaaatatcgaataccaattattattaaatatttaagcacccaggagagttggttttccaggttgaagcctgccccagtcactcatccttatgctgtggacacgtggaggggtcatttcaggaaatttccatttgtctctcaggtcctgggagcacaagaggagaaaaggaagacacgttattgacaaccatggtgagtgtggggcttttctaaaagcattttaggtctccggcaatcatcagttgattgatttacaaggagggatgtaggtgtttgtctgtctttgtagtggtcacagatagggttggtgatgagaatgtgtaacagtgggcttagctctggcactgaggagtcagaacagatgccagctctaaactgtggagagggctgtgctggtgctcacccgctgggtgtcagccctggccctgttctcatggaggcaggggattgagggtaggaattgatgggcagcatgagaaatgaagactcaccatttgggctgtggagaaccagggtgagaggagtcaaagaggaggctatgtttccagctggggaggcctcagtttcctcatctgtaacttagagatgtattaggattagggtcaactgtgagtaacggaaaatccccaagtaacaatggtgtaaataagacagcagcctacttcattcaagtaaacaaagtccagaactagtatatggctcattggagttagggacttgagtcctttctgcctgttggtccc

SEQ ID NO: 48569 - DNA, 1050 bp, Homo sapiens
ggcaggactcacagccagggagtaacagtaggtgggctgcagtgtatataaacatctagctctgagaggtcaagcactgaagaaagtagcttcaggcacattggctaaaaagacctgaaagtgttaagtttgttaccattgaaagaatatagaatagccccatcaatcaagagatgctgaaaatttggtaaatgcttattagaaatacactctccaaaaaaaaaaaaaaagaaatacaccatccaatcagaacaagtctgaaataaacatgttttaaaagcctgtaatgacagagaggtggcaaaaatgaagaggatgctcaaatgaaaaggaaaaagaagtttaggaagaactacctgaagccaagagacctcttactttgtccaggtgggaaactgaggcccagagagggaagaaagctggtcaaaggtcacacacccattggaagctgagtgagtgacactcaggaggtgaggattccatgggaagagcacctagaggtgattctcccacctgcagctcctgcatgggctctagaagctggtttaacacatgactcttctgagcctttgcctcatctgtgaaatggacacaatgacaactactacggggtggtggtgagcagaaggcaggttatcctctggcgtgtgagatactcagcccagtagagtgttagggactcataaaggcttgctattagaaattagggccccagtctcctaggacagggttttgttttgtttttgtttttgacacaaggccattgctctcctttaaaggtttgggttgtttgtggcagggatggggaaaggatctgcccttcccaggccctgccgtgcccagcacacctgccatgctgaatctcccctcaccctcgcagggaccctctgaggagggtattcccccattttgcaggggagggaattcaggctcagaagtgaacactccagaacttgcacctgcccgtgcctgccgagctgtgcctcttctgttgtgcatgcgttctccatcccaggtttccttagcctctgcatcttgaatcttcacgga

SEQ ID NO: 48570 - DNA, 1034 bp, Homo sapiens
ggtgctagggagtcatggaaggttctaggcagaatgagtgacaggatgagagttacgttttggaaaaattactttccttgaagtgtgagaatagattagatactctagggtaagctagagtcaaaaaggctggttaggtagagtttgctgcagtctgagtgagaggtgatggtggcctagaccagaatggagacagcggagggagggcacccagatgaatttgtgatatattcagggagtagatcagcaggagttgacgactggcccttggggaggggttaagagagacagcaaggatggcatctagagatctggcttctgtgaagcctgccatgatatctccctgttctctggtccctccgcagcagaaaggcctctgtggtagcatccatcacaccatgttaatgctgactggcttcctcagtacccaaacctggccacacatcagaatcaccaggatgcttgtctaagtgcagattcctgagttccttttctggagattgtgatttagaaggcccagggcagtgaggggagtaagagacagggactctgtgtgagaagaggctccccagtgattctcttgtatggtaggtttgggagccactgatgtgttatgtgtgtctcatctctgcaatccaccaagtgcgtgcacaggggccctggtgagccccctgaggaatttactgagtgaggtttgtgactacagcactgacatgcctcagagtgtctcagagaccccagatcatcagttttaaccaagttctgcaggatagtcttgagcctgggtattttaaaatgtgctgttcctcagttggtgtgacaccgactctatattcaggtagcatctctgcctgtgttgagttgtgctccagctttctgctgcgtaattcataagaaaaggtcaagttgaggagtagtatatatggaagacttccagaaggatgtacagtgtgtctgtccctcacatcggggtaggcaaatgaatggcctgtgtgctgacaccttccagccttgtgctcttcttccttggatct

SEQ ID NO: 48571 - DNA, 1093 bp, Homo sapiens
aaattcctaaagttggtgggtctaagagttgttcattttaaatatcaatagctactgccaagtttgcctaccaaggaggctgtgtcactttactcccccacaatgtatgatagagcctcttactccatgcttttgtccgccttggatattaaccattttaaactttgccaaactgataggtgcagatggcatcacatttgtatttgtgtttctttaattatgactcctgagttacttttgatcatccttgcttgcatggaagctttctttttaagtaacgtggacatttaccaaacatcctgcatgtgtcagtagacatgaggcagctgagactatagtgggtagaggaaaaattattggcttggaaataggcatcttggattcaagttccgtatctactgctttaattaagtggctttgaataaattgcacattatccctaaagttaccttcttcaggttttaagttagctgagactaaaatgacttgtaaagattacccaacaagaaagtctgtagtaatgccagcatgtagttcatgctcaatgatgactagctttaatatttattgagcacatactgtgtgctaaactccatgtgttttgcatatatcagtgcatttaataatcacaaaaagtatatgggttttttgaactataatttgtcaccatgttacagaagaggaaactaaggcccagagtgggataaattacttgatcgtggccagttagtagagctgagattcaaaccctggcagtcttgaatctagagcttgtgctctaaactactatagttcattcattcagttccttagaaggagaaagatcctagagcggcactgttcagtatggtagccactagccacatgtggctgttgagcacttgaaatgtggctagtctaaactgagatgtgctaaagttaaaatacaaaccgattttgaagatgtaatgtgaaatatatgtatatataaagtatctcattaatactgtttagtattggttacattttgaaatgataatgttttcggtaaataatatgttaaaattaatttcacccttaaaaacatttttaatattactagatttctattaga

SEQ ID NO: 48572 - DNA, 1050 bp, Homo sapiens
gaagaaaagcattgaatgtctgcgctaaaactgtcctgtgcaagtggaatgacaagcaccaatttcctgaaccaagagagtggttgttggattagagaacagaaggggctaaagtgaggtcaaacaaggagacagaagaaagtgaggttgaggggtcagggtaagccagatctgcaggggtctcacagatcatgataatgtctttggagtttattttgaatgagacaggaaaacatggggggtctttgtgattgatctgattaatgtatttaaatgatcactctggttgccataggaagaatagacaatcagctggtgaaggtagaaaaaggaagactggtgaagacccttttgcagtgttccagacaggggatgtttgtgggttgggggaaggtggtattggtggagataagaactggctgtgttcaggatatattttgaaaatgaaagtgatagtccttgtgggatagattggatatagatatcgggggaatggaacgtaagagtcaacgatgagtgccactttttgatctgagaaccttgatgaatggagttgctatttattgggatgagaagaactgctgaaggaataggctggaggggttagaaatgctgagtccatccccagatggctctcagtcatctcagtgcagtcactggggtccttttgagggtcagagtgctgggaagacgaatcagaggccttgatttcccaaaggatgcagcaagaactccctgtctgtgatcacagaactgaagctttaaagagcacccacaggaggcgctccccggatgctcattcttagaaaagaggcagggtgactgtgaccaaggctggaggcagctaaaagttagactagtgatggataatgtttgagcatagagagctgctcaacactgcatttggacttgaatttttttgtgtaaataggaaagaaaaaccttggtttgtataatgttttacaatttagtgtgtgctttcaaattcatcgtcatatttatcctatgaggtaggaactgctgtcttcagtttggagatgaggaaatgga

SEQ ID NO: 48573 - DNA, 1022 bp, Homo sapiens
atggctgcatcatggcagaatgtttctggtggaaacagggtccttaaagagcaattacactgttccttccataagcatagatttgaaaatccctttagccagagagaagacacaggcaacaaatggaaggtacaagaatttttttatgcggagttgtttttgagtctctaaacatatcaaactcatcagctaatattaggaggcaaatctcttatctctgattaagagactcagagtgagctggtggacttcagcagaaggcaggggtaggtgccagcatgagcttccttcctaagatttgttctttgtgaactgactggtaaagccactttgttttctcatgctcatagctttttgtttttggtctgtagtttccagcatccacgtttcctccacttttcggaaagggtatatttttccatctcccaccttttcatattctttgtgtgtgtttcaggagtgctgactgtgtttctgtagtcacatctgtgtgtccttttagtccctcacatagttgcctgggttggatgacattcatagaagtgaatattgcttctcaacagcaagtttcctagacactcccaacttcatctccaatgtaaagtgagtccttggtacaatctcaggtcatctttttcttttttcactcctcttaacacaatttgcgctgatataatcatgtgattatttgtaatgccatgtctcccacttgagctacaacctgcatgaagatgggaccttggcgtttttggtctctgtggggttcccagtgcctgggacatattaggcactaggtaaacatttgttgactgactgaatgaatgcattgatttaatgtaaccagaaactcttaatgtcactttacttatcatgacataaagtccatcatcttttcctttttttagttgacagataataactatacatacttatgagacggtaatattttgatacatgtatacaatgtttaatgatcaaatgaggataattagcatattcatcaccttgaacatttatcattt

SEQ ID NO: 48574 - DNA, 1060 bp, Homo sapiens
tgatattttctccaaaaggcagtcactgactgctttggcagaaagaattgaggtgattactcaagagttccaccaaattgttgtgctagcttttacatttgcaaactataaaaaacgggactaaattaagtagcagctcactttttttattaacagtattacaagttgactttttcatttcttgtgtaattgagataaaagggggggtgtgtgtatgagagagagacaaagattttgttaatggttttagtatgattcatttcttatgtcatatgggcattctaatttgagtcatattaattaaggtgatctatgtatgtaaactctttgagggagggacttggcatgccttgtatacagctagatccccagtgtagttccggacacgtggtagatgtgctcagacaacattagctgtatgaatgaaagaacttcttatgatacccaaatctggcagccacaagtctcattacaatttactttatggagggtccccattggtaataaggtctattaattgtagaattgtccctgctgactttaagagacttcactctgtgtccttttatgctgacagagcctacaacttttttcatctccaataatcttcagctccaggccaaaaaaaagttgttcttgccctgctcacattaattgaaataagtcagtgagattccttctgcccaccacctcacttctcactagcatggggctcagctaccattagagatgttagagtggggctgttgtgcagttcttcagactattagtgctgtatgctatgttctgaggagggttcgggcttttatcttctcaaaaatgtgtaaaattttgactcactcatacagctttagatgttaacagatagaagtatactgactgtgtgtgctaggctcttccatgtattatatcagatgttgcttccagccaacctgagaagctaagtactaacattgtccctattttacagaagcataaagaagttaagcaacccaacctaagttcacaccaaaatttgaacccaggtagccttacttcattcagtgcccgtgttcttaac

SEQ ID NO: 48575 - DNA, 1005 bp, Homo sapiens
gtccagtaccaatttgacttaaaagttattttggccaaaagcaatgtggtcaagtacaatttagctgaaagcaagttggttaactgatttgttgtaatcagctattaattgaaacaatgatttcgtcaaaacaatgagttggtcaaaatgaatatcctgttaatagtttttgagtagtggtaatttcagtgtaaaatgattagatacttttggtccattttctagggacttttccagtatttttcttttacagttcaagttaactttcagctatggcagcatttgattgcttgtgatttcaaaaagttaaagcaacctagctacccagtaataggagaatagttggacaagagtaatcttaactaaaaggcaataagaggttaattggaacaaacaaaacacccagtgataagataaaaacatgtttcctgtattatttttcttttcccctcataaaaaaggctgtgcatatgcagtacaggacattcagaaaaatgtagataaagactagaaggaaaaaagaaaaaagctataaattaattcacccaggaataaccactgttgtccttccctatccttctaagtgcattttatacacataaactctacctatagtttgtaatttgccataatttatttaagcattctccagttattggttagtcacttttgttgagaatcagattttggttcctttgtgcaactgtgggccaggctacctttagctgggaatagattgcctttctcttttcccttctgtccctcaatcctgcctaggcctgcatccagcctgggctctcaaggcccccctgcctgctttaagtgagacactttgtaaatgaaaccattctgccaagcctttctatggttactaaagaggcctggttccagaattcctgtggaactctctggttatatataaaaatttttttggagttcatgcttgatatatgttatatgtatatgtatgcaaatcagatagagtgaagagatgggagggattat

SEQ ID NO: 48576 - DNA, 1061 bp, Homo sapiens
agtggctgttaaaaagggagttgatttgaggaagtattacttagcattcatgcatattgggcttaggctctagccctgccactatcattgtcttctctggactgtgaagtcactgaggacaaggaaactaaatttaatgtctgtatcactagtgcctagaatttctggacacttagtagtcaccatcaggcgtttatttaatgaatgagaagcaaagtgaccttggttacttttttaccctgaggggctcagcactcattaggacttggtgcctaattttataaaaagtcactaagctcaagtgcttggatgaaaggacagcgtggataaaaaggtttttaaaacatggatgttaaggctgttttgcttggagaagacttgggactgggacagtctttagatattatttgaaatgctggcactgtctatctggatcccagggcttgaactaggatttgaggaagtcacagggaagcagatttcagtctgacatttattcagtgcaagttttttggtgctgtagtatatgatgaaagatgtaaagctgaataaagcattatttctgccctagagttgttcacagcctagtcaggcatatggatatgtaaacaatgactgtaacgtgttatagatgtaaagacaaaataaaggttaaagagggcataaaggagcactcaattgcagagatttgaggacattatttttattttgagctttaaaaagatgaataggtgttctcaggaggtagggatctggctgagagggaataatctgagcaaaggtatgaaacagcctaatgcattagagaaaaaagttcttttagtaaggcatttggggttggggaagctagaaaaagaaatgggagctggtcacacagggccttgtgtgccagactaaggggtttgtagtatatattgtaggcagaagagatccatcaacagattgcaagcaaggaagtatgttcactttaaagtttgagaaagaatagtgtggaagcacgtctcaaatttagacttgttccccctctgaaccgtgaatcagaccatttcaggtagaagtct

SEQ ID NO: 48577 - DNA, 1033 bp, Homo sapiens
aatatttttgttataggttcgcagtagtgctttggttacaaagctgcatagttttcagtggttagcccctaactatttttcccttgagccctgttatttttagtgtgatgttgcagaacaaagtttttttttagttacatatatgtaatttaggaaaatatataaagtgcccattaataaaaaatggttaatttggggtacagcatcttgatagactataatgtgccttaatgataagcatggaaatttttctatgaaacaagtacaggaattagaatacaaaactgagtatctggatactatgcttacaactgtgtaaaaatgtttcacacatacctggcctgcaatagttgtggtaggatggtgggactataggttagcaaaagtttttttaatactgtgaagttggtaaaatagagataagtccattttaacagtttacattttatttgactctggttttagaattcctggaaaactcaagcaattcgtatttgacttacattctggaaaactgcacagagaattccatcatggacctgacccaactgatacagccccaggagaggtaggactcctgtttatttttcaatgagaactctttttttccctttttcagttagcctcaaagagggtctgaagttcttgcatcagcttgagcttcagcttctgaatatttgtgtagagaaattctgagtagaaattaaccttttaaattaatttttaaagctttaggtcttcagaaaagttgaaagaatattataacgtagtttcttgattgtataaaagtgttctgatgtgacctctgtggaatatggctataacagttaaatatagttggcttcaaatgggaataggaaataggaatctaaagcagataaatcagtgaagaaatcagtggattccaataactatccaagccttcctctgtggctggaagattgaccacactataaagaaagtaatgatttgttattcttgctaaatcattctaagagccttcacaaatacactattcataatgctcaaaacc

SEQ ID NO: 48578 - DNA, 1029 bp, Homo sapiens
gatgctgtattatgttagtttcctgtacccacgtttgcaaggcagctcattggaggatcaactccatagctctttacagtcttgccccaacctaaccttccatctttatcttccaatgaggcactacatgaacttccatagccaggattcactactctcttcatccatagaaactactcgttgatccaacccatgcagtgctccctgcctttttttggccctgtctgtaaattttctctgtaatgctttctattagccttacagtatatgcatcatacatattatgtactttttatactagatcattaaaatctccctaagtgaattgtaggcccttgcaggacagaatgtatcttgaatttccttcaggccttagctggtgcagtgctttcatcttcataggttctcatctgaggactgccatgagcttgtggaagagtaggtagatatgttcttgatgagctgtatatgatagaattttcatcaatttgtagaagagaaaggtgagcagatgttcagtcctaaaggtgagcagatgttcagtcctgtaaggaaaaccttctagcggcattactttacaatggattgggttttcctgtaagctctctgtcatagcaagcgttcaattgtagggtaaatggccattctgccggggatgctgttaaggagaaagagaattgaaagggaaagagtattctaaaagtaggtaaactagggctcgcttcatctttgtaattctgaatacctatgattttgacctaaataaagcagaaaccatagaggatttatttatttaatatggggattgatgaattgacaaggataatatgataggaaattaaacaataatacacttactttatatataactgaataatctttgaagtttatgattctgttttttttttttttgttttttttaaagacagcactcactctgtcacccaggctagagtgcagtgctgcagtcatagtacaatgtaacctagaactcctgggctccaatgattttcctgcctcagcctccca

SEQ ID NO: 48579 - DNA, 1050 bp, Homo sapiens
ctgcacatcctcagttcctttgacttattactggagttctggcccaagtacagtaaaatgtcagctagccagtgataagcttacacttctgtaatgattttacctctgaaagggctgagaataaagaatagctactttttttttctttttttgctagtcaaaataatttcttagaaaacagctactcaaatggactcattcctcaaactttctaaatagcaggaatttttactgtaggagtggatattatttcctcacaggaagtcttgtagtgtgctaacaacaaaagtattacaatgttgtaaaatacttagttctttgttagtttaacctttgaatgaaatgaacagtttcagagaccctaattttgctttagagttacagtagtcccctcttatccacaggaggtaatgttccaagatgctcagtgtctgcctgaaattgtggattataccgaaccctatatatactatgttttttcttatacatacatacctatgataaagtttcctttataaattaggcacagtaagagatcaacaatagtaactaataataaaatatactgttcacagtttctttatagaagatttattcttaatctagatcttagccacctcagcgtatgatttattttctttccatttaaagtcaagagctttcatcttttcacttaaggaagcgctttatggcttctctttggcatatctttttttttttttttttttttttgagatggagtctcactctgtcacccaggctggagtgcggtggcgtgatattggttcactgcaacctctgcctcctgggttcaagcgattcttctgcctcagcctcctgagtagctgggattacaggcactcgccactacacccagctaatttttgtatttttagtagatttggggttttgccatgctggcttggctggtctcgaactcctgacctaaggtgatccgcctgccttggccctccaaagtgctgggattaacaggcatgagccaccacgcctggcctctctttggcatatcttaattgccagcatcactac

SEQ ID NO: 48580 - DNA, 1059 bp, Homo sapiens
tgtagcttattagtcacacttttcccccaccttttttttaacttaaaattttattctagagatgcggatagaaattttgcctatttctttttaactgcttatgcttcactggatagataccagttcactgttgttaccattcttttgctgttacagatagctctgcaaacaatagcttgtgcttacgtaattttgatagtgtatctttgagatagatttctgtacttgcagttgctagggcaaaaggtaaatgtatatgtagctttgtaggtattgctgtatatttgaaattactctccgtataggggttgtgccattttatgacctcaccaacaatgtaatagtttccctgtagccttgattaaaaaggtataatgtcaaattattgggtatttgtcagtctgatgggtgagaaatggtatctcaatgtattttaatttgcctgtctttaatatgagtgtgatcaagcttcttaggtgtaaaagtcatttgcatttctttttgtgtgaactgtcttcctgtctagcctggttttctgtagaattgttggtcttctatttctagactatatagacacagacacacacagttctttttttttccccccccacagacagggtcttgctgtgtagcccaggctggagtgcagtggcctgatcttggctcactgtagcctcaacctcccaggtcacgtgatgctcccaccttagcctcccaagtagctgggactacaggcacaagccaccacacccagctaatttttgtatttttagtagagataggcttttgccatgttgcccaggctggtctcgaactcctgggctcaagcgatccacccgctttggcctcccaaagttctggtattataggcctgagccactgtgcccagcccacacagagttcttaaccctttatatccttagttgattctgtgatgatgctcacagggttgagaagcactggaatatacagccatatgtgaattcagtcatatgtctgataggttaaaatttgtaaaaacccttggagatgtttaattgcttacagttattgaaaact

SEQ ID NO: 48581 - DNA, 1078 bp, Homo sapiens
acctgccccagcctcccaaagtgttgggattataggtgtgagtcactgcacccggcctgtagtcattttatgtatacttttctgtagttgttcttggctagattaatgagtggctcaataataatagttactgaaaacctatgatgagttatgggctataacaagtacactacatgaattatttctatccatagctaccttgtggtgtagaaagtataccctcactttatagctaaggaagttaaggttcaaagaaacagattgaactgtccaagccctgaattcagtaatcatgaagttccagagcccctttctgagaaagtccataaggtcagggctattttcataataatacgaagacattatttgcctttttcactgtgttggcatttgcacttagattttgggaaagctcctaccgttctctaacttataagagtagctcagtgtgtttaaattgcttcgtgcaaacaatagggttcgtgctgcacacctttccttctgggagtctggaattttggcatatgctaggcagagggtatctatgtgactgactccagataaaaatcctggagtcctaggttcatgtgagctttctttgtcaacaaaagattgtctgactggttgttacaatttattgcagaaggaattaaacgtgttgtgtgtgactccactgggagagagccgttggaagctcgtgcctaatttcctctggacattgctccatacaccttttctctttgctcattttgctttgtgtccctttgttataataaatcctaactgggagtacaactatatgctcagtcaaactagtaaatcctccaacctcaccaaacctggtggtagtcttggggatggggatcatggggatccctgacacacaagtaaactctaaataggataaactgcaaaaagccatgccaagacacatcatattaaacttctgaaagctaatgataaattttaagatcttgaaagcagccagagagaaatgacatattacctaggactgttactgagaaacaccaatttgaatgacagtggatttctcatctgaaaccatggaagccaaaag

SEQ ID NO: 48582 - DNA, 1025 bp, Homo sapiens
ttttaggacagccttcacccccactcccagtgcctactatgtattttgagcttggtagatgctcagacaggtttacataatacagtttagtcactcaatctgttatatccagaccctggtttaggtgtttggagtatgactagttcctgggtagtaaagacataagaataaaaataaagtatctcctatgtgtagtaatttagaattaatgaagcgtgcattatctcattccagcaacctgtcatattaacaggacatgtgcaacaattattaaatcctgttttacagatgaagaagcagagggtcaggggggccatgtgatttgcccaaagtcacataacctgttagagcttacctgaacctcacatttcatggttacaaacccagggctttttcctttaccccatgctgtcctgagcactttcccatctttctaggcaaaaacatcttccaaatggtttatacaatgtaaattactaggatctggtgtgaatttcatgggtaggctctataaaattggccttaccatgccaccacatggaactcactgggaaaacatcaaagagcacagatgtcatgttgagaatatcagtaacaaagaaccacagatgcggcagcaccccattttcctaccttcgccaggcgcgctggatgactgctgctgccttgttctttttgcgaaacagctccttcctccttcgttctctctgaattatctgcagtcggagctctacggggagaaggtcaatattcacactctgcccagagaggggaccaggtgctggatcagtctccttagatacctgaaagtcctcggacagggtagatgtctccagcctcctagctcctgacctcaactcctctgtgctctgtggcaaatgtgaatagagccctcctgtgagcttggcttgtgtcactttgtttcttggtgtacgatggtggggaggattctgcccagcatggaccgcctccccccgggcactgccagggcggctagaaccagccggagagcaccttcctcctct

SEQ ID NO: 48583 - DNA, 1016 bp, Homo sapiens
tgatagaaacctggctccagttatacttaatatatttacttgatcagcttctctgtctataattagtcttcctttgctgccacccctctcatctcactccatttgggctctggttctttcgggctgtctactctgggccatctcagcactcccaccaaatccagtgccagagtttacctagtttggctccagccattggctttagaactgaattgtttagggcagcaaggggaggcagaagggaagtgatgaagtggtcattattgaatgtgcacttttcaaatgtggtttggattaataaaaatattcaccatgtttgttttggagtaggaagatggccttggaaatgagttttttctcattgttacttaatggtataaaagaagttaccaagtaaaatatctgggtaatatctacaagatattttacagagaaataatgtatagatctgttgattcccccccccacacactctcaaatctgtaaataacaagtataaaaagtcttgatttttcagggctagatgacagctctcttgaacttaactgactgatctcttcctagagtgatattcatccttctaccattcttgttttttcatgtgatgtttttacatatttcatttttggtagtatactgtatcagattctggagtttgtgctgtgactgatatctgtgaaggacttagtactgttcttgactcttcttgtttttctgagaacttaggaaattaaaaatactaggggttttacttctaactctctactttttgtgcagatttcttttttacctttagagaaggcagtgttatgattaaattgaacaggatatttgtattttctgggtcataaatatttttctgtgatacatttctctatcaggtgggcaaaaaaaagcttttgttagccctttgttcatatcactcagatctttctgtcatagcactcaatagaaatacagtatgccctcacttaatatcctcagtaggttctttaggaaacagaaatgacatacac

SEQ ID NO: 48584 - DNA, 1912 bp, Homo sapiens
ggttgcagtgagctgagatcatgccattgcactccagcctgggcaacaagagaaactccatccccccaaaaaatatatatataaataaatataaatgcaattattataacagtaaaaaaattactaagtacttataggtgaattagaagttcctaattttgtttgatatttattcagttgtctgtgataaaaatttttagtataagtttgtctgattattctcagcctttttgcaatacccatgactgacatctgttttcttcctagccttaccttgaagggaatttttaaaggagacactagaaactgatctcataggaggaaccaaataatcctcatttaatgggaagctgctttacatttagctattccttttgagtcctctgccaataccttagctgcactattgtgaaatagacctagttacaactttactaagaataagaacacatagttgccttatagtggctttaaagataagttttctttgcctaattaagatacttttgcttagttatgtaggaagctgaagcttgtttaaacataactcatttgctgagggtaagactataaaaatcaaatagtaaatacatagcagctgaacctactactgaaaagcaaaacttcatcttggctccttagagtctgattttcagatgggatggaaattttctgttgtactatatatgttgatcaagtatgctttttaatgaaagtttgtattaatatgtttgaatttcaaactttcatactagggtacttgagcccttggatatgaaattaatacaaggcatactatgggttttattttaagctactaaatcaaacttgttttcagtaaagaacaatggttatatactgtgctacctttgacaagtctgtcaagttggtcacttctggtaatagttctccctttgttttttatagatcatcattttctgggtggaagtattcagctaaagactggttgatgagtgatgtagactatttcagcttcttattttccacacttacaggtaaccacattcacttgccagattaaaaaagaaaaaacctaatatgaatcacaattctccttctaagatttgccattttatcagtttggttcagttttgaagatgataaatattctatcttggagtgatttttgtgattagtaactggaaatcgaaagaatatttctaacctacatacactgttaggcttctgaggcaggaggatggatgatttgtctttaaatctcttatagtatgagtatcaaaaccctgagcattatttgaatgtcatgttattgtatttttaagtttgatgtactactactattattttaaatgtattatttgaatattttcattgtatacttggataatgataggattctttgaaattttctgaagacttgaaattaggagagttaatatagtgtcaggatccaaaaagaacttgacagatccaatactatgctgaatctagcaagataaatacttcagaagataaatgtaagctcctatatgtttactgtatatttatgaatgtatacatttgaggtgggagaggctgtgtgttttaatagtagttgtcagaaagtttttagtgattttagaaagctcattgggagtcagtactatgacatggctatcaaactagatgatgcctctttaggtagtgcttacagaagtatagtgatttgaacatcaaggtagatagggttgggccacatcagtggtattctgatcattttgagaactacctttcaggagtgactttggcagcttgtttgtgtaggttaggccaagtgtaaatagaggtggtaaggggaactagaaattgttgaatgaactatacatgtattgtcaaagtaaaaacacctagggggatggagtagttttgaaacatttgaaggtctattatc

SEQ ID NO: 48585 - DNA, 1043 bp, Homo sapiens
accttcttaacaactctgattccataatgaaatggtttatttatagaactgtggcctaagtcttgcctatgcacctatcttcttggccatctattaattctagaagggaattttttaaaactccattgatagattattttaagtattctaatgaagcaggcatggtagacgtaatgctttatagatgtgtgtgtctttgtttctagcatcaagcattgcacagttctctccaataacatagatcatctcttactgaatttaacactgtctgatatcatggtctccctggcaaatgcgtcaactttgcagaaggattgcagttggatagaaatgataaggaaatttgtaacagagacccttgaagatggctctaggctaaatagtaagcaactgaacagattgctgggagtatcctggaggttaatgcaaatacagccaaacagaggtaggtgatgctactttgcccttatttaagagtggagctcttacatgtgctatcttaaggtctagctttgaaatgatggcttgtaaacattccatgtagtcaggctaattgtattcaagccataaaaggtagctactgtctacttgaacactgaaattgtttatggctcagagtatctctaagtgggtaggtccactctgaagcagattgataaagatttctaccctcttctgatctagtttggctagaacttgagaactttttcccttgattgatatggcatgaatcttccctgtctctttaccttttttctagcttaaggttaagttatattaagtcagttttagagtgacttactaattctttgattttaaaacaaagttttcctatttggttcccatctaaattgcctttctaatattctggtttttgtcattcctaggtttgttgttaagaaaatttatactgtaactactgattggtttgacttttttattaggctattgctataggacttcaatggtagttgtctatttgtggctaaaattggctttgccataggaagaaagtaaagtacttcggtgcattcagaggaatt

SEQ ID NO: 48586 - DNA, 1027 bp, Homo sapiens
ggaatcttgcacttctagttattttcagcaatttttttttttttgagatggagtttcgctctgtcacccaggccggagtgcagtggcatgatctcggctcactgcaagctccacctcccgggttcacgctattctcctggctcagcctcctgagtagctgggactacaggtgcctgccaccgcgcccggctaattttttatatttttagtagaggtggggtttcaccgtgttagccatgatggtctcgatctcctgacctcgtgatccgcccacctcggcctcccagagtgttgggattacaggcgtgagccactgcgcccggcctgttttgagcaatattataattacctatactacctttactggaagttaaagtttcatcagagatctgccttcctcctagaattgttggttggtatatttagtctttgaaatttctgtatatgttattggaggagcagaaggaactctcccaagtttgcagatgtccattgagactttccggattgtaatagattatgctgcctgagataaacttacggtaaattttccaaagctctacctgtggggaagaaatgttgcaattctatcccagtgtttactgtctcttttcttaatgataggattcttaattttcatctgaatgtatcactacacaaaataaaaaacagatttcccagttttctttgcagctaggagcagtcatatgggtaatttctattaaatagctcagacttcttccagtgtcagacttgtacattgaattatctgttggccatctccgtctggatttgattatgatactttaggctcaacatatccaacgtagaattaatttctagatctctctgcccctttttcttcatcatctctgaatttagtcactactgttagaacccttaatgattactcctcctgtctccaccatcttcagactcacatatttgtatatatttaagcatatttcaaatctggctaatttttcttctttgtaaatgctctccttctcccagttcataccagtat

SEQ ID NO: 48587 - DNA, 1035 bp, Homo sapiens
tgacccttgtccgggtgtggtggctcacacctgtaatcccagcacttttgggaggctgaggcagcggaccatgaggtcaggagacctagaccatcctggctaacacggtgaaacccatctctaccaaaaatacaaaaaattagctgggcatggtggcgggcgcctgtagtcccagatactcaggaagctggggcaggaaaattgcttgatccctgaagatgaaggttgcagtgagccgagatcacaccactgcactccagcctgggcgacagagcgagacttctccaaaaagaaaaaaaaagtcttgacccttgagaacgcatatttttaatattctgtgtgatgaatgggaagtgtacataaagcatttctgctgcatatcaaagaactatgattgtctcaaggaaatagccctgtgggaatttcttacttgtattttcctggaatggactagattttaacttgaaaaaaaatgactgacaaactgtggttattcagatttgggtgtttggcacatgttttcacaaaaatgaacaaagtgactggccaggcgcggtggctcacgcctgtaatcccagcactttgggaggcaaaggtgggcagatcacctgagatcaagggttcgagactggcctggccaacgtggcgaaaccctgtctttactaaaaatacaaaaatcagccaagtgtggtggcgcacaactgtaacccctgatacttgggagcctgaggtgggagaatcacttgaagcccagaggtggaggttgcagtgagccaagatagtgccactgtactctggcctgggtgacagagtgagactctgtctcaggaaaaaaaaaaaaaagaacaaaatgagcctatcagttccaggaaaacaaatggcatttgttgccaatgataaaatttgagctttcaagcaaaaattgatactttagtaaacttctgtctaccactgtgaattctgtccttagatttactacctttttgctcttcatgtttttcatgtatctcagtcctccctgggatcatttagagt

SEQ ID NO: 48588 - DNA, 1460 bp, Homo sapiens
agtagctaggcttacaggtgcccgccaccatgcgtggctaattttttgtatttttagtagagacggggttttaccatgttgggcaggctggttttgaactcctgacctcaggtgatccacccgcctcagcctcccaaagtgttgggttacaggcgtgagccaccacgcctggcctagttttttcatttttagagagccaagaagtaaaaattccaagcttcttcggtgtttgattacatataagcactagtaaacttttgttactgctttgttagtagcatttgtatttagatagactagtaggaccaaaattcaaaatctgaaaatttattaattatgctagttttgggtcatcttatctggataacactaacaaaggatctaaatactgctttagttttatggatatttaaaatagtatgctttagaactattttgtgctattataacatgactaggcttattagcagctcattaacatataatggtaagtttaaaagactgcgtagactgttgaagatcagaatacaaattgagatactgtataaagctgaaataaataaattcagataggaataatatttaaaaacatccactggtagaatgctctaattcaccttggcagatttgtaataacttgataagaaccattatttatttatttattttttaaaaaggaaccattatcttagagacagagtataaaaatgtacatcattggtacaatctatacaaaatgatagattgttagtagcattctatacaaaatgacattaaaatgcacattctggtcttgaacttctggccttaaatatccttgcaccttggcctcccaaagtgttgagattacaggcatgagcctctttgcctggccacagcctaatctttaggaggaaccaaatagcattgcttggcattgatgtcagatcacacaccacaagctgaattgtaactctttttctctcagaaactgtatagatttttctattggtaaattgatgtctcggttagatatagtcttaggactactgactgtttgcttttacatgttggtgctgcagcttaatgcatttagtttgctagtatttacaaaaagtcaagaaatttcacttgtattcaggtagtttttttttttttttaaactttttagtaatttgaagctttgatccttactttgaaaagaagtctcagggtacattaagtcttacatgcagtggctgaatagtcagattctgtaataatcaactgaagttgtttatttctgaaatactgtgtgtatcttttttttttcctgttcatataaacagccatttattccagcactatttgttgaaaagattgttgttttacatttgattaccttggcactatttttcttttctttctttcttttttttttttgcattcccttacctatcttttttattttaaagtcaaaccttcagaaggaatacaataag

SEQ ID NO: 48589 - DNA, 1322 bp, Homo sapiens
tttcttactagttttgattgatgtaattatcagttcatggtgcttcattttactagtactttatatttaagatttaaattagcaagggataataaacattttttaatcacttaatttttttctttcttacccttattaggtatctggttggaggactgagtggtgtggatgaaggcctgtcatctactgaaaacctgaaaggatttattgagataataattccattgctaattgaatgctgggttgaagctgtacctccacaactagctactcctgttgggaatggtatagaacgagaacctctacaggttatgcagcaagttcttaatattatttcccttctgtggaaactctctaaacaacaggatgaaacccataaattggtgagaactaatggttctttattttcttagtattaatagccttttatcataaatggcaagattcgaaatcagctcattactactaattggttatatatttttctgaaaagtaccctgggtttaactgtaaacttgtttgttttgcacaaaactacaaattagttttctgaagttattatctgtgaatatatatatatatatatttaagtgaaatgcgtaactcatgcttggttccattagttttttactggctataattcatagtagtgttacagtgtattgtttatggcagattgattgtgtaggaacattctagtttctgaaaggtctcttacaaggtttaaaaagttgcttattaagtagtctctttcaatttattccacattgccaggtttagtagaaagggacaaaactgaagagctcatgatcagacttgaattgttttaagtgttgtgctatagtgaatgtagtgcatagtgtatgctacacttttcctttgcaaccaaggaggaacaagctgcaagattaagttggtgctaaatcaatacagtaacacacttgaaaagggtagctacagaagcaagacttcaaagctagaagcatctggttttcagaagaattgctgtaaggacttttgataaggcaggtgtgaatccttcaagtttatataaaactgagaaggtagttttcttgtttttgttttatttttatttcaagttgaagtttagaatgagtcagtatggtgcataagacgggataaattaagtagtatttgatagtcttgaaaagcattatagagttgtagtaaggtgtatattttaagagcgtgttctattgctgttaactcatcatctgtaggaatgttttgtcaattgctttttcaaataagatggcattttattgattacggttttgagactttgttttatgattcattgc

SEQ ID NO: 48590 - DNA, 1068 bp, Homo sapiens
catgtaggttaatgtaaagagagaaaattccaactgaaaattatgcaatgtttttattaagctgaaagtatttttctgtttctgatcctaacaaaagctaaataacatttaaaaagtacttattgaagcagtttccccaaggagtgtcagtttactagtgtagtgttagttagcatgtttacgtgaaattgatacatgtatataagtatacatctaaaatttgtatttttatttataggatttgctgtcacagatgcatcactacaatgctggggttaaacaaagtgctcttcttggacttaaagaccttttgtctcaatacccatttataattgatgcacacctttcaaacatattaagtgaagtgactgctgtgtttacagataaagatgctaatgtacgattagcagcagttcaacttcttcaattcctggcccccaaaatacgagctgaacaaatttctccattttttcctttggtaagtgcccatctctctagtgccatgactcacattactgaaggaattcaggaggactctttaaaagttttggacattctgctggaacagtacccagctctaattactggccgtagcagcatattgcttaagaattttgtagaacttatttctcatcagcagctgtccaaaggactgataaatagagacagatcccagtcctggatactttctgtaaatcctaatcggagactcacttctcagcaatggaggctgaaagtcttagtgagactcagtaaattccttcaggccttggcagatggatccagtaggttgagagaaagtgaaggacttcaggaacagaaagaaaatccccatgccactagcaactccatttttatcaactggaaggaacatgccaacgaccagcaacacatccaggtttatgaaaatgggggttcacagccaaatgtcagttcacagttcaggctacggtaagaaggatttcagttatgtccacacagttttgctgtattgaattataactgctaaccattgatgactgttggtgggaagacatgcagttgtctttcatagttttcatatagtta

SEQ ID NO: 48591 - DNA, 1034 bp, Homo sapiens
cttcgcatgaaaatgctttgtatcccgtaataatattactaggtttgaaaagtcaaggaaggtcaatcagccttcttaattttcctaacagagaaagcattaatgtgactaatacaaagcgatagataatatggcatgaagttgacagtagactgttgaagatctatcaggtggttaatggctaaatagaacccacaggagtggaggaggaagggagttaatttttctgaatgtcctgtaccatttactttcgtgtctagtaccagctagtaataaaattgtaggaaaagctcacaaagtgtgcttgcttaattaatgaaaaccatttttgtattaaaagaggccaggtgagtatcatggccttctttttaggccttattccctcccacccacccacccaccgacccccagcttttttttttgttttgttttgttttttaagactaaggtaactagaggtgtgggtgagatgaaaatttggtaatagggacaaatgaaataagccaaactgttttgccacgaagacttccagtcttcaggttaattctggtatgttaaaggtggttttgcagagctcagttctgtgaatgaatcccttttcaacttcttgataaaggcgtgacttccaaacttttctgaggtacattgttaaaatgggtttagttccacctaccttgcatggttctgtgcagattgtatactgaggtacacaatgcatctagtaccgggcttggtatgtcctgatcctgagacttgagggacacgcacatgtttatgctttgagcatacgtatttaaccatgtaccaggcacagttctgagtgttttacaattgtgtatgattatccctattttgtagatagaaattgggacagtgtacagctggaaggcgtcagagtttggataaaagcctaatcaatctggttgtagaattggttcttaacctgtgggaaatcctacctcatggcgatctaatataaccctgtaattaagtaaatttggatatattgtcatagctgattggcttctgaattc

SEQ ID NO: 48592 - DNA, 1036 bp, Homo sapiens
agtctacttagtgctatgcagaggttgctttttcaagaccaaggagggacacagaatatggtcacataggaactgtgggagaacgcaaggtaggcttataagaagaggtggtgaatctgacctaagtcacacggcatctaaggctagaaggaggaataggagttaaaataagctgataaacaggaatgggactccaggcacagggaataacaggggcaaagtgggtaagaaagtgttcaataataacagtgcattcagaaaattgcaagagattatggggagacggagttttgcattttaaaggcaaaactctcttactggcaactgtcaaaggactttaagaaggtatttctgggctgggcgtggtagcccacgcctgcaatcccagcactttgggaagctgaggcgggcgaatcactaagtcaggagatcaagaccatcctggttaacacggtgaaaccccatccctactaaaaaaaaatacaaaaaattagctgggtgtggtggcgggcacctgtggtcccagctattcgagaggctgaggcaggagaatggcgtgaaccccagaggcggagcttgcagtgagccgagatcatgccactgcactccagcctgggcgacagagcaagacttggtctcaaaaagatatttctggaaggccaggtgcagtggctcaggcctgtaatcccagcactttgggaggccgaggcaggtggatcacgagatcaggagttcaagaccagcctggccaagatggtgaaaccccatctctactaaaaatacaaaaattagccaggcgtggtggcaggtacctgtaatcccagctccttgggaggctgaggcagagaactgcttgaacccgggaggcggaagttgcagtgagccaagattgtgccactccactccggcctgggcgacagagcaaaactccgtctcaaaaaaaaaaaaaaaaaaaaaaaaagaagatatttctggataaaggaacctgtcattactaacatccagattatactttggataaaataatgcttaataa

SEQ ID NO: 48593 - DNA, 1049 bp, Homo sapiens
cctagtgtgtccacctttacgaagccgagcatacacaccacctgaagatctccagagtcgtttggaatcttacgttaaagaagtttttggttcatctcttcctagtaattggcaagacatctccctggaagatagtcgtctaaagttcaatcttctggctcatttagctgatgacttgggtcatgtagtccctaactccagactccaccagatgtgcagggttagagatgttcttgatttctataatgtccctattcaagatagatctaaatttgatgaactcagtgccagtaatctgccccccaatttgaaaatcacttggagttactaagcaattcggaagagaaacacattgaaatcactgtctttccctgagcaagggggctgctcattagatcttttgatactttaccatgtgaaatactaccagaactgttctctaaacccactttttctgtagaggaatgtatcatctttttttttctcatattacaaatggacaaataacggactttctattttcatatttgctgaaaccattttttaaatgaaattaggtcattatttatgaaaagttttgagagggcactgtcaacttgggtttaagacaggaggacattgcaagttcacacctttcataagcataaagtagttgcaagaaagtattttcatcctgttaggattcatatctaagatagagttatgcattgcacatacacaaataaacttttattagatagatacctataaaagaaacataaaagtatgttgtgtattactgacagttctagattaatttcttttagaattaaagtagatttgttaaagtgtattgtgtgttgtaaattttttaagtgaaatttgcttgcgctctgccttgccatttctttccagtaagtataattttgaaaaaattagaatatatgccaaatattgagtgctgtgactcttcctcataagagatgtgccagattctatgtctaattgcatattctcttcagaggagatgatgcttattttaaacctttttctctataacttttaaaaag

SEQ ID NO: 48594 - DNA, 1054 bp, Homo sapiens
ctttggtcaatatttgttattatctctcaaatctcttccaagtttgttttattcattcactcaacaaatattttttaggctgtttactatatgccaggctatatcttaggtgttgtaagaatacagtggttactaaaacagaccaaatttttgttctcgtagggcatatgttctaatggaggaagaaatgaacaaatgtgtaatgtaatttcagaaagtggtaaattatgaagaaaactagaggaaatagattactgagaatgatgattatattttctttactattttaaaaattttatatatttaagatatacaacttgatgttgattattagtcaagataattatcatattcatctcttcacatactttctgttttgttttgttttagagaaaggagttctcactatgttgcacaggctggtcttgaactcctggactcaagtaattttcccaccttggcctcccaaattgctgggattccaggggtgagccaccacacctggccagttagaatttttgtgtgtgtggtgaaaacacttaagatttactctcagaagatttcaagtatacagtacagtattattaatgatcgtcaccatggtgtacattagatctctggaacttattcattctacataatttaaattttacctttgtccaacgtctcttcatttccgccacccctggtagccaccatcctactctctgtttctatgaatttgactttttttttgtttgtgttggagatggagtctcactctgtctccaggctggagtgcagtggcgctatcttggctcactgcaacctccgcctcccaggttcaagcgattctcctgcctcagcctcccgagtagctgggactacaggtgcccgccaccacgcccggctaatttttttatttttagtagagacagggtttctccatgttggccagaatggtctcgatctcttgacctcatgatccacctacctcagcctcccaaagtgctgggattacaggcgtgagccactaaacccggcctaatttgactttttagatactacatataag

SEQ ID NO: 48595 - DNA, 1036 bp, Homo sapiens
tagagatataggcactggggcagctgaggaacctcaatatgttaagagccttggctttggtagcctcctggcaggagcagcagtttgccacaggtccggacctctccctccacacagccacactgcctcatgcagtctgacccacccagtgagggtgcatttgaacactgattatattctccatttgtttttaagctctgctttgtgttagagcttgtgactgccaaaaattttgtgcacagtgatatgactgttttaggatcttaagggtagaattttgtgaaaggtgagatcctttggaattgagttctttctcattgggtatgaaaatggatgtatgtttagaatatatgcccaacgaggcaggaccatgtggatagattccatttgtttccttgacctgatgtaataaaaactgataaaagccgtgcagtgcccggcatcttggaggcaggtgatctggcttttctgttacctgggattttcttttcctatatatctgtagtgcactgataattgatattgttagtgagaactttaaggcacgacaagatctggaagagcttgtgaaccatcaaagtcagattgcttatgttgagtagtgatttaacattgaacatttctgtactactctgactctttgaaaattggacatttcagaatgatacaatataggggagctctttacaagtagcatatcatttttcctgactttcctggctgactgcttaccttcatttctttttcttctaggtagcatgatgttatagaaaaaaaaaaaaaaaaatcatggactgaagtcagaagacctgaccttttatttcagatctctgccatggcctaacgacgtgaccaccttgggcaggtcatataatcactctgggtctcaatttcttcacctgtaaaatgaggacagtaatacttacatgttaaagttgccttgaggattaaatggcagaatatatgtaaaacacctagcaagtgcttagtccatagaagacgcttggcaaacttttctctcctataataaacatat

SEQ ID NO: 48596 - DNA, 1048 bp, Homo sapiens
tcccccacaagcagaaggttttattttaaattccaagaatatgatggtcaaaattgctgggaagattctgatttagggttgtcactgcagagcatttccatgtcaatgtaagtaggtacccaaagtcgtttaggtgcagcattcagtaacgtaaaggtaaagaaaaaaaaagtagccacctgtggctttttatccccagtcgtagtaggaataagattgcatggtttgggcacactaccaatcacaatttccaaatttcatttccaccactgagatgccttgactcaaatgaaacattagtataggtttaggtggtgtttgtgtgtttttggtgaaacattagtataggtgtaggtggtggttgtgtgcttaactgaccccctaaaaacaagaccaaatacttaagcacggaatgtatttctgtttatgatatggaattcaatacaccccttcagtggtataaagacattcctggatttctttaggatagggtcagagttggtttactatctggccttcagtttttaaaaggggcgattctttgatatagcaatagcgtcaattttttttttcttttacctttacaggtgagaaaccttaccactgtgactgggacggctgtggatggaaattcgcccgctcagatgaactgaccaggcactaccgtaaacacacggggcaccgcccgttccagtgccaaaaatgcgaccgagcattttccaggtcggaccacctcgccttacacatgaagaggcatttttaaatcccagacagtggatatgacccacactgccagaagagaattcagtattttttacttttcacactgtcttcccgatgagggaaggagcccagccagaaagcactacaatcatggtcaagttcccaactgagtcatcttgtgagtggataatcaggaaaaatgaggaatccaaaagacaaaaatcaaagaacagatggggtctgtgactggatcttctatcattccaattctaaatccgacttgaatattcctggacttacaaaatgccaagggggtgactggaag

SEQ ID NO: 48597 - DNA, 1045 bp, Homo sapiens
taataattttgtagctacctcctgttgctattgtggtgagtgagctcaagtgttaccaatatctgcttaaaatgccatgtgccgctaaccatctccacatgagcagcacatgagagtctccattaattgcatatggcagcgaaaagtgatctcttgcattgtcgtgtattttttatcacgtttaatgtaatatcgtaaaccttaaataacaccatgagacctataggaagtaccacaagtgttgctcccaggaagcagagaaaagtcataacattacaagaaaaagttgacttgctcgatatgtactatagattgaggtctgcagctgtagttgcccaccacttcaagataaatgaacccagtgcaaggactattataaaagaaaaggaaatttatgaagctgtcactgcagttatgccagcaggcatgaaaaccttgtactttttgcaaaatacctttttatgttgtattgaagatgcagcttttatgtgggtgcaggattgctatgagaaaggcatacctatacaactattatgatttgagaaaaagcacagtcattgtatgagaacttaaagcaaaaagatgaaggatcaaagctggagaatttaatgccagcaaaggatggtttgataattttagaaagaggtttggctttgtaaatgtctggataataggaaaagcagctcctgccatccaggaggcagcagcaaaggcagtcaggtttatgatcaggactgcccttatctgtaaagctgctaacccccgagcctggaagggaaaagattaacaccagctgccaggcttttggttgtaccatacaacaagaaggcttggacaaggagaacactttttctggattggttccattgtcgatttgtccctgaagttaagtagtatcttgccagtaaggggactgccttttaaagttcttttgatactggagaatgcccgaggccaccccaaactccatgagttcaacaccgaagacattgaagtgatctacttgcccccaaacacacatctctaattcagcctctagatcagg

SEQ ID NO: 48598 - DNA, 1023 bp, Homo sapiens
tctacatttacatatacatcaaaagattcttctgaagcatcattactggctattggcagttatgctttgcatcttgggggcattttcataaaccttgcttatgagtgggacctttttattatgtttaggattgacaatataatttgaaggcaaatccaaagaatattagcattttatacatatttcctgtttagttatgcatgaagtgttttatttgttgaggggagatgattctcaattagattacttatatccctaaaaattaaaaaccctaagcgctttcttttgaaagttggttagaaacatttgatgagtcagcttgggactttcagtatttgcccttacttatagttggatcaatgaagcatcttagctttgaaaagtgaatgatagtttctaaaataattggcagttttaactgctattatttgcatttctagcatgtgacaagcaactttctgaaattttttttcaccgaagtgctacactgtaatagcattttgatgacatttgaagtagcctgtggggattcaaattaagtttgactttaacagcttatgttgctaccaggaagaacagctaccttccatcccagctaaactcatacatccagactgtaactactgtattcctagctcctcttctgtctagagaatggcaaggttcttttggtatcagtttcgacatatccacttattcctttttttttcttaagttttttcatttagaaaaaaaaacagatggggtcttaatatgttgcccaggctggtctcagcctcctggtctcaagtgatcctcctgcctcggcctcccaaagtgctgggattacaggcgtctgcccctgtgcccagcccacttatttcccagatgctaggaacttacattagacctgaggccatttggtcattgtttattttgtgctgtagtccaatccagttgtgatttctgcctcctgtgttcctcgttgctggcctgatgctgaccttcaggttaggtcagtcccatcattccccagggtattct

SEQ ID NO: 48599 - DNA, 1052 bp, Homo sapiens
ttcctcagccttgtggcttgtgtgttttcccattccccacgaggcagttcctcccctgaatgctcagtttatattaacatctgattttattttttgaacaaatgttgtgactaaattataggcactgaaaaaatgaaaagataagcttcttcaattcaaaatcaggattggaagagaccataaatgtaaaataagtcataacacttttaccaaatatagtaatttgtcagaaatatttattcagcactcatatggtaggtgcagtagatgttaccaaaaacttataaggagatatgagttataagagtttatagtcttgcttgggatgtgtaaagcaatgcaagattatatattcaaactgaattttgctttaggaatttaaaatggagatctgtgaagttgtgtggggtcatcagcaactgcaagaaagtagccaggcaaggtagcacatgcctgtagtcctagctactcaggaggcttaaaaatatctgtgtaatttctaacaggagatcatccaagaatcgccgaaaagcggagcggaagaagcacagcctcaaagaaggcagtccgctggaggacctggccctcctggaggcactgagtgaagtggtgcagaacactgaaaacctgaaaggtatattctcagtcctgatgatgattcctgaccacaaacaatagtgaataggcagtacagacaggcagagttcagtaggtgattaagctaccattttcccaatttgaggaaagatgagaacttttagcaggaagggtcatgtctgcacacattcctgaagcagcccttcttagctggtaactgagaagccttcctccatttggcatccccctaactgaactgggagagatgcttaggccaggataaagaattgtgggacactgctttctgcgtaggccccccagcgtgcttgattttctttttgtagtacatgtgtttaattattccagcatttgggaagaaaaaagataatgtgggagaaaggacctgcagtgggatcatagaaatttttggctttggatagaagctatgtatgatt

SEQ ID NO: 48600 - DNA, 1031 bp, Homo sapiens
tttatcattcttgataataatttgaaatattactgtcttttactgaaatgaattgaatttccttggctgccttgtaggaggcctgtttttcaggaaaatattctgattacctctgaaagtaatccatgtctttctaagtatcttaactctccagtgactagaagttttccttcctaaaattattgtgtttttccttctaggtatacaaatataacagactggatattatagaaaccaacgtaaagccttccattttagaaggtgagggttccattttagatagaattcctcatttggaagaaggtgaggagagagagatgagagagtctcctcctatttactgtgttttcttaataatatgtcatgtagactcaatcaaaattaccacctggatataatatttaattctcactagaatttttaaatatgctgaactattaaatggtaacaaaatatttaaatgttagaaacctgtgatcaaatatgattaagaatctttgtatttggaaatagtaaacttgaatatgaactatattagataataatataacactgataaatttctggcatttaataatcatgttgtggttatataagataatatcctattattctcaagagataaatgctgaaatatttaggaatgaaggatcatatctctgccttactcttaaaaggttccacaaaagtattaatgaatgtgtgtatgcatgcagagaaacaggaagcaaaaaaatgtcaaaatgttagtaattggtaaatcaaagtaaagggtatatgtgtgttcattgaactcttacaacttttatgtaggtttcaacgtttcaaagtattttttaaaagttaccttttcaaatgaagtttgtggttcttagagaacatatgaatattaccagttctagaatactcagatggtcactgtgacctcttaaaagcaaagtggagaaggacatcagtttgacttatagaaaccttagggagtggttgattttaagttctgcatttttatgcacatctaccctgtaagtaac

SEQ ID NO: 48601 - DNA, 1033 bp, Homo sapiens
tcacagaaattcagaaagtacatagtttcatacataataaagacatattaaagaagcacttgagctaaagtatctgtttaactttgtagtcaactgctgcttattgtctctacaggaaagctggttgagcagaggaagcacattgatgcggccatggttttggaagagtgtgcccaggtaaactcaattcctcccttctaaaccccccagtcagcaagaaaggtcttctcaattgtatcttagtgatcatgaaagttaaaggaactgtgcataattgttaagtccagagatagtgtttgccccagaggtcttatcttgctggcttgacttggaaatctaaatttagtacatctctaagtttggtgaggtagaatatgaaggtgctctactttaacataccactggtttgaccttggtagaaagtacttaattacatctcaaggtagctgtgctttttaaaattgagtttgccaaagtagaaacaatgagaaaggaccattataaaacaggatcattgaaggctacatactcttggcttttactctcattctccctattggaaatgtctcttttacctcagggacctggaggtacagcagattataaggataagtacccatatgagcatttggtagtattataggatttattatgaaaataataaaactgcagtaacactggccacagactaacagtacacaggtgcacagttgacaccagggattattgccttgtagagttttgacctttgatgagagagtgttttttacagttgttactgatagcacatttatgtaacttaattgtgctttaaaaatatttaattgtctcttgtgtaataacagtaagtgaaagacgataactaaaattttatataattagatcctggagagaatatttgttgggtgattgaattgaaaataccagtgaatgaaacatacctaaaagggtagataggttgggttggaaagatataccacatcgagggttaattaaatggataagatgtcattatctttttttctttgtaaag

SEQ ID NO: 48602 - DNA, 1042 bp, Homo sapiens
agccaggaatgaggtggggaaaataaaaggccaaatgtcgaagcattctgaaagcaaaggcagtttagctgcgtcagggacaagggttgcccgaaccagaggcgaggctggtaccaggggctctagtaccagagtggaggaaagggtaaggacacctatgaaaagagatgagcagaagctctggtcatctcagcagtgcttgaagtaaagcaatgactggtatatttttttccctaacttgtaaatattgttgagatctcaaagaaaaaaataaaaagcagtcctaaaaaaattccaaactctatcctgttaaattttgttaaatttatgtaccagtccttctttgtcatttgcagtattctttttttcttgggattataccagtgtatgggattatcacttttctttttctggttattagcctttcccaaatccctccgtttccatgctggcctctttttacaaatgtcgagaattccttatttcaggccttttagttattcgttcggtctccattgttcctttctgctttagaaatttatgatattggttgtttataccttctatctctgttcttggatctcttctattctttacagctcttagcttgctatttcccatgtcttatgagggagtatttctagtttttctcagatgtttagcaaaagtaggtggggagggcagtggtcaaagatgtttgagaaatgttacacactggagtcactctgtgtgtacatttaacgtaggcagtttacacaagagagcaaaagaaaggtaactatttaaatagtggaggtgattttacctactttttttagtgatatatgcactggagtgagcatgcaatgagagaccggaatctaccagctccttcgaaagccttgggttctctgtgcctctcattgtggtttatctcaattgggctgagagtgattctaggatctaaagacactgcatgactcaaacataagtcagctacctccatctagtgctcaaccaaagaaatagtggtctcttactgttaagggacgaagtggtttag

SEQ ID NO: 48603 - DNA, 1071 bp, Homo sapiens
ataagtatgtatgctgtcaccaggtggcatcctttgaaaaaccgaagtgtgtagttgtccttgtccagcctacttacctttctcattctggtgttcttcacttattacctcagatactgcctatccatacttacatctcatgtaaagaagacaaccccagaactggaaattgtactgcaaaaagtacacgagcttcaaggtagagatccgctcacagagaaagtgcttaaggtggccgtgactgctactagtcttctgcaggtgacaatcaccatgtcattgccacaccacagatttaacatgtgactttttagttgccattttaagacccttgtcagtttttttcagtgctgccctctaaagcatatataaaagtatcagaagtatatattcttctgatgtccagttctattgagaaaaatttattgtctttttggttatgttgttaggtctgtggattttttccccaaatgattgtgttctgttttgttttctaaacactgttaggaaatgctccctctgatcctgatgctgtgagtgctgaagaggccttgaaatatttgctgcatctggtagatgttaatgaattatatgatcattctcttggcacctatgactttgatttggtcctcatggtagctgagaagtcacagaaggtatgtggagttcttacttttatgccatttggttcttgtttatataatgatagtgtgaaaccctgcttctggtagtgcagtagcttttctgctatcactctgtgagtgcagggctggagacagatctgtgagtttctagggcccacattcctaagcccctgtgcttatgaaagtgttttgattgtgaggttgaagaagtgaagtaaaattgcatggcttttttttgtttctttttttttgagacggagtctcactcagtcgcccaggctggagtgcagtggtgcgatctcggcttactgcaagttccacctcccgtgttcacgccattctcctgcctcagcctctctagtagctgggactacaggtgcccatcaccacgcccggctaattttttgtatttttagtagagacaggg

SEQ ID NO: 48604 - DNA, 1603 bp, Homo sapiens
gaaccagagtagaggtggtggtacacatggatacagatgatacagatgtttgtgtaacacaaaaggatttttacgtttcttcatttggttataaggctgtatctatctttgtttcttcttttttttttttcttattccctgaagtctgaattcaactcgaatagtagattttacgcttcttcacagatttcattgttccaaggccgcatatattttgcattcctaactcttaaaaggctgtggttttaaggcagggtatatatgaagccattgtacagagcagaaaatggtgtttagaagggaaggcccagtttgcaaggctctgtggggcaaatggtgcttttgtggaaattagggaaagagcctccttccttggcacaaaattcctacagcagaggatctgcttgccaaggagcatgcaggctggattcagaccctgctctttccttccattctcctccttggcccagtacccttgtgcaggttacaatttgcctgtcatatgtggctgcctgattttagatagaagatgtatctcctctgtttcggtgatatctgttgtatgtagacctcttgtttcccaccagtatctgaatggtattatatgatagagcagaagagaaatgtatttgaattaaaaccctagagacaaatatgaataagatgaggcaattaagatgttttcaacatttggtgaagtcttaaaaaagacctactggagcatagaatatttgctgaagttgtataatggaaggagaaatagattttgatttttaggacattatacctggaatggtttagataacttattatttttaaagtcatccaaatgcaatgtaaatatgtaaggttttgtgggcaaatggagcctctgtgtaaaacaggaaaaggcactctttcctctgggcaagtacagtcccacagtgggatgaaccgctcgccgagagacaagggacacatgggatttaaaacttccttggataaagatattcattaattcgttcattcattcattcatgtttgctggaaaaaaaactcttctggattttatctattctttagttaggtgagctttcgatattgtaacactctgagtttgctttaagaccctcaggcagtttgattgcatctacacaagataaacccaaccagcaggatattgtgttttttgagaaaaatggactccttcatggacactttacacttcccttccttaaagatgaggttaaggtaagtgcctgagtttgtttcaccctcgaatgtagaggactttccatagctatagagggaattttttttttttttttttgagatggagtttcattcttgttgcccaggttggagtgcgatagtgcaatctcggttcactgcaacctccgcctcctaggttcaagtgattctcctgcctcagcctcccgagtagctgggattacaggcttgcgccaccacagccagctaattttgtatttttagtagagacggggtttctccgtgttggtcaggctggtctcaaacccctgacctcaggtgatccacccgcctctgcctcccaaagtgctgggattacaggcgtgagccaccacgcctggcctatagaggggat

SEQ ID NO: 48605 - DNA, 1046 bp, Homo sapiens
ttttcacacaaatcctaatgcagtaaatcaaaggaaatgtaggccaagttaagatcttaggtctcagaaatgtgtttctcagtacaaaaaaaaaaaaatcattctatggagtgatgaatatttttcctctatcctggggtcagtagacttgttctgaaaagggctaggtcatgaatatgttcagctttgcaggctgtatgatctgtgttgcagctgctcaattctaatgttgaggtgtgaaagttatacatgatacataagcacatctatgttccagtaaacgtttgtttgtaaaagcagatgtaggctgtagttttgcaaatccctgctgtaaccgcatcatttcttgtcttccattggaaaagttctctttcttcattccttggtccttaatctttctgtggaaacttgcagatagaagcctgggggtttgcaccaggatagtcactaccatttgtacgcagcagcaattgaggtactgtagcacttggatgtgagcagacaggaaatggtcatatggacccataatttataggaattgcaaacagccctgcttcatcagaatcagaatcaatggcaggaggaaagtattgggtcctggattaggtgatgttttcaggaccatctttattgtgcttcttgcaaatggatcctacctccaggaacagaagggttgtgttgtttcagcaactctgcctaatagtttatataagagaagtgttacgatctagaaagaaccccagtcagcctggaaggcagaagacctgtgttctaacttttggctccaccattagggagggtctcaatctctaagtctatgtgaggagctgttttgtgacctgcagcccctctatcaccagtgagagcttgcaatcagaattttattcccagttctcatcttggggttttatgttccggacatattttgtaaactctttatgtttcattcttcttacttataaggtgagggtgagatcgctgacttgtgtcatcaaagaaacttggaatatgtaagatggcagtaaaatgctttccaaaataaggaa

SEQ ID NO: 48606 - DNA, 1013 bp, Homo sapiens
atgttaaaactaaataaatggtaaggtcttttaagtactacttttagaatatcatttgcatgctttttgtcattgtaggttgacaagtgtattacgaagacaagatccatgatggctctcttagtccaacttctttcactttgttataaactgctgaagaaggtgaggtagtttttctattttagactcatactttaaaaaatggtttaaaagaaaatagttactacttaattttgtaatttttttttcagagtgaaaccagatactaattgtcttaactctttccagcttcagatggaaaataacggatgggtctcagttacaaataaggacactatggatagtaaaacttgagaagcttttggggtcagatctctggaacatcatgtgatgaagctgacatttttaaaaatcaaatgatcctttatcttttcagaaattcatcaattttataaagaaaacaatattgaaattttgctctattttctgatcatgaaactgattgtaaagctttttgacaactaataaatgtcttggtaattgctagattctaattgtagtgtgatttttaaaatagaacattgcactaatgttctttaaaagtcaaaccaaatatcccaactgtctcaaggacaatttaatccacaagaagctattttgaatatgtgcttagctttggcatattttaccttaactgttttctttatcatctagatcactaatgtcagcagcaaacatacagtagtctgggtgaatgcagggttttccttaaacctgtggactcttcaatccctctgtttaccaagtgtgacaaaaatccccttgatgaccctgtcccagattgtccatgccagcagcaagtttgttccctaataagcattttgtacagcaagggtgggtctgctgtgctgtgtatgtccctcacctactcccaaaagtaaggtaatggaactccacagaatcctggaacaactcctggagagtatgagatgggtttttggttctagttctag

SEQ ID NO: 48607 - DNA, 1040 bp, Homo sapiens
accagttatatctcaaaggcagcttcacttccaagagaaaaaggagaaaagaaagggttaatgtgttcaatttatttttgcaaagtcaccagaaagactgaaaagatgagcatccacctccttttatgggatgggataggtgaggcagcagacagaagtgagggatcctgtgctcgtgaagattccttcctatagaaggaggattaagagtggggaagatgcagtcccaagcttagaggcatcattttcctcttgatgacgtcttctaccttttctagatagataattctctggaaaaagaaggcagaaatgataggagttagaaattttgctgctgtttagctgtcatttgtcagtaccttatcatattttccatcattggagaccattcctttggtggtttccttccattgttcttaactgttgttagcaagcttatcctgtgattgagtcttcccaacatgaattttgacctttttaagttcatacctttttaaaatctgatggcccaggcctctaaaagaatgcaaaatggaactcctgtgtttacccacaataaatttgcacagactaactgaaataacaaaaatctcagcttttggctggaatcaagctagttatttccatggtgatgaaaatcatgcttttaaaaaatgtttttgactaataagacttgggggaatatattattaatgaatatagtttgatatgtaaaatattcccaaatgaagggttcatcaatagacttgcctggtttttttttttttttttttgagatgtagccttgctctgtcacccaggctggagtgcagtggcatgatctcggctcactgcaacctccgcctcctgagttcaagcaattctcatgccttagcctcccgagtagctgggattacaggcacacatcatgacgcctggctaatttttgtatttctttattttttattttttttgagacggagtcttgctctgtcacccaggctggagtgcagtggtgcaatctcggctcactgcaatttccatctcccgggttcaggtga

SEQ ID NO: 48608 - DNA, 1033 bp, Homo sapiens
gccaacatggtgaaaccgtgtctctactaaaaatacaaaaacaaaacaacaacaacaaaaaaaattagccaggcgtggtggcagaggcctgtaatcccagctactcgggagggtgagtcaggagaattgcttgagcctgggagatggaggttgcagtgagccaagatcgtgccactgcactccagcctggccaacagagtaagactgtctcaaaaaaaaaaaaaataaaattactgatgattatcaatagtaacagtgtggtgaagaacaacagatggtgagtatcagaagagagaacttgcaatgaagagagatattaaagtcttaagtctggaattttagaaatgatagtgggaatgcttgatggtgtaggggaagaacaaatgataaatcaaatccccaaatcaaaaaatggtccaaacttaattagtgtactttttgaaaagggactggcatttaatactgaaatacaacattaggaactgaatgtagctggtgtaaaagcgatcatgatactgcaaattaattctgtgacttaaaaaaaacagtttttgtgccttaagctattgtcagaacagtttgaaagtacaaatagcaatttgtctatttttgttattttaagataaccctaacagatggttttatagctaatatcctactgggtttaagcaagtaaggatagactcactgtttttgtaagtgctataatttagggctactacaaaataattttttgagaattagaaaaggcatcacaaagcttttaacaggttgaatggaacaaagattttattcaactgaatagtattttttatctttagtaacaaatcatttcagagtcatgaaccattttcttagttgagggatagcatagctaattatattcctagaaaattatagttctctcttttaggaagtgaagttggagtctggtgctatttatatttaggggactgacgtcttttagctttatataactgaaacgaatgaatctgactgcattccaaaatagtgtccactagatggcaagctt

SEQ ID NO: 48609 - DNA, 1095 bp, Homo sapiens
gagaggaagaagagctgtttctactctcatagcatctgaagtcgtagtagaggaaactagacctgaagtactttggctttctgaatgtaatgatctatccgcttctacttttctccttaagatttgttgaaagatctggagggcctctggaactgtatgccccagataaactgcatgccccagataactgccctcaggtgaacttggagttgtaattaatggaaacattgtcttaaggaatgatgcaggatactttgctggttgtctctgttgaagcatctctaactattgatttagtctattgagctatacagtatgccaggcttcattttctttgactttgtgatacagcttaaaaaagaaaaggtattgagataaaagttgcttttatcttttatttttagatcaccacgcttattaatcataaagataataccaaaaagtctgataaaactctgcaagcaattcagcgtgtaggacaagctgtcaacttggcagttggaagatttgttaaagtaggagaagctatagccaatgaaaactgggatttgaaagaagaaataaatattgcttgtattgaagctaaacaagcaggtaggtggatattgattttgaagactattcataccacttttattgctttggttatgatgaaaaattattgatttatttggaataaagatatacagctctttgattatgtctgcctcagacattaaaggcctggattagcttccgcgaatactgcacttggcttggatcaagtcctaaatctgaaacataggactccttcactggtcagagttagtgatcggccatcctcatcagccattgagatgtgagagagatagagaagtgggagctgtggcctctattctctaagaacatattagtctactttccatgacataggaaatggaaataagcattagtatccattagtattctacagcaaacaaatcatagtgacttcaaacttcatgatggttcacagttctctatagatggtagcacagaagcctttgagaacctagagtgttttgaggactgcagctttgttgaagtatcatttatccattaattttttcaataaat

SEQ ID NO: 48610 - DNA, 1046 bp, Homo sapiens
attcttttattccacagcagagttctttagtacaccagatcttctttcttccccaagggatgccttttctgccctcttctctggttcatttaggtgttctctagactctggtgtcagggcaactccaagttatgactctcaatttaatatcattcctatttttgcagaactatagttaagattgtatttggcatattatgatttacaaagcactcttgctagttgtcttttccttgatccttaacataatcctggaaggtaagagagacggtgtagtgattaagagtgtaggtagctcccctggctttgtgacctcgggcaaatacttaacttcttcaaatttcagattttgtatctgtaaaattagggtaataatagtatgtacctattagatgctggagaagcaagcattaaaagaattgatacatgtaaaacacataggctagtgcctggtactgttgtgcttaacaaatgttagctagtcttattttttatatgataaggaaagtgaagtttaatctcaattttgtaaaactgtgtatttaagtatctatatgtacaaaacaagactggaaagaattatgccagaattctcagaggttagtaggattatgggtaatttttatttcttgaggctctcctatattttccatttctgtttataaacaataaacatgtataacttttgaacctaccttttaaaacatttgaaactaattttagaatataagtagaccttaaataaagaatgttacatattgacttagttcctctaaataaaattttaaaggcatactatatttggattgaacatttcctagactgctttccagtgaaaggaaggcagccacacctaattatgcactggggaaggcgcttctagtgaaagcaaaatgtgtcttttggaacggaacaatagttcatattttggcttaattgcaggatcttttctttgtaattgaaattttaaaactttatgtaaatgaaatatttaataaacagaatcaccttaatctgttcggattgctataaaaaatagactgggt

SEQ ID NO: 48611 - DNA, 1913 bp, Homo sapiens
aagattagtttcaagttcacattcgctattcagttgtaaaccgaatggatgggaggggagaaaatacaagctctccacacaggtatgctcctctcttttctgagagagaaggcatgggattttcagcataaattccatgttatgtgagtgctgtttgagttctgaagttcctatcaatatctgttcctgcaagtgatctctgtaagaccaccttacatgctggtcttagttattgttaaaattgcaaggtttcttcacaccctctttgataagaagtgtttagctggcagagctttcccttgacttctgagtctagtgtgggttggcccatgacagtgggaagaaatccaacatgttacatggagaccttgtatgtaaacaaactctgtagcctttgaaagtggaactgctttttacagttaaagggctgctaaatggcttgcagatgagatcttctggctcaccttgatcttcacatgaacccattgtgacctatctggatttcctaggacctgtagtttccatttgggttatattagtgcctcaggaatgtgtcactactggtcaagcaatactcagaaattcaggctgtgaggggttagattagaggaaagtaatttaggtgagctatccagagctttcaacctcagggtttataggaaaaaaaaacaaaatacaaaaacccttaggacttctcatactctagccctgaccttgcagtctcctctgaggggcctcctaagacccttaaaataatattacaataggactttgagtgtgcatttcacagtggaaatagcctctggctagcattacttccaaatgctagttccagctaaaaacaagtactttttattagtttcttgtctttcaacattctgccatcaaaatatattcattttattaacttaccgattattgggaacctgcaaaaaaaaaaaaaaaaaaaaacacacatgctgtctgcagccactgtttggttatttttgatagtttaagagaattataaatcaagttgttctgtctactagagtcagaaattctgtgctagaatgggacttctaaaattaggtggtcctgtcactttctagagaaagacccaaattcataggtttaagtggcttgtctgacatacacatacagccagttagtaacagaattcagaatagaatagagttcttttttttctgtcagtccgttgttctacttctctttccttttcttcatggttgagcagcttttggcaaaatgtgttccatatagcagtagttccaagagatgttaatagatgtaagaaaaaaagtgtgtgtgtgttgggggtgggggattgcatggtcaattaaaatgaaggaatgctgagtttgtttccttactgtaggacttctaagagttttgaacatgctattacacattgtgaatttataaaaggggacaaacactgtttgaccttagactgcactccccttctttattcctcagagcatctcaaaggactacagggtcctttgagaaacatggcccttgatcaagtttacaactctttgagaagacatccctaatggaaatactgaatggcagatctattactgtggtaccatgtagtgtgtaataaatcttgaagtccagaaagcaagtatatttgctgtttagagctatacttaaggtatagagattcttttccacctgtggtgtgtaaaatcagtattgtgtttaattttgcaggtttttcaaggatcaactaatgtgcaaatacagtggtgatatattgatattacattttaataatgcttttgtatggcactttatagttttcagacaccttttgtaacagccctgtgagacagacaatattatccttattgtacagatgggggggctctggaggctctgaaaagtttttggtgatattcccc

SEQ ID NO: 48612 - DNA, 1212 bp, Homo sapiens
gtgaaaaatctcaggtgtagcaatactctgatttgttaaatgtatccgtttcattatttggaactctgccaataagttagttttcagcagaattttgtatttatgtagtattttcccatctcttagcacagtgccttgcacatgactctaaatgaatgcttgttgaattgaattgcaactttaaaaatatctcagatatcacaataaccagcatagtgctttacattttacaaagtccttttgcacatactatttcacaagtacatcacatcagctttcatatagctttatattattttacatcagttttacactgatggagaagctaaggttcagaaaagtgaccaactcaaagtcgtaaagtgtagtaggatttggcctcagatctttgactccgttgtgtgcagattctgctgtattagtgttccttctaaatattgtatgcagttttcccagtgttacgagattggtgttgctatccatttgttgtgaatgaagacttgtcctatagtacatgacagggctgagagtggactgtagttcttagctgaaccctttctactgtttaaaacaatcatcaggcctatcctctgctcccaggggaatgtgggagagaaaagggttcttggccaggctgtaggtggtggctcacatctgtaatcccagcactttggaaggctgaggtgggtggattgcttgagcccagggatttgagatcagcctaggcaacatggcaaaaccccatctctacaaaaaaaaaaaaaaaaaaaaaaaaattagctgggcacggtggtgtggctatagtctgagctactcaggaggctgatgtatgaggatcacctgagtccaggaggtcgaggctgcagtgagccaagatggcgccactgcactccagcctgggtgagagagtgagacactgtcccaaggaaaaaaaaaagtgttggggggtagttcttaagcgttgaagatttcctttttggaaagtatttaaaggtagaaatattaataatttttcctaaaacatctccctaagaagtcactgataattataattagtttaaatttattcttacactacttaagaaaaatttcatttagaaaaggctaccatgagatcttttgactatatggagtagactgcatacagatctctttatttctattatgaatattttagcgattataatcagctattccactgagtattagatt

SEQ ID NO: 48613 - DNA, 1025 bp, Homo sapiens
tgtcaccagcatttcataaaataaattataatgtttgaaaatttttctcaattgtcttataattttcttaaatttctttaggtataatttatatatggtgaaatgtacatctaaatagccaaatgtacctctaaatagacaggttgattttttcatgtactcacacccatgtaaccactactcatatcaaggtatagaatatttttgttgttctggaaggcttctccctgcctcctctcagtcagaccccactgcctgctgatactctaaccatagtcacttttcattagttttgcctgtttttgaacttcatataaaagaaatcatatagtaggtaggtactcttgagtcagtcctcattgctcaacagtgtatctgtgtgattcattcatattgttggatgtttttctctgttcatggttcattcttgcattgttgtctaatcttccattacatgaatatattacaatctcatttaatcattgtaggactaatagatatttgggtagtttgcagtttatgtctgttttaattcaagatgctatgaactttttaaaaaaaatttcttattttgccacgaacgtttttgtacatgtcttttggtggacatgcgcacagtacttactgtagttggacatatacctaaaagaggaatgtctggttatacatctggttttaagtttaggtggatacttaaaaacagttttctatgttatgtgccagaaattacattttaacaacaaaaaagaaggacagtctcagaataaaaagtaaaatgttttgaactttccggaaactatatggcattctccttgttatctgcaattggaaaacactagttttcctgccactggatattctcgtgtaatcaaggagtcactgacaagttggttctgacaatgcatttaatgaaaatattttatacttttatgtaaaattctttaacaacatgattctgcttaattttgtttttagtgttatattttgtgaagagagacattgtcctttaactcagaacaaatgca

SEQ ID NO: 48614 - DNA, 1034 bp, Homo sapiens
acctttgatgtcaacttatttttggcttaaattttttaaataacataaggttaaagaaaggatcacatctctatcttttcctcattgacctccctagttctagacaaattctatacttttttcctttctttttctctgtggtcgattatgtcattattccctccccctcaaaacctaccttctcccttggtctccgggaatactgcactctagtgattttcctcctactacggaaatgatttcattacctctctggctggtatttctttgtctttaggtcctttatgaaaacacaacctgttgccctattttctctccacttgcccttttaagatgtcctgtactcttttataattattctggtgcgtctcagatgtcttgttctgaattttctattaagccttgtctcttatttcagctacctctagggtattttcatcatcctttttgagttcctgttgcccatactaaacaaactgcccttttcttgcatgcctcttccattctggccttctccatgactttgagacactgctattctttccccttcaggtttaaaacctgaagctctgttgttttctttttgctctgtcctctctgtttagttgttgagcagatccttggtattttctttggggtctttcgcttccttttggtatttttgataccactttattctgggttcttgttgcagagtcatatggctcctttaagacgttctctagtgaaagccattggtccggatgacaaagcaggttttacaattggggagccactctgcccctggatccatgtcccagaacactactaaatgactaaatcactagattacagggcttcactttgctcctaacagtatacctcttgggatgctttagaaaagcttggtgtttctttttgcatgtacaaggtcacgtttgccgctaacgtcttctttttcaactacagcttttcttctgtagtgaccatatgaaggtgctttccctgcacccctctgcaccaccccatagagtccaggtttttatgattttgtg

SEQ ID NO: 48615 - DNA, 1125 bp, Homo sapiens
tgcctgtaatcccagcacttgtggaggctgaggtgggcagatcacttgaggttaggagttcaagaccagcctggccaacatggtgaaaccccatctctactaaaaatacaaaaattaactgggtgtgggggcgcacacctgtaatcccagctactcaggaggctgagacaggagaattgctcgaacctgggaggcagaggttgcaatgagagtcgagatcgcgccactgcacttcagcctgggtgacagagcaagactctatctcaaaaaaaaagaaggatttattgtatatccttagagtgggtaatgatcagctaataccagaacgtaatgaattaatataaaagtattaaagatgaaggttagtgatgaaggctaaagattgaatgtttataatgaagtagaaaaaattctaaattgtctctatgtaaataggcagaaagttgcagaggaaatagaaaaatggaaacaattgtattaaggaagtgggcctacaaacttctagaaattctttgggtttttgtttttttttctgagaccaggtcttactctgttactcaggctggagcatgttggcgtgatcacggctcactgcagcctcaacctcctggactcaggtgatcctctcatctcagtctcctgagtagctgggactgcaggcatgcgccaccacacttggtaatttttttgtatttttgtaaagatggggtttcgccatgttgctcaggctgatctcaaactcctgggttcaagcgatctgcccacctcagcctctgaaagtgtgaaaattgttttttatattataatatggttttaataataactaagtgggacaacattttataatgatagccttcctctaagttacgttgtctcagtgtacttgatttccacaaacccggggccagtctgatcaattgtaaatgagaccggacatctctcagcatgcaaatagaggaaggattcgtgtttatagccaacatcctaaaattttacttaaaattctgtggtaattcttaataatagagataaatgtaacatgagacatatgtataatggaaggtcactgggattacaggggaaagatttttctctggacaggtaagatcagataagtcagcaatc

SEQ ID NO: 48616 - DNA, 1052 bp, Homo sapiens
gtacacagtgagctctatgtaagtattaggaatttgtgtaggaaaagtgtgtatgggatacagtggcagcactgagcaagaaatgactcactgttcatagggtcatgagaaagggaaggttagcagaggaagtgatactggagcaagttttgaagcacaggcgggagtttcttaggtagacatggccagaagggcaagcagacggagcagtgcaaaggcatggagacactaagcctacgagcatgcaggttattttatgtatttttaattgttggattcccaacaaagatgtggttatcatcatttcaatcattatatatcttaaaggaatactacattccgttgattttaaaactttgatgtgttacagtttttccgtccctagtttttcctttgtctgggatggtttccttctcatgctttccttttcttttcatactatggttgcattctctaatgatactccactgttcttatcttctctttctcaccttaccccctatcctcaagctctggcactggctaaataagaaggtaaatgaacacccagatgttggtttttactattgaattccgtaatgcccctgtatcgcctttttcactctatgtttctgtccatgtgtcaaactaagtttttgttttcaaagttttaattataagctatggaaggttgtgaagcatgaatactatcacagtataatttggtaaaaactcagcaaaggctgtctaggatatggatggtatctccttgctcaggtgtttgtaagaagttctgtctcatagtccttttgtcccctgtaaatccagttctgtaaatgtggctcagcctgatattctagtctcctttgatgtgtgaaaacacattaggcaatagttattgtaagggcaagagagaactctctgtttgatactttttctataaaagacacaggaattttttaaaaagacaaatctgtgaaatatttgtatggtttccttggcagataattttatatattgtctttttttaaataactagtatttcaaaatttatttttaacttaaaacagata

SEQ ID NO: 48617 - DNA, 1073 bp, Homo sapiens
tgcatgcttcatgtgttaatatattgacccctcaaacagacccctctggttgttttggactcgttgtcctgtgtggcctggctttgggaattgcaggctcctgaggaatccagctggtagatataccagctgtagagtcatgctgtactcttgcagagttccagaatgtaaaaggccaccttagtctgtgctgagagatccattagtgccagaggtatttggagttagggaatatttagagtgaattctccttgaagaactgactttagaaatgtcagctaagataaaggaatttggtgtagtaggaacacttatttttcttgcacatggaattatgtttccaaagtggagaggaaatgatattttggttttggactcattcttccaaatatctgtcacacccaccatcatgaagtttccaaattagaaagataactcagagcaaagtcaaacaaaagcatctgttaactagcttgggctttagccctgcacttttaagggtagaatgttggtcctagtgaggtgagctgacttaccagggtgcaagtgatctcagtagtaaaaattgactcatagctgaacttttaacattaaaaacacttaaggaaattatgatacagcacttggtgggctactgtatgattgcttatgaaaattatgaaacaacagggaagtcattcattcacttatttagtgagcacctcctatatatgagatactattgtatgtgccaggaattcagtggagggagaacaaaacagacaaggtcttagctctggtggagctgactttcaactgaagagaaagaatgagaaaggataagtagaacatgctacaactatgtaaaagaccagggggaaaatgtgaggttgggattatgggagttcttatttcttttctcttttttctagactttttttctgacgtatgatacttttgtaattaacaatccacacattcaacgtgacatacttttgtaattaacatttttttctaatggaaggcaaaatgcaagttttaggatcttaataattttcattattatagtatatatagagtaatactactttaag

SEQ ID NO: 48618 - DNA, 1034 bp, Homo sapiens
cccttgcatttccatatttatgatcagctttcctgtttttacaaaaaagccttttgggattttgatagggattgcattcaatctagagatcacttgtgggcgggggggagcattgccatctttacaatataaaaagacaaaaccacaaaaaccttacaatttatgagcgtgggatgcatttccatttatttcgttactctttaattttttagtgttttttttaattttaaattttaatttttgtggctacatagtaggtgtatatatttatggggtacatggaatgttttgacacaggcatgtaatgtgtaataatcacatcaagtaaaatggggtatccatcccctcaagtatttatcctttgttataaataatccaattatactcttagttattttaaaatatacagttaaattattgactatagtcaccctgttatgctatcaaatactaggtcttactctttttaattttttttttctgtttttgagatggagtctcgttctgttggccgggctggagtgcagtggcatgatctcagctcactgcagcctccacctcctgggttcaagtgattcttctgccccagcctcccgagtagctgggattccaggcacccgccatcatgcctggctaatatttgtattgttgtagagatggggtttcaccatgttggccaggctggtctcgaactcctgatctctggtggtccgcctgccttggcctcccaaagtgctgagattacaggcatgagccaccacgccctgtccatttttttaaactttttggtacctattaataaccacttccagcttccccgtaccctctcactatccttcccagcctctggtaaccatccttctgctctctatctctgagttcaattgttttgatttttagatcccacaaataagtgagaacatgaggtgtttgtctttctgtgcctagtttgtctcacttagcttatatggcctgcagttccatccatgttattgcaaatgacaggatctcattctttttttttggcggaatag

SEQ ID NO: 48619 - DNA, 1078 bp, Homo sapiens
aggagtgttatataagtgtactattattgtactcagatttttttctatgctctgcaatcagatctcaaattctttgaattcccagggttaattggtctggtccagcaagactggactttttgaagcagctgtagtctcacttcccatgtcctcatatttttgagcttcaaagctctttaatatttcatctgatagagttacttgaagaaatattttaatgtcctttttattataaaagaattagtgcttattaaaggcagtctggaaaatacagaaaaaagtgaaaggaaaaacaaaattttaccacccaaatacagccactaacttcttagtacattttcttttcctcccaccatatagtagatgtaatcacagcacaagtattttttgtattttacttctaacttaatatgatattgtgagtttttaaactatatagtctttgtttttaagaagtgattttaatggttgcataacattttattgagtgaatcgtaatcatttcccagttgttgaccttttaggtaatcacttttttcactgttctgaatcatactctgatgagcttctttatatttaaaactttttcaaaatttatcattatttagtaaggataaagtctgaaagttgaattctgaggttagaagctataaacatttttaagatgcgaagattatttgtattgatagatttgaccaaaataacgtaggagatagtttttttctgtcttttttagtaatcccatcagttcttttttcttcatgctctgaattatatagctcgaagtttctttttgtcttaatttgcttttttttttggcaaggttcatgtcatacttgacttttagcttcttggtcttatgttaattaaggtctttgtgctcagatgtgttctggattatgtattccctctgtgttttataaatgttctattaaaatatgagtttctgtgtaggctacgctggtttcttttgatgcgtcttaagctctagggtcatttaactttagtgtaggaagaactgaagagggtatcctggctgattcttctgttctgaagtcctgctgtttgttcctctaat

SEQ ID NO: 48620 - DNA, 1050 bp, Homo sapiens
tggccatctttccttattagcacttagagatatacgtctttcttttttttttttttgagatggagttttgctcttgctgcccaggctggagtgcaatggtgcaatctcggctcactgtaacctccacctcctgggttcaagcgattctcctgcctcagcctcccaagtagctgggattacaggcacatgctaccatacctggttaatttttgtatttttagtagagaaggggtttcaccacattggccaggctggtctcgaactcctgacttcatgtgatctgcccgcctcagcctcccaaagtgcaaggattacaggtgtgagccactgccctggccacttttttctttttaatactgctacagtataaatcttttttctccccctcccccaccatgccttttagaaaatgttttcaacagattttcttagctctgaatttgtattagaatactttgataaacatttttaaccattggtaattgtataatcataatgggcttaatataaactctaaagtgtttttataaatggccttacctcttgaactaatattacttctgcgaatcttttctgaggaaacacttcaaaatactggaaaaaatccagaagccaaaagaatttcctaaaggttaaaaatacttctttttctgtttataaagatactacataaccttagtagaaaattgagcacctgtaataaaacataaagaagcagattactccttgaaatctgccatctagagataatattttaaaacattttttgttgagtatattttcaccattataaatttacacacgaataaattgacactgtagcactgtatattgatgttcatcatactgttgaaagtctgactaattactcaatttttggagatagcattatttaaacagttcactataaaatgatatttaagttctcaattttttatattgtaaatggcaagtgaatatttttatatgtgtctgcacagtgtgcttctgtaaaacactcctaaaagtagaattggggagtatattttaaaatggttattttaaactgga

SEQ ID NO: 48621 - DNA, 1057 bp, Homo sapiens
taagatccaacttttgagcatctgccatgtcccaggcactagattaggttcttttacatgggtgttatttcattctctcaatgtcttatgagctaggagggagggatttcatatgtgagaaaactaattcagagaactgttgatgctgtcagtaaatggcattcaatagacctagcagcagttgaagtcctgctgttatcaaaactctgtagtaaccttcaataaggatttttaaaaagttttccctaatacattgtgtttaattatttttagtggattgtaggccaggtgcggttgctcacacctgtaatcccagcactttgggaagccgaggcaggcagatcacctgaggtcaggagttcgagaccagcctggccaacatggtgaaaccccgtctctactaaaaatacaaaaattagccgggtgtgacggccgactccataatcccagctactctggaggctgaggcaggagaattgcttgaaaccgggaggcagaggttgtaatgagcccaggtcgcgccattgcactccagcctgggcaacagagtgagactctgtcttaaaaaaaaaaaaaaaaaaaaaaaaaagattccagttactaggaaaaaatcagaaaaatatcagcattctagtcatctagaaaccttattcgtccctcttctttcttcccttttatttttatatctatgcagttttccaggtcccatcaattttcctttttagtgtctttgggacctatgtttttcttttttcttcttatattttgagacggagttttgctcttgttgcccaggctggagtgcaatggtgtgatctcagctcactgcaagctctgcctccccggttcaagcaattctgcttcagcctcccaagtagctgggattacaggcacccaccacgcccggctaatttttgtgttatttttaatagagacggggtttcaccatgttggccaggctggtcttgaactcctgacctcaggtgatccaccttccttggcctcccaaagtgctgggattacaggcatgagctactgcgcctggcctggacctatg

SEQ ID NO: 48622 - DNA, 1025 bp, Homo sapiens
gatggtgtgtgtttatacacaaaggcctgaatatacacaccatgagcatttgaaggtctttgtcaaggttgtttctgtttctgatctcttgcctactttaaaacccaagaggtagaacattatgcatattacaggcaaaactatgcttgagtttatagcaatgtagtttgtagaaaggattcctggatgttttactaagcctttcctcctccattcaacattatatgaattgttaagaacatataaagtaccactgttgaatgtgacttttctatactgttagttaagaaaccaagactagtgttagctgagtaactggcatgttgatgcaacctatacaggttttgtatttaattaggttccttattcagttattcaagtatccagttatttagtttcaaggtagatttctttgtttttatatttaataaaagacttgcatataagttcctcttcatgaaaatagtggctaggctagtgtgattttaagtatgtctggcaactcaaaatgtaatggattcatcaagctatttgggatttttaacataaaacacactgctgcttgattaatgtgttcagttttcccctggatatttgctattaggctgatagccatttggttggattcttctggagagtaattgattctctaaggtaatggggtgctgcagtgggtgtagcattcacccaggtcactagaatcctacctgtttcatcacatagaaggccctggccatggggaagagtgaatgcagcttctccggatgccttatttccacagacatgctgatatgctggaacaatctggctccaggagtattaatatacttttttgagactgtctacaaaatactattttgtaaaaactatgcctttacatagacattgataggttatatttgttttataacaattgtgtacctaatgtttgtgattaattttgagatttatgtatatttataagcctatcttatgtaaatttttactctaagatgtgtggcacattactaataaagacgtggatt

SEQ ID NO: 48623 - DNA, 1047 bp, Homo sapiens
tggactagtggcagggcttcctgactttttcttgtccttggcacacatagaaagtgacgtatagcatgctgggacaagcagacaaggctgcttgaagctccaggctccccatgtcctgcccacttactccaaggactgggagaataaatggttcagcccacttgcaacccttctgaggcttaccagttggaaagttctactgaggtccttgtcagcttatccccaatgtgttaattctgattaggaatatggaattgtccccattgaggctaaagtaaaacaggaaccagtttgtcccaaccagctcctccagaaggtgtgtggagaacttgtgtgctacctgtgagtctactgtgtgggctacatatacactgatcccgccgccaggaaccccaacttggagtgaagacacatgacataaatagctgaggagtaagtccaagttcaggcagcacttgatacgtgtgcactgagcaatccagacgagatgtatgcgactttggataggggaagttcattgcatttcctactgcatcagctggcgtagtacctatgggggacttcttgaccatccagacatgggcattctgttaaaggcggggaatctgttgatttcttggcctgcatggctgatgatttggttacttaggaggtagaagaaaccctgcagttattactgttgtaaattctgttcagcaaggaagactgcattggaaatgtgtaagtaacaagatccatggaagaagaaaaccctgacatctcagaatcatgaacatgaagtgagtgaaatccagggcttaattctccacatattctttttcttcttcttgttgatattcttttctaaaattaatttgtgtgggtacatattaggtgtatgtatttatagggtatatgagatgttttgaaacaggtatgcaatgtgaaataatcacatcatatatgttttactgtttagaaaatccaatttcaaaatgtcatagaaaatagacttgaatattttttacatgggctgtgaatttagaaagcatagataatccgaaagag

SEQ ID NO: 48624 - DNA, 1075 bp, Homo sapiens
tggcatccctcattgctttaattgctgcataacgttccatagtaaggccgtgcccttcagaatcctgtgggcttacgagtcgcagtttacatgtatttccattggtttttctaaggggaaagagccctgcccaggcggaactctcctatctgaataaagcgaagtggctggaaatgtatggggtagacatgcacgttgtcagggtaagaactgtgtgcgtttaagtaatttggttttgctgttactgaaaaatgtatgaacattatgcaaacaaaataacttgtggtgaggaaactgtttttgcattttgcattctgctgtgtgacgacctgttagaaccctctaccgattgtcacttcgtttgtttgtagggaagagatggctgtgaatattctcttggactgaccccgacaggcatattaatctttgaaggagctaacaaaataggcttattcttttggtaatttagttttgtctaatattaaaaatgtcttttcctattttgtggtggaattctatgtgatggatgattattgaggggtatctgcaacacccagattcatcctcagagcacacggtgctgctgttgtgggtctgtggcagttgcgctgaaacttctggataatcacacttggatgaatgtttttattttttttttagtctaagctttaaaagtagaaaggaaactgctatttgatgtgtagatagttttactgcagattgtgcttttaaaatgctttctgtctgactaggcctaaaattaccaaaatggattttaaaaagagcaaattgacactcgtggtggtcgaggatgatgatcaggtaggcctggctcccatttcttcccccttgctgtgaaaatcctgtgttggggttgcaaacgcccactcgaggcccttgtgcttcctctttaagggacgtgagcaagagcacacgtttgtgttccggttagacagtgccaggacctgcaaacacctttggaagtgtgcagttgagcaccacgcattcttccgactgcggacgccaggaaacagcaaatccaatagatccgactttatcaggctgggctctcgct

SEQ ID NO: 48625 - DNA, 1039 bp, Homo sapiens
gggctctttgatagtctgctacagctttctcaatgtacaggtgtggaaaccacattttttaatgttgtttatgcttgggtaatttttaaaaattcatattctcttaaaagtactttaaagtatttttagagaacagaacactttgcatcactttcctttagcctttgtactttgtaaaaactagctgtcagtttggagtattgtggcatcaggggtgaaaataaaatgtcagcttttagtaatctgtctaaatcactagggtttttctcctggaatgaggttactagctaaactatcttagtcagcacaaaagtccatccatctcagtttccctgatgaggactgaaaagaattggctagtgtcgcgtgcccagttatgctgtcctgatgttgtgctaaatgttatagatttaacgtgctttcccttttgtccatcctgtgatcttcaaaactgggggaaaaacatcttcaaccttccatctccaaatgtttagttggacctgcttatgctttacactttcgagttaaatactattcttcagaaccaaacaaccttcgtgaggagtttacaaggtaggccacgatgcagaacaagctcccgcccagcagggcttgccttacatgtcatttatggctcttctcaattgtgggtttgcctcttcttctgtctgctgtctatttctcagcaagagttattagtacttttccggtgcttccgtgttccgttaaaaatccacaactttgcttaatttgacatttttctgagtgaatagaaattagaagatacattttcttgtcacacttctattttcttggaccctgggtaaattaattggttgctctgcggcgttttatttttatctcaactacaaaaagggaaggcagatattggaaaagcatttctcagtccttaatcgccatcttatgttttaagagattgcaaaatattctcttgattgttacaatacaaggaacctctttaagaaaaacagagtaattatagcaaagttgttaaaatcccttcatgttatcttttaac

SEQ ID NO: 48626 - DNA, 1030 bp, Homo sapiens
acaacctctgccttcctggttcaagggactcttctgactcagcctcccaagtagctaggactacaggtatgcaccaccacacctggctagtttttgtatttttaacagagatgggattttaccatgttgtccaggctggccttgaactcctcacctcaagtgatccacctgccttggcctcccaaagtactgggattacagacgtgagccaccacgcctggcctatttttaatatacacagggtcttattgtcacccaggctggagtgcagtagtgtgatcgtagctcattgcagctttgatctcctgggctcaagtgattctcccacctcagcctcctcagcagctgggactacaggtgtatgccaccatgcctagctatttttaaaaaagaaaagtttatagagatggggtcttgctatgttgcccaggctgatcttgaattcctgggctcaaacgatccttctgcctcagcctctcaaattgttgagattacaggtgtgagccaccatgcctgactcagatactcttcataagccaagaaaatttgcaggtcctagaaatcccgttatgagtttcgtcactcagacttaatggtgaaggctcaggagatgttccagcagagagttgttagatgctcttcaactcctgagctgctctgaggccttgtagttccaatgctcccatgtagattttagatgattaaattctacaaccagccttatgggtgtcatatttccagaattgatgtactattggaacagatgggccttgccaagatcatctcacacatcttgatttatggaaaggattttgccagatggacttggatgagaaattcagattagaaaccacctttctaacacccgttagagtgtttgagtgaaatgtcctgccatttgaactcagaattgcacctgtctgtttccagtgactggtttaatggtctgctaagagggccggagccgtttgccttggcgtttacccacaggcggcatggctatatttagccaagacacaggtgaacatct

SEQ ID NO: 48627 - DNA, 1089 bp, Homo sapiens
aagagagaccctgtctcaggaagagaaaaaaaaagtgccagtatgttgttcaatctcattttttgcttttaaaaacatagtatataaatgtattatgcgtttacatatatgtgcttctgttcatttgtgttcatgtaggcacagaaaaaataagctggagaaaatatacaaaaagcacatctcagagttgtgaaattgctgataatttttttctttatattagtctgaatttcccaaattttccgcaaaaaaaaaaaatcacttccaacactgaaaaaactgtgtttttaaattcccatagagttaataaaaaccactggtgagaaaggattaaagggaaaaagcagtcatatagaaaagaaaacataagccttggagtcagatctgagttcttgtttgtgatctcgaacaaagcattgaacttgcaaaataagaatacaattaatatctcttacagggctgttgtgaaaatcacatcagataccatacaaatatgtctaatacatgactttagatatgcaaagattgtgttgtttgagatttttcgtagtgattacatgtgtagggaagtacctctgtaaatgaaatgtactatatattgggataaatgtttttcctgtggaaatagactcctgaaatgatgaatgaaatgctctcgttcttaaaggaagggtgtggttcactacattgaactgaagggaaatgattctagactaatttagatgatttccatttaattttgagccagaattcttcccccccccccccacatctagttgcttttagctcttgtcaaatagttgtcataaagacaaggtttcacttaccatgctccattacctgagacccagacccttcctatggcattttttcaaattaaaaaaaaaaattattaaagagtttagtcagtttctcatggaactgtagaatttcttattgggaagattttcttttagtatataacacataatcactttaaaatgttaagattttggtactgtgaatgataaagtatgttttcacactttcttcatctgatttttgcaatgcttgcttttttctctatttctcacatagcaactctacaga

SEQ ID NO: 48628 - DNA, 1084 bp, Homo sapiens
ctccttacccatggtttccttgattcccggtcccccttttttttcctgtccttttccctttttcttcccccttcttgggttctcagccttcaggaattcccctttttctgttcatagagttgacggagtgcttgcttccacttgctgggccttgccagcatccgctggttagagccagttgggggtgtgaagctctcacctgagggatgtgagtaggctgcacacctttggttgagtgaggagattagagtcacctgatgccttctctaatattatagtaggtgacttgttctaagaagaaatatttaagccaaaaaaccatccattgcacccctaccacattggagagcatctgctcccaccattcaaattttttgtctttggaggccagagctggtgatactgatactgtaatttcaatacagttgttccttagcaacccctcttagccgaactttttataatttaccgttagcttcagagcttcttataactatactctgatagaatgagaacaaagcattttaggacataaaaattaataatttttcataaaattcagtggttttgtcattttgtatccctgtgaccctgcctctcagcctcctggtgactcccattctaggacagaatctaagggacctgcagccaggagctgttgtctccctcacactccttcagcccaggaataaccaaagcaaattgttgtttttccgatgaattggaaaatgaaaaaaaagtgaaggttctcttaaaagccatgtctcatactctggccaatatcacaaagccttaactcattccgttccatccctgacccttccagaaagacatacctgtgattcctacactcactttccactctgtccctccgccttctcagagcagtgtttcataaccagactgccaagcagcccacagggcctggagaagagtcgataaattttaggaacttgaggccaggcgcagtggctcacggctgtaatcccagcaccttgggaggccaagacgggtggcttgcttgagtgcagaagttcaagaccagcttaggcaacatggtgaaaaccagtctgtactaaaaata

SEQ ID NO: 48629 - DNA, 1027 bp, Homo sapiens
cagaaagcatttggtcccagctgtcataaaatcacacttaataattagcatttctagagcactttggaacctagcaagtgtggtgcacatatgttgtctctgttaactctcacaacagtactgtgaaatcgatatggccagcatgatgaggatcacccttttacagatggagaaaacgaaaatcagagaggctgagggacttgcccagtggcacacaactagtcagagatagagccacaattagaatatatgttaaatatctaggctaggcatagttgctcatgcttgtaataccaacactttgggaggctgaggcgggacgattgctctagcctcggaggttgaggcttcagtgagccatggtcataccaccgtactccagcctgggctgcaacagagcaagaccttgtctcaaaaaaataaataaaattttaacttattgtcggcaactcgccattgctgagtgtacccagccctcactctatcctccaacattagccattccctttggtagccacactgtatgacctacatcaatgggagcagtttggtggtatttttgattggccccaaactgcctaaatactctttgtgtagccaaggtagggtgttcctctttctcttatgtaaaggagcagaattggggttcacactgaccccaaaattaccacttccaggaagctcttgtttttgtttgttcctaagaaaaacttggagattaatctacatgttccctgagttgaagtgtccatttaagcaaaggacaggatctgcatttggtatagactttcctggataaaagctaagtgatgatgctaacctgtcctttatttgagaaccagcttcccagcaacaaaggatcccagtgtccattttcatccagtgaccaggtgactcacagcttccctacctccttgcccactgttagttaagagctcgaaaatgaggaacaccacaagagaatgcctgcatcccccagttgatggattacagcagtggctacaaaagaccaccaaaggtcatgtca

SEQ ID NO: 48630 - DNA, 1047 bp, Homo sapiens
atatctgcgtggcaaagacccccacagtatcagagggggttggtcatactaggctgttctacgtgaactaaaaacccctaaatctccatagcttcatatcataaggtttatctttcagtaattcaaagcttgcattgagtctaggagtcttccagggcagccctccaccccatccatcgcaataactcagcagtcgaggctgcttccatgtcatggccatctttccatgtgacctccatgtttgtcacaagggaacaggaagctgcagggttacacaccagctcttaaatgcttcagcccaaaagagacatacattcctcctgctcagagcacagtggccagaactagtcaccgagttctgccctctgcaaggggagctgggaaatgtggggttgggcctgggaattgaatagacagtaacttcctatgctgcaggggttgaggtgcatactgaaagaccacaggattaggagatttgagacctggtctttggcccacccaaaccattcatttgtttccttgttcactcaattttgatttcctttgctaatttgctctgtcacacctgcttcatactccctctgttgtgatctcaagtatcatatttaaatgcaattctacccttcatcaagcaaatttggttttgttataagcatgtgatttctgttgggtactgatagtgaatactgcctggactttccacagtatcagcactgttttgtttgtcccgtttctctaactccatgttcacattgtggttcacaaagggtttgtcccacggcaaaggggaatggacgtttcttatgtcttccacgtgccaaactctcttctagaagctccatatgccaagcccccttctaggttttcatctctcatttcagccagataaaaacgcttcgaggtgggttctgtcatctttattgtacaagaagaaaaattgagcctcaggagcccaacattatatagctagtaggtgccagactgaaggttcacactcagttgtgactgactcaaaccatgccccctctttataattactagtatctg

SEQ ID NO: 48631 - DNA, 1027 bp, Homo sapiens
cacattcaatggataagaataaaaacttgctttagtagaatttagcattagattgctgaagattgataacataaggcatttaataaccttacagaaatggtatcaaatgttctagattttttaaaattggagttaatgccctctctttattggatgaactctgctttttgtcttttcttccgtagtgggctaaaacaatcagaagcagaatcctgctatatcaacatagcgcggaccctcgacttctatggagtagaactgcacagtggtagggtatgtattcttgttatgtcttggctcaaacattatgtttttattttaatctctgagagtttgaaaaattctttgatgaaactatttctttttcattataacaggactttttaaaagatatttggaaggtttattaagtaatgctgaattttttgttggtcatttgtccaattgcttttttttaatgtttgcttttgtacttgaagacttttcccttttgaagggttaggggactagaaactagtaatttttgtaagaccattttatattatggttttaaaaggcaaaaaataggtataaattcatttttcaggtgacggtttaaggagccaagatttctactacttaatctcaagtgttgctcaaattggagatagttactcatatatgatagtttttttaaaaagattatggtgatataattgttaaaatcaataaatatttgaaattagttgtggctactttagtaggatttactaacatctgtcatctgtcaagcaatttctatgcaccagtggattatttcctgcggtaataccatgagttccatatgttatcattaaccccattttacagatggagaaactgatactcagggacataaccgaggtcacacagcacacaagttgtagcttcagcacatgacccctcactgtctaattagcatctgacctttgatcagtggcatacgttttctacctgtgattggtccacatcatatccaaaaggaagcaaaaattaattgagcacctac

SEQ ID NO: 48632 - DNA, 1045 bp, Homo sapiens
cctccctcagcctcctgagtagctgggattataggcacataccaccacgactagctgccagatcatcttatcttggaccaggcttctaccattaattcacatgctttaaaaaaattaaaaattaaaaaaatgaaaaataaaaaaacttaaaagattttacctatattcctggaacatagttatcttaccccagctttgtagttcctgtttaaggaaattccctctgaaggaaattttagctctcaagagtcaaagaagatgtatagaggtggtatctgttagtttttgtttgtttgttaaggatctaggcagagaggtcattacatttttctgaagttgaggtcacaggtggggtacccacaagagaggtcattacatttctgaagttaggcatcccaggcatctcttctaaagaactatcctgtattctaattgttaaataaatatcttcttcattgtgagcctccacaactgctgtttctgataaatttagatcattctttgcagaattttatatactggcaatctcaaaactaggctccttcaagattcctaggaagtctcccaagctcgggttgggttccactattctagtttctttgtgtatgatgccatggggttgactcagaaactttgctcaatatatgacaaggcagcatttggtgagtggtgatctccacgtttatcttctcatttatatccctaggaagacatactgattagctgagcttgtcaatgaaagcccgggttcaccattggattatctataactctcctttctctttttttctctcagtagcattgtaggaggagagaacacttaattctggttgaatgtcagcttggataaacatagaaacaaactagaaagaactgatgatgttctcctaggtggaaaagatggagattccaataccaaataggtgtgaatcagcaaatgtatgttatactgtctctcaaggccaggtgttcaatacattgtgggtagttaattataatcaaagtaataatattagagttacgacatggatcctaagctttttag

SEQ ID NO: 48633 - DNA, 1698 bp, Homo sapiens
gtttgaaattagcccttttataatggaaaaagctatggttgagtgaaaaaatgcatcacttatggaagagaagcaacttacatacattgactttgtcaaagggaaaatttaatttgtttttgaaaaatgttgtaggaggtttcccctgtaccctgcattttcgagtaagattttttatacctgatcccaacacactgcagcaagaacaaaccaggtaacaacatttttttaaagttttctgtttagtgtataaaaatgagtaaccactaaaaatgtactcttcattttattactatggccaaataacttcatttgggtgtaactacaccaacaatgatgatccaagtaaaaatctggggtgcacatactgacattttaatcacctaatgagttttcagtcttgggcctgcttctcttatctcctgatttgctgccattcccagcatactcccatctgccacctcctacctctcccacctccttccacctccctggcctctcctgcctgctgaacacactgtgctcaaaggacaaaaagtcattttctaccaatgtaggcaggatgtagaagacaaatttgtaaaatagtcatccacaggtcaaatagcatgatgtctctgaagagctaaaatcaaggctcttgaagataacaagacatctcttgttataagaattttctttctttttttttgttttgagacggagtctctctcttcaccctggctggagcgcagaggtgcgagcttggctcactgcaacctccgcctcccaggttcaagcgatcctcccacctcagcctcccgagtagctaggattacaggcaggtaccaccatgcctggctaattttttttttttttttttttaacggagatggggtttccatgtcgtccaggctggtctcaaactcctgacctcaagtgatctgcctgcctcagcctcccaaggtgctgggattataggcatgagtcaccaggccagctttgttataagaattttctatcagatccccagtttgcaagagttagaaaggagagcaggctggattcagcttgtcttctcagtgaatcagcaagtacaggaaatatgtgaaccagataagggaaagagggctgtgataggagttgtttacccctcagggcttggagtctctcccaaccctgggctggtactggggtttttctaggtgtgagggacagagtaattggaatggagtaggagagtgtagcacaagaaagttgttgctgttttaacacagactgcacaaacaaactttccctcccctgtggcaacgttaagcccttttattattgatccatttatttttcttagggagggaagctatagaaaaaaagcaatagatgcttagtattgaatcctgttttacattcatcgtggccaaaagacataatcaaggaggcagcattaactcagacacagagtgttgccttgttaattttttttagcagtaattacatcacattttaacttgtaatatgttgaaaggccaaatattaatctgttactgtattttgccttctttgtgcacctcctccctctactatagcagacactgggaatttgactgtattttttattactttttaagccaatgtccaaggtgtctggtatgacacatccggtgaccacacagaagcatgccctgtcctctgagttttccccataccagctctttatgc

SEQ ID NO: 48634 - DNA, 1068 bp, Homo sapiens
gtgagagctttcctttcctggacatgcacttcggtggcttctccaggagtaggagccacaggtgtgtcctgaggagccaacagaaaccaccctggggttagcatttcattgtggataatccactggaggccacagggagttcactgtgattatgagagctgagttttccgatttagacattatcacttgggaattgcagctaagggggaaggaagaaatcttagacaattaaattaaactcgtattgtcttgtgttgatgtcatttttcttagccctacttcccatatgtgctgtgtggcttcttaaaatttattaaagcttttcttgtggtgggaagtgtgtgtgcatagcatttctgaatattttaactcttttttgcctacagtaaagatgtttttaccaccaattaatttaagacttttcccacttgataatttcctttgttctagaaacaagacactggccaggttcttctggatatggtgcacaaccacctgggtgtgactgaaaaggaatattttggtttacagcatgatgacgactccgtggactctcctgtaagtgccatttttaaaaaatgtgctgaactccttcacggtttgcttttatattttatgttttcttgtccaacagagatggctggaagcaagcaaagccatcaggaagcagttaaaaggttggtgtgatcttttcatttcagtcgaacattaggtgttagtgtatcacagcctgtttctcccctccaatcgtcagtgcctgtgacatctggtacctgtagttccgggtgtccaggagtcatgagtgagccgacttctccctgtctgacttctgagtcagcagagatgcttccagatcagccctctaggatccgccccagctgtgggaaagaaggggaagggtgagagtaggcagctcagagcgagggaacccacatttctgtattcaaggaaggaaaaggaaggaggatggccttacttagcccgatgtgagagccagggtggacaagagagacagggagatagacaaacacaaacacctcatactttccaacagcatagtcgcgttca

SEQ ID NO: 48635 - DNA, 1098 bp, Homo sapiens
aaaatggaagcagtctttagtagttcatagtccccactttagattgctcagctttggtaaacatttcttaaagtgtgtcagaagctcctacgatgtgtgttaaagatgtcaatcccttgtcctgcctgggtgttttgaaacttgctctctgtggggtggggcctgagaatctgtattgtaatggctccccgagttgtctcaatgtgccgtgcagttagagaaccactgatttaggggtctgttggcaaggttgtaaatatttcccttaaaaggcaactagtttggttctacagaaccttgtcttgtatctgatttccttttaacataatctttcatagaattttgtgattacacaagctccatgaaggtcacagatgtctcttccagatgctgtacactaatagtttagtatgtgtctggcttctttgttaaaatgtgtgtttgtctgtcttggagctgttctttaaccgtttatcctcttcctgacgaaaacatgaatgtttgttagtatataactcatgtattcattcagcatatgtttactgagcacttactatgggctaagctttgttctgggtacaaaaaatggcaacagtgcacaaaacagaacaaaatccctgcgtttttgaagctaacatcccagcaggggagatgggccataaaaaaatatgtgctgagtcgggctttgcagaaaaataaagtagagcaagagggagagagtgccagggcaaggtgaggttaccattgtatagacgtaaccagagacgtccccactgatgagatgaaagaaccaggcgttcatctggagggagcacatcccagggagaaggaacagcagtgcaaaggccctgaggctggagcccacttcctttggttgcagaacacagtggagtctggagtggaatgagcaaggggggagggtagcagaagataagctcagagagataacaggggtaaggggtgggggatcgcatggagccttgtagatcattctgagggcactggctttttttcctacatgaggtggaaagcactggggctctgtccacagttgacaataggagggaaggggctgaaagactggtgtggcagtccagg

SEQ ID NO: 48636 - DNA, 1029 bp, Homo sapiens
agatgtggatatccattaggctatctgtttattgaaaaggtcatctcagctaggcatggtgagtcatgtctgtaatcccaggcagttggatcacttgagtccaggagttcaagaccagcctgggcaatgtagtgagaccccatctcaaaaaaagaaaaagaaaaggtcatctcttccttcctcattgctctgaagtgccacctttgtcataaacatattatgctggtttatttcaagggagttttctgatttgatataaatgggtacatggcatgaaattgacttctctttgatttagattcccctctccttgggcctccatgtgaattcaatacaggagttgtttgggggtttaattattgtcactagatcatcagagagtgtattcacgtagtatatcaattagctttcaaggtaaagtacaaattctaatttctggatggatcagaactttcttccaactcttacctcacgcctttttccttctgcagactgcagttataaagatgtcgggagtgttctagttggttatctgtcttccatgttcacaaacttcctacaggcccaaattgcttatctttttgtcacagttttattgatatcttctttttcctttgaccattcaaaagaatacccactccctcaggagggctgagctaaagctggggacaccggagctaaataaagacacataaaagacttattcctaaggctaggcatggtggctcatgcctgtaataatctcagcactttgggagtcccagatggaaggattgcttaaggccaggagtccaagaccagcctgggttaaatggtgacaccccctatctctacaaaaaaaaaagtttttaaaaaaatagccagacatggtggtgcatccctatagtcccagaaactctgtaggctgaggtgggaggatcgcttgagcccaggagtacaaagttataataaactgtgatagtgccaatgcactctagcctgggcaatggagccagaccccattaaaaaaattaataaataaagacattc

SEQ ID NO: 48637 - DNA, 1093 bp, Homo sapiens
ggaaagaaagacagttaaaggattttggtttcggtggggggatttctttggctggatctttggtctaaaagtagtagtataacaaataatttaggtttgatacatgtagcccattgaaaacaaattttagaagttaattttgtcttaaatagttctttttttccccacattgaaacatgggccttatttgaaatcccagcctcagaatttgatatgccaagctgttttatactaagaaaaatttgatttagagaaaatttatgtctcttagatctatgtctccaaagatctaaatttttggatctttaattagtctctacttttattaagtttccatttaagaagcttgggtatgttgattgccattacctagttctaaatctttttggatttttcattttaaattttccagtccctctctgaaaagtattccaacgtgatattccttgaagtagatgtggatgactgtcaggtatgtagctggaaatatgagatactgctgagcttttcacattggcctttttctctgaattgcacagtgcttttttccataaatatgtcaaataattctagaactgtaatcctatctaaaaagttctatctcagaagagcaggcaagttaggagcttaatcctagctatcgggagctgtatatcacatcctaaagtaaacaaaaataaatgagtgagacttctgaatcttatcggccacccacctttctaaaaccctacattctactttacactctgagatgtgcaataaatggagattgaatttagctatgatcattacatccataggcttgatggagtcaccaaattatgagaccgcttgtagggctctttgtgaacttgcagtagcatgagaacctgcatttgcaagcctattctagtcttggttgattttagtcaattagaaaccacaaatgttttaacaaataaacaccaaggtacctgagagaataatttggaagaaattccagggttggttgtatttaacaaatacttgttttgcactaggtatataccaggcactgttctgggtggtttttaagtatcagttcatttaatcctgagtgctgttatcatcccca

SEQ ID NO: 48638 - DNA, 1048 bp, Homo sapiens
tttaactttcttgaaaatcacattagggaaggctttgaatgaaattgatctggaacaataagtgatgatttggaaaaacaattgctatacttctatgtaccctgctgcagctctccccatgtctccacctctagaggtggggttcagggatttgcataactaaaaaatttatgaaagtgttgtcctacctttctcaggaacaccatttgtgaattattttcccaaaaacgaggtagaaattagaaatctagagaagtaactattagtacatgaggtcatattagtgttttcttgttgggtttttttttgtttatttggttttttatcttatggttttttatttatttgatttctttctttacgagacctcttgtggcggtggggggcggggaatgttcatttttttttaaacctatttgaccagcattgtttccttgaagaaaacctagatttcagatacagatgtttatgttttgatttatcttaattgctctggtttggtttttgggtttggtcagcactaacgtactaatgtggttaaaatgagtcctttgttttgggaggccaaggcgggtggatcacttcaggtcaggagttcaagaccagcctggtcaacatggcgaaactctgtctctactaaaaatacaaaaattagctgggactggtggcagaggcttgtaatcccagctactcaggaggctgaggcaagagaatcacttgaaccccggaggcaaaggttactgtgagccgagatcaggcctttgcactccagcctgggcaacaagtgaaactccgtctcaaaaacaaaacaaaacaaaaatgagtccttggtaactagaatattcggttcccagggttacagtatctagatagtaaataattcagggaagttagtggtaagagatttcttgatcatttctactgagaattttatttaacaagcattccttatgaaaaataatatctatgaaaaatttccttcatgaggaacgaaaactttcatttaatgaatgacaagggtatagttttaaaataaagggcaaaaatc

SEQ ID NO: 48639 - DNA, 1030 bp, Homo sapiens
attaaaaattagcaatatttattttattttaaataaagcaaagctgagcaattttataccttagttcagttaattgacataaagtgacacctttgtattcctcttaaaatatactatgcattgttaaatgaaaaacatagtctgtaatcttttaggtgatataaagatggaaagacaataatgatgcctcataataatttatcaataaatgtggggataagatacagaggcagtacaaaataagcatatggataataactttttttttttttgagatggagtctcattctgttgcccaggctggagtgcagtggtgagatcttggctcacttgcaacctctgcctctcgggttcaagttattctcctgcctcagcctcctgagtagctgggattataggcacacaccaccacacccagctaatttttgtatttttagtagagacaggatttcgccatgttggccaggctggtcttgaacttctgacctcaggccttggcatcctgaagtgctggaattacaggcgtgactactcttcatgactcaggagggatttgccaaggtatttgtgtatgagtcttgagtcttttcgcctaacttctctccagagatctcatttcttttcttccgaaccttgtctccctccctccttccagaaactgtcagttctaaagcctgggttttagtttttctttttcatcccctaagtctcagattcaacattaaaaaaaaataaatgatttagccagccaacaaatacaaaggattccaggtttgctttttcattgcctccttttctatctttaacattattggttcccatctcttttttccctagccagacccaaatgaaatgccatgcagtttgcatatatgcaaacagaaatatttacatttggttaaaatgtacatggaaactactttatactagaagtttgtaagtgtgtaactgagtgtgtaaagaaatgttatattttaaaatacattttatatatgtgttttaacatcataaccacttaccctgagagggc

SEQ ID NO: 48640 - DNA, 1032 bp, Homo sapiens
agaattgagaatttataaatgtttaaaaatcctagaagagagacaacaaaaccaaattaattgttccaaaatgtttaatataaccatgtcagacgtagtccccaagtggaactctagttttctttcctgaagttttatttgttcatgtaaatttgaacctttcttagagttagtaatatgtcaactgcaatatttatttgtaagtaaaaaatggccatgctattgctaacaacattcaatgacaataatacacttgcatagtctttcacagattgtggatattttcatgcacattttttactcgatctcatttgactctccccatgtctctgtaattgaacataattgatattatccagcctgagtttgtggacctgaacatgcagtggaaatgttccgccagcaaccgcatcatgggtgccaaggaccatgcatccatccagatgaacttagccaaggttgacaaggttataggcaggtttaatggccaatttaaaacctatagtgtctgtaggaccattctcagaatgggtgagtcagatgactccattctctgactggtcaagaccaacagcatctcaaagaacttctgattggagagaattgtgagtgttgaatatttgtcataaataaatagtgaaacccttcacttcctccccgccaaaattagcccattttccggacaaaggatctaagtcttggagatttgctgcaggtgcagagccagaaattcaacccccttttcagacattgagtcttcccaatgagaaggtctcatatttacacttaacacccaatccccttacatttaagtgaatttgtgattcctcatttagattctactgtctgaactttccctacctccatcaactcagtggtacattcttggtttttgtttataagcatcaagttcaaaaactatttaaaacttctgaattgaatatatttatcgttaaaaggagatttagaggtcgtctgtcaaatgtaccttcaaatgaagaaatcttttttttacaatattcgtaacggttc

SEQ ID NO: 48641 - DNA, 1031 bp, Homo sapiens
tatgagattcaggaacaagcaaaactagttgtcagagaaatcagaacgacgatgcctttagagataatgggaagttgattagaaatgagcataagagggctgggcgcggtggctcacgcctgtaatctcagcactttgggagaccgaggcaggtgaatcacctgaggtcaggagttcgagaccagcctgaccaacaaggtgaaaccccatctctactaaaaatacaaaaatacctggtgacaggtgcctgtagtcccagctacttgggaggctgagacaggagaattgcttgaacccagggacaaaaaaaaaaaaaaaaaaaaaagaaggaaatgagcataagagaaatttatgggtggtgaaaacattctatgtcttgattggggtagtggttacattgttgtatacgtttgtcaaactctgaactatatggttaaaaggggcacagtttcttgtatataaattatacttctatcaactaactacctcaaaaaaaagaatacatttttagaaatctgattaatatgatccaaaaaattacatagttcaactctaaaatgtacaaattctaaagaaattaatggcagttttattaaaataaggaacaagggaattaattgcatctctatgttttatggacattctagcctcctgtaataactatattataattaatactcttgcaacaacagcaatgactataaaacacacctagtcataaatttaattaaaaaaaagtaagaaagaaatcatcaaattttactagcaggcataatacaagatctacataaaaagaatggcataccatactcctaaatgagaatactcagtaatgtaaatatagctctgtgccctaagttaattgtataaacttagcatcattctgatcaaattctaaatggtatttacatgtggacattggcaaaatgtttctaaattttatatttaaaaataattatatagtgagctatataatatataattatattattataaactataattataattatatattaattatatgttat

SEQ ID NO: 48642 - DNA, 1087 bp, Homo sapiens
ctttgttttgctatcacaggtggccccagacaagagaaaagttttgctctatggaccatctaggttccaggagatccatgtcaactctccatgtgcctccctgtttcccccaaaaccatgtccagttaaacttgggagaaacagtgaaaatcatgcttgaggaaattttagggaaacatgccaacatttttaagtatggcttgagtttctaatttgactttaagattgtctgaaatatctcttctattgtttactgccttcattatgttttaaatttggtagttgtgatagtagtctgatattcttggaatattcttggaaagccttggaatattttccctttgggtcataaaggattcatctaggaaacgtttttcaatgagctactgtgagaggaattcagagagagtctgacctgccttgattagttcaaggcttagcctgcctttaccagagggagttagattcatctttcacccccaaccctcacccccaatacacacacagggacttcatggacttgcatatcagctttggaggcatttgggactggccagttgccccaacagcttgagatatgactggatataatgtaacagggatagaggggtgtggttagaacgtgtcacaaaaatgtataaggaaggtcacgttcagaggcagagaaatgctgctatttgtgtgagtgctgggcctcccaaatggaatgatcacagacaaagtctttcaatgactgacttttctgagcagaaacatctcattacctttgaccaacaggaaaagtgattaggactcatatctatgctaattcttaatacttttgggaagatccaccttgtttacactgtcagagctctcctctgaggggctaatgaatgaaacttggaggctagaaagcagccagataaaattcatgtggtgccagtttatagtcagaaattatcaaacccatccagaactttactgctactctgaggaccctctaagtctgtctactggtgaagaagaatagaattaaggaggaaaagcagtcaacatgaaaagctctctggacataggatttcgttccagaatgaagttcagaact

SEQ ID NO: 48643 - DNA, 1045 bp, Homo sapiens
aaatagaacctagacttcaaagccagtatttgtttaggtcatgaagcaaacaatgctctaatcacaatattaactgtttaattaaaatgttgtaacaagtataaaacagggaatgtaagtttattaccaaagtgatatgtattccaaaaaagtcatagaagatgaagcactataatattgttcccatatatttaaaatacccaagtacattctaattaccagtatatcagaggaaaattttcgtagtctttgtaaaataatatactcatcatagaaaacttgaaaaatgcagaaatgtataaaaaagcaaaaatgattactgataatatcacaacccagaagtaaccacctttaaaaagcaacccccatgtatgcctatatgtgtattgtatactttttttacataattggagtcatactgtaaacagttttataagtagatctttttcattgcaaaattgccacattttcttatggcattaaaaattttacaaaaacataattttaatggctatattatattccatttaatggatgcaactcagtttatttaaccattcccatgttgttaactatttaggttgtttctaattttcattattataaagttgcagaaatttggtgtacataaaactgtctccatataattgattattaggatatattcccatgaaggattctttttttaaaaaaatgtgaaatgtcatcttgtacttacacctttcatgaaaagggatttcctgcttttgtactgcatgggtggcagttgtgaggaaaagccagtcaaatgacctttttacaaaagaaatgcagtggtcacttcagttgagagtgactttttaatacaacaagatcaactagaagaattcaactgtctcaagaatcaaggtaccccaatatatctcgcaattccaaactttgtttgagggactcgttatccagctcttggtagccacacctgcaatgtaaaatggaagaaaatgcaaagaaaccaaatgtgccgagtgaataaaggattgtcatatcaattagtgtgggtccatct

SEQ ID NO: 48644 - DNA, 1017 bp, Homo sapiens
gacttggtatcagtaaagccagaatacctaaactgatggaattgaataggattctactttatgggtgcagtgtaccttattttacttctctatttatgcttatttaagttatttacagcttttaaaataaagaatactgcaaatctttgcacatgcataattgtattgtgtgtaaatatatctgtaggataagtttctatcagcgatattgttgcagtttatttagacagctttagaactgattgacttttgcttaggatttacgggctagtcagaatttgctttgcaatatttagacttggtgttgtcaattttatcagctagcttttttactctacacttgtacttaaaataattgaaatttatgtagaaaaaagtatgtttatgattgtgaatctggaattctgtagccgaagcacccacttcccaattgaataattgtttttataaccttactttaaggatttttttaatttagaaaaagtttttgataaagagagatatcttagacacatagctatcatattagaacagaccgtacctcctttctgctctgccaagaatctgtgcttcctaaagatcaatccagggcatttggcagctataggagatgtaactaatctcaaaaagaatgacagtgaccacatttacagtttatactgttcttcttttcatgtcttttggctattaaaaattatatttatataaatataaacatttttaggttatgtaaataattcacaaagttttctgaattcgcttttagattaaatttttaatattttccccattttgatagtaagaaaatgaattgtaaataaaatttccattacgtttctctatccttgaagtttctgtcttgggtaatacatatcttgtgattcatgaactgcaaagaaaaaaaatccacaggattttgtcatcagctacattctatgagcattttcagccagatttcagtacttgtttagatttatattattttgggagaatcttaatttgtagttaaaaaattaa

SEQ ID NO: 48645 - DNA, 1035 bp, Homo sapiens
tgcttatcgaccttacttgaactatgcatccaaagcattgtattcatcactcagaaaagtataatgtaagcattggtaagtttgatttccagttgacagaaaaatgcttcagaaaaagagacaaactttcccttccccccattctctacttttccaaatattcagatgcctaaaccttccacccatgctagagctgttgctgcctaaccaccttctgggcacaatggcatggaaatacataatcagggtataattttgtgcagggcagagagaacatgctattatggaatcaagtctcagctgaatagcctggcctttggctgtgttttgatctcagtgctaaaatggaaatgaaacgttgcctcctcctttgtggcctatacaaagtttgctgattctgtgctcatttggtgattttcatgcccaagtaggtgaagggagaacaactacgtacatagatgtgcagctttggggttgaaggcattgatgtgtgtgtgctgagtcactatgacaatctaaagaggactctctggtggctgattagaaaattgtggaagttacaggctgtctgggttaaacatttcctggtttattggaggcagatttccttgggccagcaagcattgaaactcccacagtggtgtcatgtgatggttctccagcgaagcattttggatatggtgacagctgctttagtttaagtatctggaacatctaatgtgggagaacttggctaagtgatgtgagaagttaagagaggagtctgaagtttccgttacatttttttctgtttagtggattaaaaggcaattcccatgcaaattgtctctgtctttaggtgttgtattcattttctatgctacatcgcaaattgtcacagacttagtggtttaaaacacacccatgaattatctctcagtctctgtaggttaaaagtccaggcatgcttagctgggttctgtgcttggggtctcacaagctgaagtctgcgtaccagttgggttgcattctcatgtggaggctcgactagggaag

SEQ ID NO: 48646 - DNA, 1087 bp, Homo sapiens
gatttcttggccatgtggcttttgtagtagacttcaatgacataaaaccactaagcagagaccttgtcatttatttaactccaactgcctttaatcttaaggacagtaatattgtgagaaaccttggagtttcaacataatcacaagatggtatgcaggatcaaatgttcaaattatttgcttttgtttttctgttgcatgtactataaaagtcttgtgttatctatataagctttaaatttggacctgtgccttctttttcatcatcttttctcctttttcttttagttcacagccatgaatgaaccacagtgcttctacaacgagtccattgccttcttttataaccgaagtggaaagcatcttgccacagaatggaacacagtcagcaagctggtgatgggacttggaatcactgtttgtatcttcatcatgttggccaacctattggtcatggtggcaatctatgtcaaccgccgcttccattttcctatttattacctaatggctaatctggctgctgcagacttctttgctgggttggcctacttctatctcatgttcaacacaggacccaatactcggagactgactgttagcacatggctccttcgtcagggcctcattgacaccagcctgacggcatctgtggccaacttactggctattgcaatcgagaggcacattacggttttccgcatgcagctccacacacggatgagcaaccggcgggtagtggtggtcattgtggtcatctggactatggccatcgttatgggtgctatacccagtgtgggctggaactgtatctgtgatattgaaaattgttccaacatggcacccctctacagtgactcttacttagtcttctgggccattttcaacttggtgacctttgtggtaatggtggttctctatgctcacatctttggctatgttcgccagaggactatgagaatgtctcggcatagttctggaccccggcggaatcgggataccatgatgagtcttctgaagactgtggtcattgtgcttggtaagttctgtcttgactgtaacttactttatagattctcagtgactaaca

SEQ ID NO: 48647 - DNA, 1026 bp, Homo sapiens
tggaaaagacaaggaaacggattctcccctagagctcctggaaagaaacagagctttgccttcccggtgattttagtcctgtgagacctattttggacttctgacctctaggactgtaagagaataaatttgtatatttatgctgctaaatttatagcaatttgttaaagtagcaataaaaaactatttttgtgatgtttttactgatttcttttgtcttcataatggcttgttctattttcaatgttactatgttaacaaaacacattgaggacacaaatcagagatgtcccatcatttaatctttttctctttctatctcttctttttttcccctcccatacatctgcttcagtgggaggtgatttcttctttggcgagagataagtggccacctcctttgattacatttttccccattatgttccataattatttttctgtcattatagccctgactatcttattggcctatagtccaattgcagttaaattggattctctctgaaccatgtaggttttctgcctaagtctgtcggctcctgaagaagtaggaaagcccattcacactgcccttcttactgccattggaggtgctttcagggtctccactgcttattcttttgacctgttgctttctgcagacaataagagaggaggtttaattcctctatcagttcagtcctattgtcataaaactaactgaaattcctctcacttcttctcaggcatattataccctcccaatttttaattcctggtgtattttctactctttcaatatttagctgctaattttcatgaaatatagcgttcttatccagaatcctcttagtataggattttaaatctgaactagaccttatgtataagttagtccaatttcctcatttcacagatgataaaattgagtttcgaaaatcatttaagttttatcattaaatatgtatggtttttatggtattacagtcaattgttgagagaaaagaaatggcataggacagggcacttttctctacctttaga

SEQ ID NO: 48648 - DNA, 1087 bp, Homo sapiens
catacattttcgttaactatagccaccctactctgctatcgaatgttagaacttactccttctatctaactgtatgtttgtacccattaactaacccctctttatcctcacctccccattacccttcccagcctctggtaaccaccattctattcactatacatgagatcaattttttttaatcctatgttcatagatcccatgcctgggatatttgtcattctgtgtctggcttatttcgcttaatataaggactgccccccactccattcgtgttgctgcaactgacatgatttcattcttttttatgaccagatagtatcccattgtgtatatataccacattttctttatccattcattaattggtaggcatttaggttgaatctgtgtctctgctattttaaatagtgctgtggtaacacatgaatgcaggtatccttttgatatactgatatctttttcctcttctacttttttttgtttatttttttgtttgttttttgagacaggttctcactctgtcacccaggctggagtgcagtgttgtgatctcagctcactgcaacctccaccacccaggctcaagtgatcctcccacctcagcctcccaagtagctaggaccacaggtgtgtaccaccatgcctggctaatttttttttatttttggtagagacggggtttcaccgtgttgcccaggctggtcttgaactcctaagctcaagcaatttgcctgcctcagccccctaaagtgctgaaatgatgccctccctcccttcctcccttcttcctttcttcctttcctcctttcctcctttcctcccttcctcccttccttccatccttaccttctctgtctttctttcttttttctcttttctgataaatagccagtagagggatacctagatcatatggaatgtctggttttagtggtttttttttttttttgtagagacatcttcatactgtttttttttaatagtcactgtactaatttacattcccaccaacactgtataagagttcccttttctctgcatccttgccagcattttttttttttgtctttttaataatagccat

SEQ ID NO: 48649 - DNA, 1103 bp, Homo sapiens
taggaagtatatttacagacaaaagctccttaaaggcaaggttggcttagccttactttttttttttgagacggagtcttgctctgttgcccaggctggagtgcagtggcacgatctcggctcactgcaacctccgcctcctgggttctagtgattctcctgcctcagcctcctgagtaggtgtgtgccaccacgcccagctaatttttatattttaagtagagatggggtttcaccatgttggtcaggctggtctcaaattcctgacctctaatgatctgcccccactggcctcccaaagttttgagattacaggcctgagctgctgtgcccagccaataacgtcttttgaataaaagaaaagatattgttagggagtatgaacatcaccagaaaatgaaaatgtttcttaaaaataaacgaatttttaaaaattattttcttaaaatgaaaaatttttttcttctggactaaattgcaatgtggaaagagtcacatcagcctttggacagaactagggctgtgatttactacagggaagttagcatctttctgagttttcttaatgaacacgtgaataagagatttggttatactttgtgcttatttagcatcctctctttgaggatgtcaaaaggattttagaaatgttctctttctcacacaggtggacgtctgatttatgaagctccccatccacctatctgagtacctgacttctcaggactgacacctacagcatcaggtatcttgcctttctttagtcttaaaagcggtaactaagttccttgaggagatataggcagggaacacattaacttcgttacgtttcatataggcctgggaaccggagttgctgctgtagtcctggttctaccattaaatgtgtgactctagtcccttttcttctctaagcctcaattttttcttctgcaaataggtggggttggacggggtgctatctaatcacttgacggtattatggtagtctacttttatccgaagcttcactttccacagtttcagttacctgcagtcaaacttggtccaaaaatattaaatgaaaaatttcagaaacaaacaattcacaagttgtaaattgc

SEQ ID NO: 48650 - DNA, 1545 bp, Homo sapiens
aacaggcatgagccattgtgcctagctgagactctgcatttttaacagacaactggtgggccacatgttctttgagaaacagtggatttggggactttagttattattattttccatctcacggtagcagcatttttcaaagttgggccaatttgaaatgactgttttatcaaactgtagacattttgttttcattataatgtgctctctaaacacctcatatccaaacattaagaacaagtgggcttcatcatattctggactggtcagaactagccagcaagggtactatattgtgttttaggtgtcatccttgaaggatagaataaatcagctgtcgtgttctcagtgaaaagtggaaagaagttttaaaggatctgcaaaatagaattatgagacagaggaaagaaagaaacagacaatctgatctctatcttcatcggccaggtaagatttgaagtgtttaaagaacgggattcagtttggttacaaaagagtagctgggtcccagggatgggtttttcagttaggataatctgaactacatttgagagagaatttctagcaaactgcctgtccaaggatctcatggctggccttggaaggtagtgagcttcccgttattggaagtgttccagcagacatagagaatagattctgcagtgactaaaggattggataagatgtagaactagacctcagaagttttcttccaatgatgagatgctataaattttatgaacaacatacttaaaatagctttaagacactctacacgaattcgaggctgaaataagactagttaaactataatcagtcaattgattattaaaaccaagcacagacttacacccactacatacacttatgctcacaaatgataaatgccaggatagtttggattgcctttgaagtttattatttgcaggtgtagaagctcttaagttttagtttgtagtgtttctaaaagtgaggcattctcttgaactgtctttgatgatttgatgttcatacattatgtctgctgtgaatttggaaagcactgcagaatcactttttcaaagatcagaggaatgtgggatagaataaattaagtttctggctaatatttggtattcttctttagggatatgctttcagagatctgtttctggaaggagaagggaagtcatgacattttatgtgaactcaactgggcaatgtgaggttttcctatcattagctaataatatacatttaaagtcacatggaagtgtgttgcctgtgatctgaatttttattcctaaataaattagagattaaaatctgtggtttccagttcaagggtagggtaccaaaaaaaattgtctgatgtgggtttttatgtcattaagaaaggcggcaacagctaagtattattggcttttcccttttcttggttgcactggtccttttcccttatcttgaaaggcggtagtaaatgttgactttttgcctctaattcacctcaatgattgtacattttaacatgttttaagataggtggttttagcccctaccttattt

SEQ ID NO: 48651 - DNA, 1031 bp, Homo sapiens
gaataggacccataaaaggcttcattgaaaggctgtgactggaaagatgagtagatatttgccaggcatagaatttggacaagggagggtattccaggaaaagccaagtgcatatgcaaagacagctgtgtggattagcattatatgttaggggatttctgagtagatccaaagtgctggggcttaacaagcaaggtgaattatagcctaagccagaagtacctgaaggactcagtttgccgtgcatgaggaggctggccttggggcaatggggaaccatgggaaggtttgaaacagatcattgccatactagatttctgttttaggaaggttattctccaaacacccaggagaaatagttgcaggtagaagggactagaatagctttttaaaaaaagttatttatgaaaacatctttatttttcctccatttcactgacctatataattttttatggtgagacgtttgaaatttactcttattttgaaatatacaatgcattattattgactctagccactctgctgtgcagtggatctcagaaagaagctattcctcttgtctgtctgaaactttgtgccctttgatcaacaactccctatctcccaccccactgttcttcatcccttgcctccagcctctggtgaccatcattctaccctctacttcttggttcaactttttaagattctacctataagttgagatcgtatagtactgagatatcttaagagggcttgagttaaggcagtaacagtgggtttggagggaagaaggtagatacgaaagacatttaggaggaagaattgatgcaacttggctattgaatagatatggtgggtgagggagggggaggagtgatagtgaatggatgacaataccgttgaatgagacgaagtaggagagagtaacaaggacatgggaagtgtatttatattagattgccagggctgccatgaagtcccacggactgggtggctgaaacaacaaaaatttattttctcacaattctggaggctggaagtcatag

SEQ ID NO: 48652 - DNA, 1103 bp, Homo sapiens
gaaataatgccttgactttggctgctttttcctcgtatatttttagtgctattgccaatttttgtctttgtgtgcaccttcttgagcattttaactggaaattgtgatgagttttattgggacatttagttcagtggctttcaaactttttagtcatgacccatagttagaaatgtttgtccatacatttgaatgagacattagttgtatatagtttactacacatagtaaactctgacattttcttttctattttttcctatgataatttgttcattttcattttaaaaagtactggttataactcatacattttgaaaacacttatctagtcatgaactgcagtttgaaagacactgatctagtctgttgctgtgctgtctaaaatcaggttcattcatttttcaacatccatttgttaaatacagtatcggttattttgctagtagctgggaatagagtgatgagtaaagcagtcgttatcactggtggcatgaagcatagagtctagtgggatggagcatatgaaccaaaaaaaaaaacatccaaatgtataaatactctgcatgataaattctgtgggggaaaagagcaaaagcgattaaatggggaacctcatctgactttgggggtgattcaggatttccctggggaactgacatttggttaggtctgcagatgagaatgtgttaactctgtgaaggactgagcaggggtgtgtgcgtgggattgcagagtcatggaagaaatagtaacagaagcaaaatagaaaaccggaagggaaagacaggtggaaggcaatcttctttgatgagttggcattttttgtgatacttagtaggccttcctgtttgtggcttttttttcttacttgacaaaagtcaaataggaatgtcaaggattttttgggggagatgggtgttggtgtttgttgaagtagttttgtattagagcaatatagtatattgctaaatagcagggttttttttttttttttttttttttgttgagacggagtcttgctgtgtcacccaggctggagtgcagtggcgcgatcttggctcactgcaagctctgcttgccgggcacgccattctcctgcc

SEQ ID NO: 48653 - DNA, 1081 bp, Homo sapiens
ttacgctcttagtctatatcaaatgttaacaccttgtcaaatgttacgctttttaagctttttgttttttaatattgggaatttcccttggtgctaagaatggtgctgaggcactcgaacctttgtgcttcgtgctattgaattcctgtacattagctttctaagcacatttctaatttgtacacttaatgccttcatcttgaccagcctaatcattcacacagctagtaatgctaaattattgtctcacaatgccccttatctttggtgtgcatgtgtacctatatttatttaaaagggttaataacagagcttgtaattgtggaatgttcgctggtgaacaaatggcagaaggactcacgcaagtttatatcatcggcctttgttttccagagctcccccaaacagattttgattcttttctccctagaaatagtgttacctgtcatacaagcaactgattggtagggtctactactgaattccttattcctggaattagttcacaagatgtatcgtcttaaatgtactgatatgtgaaaaggagatacccagagtgtggcaagttggaaatcagaatcatcaaagtagtatataattgtctttttggtgataaagagcagctgtttccttaatgaagtttgtgttgaatttataattccatgtgcctccctgtaatacagtctacctgcacagcaaaactgccaccgcattcccattgcttcccccttccatcttttactgcgtacttactaacaagacagaaaagaaaaaagatgtgcccttgttggtcttcgctctggtagcaactgcactgcgcgcacactgtctgcccttcatggggcatttctacctgctgctgccacaatatattcatgctgcttgttaagtccagggagttactttgacattggccttattgtaatgtacaaactattgttaaatggatgtatatgtaacagaattttgtattttatatgtgactttcacagaatcgtctgcagtatgtcccagctagctaagtgtctgatagatatttgaaaggaaaatcccatccatgcccaagaagatattaaatggc

SEQ ID NO: 48654 - DNA, 1051 bp, Homo sapiens
tctttttcttctaatggtctatcagtgggtggggtgggggggaactgttagcattttctccagtggtgtatctgttactgacttcagaaggaggaccctcttcttttttctctctctctctcaaattgttttcacggattaagaatgtagaagatggaaacgtttttcctgcaaccttgtgtatttgctctttctacttctctatctttgcttagcaattaaaacacctctcttagggctccatcaaacagaacttttagactgagtaacgctaaacatctcctaatcccttttttccttgttgagataaaagagctaggcacttagtcgtattaccgaattctcagtttgccagatatgtactaatatagtccagatgaggaaaataaggctgaaggcaagctaaacttgcctgaagccacattgctaggaagtgacagaaccttgtaaacaagatttaagatttgatatactttcttattttctaaaaatttcaatgtgcatgtagttctcagatgctttcctcgaagaaaagggagtgtcatctatttatctgaccttgcaattatgacatttcttagaagttttttttttttaactgaccgtatcttatgaaatggtcttgcgatggtgttgttgaaatgacttttttgctgcagtgtgccttgccctgataattccttcttcctactatgcttcagtgtaattatttctcttactcccactgatactgggggaaggagaggaaactccctgatgtgcctctacgctactgtcaagaattaggttttgagacacatattgacagtatgtaatgataattatatactgatctgttatcaagaggttgctttgcatttatttgggggataggatatttttaaatttttttcttgcttgttctataaggattctttggggttttttctttttgctttgttttttgttttttttgtttttgttttttttttttcatgcagaatctaaacagtgggaatgtttgacatctgaatgcagagtgctcctaattgagtctttagctactatggag

SEQ ID NO: 48655 - DNA, 1044 bp, Homo sapiens
tgagcaaggagagctttacatttttaattaagagtgtgattttatgtggccttagagtattttagagtagttttctaaatgtgtttttcaccttgtcgcatattaattgatgatgcccatttgtgtgatacgttcctgtgggcacccaagttcgtaaagttctactattgtgagaataagtcacaacaccaacacactttctctccctttgagagagtggtgtgttttaacagttgagagtcactgcttttagactgttggtcactgactttttttcaggtttagaaaaatcagttaatttttcttgtcacttaaaagttgttttaattttgctttcctaggatcctttggtggcattcgattatacctgcaggagttaattactattacccagaaggctttgcagtctcagtcctggaaaatgaaagcccagggtgcaattgccatggcatcaattgcaaaacagactagctctctagtacctccatatctcggaatgatactgaccgcattgctgcaaggcctggctggaagaacgtgggcaggaaaggtaaaggaaccattcatacccagttaaagggattctgacttcatctttcattttgcataatagtaacgatctggttttgtgtaacttttccaatggattatttttgtgaactagatttcctagacagtggaagctttgggtaaaccttgcctgattaactgtggtatttcctctcaaactgcaacccgtgtggccttgcataatggacagtaatgctggagatagatacattttccatattcagccttccaagttacgtcttaaaccaacttgtcagcattttgtacctgttgacctcatgaacagatcaggattgggcatagaaagatcaggattgggcatatgtgaaatagagtagcaaggtagcctgcctctaaacctggggctgaagatgcccatctctgggacctatgaattagtaacagttatttttttacacaagagctttagtaggattcttaacagtgaacactcagtggggaacatgagattgt

SEQ ID NO: 48656 - DNA, 1027 bp, Homo sapiens
tgaataccatttagttatattcattagtaatagaaaacatgttaattgcattttcaaaaataaaggccagcaatttataggaaaagtcatctaagaagttgactcattagagggggtttggtagggtaggcccactgtagaagatcaatatttagtttaggttttttatactaaacatggattgataaagaggaagtaggcccagaaagattcttcattcttgagtaatcattatttttcttttttagcaaattgatgtttttcatttttttgtttgtttttagtgttgaatcactgatgaataatttttctgtttgtagtacaatagtggttttaatattgaaatcagagcagaagcaagcagtgatttttcaacttcatgtcaaatccagttggtacacgtttgacaagggcagtttttaattgaagatgtggtcctgacttatttgccaaggcttacctttatatttgtcctttttcaaaagtgcctgcaataccttgatgtgtcagtgctgggcgagctagttcctaggttgtgtgaactgatcagaagtggtgtaggtcttggaactaaggtaagtgtactttccacaagaggaaatgtgcatcttcattagttctggccataaggatataacagccatcatgtttgaaattcatgttttaccacaaaatctaatattatacactaaccattttatttctgtggttgcactgataactgaaaacatgtaactggttcaagaaataaaacatctaactgttccagtaagtattaacttatttagtggaatcatttctgttctctggttgccgtgtacataccctctgggttgtcattcattagcagttcatggaaatgcacatccagttattagggcatggattgttttaggtggcaattgcatttttcacagaggggtcagcagtgtttgaatagaaaaatgtcctagttttcaagatctttgaaggatcagacacccccctaccacccttttaacaacaaattaataactcacattttttc

SEQ ID NO: 48657 - DNA, 1029 bp, Homo sapiens
aaattgttgagtgtaggtcaaaagaaattagagttagacttgatgtttgcctttgttatagctacggattatttttttttaaagttctttagcttggaagtgaaagtcttttatgggtgtttgtgcggattattcctaattaattgaatgtgccgggtgactttaatttctcttctttaggctgcgatggatagtgctcggcttagtgctgccaaatcttctccaatgatggaaacaatcaacatggtgagtgtcttaaataataatgagagggtttgtttgcttacctgaaagtgtaattcttcaaagtcttcaggctatgttaaatgaagcagagacttatgggatgagtcaagcagctgttgtgactccagttttttcttagtatatttctcttttcttctctgttactaagtggaataaataattccccaaataccagaaacagttggtccaaatttgtattacaagagacaacaacatatcaagagctctctataaatttacatctgtagtcttttgatctgcctatttagaaaggttcagagttgtgcctgtgcctaatagttatctttgggaggaactaggaaagttataagctgtggaggtatttaatgaagtaggtaacataaaggtatgtgaagagattgggcaatgtcgatatgttgttttagtcataggaaggcatttgcagtaaagggctgcttggcattctgaggttctgatttctaaacttcctggagtcttggtaaagttactctgttgtgcattccctgtaatggttagttagctatgattgtgtttactggaaattagtttgctaagcagatctgtacctttagcaggactctgaaggtatagatccaacccctaaaaaaactgaagtgtacaaaaaactatgttaaactggtgaagagaagtagctattttttagtgcctgctgggggagtattaccaaaatttggtctaagaatgttatgtcttagttggattattggggggaaataaaaatttaaagaaataggaata

SEQ ID NO: 48658 - DNA, 1013 bp, Homo sapiens
aaaatgaccacaaaggatttagaatatttcataaacttagttgataaagcaacaacagggttggagaggattgactctaactttgaaagacgttctaatgtgggcaaaatgctatcaaactgcatctcatgctacaaagaattattttgtgaaaggaggagttgattgatgcagcgaacttcattgttgacttattttaagaaattacgacagccacgccagcattcagcaaacaccaccctgattagtcagtaggcatcaccattgaggtaggaccctccaccagcaaaaagataatgactcgctgaaagctgagatgatcagtagcattaagatattttaaagttaactaatgtactttattttagacataatgctattgcacacttaatagactacaatatagtgtaaacaaaacttctatatgcactggtaaactagaaaattcatgtggctttctttattatggtggtctggaacagaacctgcagtatccccaaggtattcttgtatgatcttatgggactactgctggacattgtggtctgttgttgttgactgaaatgtctcatgcagcacatgactgtaatacagtggcaggggggaatagcggctgtatgtatggaggaggtataaatgaaacaaaattggtcaaatgttgctaattgttgaactgggtggagaatacatggaatttcatgcctactataaattcctaccataaaatttcactataaatataaattcctactataaataaatacatggaacttcattcctactattaatgaaggtaggcttttcctacttcatttatcattctacctacctctatatatgcttcaaggtttctttaataaaagttaaaaaaagtaatgcccagaccaggctctgcaaccatgtgaaaatatgctttaatgcagtgaactgcagaacatcctcatggttagatttgtaggtcttctcacttttgttaaaaggactcaggagttgtgttccatatgtttgtagca

SEQ ID NO: 48659 - DNA, 1087 bp, Homo sapiens
gtaaaggaaatgttcttaaacgaagtttaaagtgctatgttagccaacacacaaatgataagaaagcaaaacagccttttgctaacagggagaaagtttgaatattctggatagaagatcaaatcagccacaaaattcccttcagccaaagcctaatccagagcaaggccctaactctcttcaattctgtgaagtctaagagaagtaaggaagctgcagaagaaaagttggaagctagcagaggttggctcatgaggtttaaggaaagaagctgtcttcataacataaagatgcaaggtgaagcagcagttgctgatacagaagctgcagcaggttatccagaagatctagctaagatcactgataaaggtgtctacactcaacaacagattttcaatggagatgaaatagccttttgttggcaaaagataccatgtaggattttcctagctagagagaagtcagtgcccggctgcaacgcttcaaaggccaggctgactgtcttgttaggggccaatgcagctggtgactaagttgaagccagtgctcatttaccattctgaaaatcctaaagccttaagaattctgctaaatctgctctgtgctctagaaatggaacaacaaagtctggatgacagcttatctgttaacagcatggtttactgagtattttaagtccactgttgaggcctactgctaaaaaaacaaaaacaaaaaacaaacaaacaaaaaaataacaacaaaacaaaaaccaaaccaaaaaaaaccccaaagattcctttcaaagtattactgctcattgacagtgtgcctggtcacccaaaagctctgatagagaggtacaaggaaatgaatgttttcatggctgttagcataacacaacatccattctgaagcccatggatcaaggtgtaatttcaactttcaagtcttactattcaagaagtatattttgtaaggctagagctgccattgatagtgattcctttgatggatctgggcaaagtaaattgaaaaccttctggaaagggcttaccattgtaggtgctgttaagaacattcatgattcatgggaggaggtcaaaat

SEQ ID NO: 48660 - DNA, 1036 bp, Homo sapiens
cttaatgtgtctgtgaagttgcaaggttgggtatccttagatctaaattaaatagacttagggaaaaaaaaggtggctgtataccttctttcaatagagatctcatgattctattggattagggacaaataacagttttggacatagtaacagtattttgatcagttctgtaaatgggattaattattctcaagtaatgtggccaattcctctgaatttttcttgggcaatcttaattttaggtattttggtattttaccattaaaattaggcacttcagttttacctttctttttgctttatttattggaggcttttaagtgtttcagaattctcacatagatctttatgtatttacttttataatacatttagtttctcaactgttaatagctaaattttttaaggtcaaaataggttacagttaatgtttaaaaattaatagtatggcatggtaatgtgttccttgatgggcagagagtctgatgagataccaatttttttaacatgatatgaaatgtaagattttccaccaaatctctgtagggcctgaggcaattaaattgcaaattgtagagtagatgatagtgaaactctctaacttgtatgatgtcacacttttgtcatttttaggaatctgtacgaaaagcggcagaactagctctgaaaactctgagcaaggtgaaaaccccgtcttacattgggaatggagtggagcagggttctgggtgaccatgacaatgatttacttactgtcataggaaaagacatttagttgcagtataattggcttcatgttgtagttcactgctcttagaatgaatgagaaagtgagtgctgtaaacactgcagtactagtgtgttgaacagagtatactgtggtctctttaaatggtgaaattaagataaaacttcgacttaaccctgaagagcacatcactcagatcaagcaacacctgtcttttctcttgcttttgctgtgtttatatataaagctacctttcatatttgtgaggttggaaagctttttgaaact

SEQ ID NO: 48661 - DNA, 1027 bp, Homo sapiens
tcattgttggttacagtgtaccaatcttgctgtgagtagaatgaacagcatttgagaagccagttagggcccaggtcttagccgtcttaacatctctacataatatcctgggcatgttatgggaatctagtaaggacttgttggttttataattgtagatgcccagatagcagaactgctggcagctagagttgtggttacaggaattaaaagaagggattctgactctgagaactggagtaatgtgatcaatgaggagttatgaagggacaaggggcggaggggaattgaccatgtcatgtactgccaatagatcgactaaagtgagaattgagaaaccatcattggacttagcaacaggaaagtcattcgtgatttctatgactaatttctatggagaagagaaggtaaaaggctgatttggagtgggctcaaaaaagagaagagcaaagtttgaacatgagtttaaacaactattttgaagggtcttaatgtaaatcattggtttgtcactggaggaatgagatttttccccctagacacttggtaatgtctagacactggggagggtgggtgccactggtctctagtgggtgaaggcacaggatgctgctagacatcctgcagtgtatagcacagctttgtatgataaagaattatccagccacaatgtcggtagtgttgaggttgagaaaccctggagtaataaaggaaaggagaaaaacagtatggtagctggaggaggaaagtaagtgcaaaataagtttgttagtttttagatggaagatgagaaacatctagtagacaaaaattgctgacactagagagattagggataagttttcattctcaggaactaaaaagttactcgagtacctttgaaatgtaattttgtttacactaggttctagagtggataattattgattccttcagcaactttaaacaccttagccatttagatttttatataggattgttctgttgagtaaatgttgatttgaatttaattttttcaggaaactat

SEQ ID NO: 48662 - DNA, 1050 bp, Homo sapiens
atcaagaaacgaataatgtttcatgacacaaacattgtcgtgtccatgttttactggaacccagccacgctcattcattgtgtattgtctgttgctgcctttgtactgcagtggcagagtggagtagttgcagcagagaccaaatggcccataaagcctttttgtttttttacagaagtttgctgacccttgttttagatcatctgtgaataaatttcacctgttttgtacttgtgtatctttgacgaaaatggacctaagattttgttatctaattcattcagctttcattttgttttcaaataatggcttgtttttttctcaatatccatcaacagattgaacgttcttttaattttaaaagatgttgtcatcaggcacgtggttctgtgtcatgtatatatttgttttttttttatactgctcagagtctgatgaataacagtaaagaagaaatgcgcgaactggcagcgttgttttattctgtagtggtatcaacagtgtcggggaatgagttgaaatcaatgatagaacagcttataaagactacaaaagacaatcacgtatgttattttgttttcattcttttttgtgggagatagggttttataaaaggatctaacttatttttgacttttatgttctcatttgtaaaatgaacttacaaattccttgcttttatgaccataaagagtaaatgagataggtgatacattggttcagtcagctcacttaacagatacgggtgctgtgtctgataagcactgttttaggtgctaggagtacagtgattcataaatacatgagaatccctggtacaacaggatgctcagagcctgcagccgtaccaccgtgaacacacctaatctcatctgatcttggaaactaagcagggtcgggcctgatgagtactgaaagcgagaaatgttagctccttttttcttcctcatctactgctgccagtgaaaaaacaagttttacttcacatagtttgttggttaccttgtgtttggaggttttggcaattagaaataggatctgtttattgtc

SEQ ID NO: 48663 - DNA, 1015 bp, Homo sapiens
cttttagtgtgtgagggacatgcacgatcagcatggttaataggaaagtggaaaatgtttgatcagaaaaagaagcaaacttaggacatgtagctagaaacacagttgtttttgagttgaggaagggcaggtatgcttcatttttcagtaattgtgtctgttttggactttttaaacttaggcttctcatcgaatgaaaactccagtcaagtacatgaccgggaccactgtccttccatttaacccagcagcctttggagaggtagaactttcatatatttctatttactttttgtaagtgttctaaaaagatcacaccacacccaaagaggggtctgtcattttgttgtgttttaggtaaacccatattgtggtgtcattgttcttcatcgggttgtttatttaaaaaaaaagtattgggaaattggtattattttaattcatagtgaagtatgtaaatatatttatctcagtgagattctttttgtgaaaaaactggatgttctgtagtgattactattgggattttgcagcaagttagatttgggttttaaagccaacctgttgttgaggttgttagggttatttagttttgaaggttggagaggattaaattgatcacacttattaagggaaattctgttttttagattattgacttgctctaggtaaattacaagaggtgatcttgttcggattaagaatattcacagtgaatttgctgcctatcctattttaacgatcaatgaaaaagcttccagaggatggactccttggcagcctgtttatgtaagggttgttttttttgtttgtttggttttttttttttttgagaaggagtctcactctgttgcccgtgctggagtacagtgaatggcgtgatctcggttcattgcaaccttgcctcctgggctcaagtgaacctccgtcccagtctcctgagtagccatgactacaggcgtgcaccaccacccctggctaattctgttatctttttggtagagatgggtttcac

SEQ ID NO: 48664 - DNA, 1032 bp, Homo sapiens
tttcacttatgtttgtggctagaggagtgacctggggaaggtacgtaagaataaagcttcaggatcagtagattctaaaactacttttctggttgaactttgtagttacagattattaatcttagttaattgaatatatttctgtagttgaaactgctttgagctaatctgagaagctcaatttgaagtatttagcttcaaattggtggggattccaagtaggctctgtttgtaatttctgccaaatacctgactttcactcatgtgactgacagtttgagagttggggtggcggaggtgatggctagaaactgtcacagtgaccgtggtcccaaggtttgggctgaggatgcgcagagattctctagttatggtccttggaggtcttcctacttcacctggaggatcctctaaaattataagaatactctttaagtaatgccaccatccaaaagacttaaacaacatgattaaagatcttgaacaaatgatttatttaatttagatacacgtttattaaaatgtcaccttagaattttgaattgtttacagttaggaagactcatcttgattggaatgaatggctggtaattgattttttttttcctttttcggatcggggtggtctgtgtatgtttacacatgaaatagcctgaagttcaagttcgacaagtggctgtgaaatttgccagtacggtgtttccctcagatcatatcccttccagatatttgctgctactggctgcaggagatccgtaagtttcaaaaggtgttaatttgaattttggtttattttgaatttatttgaaaattactaaaagttgtattgtttacaatgttggtctatgaaatttagaagctatttattaaagaaagtatggctcttgatgtgatatagacctgtactcatatacctatatatttatatagtaatataaatattacatgtatatatctatataatatacattatgtagatatatatgtgtaatatatgatatatagctaatacagaaaatggttatgaaatgg

SEQ ID NO: 48665 - DNA, 1030 bp, Homo sapiens
gcagctttttgaagccctttgcaaggtagggaaacagctgctaagtttatgctttgtgtttggatgttcccctgggaacccaacaaggagggaaacatttttatcatctttataggaagagcctgagactcgacttgctattcaagaagctttatctatgatggttggagcgtatagtactttggaaggggcacagcgaactctcatggaggcacttgtggcttcgtacttaataaaggtaggtccgtgtgaactacaaagcctgggtagtatacggtttacatttttaagaacaaaatttgaattgctacttaacttttgataagaggagtatttgctttcacttgggctgtgatttaggatctatttttaattcttcatgatgaaaatttgactttaggggagaaggagtggtagtattcatagcgatgcttatgtttagagctttccatgtgggaaaactattcttaatgccatgtcctccgagttagaagtgttttgtctttgtaactggtagctgagcactactgtccgctggggtagagtttgataggtaacattttcagagaaaagcagaagggatgaaagacaaattccatatgtcaaagtgagtctttaggaagtgagccagtactatcatacatgctcttcttcctctttatttggttttcatgggaatttgtaggaggattttgaatatctgtagatacacacacacacacacacacacacacacacacacacacacatatatgtaatatgtaatatatatttgctttagtcagttctttgtcccacatttttaggagtagaaagggagattggaagacagaatgatactaaaaagtgtcagtcagattaatataaattgtgtcctaatggaattagactgacatgatttaatattttgagggaattttaaatgttcagaaaggtatctgcttcctattaaaatatgacagggttaaatgtgctattatatacattcagaaagcttactatgatggagtcctattgtcaagtgctctta

SEQ ID NO: 48666 - DNA, 1028 bp, Homo sapiens
aatgttttttagtgtgttgaagatgaactttggtgtttggaggttacatagtgttgaaatatcttgaactcagcaccagctaagagaaacctttcatatctatgaccactgcattttctttttggagcgattggggatgcaaggttttgtcttgtttttccttttagttagtgtgatggattctgggtttggacatttttgttgttgttcaggtgctaacaccatgtagttagacagagtgagacctaggtttaataaggagtaaaataatgcatgtaattgcagcgaaaaggttttactgtttactgtattttttgttttgtctgttttttgttctttcttttctttcttttctttttttaatttcaaggaccctaaactactgtcaatggcatattcagctgttggaaaactctccaggtgagtaaactcttttttagtgagagatatggtgttggtaaacagagaaaaattatgtggcatttaataatggcggagaataaatttgtcgtgattctgaaagggaatgtatttaatggtcataggttgtttagaaatgtcttctgtgtagaaggaaaaagatgtgagacattttaatttacatttgaaggtatgttactgtattaaatggtggtcttgaaatgagagtttgaacttaattgtgtcataatgggttactttttttgtaccctagagacttttgattgaccttaagtgtttttgttgctacttggcactaatctttataaacccagtgatcaaggtttttctagtgattctcttttctgagaatggtgtttatgattctgagtggccctgacagatttttttttcttctcaatgtgatttcctcattccagttcctcctggcttcatcttccttcactgtatttgaaagcagggagatagagatgaagcattctcagtggcaccatgtgctgcttccacgcccagtgcaggttttgtgttggcctgtgtagaccaggtcttgctcttctctacagtgaaaggagctttggggtttggaa

SEQ ID NO: 48667 - DNA, 1964 bp, Homo sapiens
gtgattattaacctatttttaaagttttaagaaaaaattttattgatacataattataccatatttatgggggtacatgtgatattttgatacatgcatgtaatatgtaatcaaataatttagtatttaggatactcatcacctaattatttatttttcctttgggttgggaacattttagatcttctagctcttttgaaatatacatgattattaacctgttttatcagttggtctgtttgtcctttccctctctgcctttctttccttctctcactttctcgttatcaaactgtcaacactggtgtcttcaaggggctgtgaaaggacaagggaaaagggatgctttagattttccacttgatttattattataaatgtatctttctattataactttaaaaagcaatgcagaataaagtaataaggataaatgtaatcattttgaacttaatatatttaatatatttaatttatactaataaaatagcatttttatttgtgcatgtcaaattggttaagttggaaaacttttggaataggggaaatggaatcaaacagctaaaatagcctgttatatattaagcattgtgctaaactctttgacttatcttttcatttaatctttacagtagcctttgaaatgttatctgaattccacaagttatttttaaatctttcttggtttatggaggattccagacaagatataaccatatttaggaaattcgccgatatttaacatgacaataatgctactagaaaattaagtaattaatccatttaaaattcaaaataggccgagtgcagtagtagctcatgcctgtaatctcagcactctgggaggctgaggttggaagatcttttgagaccagcctaggcaacatagcaagatctcatttatgccaaaaagaaagaaaaaaaccatgcatggtagcatgtgcttatagtcccagctactgcagtgactgagataggaagattgcttgagactaggagttcgaggctgcagttggctatgataatgccactgaactccaccctgagtgacagagtgagaccctgtctcggaaaaaaaaaaaatcaaaataaatttattattaaaaaaaagcatgcaattgtgggcaagattctctgtctccatcgataataattttctatagagtccctctaggaatcagcctagattacaatgtcagaagagggctctttcctttagactagttcctcctgattgttttctcttgtcgcctagcggtatcacagatccaggacaggtaggaagctcggatgaagtatggatgacaatgcaagtttctagcttcttggaaggtatcatgtctcactgacaaacactttcgctgatgtgagttcaaatatcagtgtttgaaaaggttaaaaaaaatgggctctggagtcatattttgactttgctatttgctggcccagtatccttggacaagttacttgaggcttctgcttcctcatctgtaaaatgggaatgacaccacctcactggttgttgtgagaatcgtattagataaggaatgcctgggggaagagtgcatagaaactgtgataaatattagctattttaatattactatttatcattcattcaacaaacattgattacagagttgttattattcttaaacataattcacctatttcattattgctgtagatctcttggaattttttgctgtcggtgtcaaacatctctacagctttctttatgcatgctttgaggctagagcacgaatttcagaaatgagggagaatagtgtaaacctggccctgcagaatatttatcttaaattcttgagtctttcttaggcaaggccttctaaaaatcttatttctcaatgctcgatttcttttctgttggcagaaatctttttattgtagtataattgaggccatttgatatgagcctctgtacatccctttctatccatgca

SEQ ID NO: 48668 - DNA, 1068 bp, Homo sapiens
cctggctaatgtttaaattttttgtggagacagggtttcgctttgttgctcaggctggtctcaaactcctgagctcaagcaatccacctgcctcggcctcccaaagtgctgggattacaggcatgagccactgtgcctggccagtattttcattttttaacgaaactgttctacatggaacatttcccccttgatttgtagaatatttcattagtcttccagtatatttataataggtcatccagtctttgagctatggtcaggttttattccttgggccacagtaattggcagtgacttcctggaggtctgccctgagagggattccaaggtctgatttgggttcagtgcagaaagagaatctttaggaatgtcttttatgtttatatctctttacaggagggaatgggcattcttgtcatatatttggcatgtctgcagttaatccttctttgctgagatagacgtgcatttgattatgtcactcttctatttaaaacccttctgtggccttctcttactattaggatagcaaggtctaagaggcccttcgtgagttgatttctgtatacttcttagccttatcagttttgttatttagcaaatatttactgagtgccttctatatgccaggtcttggggatatggtgatgaatgatgacaacacctagttggggaaatcagtataaaacagtcaggcaaatagtacatagttgaaatttgtgatacatgccaagatggaaaaggaaatatattcttatgaaagaatatatttgggatataatttagactaagtgtggggtataaggggaggcctctgtggtgtgcaggaagtagccaggccaagaggtgggggagaccattgaagatagaccctgtgcaggtgttctgagctgggacagagtgtgatgccttcaggaaattggagaaggccacagtgatgtccccagtgcatgagacgaagcctgataggaggaaagaggtattccaggggcactgatttgaaagggtattgatggtagtgcctccatcactctagctgttggctggagaaagacttggagtagg

SEQ ID NO: 48669 - DNA, 1038 bp, Homo sapiens
cgcttcaggctcatcttgtttttgacctgccccaatccctaaactcagacctttttccaaggagcttggttccttttcctggagaatggtattgaaaaacaagatcaattctgggtgttaggtatgcttgttgctactaggatgtcattgcttctgcccctctcaggattgatcgatcaatctgttgatctgtctgtctgtctatccatgtatctatctacgtctctgtcattgatccatctattgagtgatctatgtctatctaatctatcttcctgtagaaaattattgtggaaaatttctggcaaacacaatagtaattctcagtatctgttatgaagcttgaataattatcaattagtggcaattttggttttacttacataacccctccccagtgtctcctcattatttaaagaaaattctactagctgttatttcgcctgcaaatatttccatctttatctctaaaaaaagattcctttaaatatatattttaaattgaagtatagtagatacagtagaaggtatgaaagtgtagagtttgatgaatttttataaatgtatttatctctataatcacgcagatcgaaatatagaacatttttagctctttagaaaactccctaattcccatgacagtttttgtagggacctttaaaaaacaaacctaaccacaataccattatagtacctaaaacaattttaacagtaattccttaaaatcaaatatctagttgtttgcataggctcccctttcattcccatcttcctgcttgccgctgcagtgtactggttgaagaagttaccttgtctaaagtttatcacagtctgggttttgctgagagtatccccatggtgtcacttaacatatgtctctcatagtggctttcttggggaaacttggctatttttctaactaggtaaccctaatacagtaatgggcagtgatcctgtctttggagaaacttcatcagtaagatgatttcaccagggatagatatattgtccctaataactgatggtatctgattaaag

SEQ ID NO: 48670 - DNA, 1042 bp, Homo sapiens
tgttcagcagaaagattatttgttgaatgaatgggttgaattattgagcccccatgttgttcagggagactgctttgagtagtggctaaaacctctggaactggaatcagagacagttttgaatcctgattctgatacttcttaatgtgttcttgaacaagggacctaacttgtaggcctcggttttctcatctgtaaaatgagataataaaacttacaagatttttttcttttcttttcttttttattgagacagggtctctctctgtcacccaggctgaagtacagtggtgtgatttcggctcactgcagccacaatttcctggtctcaatccatcttctgacctcagcctcctgagtagctgggactgcaggcgggtaccaccatccctggctaatttttgtattttctgtagagacggggtttggctatgttgcccaggctggtctcaaattcctgtactcaagcaatctgccctcctcggcctctcagagtgctgggattacaggcgtgagccaccgtgcctggccaggattgttttaagaatgggaagagatagcacatcttggcacatggattgcgggtgtgtgggaaccttggttctgaagctagggagacagtgtgggaatgattcccatggtagagctgtgggaatgggcatattgttcacagtcagctgactgggagccacgtgtatacgtatttaagagcgagaggaagataatcagagaaaggagatgaagagtgctaagagaggtcagcggtggccggggttatgtctgtcagccatttgcgttctcatatgtaatgtgctaaaaacatgtatacatgtttagtaacacttcttataaaactattatgtaattgaaacacttctaattaatgtaacagtttatatatttatgatatatatacacacatatacatatatgataaaatatgttgcattggtattagagattttaagtcttcagcaaatgattatcagtgtattttttgaagtattagcatgttctcagtaaatttggtttgtggacatag

SEQ ID NO: 48671 - DNA, 1049 bp, Homo sapiens
ataccattgagcatgaagttgccagaaggctgggtgcggtgactcaagtttgtaatcccagcgctttgggaggtcgaggtggtcagatcacttgagtccaggagttcgagaccagcctgggcaacatggtgaaaccctgttactacaaaaaatataaaaattagctgggtgtgttggcatgcgcctgtagtcccagctacttgggaggctgagtggggaggatggcttgcacccaggaagtcaagactgcagtgagctgagatcacaccactgcactctagcctgggtgacaaagcgagaccttgtttcaaaaaaaaaaaaaaaaaagttgccaaaaataggcaggttaattttggggtgagacttgttattgttagcatttgttatcctttcacaaacctcatgtttgagtcagtgattataatagaagaatagtaaagctgtttatttattgtgtgtttaccgtgtgttctaattgttttgcatgtatcaactaattgaatcctcagaacaaccctgtgagtttggtactggtactgtctcaggggtagagctaccctcattagacagttaggacttgaacttagattctctgattgcaaaatttgtattaattctgccctactactactgtgttattcctgtcctgcatgggagaatatatagttcataacaagatcaaaatggctttttgtgtgtgtgtgtgtgtctaactagtatccagagagaaccttctgtagtgtataaaatgtggcaatcggggccaggcgcagtatccagaaagaaccttctgtagtgtataagatgtggcaatcagggctggagcggtgcctcacacctgtaatcccagcactctgggaggccgaggctgggggataagttgagagcaggagttcaagaccagcctggccaacatgatgaaacccccgtctctactaaaaatacaaaaaaattagccgggtgttgggacgtgcacctgtagtcccagcttcttgggaggctgaggcaggagaattgcttgaacctgggaactggaggatgcagtgagc

SEQ ID NO: 48672 - DNA, 1039 bp, Homo sapiens
ttgtgggaagtgtagttccggggcgccgcggacccacgctggggtcataaataccgaagtttcataggacataggacatgtgagataatttctgattgcgttttgagtgttctcccccccaagggttttctttctttccctttttttttttctcccaatgctgcccttcagtttatggcaaaaacaagaaaggtgttatttgaagatgatgtgggttttaaatggaataaagcatgggtgaggtgttgcaagctttatgaagcttacgttgttaaagccgcttctgaatttccatatgaaagtagttatacacgtaatgtatgtttttctggtgcttgtcagtttaaagccacttttatatacatgatctcacttttgccctcatagcaaccttgtgaggcagataggtaggaattatccttgttttaaagaggaggcaggtttggagagattaagttccttgctgctttgacacagaactggtggagcaggagtactgtttgctttttttgaagctgaagtaaacacttggtgtgatcctgagcagattggagagtcggaggagacaaggtctcatggtgcgattagagagagaagcgggctacagattgctcttctgtcggttccacgtggaagcaccaccaggccttctgagatcagttccatgttttgttttaattggaagaaaagtacacataccataaaatttcccgtcctagccattttttaagtgtacagttcagtgggattgagtacattcacactgttgtgtaatcatcaccaccatccatttccagaactcttcgtcttgtaaaacggaaacttgatacccattaaacaacaaatcctcattccctcctcccttcggcccctggcgaccatcattgtactttctgtccctgtgattttgagtattcttcctacctcgtgtgaatggaatcatacagaatttgtgactggttttatctttatttagcataatgtcctcaaggttcatccatgttgttgcgtgtgtcagaatttcttttccttttaaagg

SEQ ID NO: 48673 - DNA, 1034 bp, Homo sapiens
tttcatggctaggatgtgattcgttggtctgcttagcaataactatgcggaccaatttatcacacggcaatatttaaactgcaggcttggggttggggaggcaccaaaaaccttctcccagaggtagcatttcacacctacatacattagtcacagtaaatgttcctgagtctaagattagcattaaggatcgctttacttccataagtgaagagttttctggtttagctctctttttataggaggtgcccacaatttcaactttaggaacttatttctagaccactgttgagtccatggggttcctccagaaccctatgacctgaagccaaaacctcactcattcagggccttaagttcctttttcagttggaaattattattcagactccaccaatgaaatttataaggaataatccaccaatacccgtatattccattcctctgaggtctaatttcacaaaagaaaacttaactgaaaattttttctgtatcaattctacattcattccctgaactttacttgctatcagtgcagtctctttagattttagggtatctattctccaaatggtaggggttataatagaacattcatacagtgggaaagtcaggtgacatacatgagagaactagctaagtcagaaagttgattccccatcaaaaggtggcagctgctacccaggaccagctgagtgctttacataaataaaagcccagtgttgttagcccttataattttttttaagacaagctttgtttttagtatgaaatgccctaattttagatagtggcaacaatgtatacacacacacacacacacacacacatgcacacacacccaagcaaattgttataacagcttttaactgttgccacacagaatgtttacactccaattgcaaaaaaatgtacttgctacaggcaaaattgttttaaagtagaatttttgcaaaccaaaatccatccagaatagctctgtcttcagcacatttccttacccccagcccccatctattttcctaggactgtta

SEQ ID NO: 48674 - DNA, 1026 bp, Homo sapiens
aatttttttttttttttaatttttagaagagacgggggtttcactatgttggccaggctggtctcgaactcctgaccttgtgatctgcccgccttggcctcccaaaatgctgggattacaggtgtgagccaccgcgccacccccaaacttcttaatcatatctgcaaagtcctttttgccatgtaaggaacaggttctggggtttttggatatgaacatgtttggggccattattctgcctggctgcagagtgcatgttgattggccagcagtcccgtggatcagaaaggagtgaggaaatggaaggggagaagcaccaaaaaactcccagcaccaagcacagtgacagtgacctgtactgcttgtttcaccatgggcacctccctggatcctgccacccaaatgtgcccttctcttcacaggcccacccccagagattgttatctatcaggagcttcgcatggaagcttttgtcgtctaccgctggcaaggagatgcccgccaaaaagctctgaaggacttgctgaaatgggtcttagaggtaaggagctccggagccaccccttccaattgtacactaggtcacactccctttgcctctcaaggcttttgttctaccaattcttccccatctctgccgcatcgtcagtttttccctattgggtcattgtgcttagagtataaatattcttacttttcccatctttgaaaggaaaacaaaacaaccctctctaaagttcatttccactgcaaatgcaggtccatttcccttctctcccttttataacaaaatacctggaagtgctgtctacactcactgtctgccattcctctctttccattcttccttaaacccacatatgaggcttttcagagtctcactctgttgctcaggctggagtgcagtggcacaatctcagctcacggcaacctccgcctcctgggttccagcaattctcatgcctcagcctcccgagtagctaggactacaggtgtgtaccaccacgcccagctaactttttgtat

SEQ ID NO: 48675 - DNA, 1047 bp, Homo sapiens
acacagtaaatagaagtcactgtgctaattattatttttattattatttaccatttggagaacagaattggtgctttcaggaagtgaccatgcccgtgtatattcatgaaaaaatgtccacacccatggagcgtcctcaagctgtcacaaagtctgagagtagaaatagggcctttctaacttcctcttcagcatgtgatatttctatcagggaaggggttaaagataagtccagcaaggccccatcactcctcctgagcactagctctcttgagggagccaccataaagagaatggtgaagtttagtcttaatggacttactttctccaagattgagtaactgatgtgggatataacacatgagtgattcacttgggtttgtaaaaaaatattctacaagtgattcagaagaaaaataaacatggttctctggcatgagaccatggaaaggtagggtaaccaaaggatggtgaggctataaaaaatacaattcaaatttgccagttgtaaattttcttattaaggaattaatgaggaaagtctctaaagaagcttgtgtggcaacacttgtgagcactcttgattagattgactcagatttttagagtatatatgcaaagtagacaaaaagacatataaccaggaactgatctaccagcaagaatcattcctggagccaaacccaaattgtgctatgcagaataaataaagatcattttccaatactatgtctagagtaaggaatagttgtgcccaggtagatcctgctggtggatggtcaagtgaaagtcagcttccttaactcctacttagcttttgtcctcttcgtttgtgaggggatagttagaagaaagaaaagagcttgctaccctacataggttcaagtcttccaacatggatgtagcgtattctggcaggttcatacaattttcacatgagatggataaaccattgcaaatgatcttcaataaaccttgaagaaaatggagagatgtaagaggactagagatgagcaaagaacaaggaactttgtacaaaggaagaac

SEQ ID NO: 48676 - DNA, 1055 bp, Homo sapiens
caattcctatatttggttatctccatcgcgaattcaagaggatgtaggccagagactgcaatcagaaaaacaaagaagggtagagctggataagaacccagagatacaatgcagtcttctcttagagaggtctcattgacttgcccagcctgcacagaggagcaagggcaaacgtgtaactgacaccaaagactctaggggggtccagtcttaataattggagctaatgccacgctggactagactgatggtcactccaacctatcatggcatttgcaaaagcatctccaagagttatttggaggaggtgaggtagctgcctcctggaatgctgaattcaatgtttggggaagtattcccgacacagaacaactgctggagtcacttggtaagagctgggtatagcttgtgagcctcagccatttgcttcattgctcaagctgctctgcctccaacattcagcagtcaatgggggtataagaattagtcaccgcatgaaaaaccagtggatctgcatggggcatagtaagctattaattagctgatgcttgtagagcactttgaagaacaaacatgttatgtaactgctaattataattaccatcctcagcctgctacctttcacaaagtctgtggctccagctgcagctgtttccatgggtttatgcaagctttgatttaagaaaagaaaaggcattctccctgagagctgtgatctttctgtgaggaggcctttatgccctcaatcaggattggcagctaaattcaatttccgcagataaaggggatgatttacatgctgattaattcatggtacagtgcagatgatctctgggtgggtaggtaggagaggcttctggtaatgtagtgagagctgctgattaccatggctcttgctcagctacccctcttcttttttcttttccctgtttttcacttgttacctatttcttcactcccctcatcccaactgtctctgtgtattttgttgttgttgttggagatggagtctcactctgtcacccaggttgaagtgcagtgatcacagctcacca

SEQ ID NO: 48677 - DNA, 1061 bp, Homo sapiens
tggtacaaaaacagacacataggccaatggcacagaatagagaacccagaaataaagccacacacctactaccaaaggatcttcaacaaagttgacaaaaataaacaggggaaagggttccctattcaatagatggtgctaggataactgttgatccatatgcagtagaatgatactggatccctatatattaccgtatacaaaaattaactccagatggattaaaagcttaaatgtaagacctaaagcaaagaaaattctagaagaaaacctaggaaacacccttttggatatcaagctgaaaagcaattgcaacaaaaacaaaaattgacaagtgggaacctaattaaaagagcttctgcacagcaaaagaaactatcaagagtgaacagacaacttacagaatgagggaaaatatttgcaaactatccatctgacaaatatgtaatatctagtatctattaggaaatttaaaaattcaacaagcaaaaaaccccattaaaaagtgggtgaagggcatgaacagacacttcttaaaagacatagaagtatccaacaaacacttgaaaaaatgctcaacatcactaatcatcagaggaatgcaaatcaaaaccacaatgagattccatctcacacgagtcagaatggctattaaaaagtcaaaaaataacagacgctggtgaggcttcagagaaaagggaacacttatacactgttggtgggaaggtaaattagccactgtggagagcagtttggaggtttctcaaagaactgaaagtagaactaccatttgacccagcaatcccattatttggtatatatccaaaggaaaataaattgttctaccaaaaagacacaggcactcatgttcatcacagcactatacacaatagaaaaatcatggaatcaacctaggtgttcattaactgtggattggataaagaagatatggaatatatacaccatggaacactacacatccataaaaatgaaatcatgtcctctgcggtaaaatggatgcaactggaagccattatcctaagtgaattaacacagaagaa

SEQ ID NO: 48678 - DNA, 1031 bp, Homo sapiens
cctgggctcaagccttccttctgcctcaggctcccaagtaagtgggactacaggtatgtgcctggctaagttttttactttttacttttgtagaaactgggtctcactttgttccttaggctagtcttgaagtcttgggctcgagcgatcctcccttctcagattacagtaggaagcactgggattacaggggtgagccactgtgcccagccttctcaatttttttacccctatatttgttctaaggatatagacagggtaacaggaaaaactcaatatttcttttggaataaattgccctctaatcacttgataagcatctctatcattattctgtgcctaaaattagagaattatctgctcagtccttattcctgcagaatacaaatgtcacattctaacctgttaagagattgtcttcaaaataaaactgttattaactacattaatgttagacaaagtacactttagggcaaaaggcattattagggatagatttcataatgatagagttctatagtagaatatagtaatgcaactgaacaaaatgaagctcattccactgcatggaagaatctcacagatgtgatgctgaacaaaggaagccacgtacaaacactatataattttatgtacatcaagttcagaaacaggatagttacctttgggaaggaggtaactgaaagagtatgaggaggggtttctggtatctggttaatgtactttgtaccagttacccaggagtgtttcaaaaattattataattgagcaaggagctagcaaccaattcttttcttaagtcagcagattattctagccaataagtaaggccctcttataaagaacccaagataccatggactgagtttcaacatgaaactcttacatgtgcatatattgcattgtcctgaccacggcatatctacaggaaaaatatttcactgaccaaaaaaaaacaaacaaaaaaacatgttttcaagtaaattttacccttccgaacagttttacatccaactagattcagaaagatt

SEQ ID NO: 48679 - DNA, 1050 bp, Homo sapiens
ttcccttccacacaggcactattataattttcagtgccatgttaaattggattatttcatttactttaagttaggaattactgtgtaatttattaattcatgattctcataacattcagcataagtgtagcaaagttgctaataacggaaggggatcatagtggtgttgaatgtaactttgaagtagggaatggccttttaagtctgagagagaacatttgaatccttttcagggatttgtgtaggggtgtgtttgtgtgtgtgtgtgaatgtgtgtgtgtgtagataagtgtatatacataaatacactcttctaaagttgtatatacatatgcacattacatacattttaatttattgacaaaattaaccaaattaagatttggagatgtgggatgttcttgttttaaaatagcatgtttgaaaccatcagtttgtgtctaaaattagctgtagcacatggatgttgtccatattaagctatttgctgtttgaattatagaggtctacagtatttgtgttggcatagtttttgtaaaaaaaagattaaaaaatatcaggatggtggaaaaactagatctgtgtatctctgttttggcatgcatttattcagtatcttctagcaatggtttttctctgttgatctaccgtagtatcctatttttaagtttattttatttttaaggagtattgtcatcacttttcaaggtgtcttgacttctacacaaagtatatatattcaggactttaaaaaatagcagtacacatttaacagtagcgaattacaccaaaatgatttactttgagatttgaataatttgcatagcagtaaaatgtgttttgtgtaacatacaaatagaaaaatgacccagtatcttaattgatacttactggagagtatcagaattacccagcagctcttacagaatgccataaattctttaagactaaatattgaaatcaattatttgaagtaatgtttctgatttactgttaaaagttgctgagctcagtttttggagatatcatttatgcctgcctgttccctta

SEQ ID NO: 48680 - DNA, 1029 bp, Homo sapiens
gaaaatattcaggtctatcatatggtttgacagattttttaaaagttatttttggtaaggtcttcttttagaaaaaaattaatctcaagggttttttgtaccactataatctctaatacttactcagaattactgtgtatttacttaatttcttattatgtgccttattatgtgcttaagatacaataggttagagtttaatctaaatatcttgaaagctatattgtgggcttggtaagcattttgttttttctttctctgttttggtaaggatttaaaatttttttcattgcaattttaagtggttttcaataagtaatagtttttatcaaatttttggtgcttggtgcagagacggtgtggggaagggtgaatggttttgggaataattcagtgcacacctgtaggcctctttacattgtgactgataggggttattgcatatcaatttggggctgtagagtgcaatctcagtttcatctttttcacccatcagaatttgtctcaggattacttggtttttctcagtcctcaagcgagaacttgcttttctttgttaatgtgactttcattactgagtacccacgtatttggagtatgagaaggtgggttatttctcatactctgtccctctctttttcattgaatgtaagagtacattttaatgttgcttcagtgattgtataatgtaaaattgtttctttttaataagaaactttgctattatttcttcaattgttgatcagaattttttaaagcagaatttgtcaaaagggtcatttttttgtctaccccttttacacttttcagattctcaaagtgtctcatctcaacttttaaaagaataaagaatatcttgctgggcatggtggtgtgcgcctgtgcgcctgtagtcccagctacaggctgagcctgtaggcaggaggctacaggcaggaggatcacttgagcccaggagttcaaggctgcagtgcgctatgatcacatttgtgaatagccacttcactccagccctggaacatagtgtga

SEQ ID NO: 48681 - DNA, 1044 bp, Homo sapiens
gagaataagggagcagatataaacccttaatgccatttaaaggctctgtgtagaagtaacatgtgaacatgtgtcatttccaccagtattctttgggaaaaacatgacatgatcaagcccagtgtgaactgcatggaaatatgtgctcttccacctaaaggcattgcaagtcatgtttggccagttatatagaagggggcaagtgaatatttggcaacaataatacaatatccaccgtatctctccttattgtttaactttgtttttagcctttctagtgtagatgttcataattgcttgtgtctatcttgaggcctctttgtgaagtcttcctttgtgcctttaatacagtgttttctgttgtaaaaatgaatcattttacctatgatcttgagcttgcttgtgtgtaagtttagcaaagacaaaatcttgtctgctttgttcagactcctcactagaatgcttagctcatgatatgctctcaacatgtatttgttaaatggatttcactctcccttcttacttcatcagttattctgtcagttactctcattttttgaatctcagtgtcaattctctgtgctaattctatccctgcagtctcttgtgacggtattttcttgaattactataattagttacatatttaataaattatattaaataattctttttaatgaagaaaataaaattatatgagtttttaactcctggaaaatagagcctacatacttgtgcctataaatacagtcatctccctatcattgaaaaagcaaactcccccctttgaggtttgcagtccaacctctcactacttctgtaatactgttgttttacctttttcatttctcattctctgtgccctatattgaaggtcctccctatcccccttttgaaactattcctctagattctgaggtactataattccttgtttctttcctgtttctagggctagtctcttcctcttttctgtaggatattccctttccttctgttgcttaagtgtacctatacccccaggctgtatctttagccttcttc

SEQ ID NO: 48682 - DNA, 1029 bp, Homo sapiens
ctttttttaatcaattttaagagttatttttgctgagtataaagttctaggttgacaggtattttttctttcagcgtattaaagataccattctgtggtattctgatgtccattgttgctcttagaaagtcagttgtcaagctaactgctgctctgttttttctggctgttctttagggattttcctttttggtgtcctttttcttttgtgtactttcaatatgatgtattcatttaaggatttatttttattctaattggagctcattgggcttcttgagtcagtggattgtttgttatttttagtggttctagaaattatcctttcatatattcccccttaacactatttctctcctgcctttctggagctttgattagacatgttatacccccatactgtcctcagtgtgtaaaacttaacttttctttctgagctgcatttggaataattcttaggacctaactttcagttcactgatgacgctcttcagcttggtttaattgtcgttaaatctgtcctataattttagatcttagcaattgtggctttcatttctagaaattttatttggttcatttttaaaaagtgtctcctgtactacagattttttttgtatgtcttttttcaaacatactatttaaatcttcatctgcttaatttagtatctcagattttttgcaattttctttctgcttagatatttctgactttttgggtttttttgtgggggagggtggggatgagttattcactttacttggagaattaattatgattgtcctttgaggctcaggattaaggtgtttgttcctccagagagaatttgcttgcctgcagcattaaaggctctacgttcaggatcatttcaacctaaatttatagcttgattttcctttggacttccaagaaatgtaaatttggactgtaaatttttgtgaaagcttccttttggttagaacttttcaggggacttttctcccttctctgctggtcacaaagcaaaccttccttgtagtcttttgaag

SEQ ID NO: 48683 - DNA, 1049 bp, Homo sapiens
agataattgacatcattacaatagaatcttccagtctttgaacattgtgcatctgtccattcatttggactttttttatttttttattttttgagacagggttttgctcagtcgcctaggctgaagtgcagtggtgcactcatggttcactgcagcctcgacctccaggctcaggcagtcctcccacctcagcctcctgagtagccaggaccacaggcacacatcaccatgctctgctaattaaaaaaaaaatttttttgtagaggtagggtccctctgtattacctagattggtctaaaactcctggtctcaagtgatcctccaaactctgcttcccaaagcactaggattaccagcgtgagccactgcagcctggatgtttgttcatgtctctcagtaaagttgggtgacttttctccttaaagatttgcacattttttgttgcacttattcctgagaacttttttttttttttttttgagacagagtctcactctgttgcccaggctggagtgcagtgtcatgatctcggctcactataacctctgcctcccaggtccaagcaattctcttgcctcagcctcccgaagctgggactacaggcgcatgccaccatggtttttgtatttttagtagagatggggtttcatcgtcttagctaggatggtcttgatctcctgacctcgtgatccacctgtctcggcctcccaaagtgttgggattacaggtgtgagccactgtgccctgctattcctgagaacttcttacttttacttttattttacatggcatagtgtggtgtctaagaaccatactttttgtattctgattctggacctattatttatgagctgtgtaatcttgggcaagttacttaactactctgcatttctctttctttctatgtgtaatgtgtaacagttcttaactggtagggttgtgaagattaaatgtgctcatgtacatgaagagtttaaaatgatacctaacataagcccaatgtaagtttgaagtatcattactgttttgttttctaactgttggtaat

SEQ ID NO: 48684 - DNA, 1043 bp, Homo sapiens
cataggaaaggaattgttgggtcatagagaacatatttcttcagtttcattacataatgccagttttcaaagtgattgcaccagtttataactgcattgtgagattaaaataatttttttaagccatctcctactgaaaggagtgaggttaaaaaaaattttattttagtgtgtggtaaatggtatcttaacatagttttcacttgcattttcctaattactaatgaggttggacatatttttattatttatcctctcatacattttgttttatttatttatttattacacgaataagttctttagtggtgatttctgagatttcggtgcacccatcacccaagcagtgtacactgtacccagtgtgtagtcttttacctctcgcccccatccctgtgcaattcttttgtctgtttttgtgttttatttctcctttttttcttacttagttgtaggaattcattatgtattccagatactagtccattgtttgttatatgggttgcaaatagtttctcccagttttggcttgttgatttattctcttaatgatacttttacgttgtcaagtttgtttcttatttcctttacatttgtgcttttttgtgtgtcttatttaagaaatcctttgtgatataaggtcataaatatatttacttatattctaaagtttatggtgttttagtaataatttaaactttgcaattaaattttgtctgaaattaagttgcaagagtagtacaaagaacttctgggtatctgttattcagattgccctattgttaatatcatgccatatttacttagatcatctgagtatttatgtgtatgtatgtatatacatatataatatatacactacctatatttgtgtatgcatgtgtgtgtatatttattttctcccacctccaaaccacttgagtaagttgcagatatgatgtccctttatgtctaaattaatcattgtgtatttactaagagcaaggacattcttactaaatacagtttaattatcaaagttaggaaattaacatctatacagt

SEQ ID NO: 48685 - DNA, 1051 bp, Homo sapiens
ggaaggttgagttacctgggaggtatgggagcagagtatgaaagagaagggcctgtgtagaaaaagtgcttcagaaataatacctttgaatctgttgtttgaatattattaagccacatatgcacagtacatatgcctgtgaggtcaggcaaagaacaaccagagagctataagcttaactttccaggactcacacaggcctgggagagatatttgagtgatagccaactacaacagagagtccttgttgaatacttgaagcacactcaagggcacctgacaccagaggagacatggactgaactagctccagcatgaaggcaaatccaaatctaccctaatgaaacttaaaaacaaactccaaaacagtgtagctaatctgaaagtaacttatgtttttctaaaaatgaagtctaacactttaaaagaaaaataacaaatataacaaaacaacagaataacaaattctggtgctcctaatgtggagcatccaattgccagacatgttaagaaccaaaaaaatgtgacccataaacaagtgaaaaattaatcaacagaaacaaacctagaaaattacagagatgatggaattatcagctgtgcactttgaaacagttactaaaagtatgttcaagtatttaaaggaaaatatgagcataggaaggagaaaaaatcaaatagaacttacagagattaaaaataagacacctgaaaaaaatacatgatggcattcatagcacattgtattctacaaaagaaaacatcagtgaatttgaagatagcaaaagaaactgaagcacacagacagaaaaaactgaaggctgggcgtggtggctcacccctgtaatcctagcactttgggaggccgaggcgggtggatcacctgaggtcaggagtttgagaccagcctgaccaacatggtgaaaccccttctctactaaaaatacaaaaattagccgggcgtggtggtgtgcaccggtaatctcagctgcttgggaggctgaggtaggagaattgcttgaacccccgggggcggaggttgcagtgagcc

SEQ ID NO: 48686 - DNA, 1070 bp, Homo sapiens
tttccaggttttgaacttggacttagataattgggtagatgaatggtaatgaatggttgtgccattcatttctattcgaatgtaggaagaacagagttggacgacacaggttcagatttgtatatattgagtttgagtttcctttggaacatccaaatggaaatgacagataggcagtgggtccctggtctcaacatcatgaaagaaatttgatagtatcatacacagttgacaactgaagccatggacatggagagtttcagagaagggagggtttctttatccagatgtttttggagttgtagggaggtggggatgaatggacctccttttccagaccaggagcttatatggtgtttgggaccatgggaacatagatgttcgggaaagtgaacaagtatagagacagaatgaaaagaactggatctaccaagctcattctagcttattttaatgtaactattaataataattctttttaaaaatgaaagcgttaaagcatacaggatactagaacaatggtacgaaattgtgacagcctcaggcaaactaggacttaacagtcattctatttaggtgttgttattaaaaagttaacatctgattctgtcacctaacactaaaattctgtttaggtgttgttttaaaaaattctcttagcttaatgtgggcatgtctttttccatgtcagctttaaattatttcatcgaattcaggggcgtccaatcttttagcttccctgacccacattggaagaattctcttgggccacacataaaatacgctaacattaatgatagctgatgagctaaaaaaccattgcaaaacagtctcacaacgttttaagaaagtttacgaatttgttttgggccgcattcaaagctgtcctgggctgcatgctgtgcacaggctgcatgttggacaagcttgatctagttctaaaacaaagaatccttcttccccgaacctttacctacaatatcttagggattctgataagaattatgttagagttatatgttaatgtgaaatgttgatcattttttggtattatctttccatttgggatt

SEQ ID NO: 48687 - DNA, 1081 bp, Homo sapiens
attggccaagctggtcttgaactcctgacctcaagtgatctgcccaccttggcctcccagagtgctgggattataggtgtgagccactgcacccagctttcaaattcttttatgtcgtctttaatttctttcaatgttgttttgttgttttcagtgtacaggttttgcacatgtatgccatttttcttgctaatgtaaatggtgttttattgtcaatatatagaaatactttgcatattgatcttgtgttttgtgatattgctataaaaacttacttattacctttttttgggtaaatttcttaggatttttaatgtacatgatcatgtcatctgagaatgtagttttattcttttctaatctgggtgacctttatttctttttctgacttctatgtatctttgccttactgctgctccttacgggaaaacaggcagtttttcttagctgtaggtttttcttagatgcccttttttaagttggaaacatttcttatttcttgtttgttgttctttggtaacattaatgggtgttggatttgtatctttcaaggaatttttgtatttcaactaagttgttgggatttatgcatgtaaagttgttcataatggatttgtttgtttgttttttgttgtttttgagtctagctctgtcacccaggctggagtgcagtggcgcgatcttggctcactgcaacctccgactcacgggttcaagcgattctcctgcctctcctgagtagctgggattataggcgcacaccaccatgcccggctaatttttgtatttttagtagagacaaggtttcaccatgttggtcaggctggtctcaaactcctgacctcgtgatccacccaccttggcctcccaaagtgctgggattacaagcgtgagccactgtgcccggcccataatgttttcttactatccttttaatgttgtaggatctgtagtaattttcatcttttcagtaccgatattcataattgatattttctttttttcctgattggtctagctttcagtattgttggtctatttgaaaagcagctttcggttttattcatttcctgtgttgatt

SEQ ID NO: 48688 - DNA, 1084 bp, Homo sapiens
tacacattatagattgacttatgtaaatttgttccaccactttgggtccatctgtgttcatcatctcttcttgttagcaaatttcagtgctcctactttatttgcatttgttggacctgacagtggtgttcattcatggttttttgtttgtttttaactctgtcacctaggctggagtgcagtggtggcatgatcatagttcgttgcagcctctaactcctgagctcaagccatcctttcacctcagcctccaaagtagctagtaaatctacaagcgtgcaccaccatgcccagctgggattttgctgtgttgcccaggctggtctcaaactcttggcctctcaaagtgctgggattgcaggcatgagccactgtgcctgccctaaagatatgtcttcataagtgaaagaagatttaaatgttagatgcaggaaccatatttgaatacaaaatttggctttctgactacctgcttttagcaagcactttgtaaacaaaggtcagatcctactctgaagagaagataagcttattagttggttcagtagcaatctatatttttataggcttagatctgggaatgtaaaattatgcattatctggagaaatttctctaagattgttctttttggattccatccaaggaatcttaattaccaagtaaatactaagaggccagtaaggctcataattcatctagatcgtgtgaaagataatctagcagttacttaatttcccttgtatgccatctgaatatgatgacacaacaaatggtttcagccagtggcaagagtggatttcaggttatcttccataagttgcttccctggattcagaagagtaatatggacttttaaaaaaagaattgaaaatactctgtagtataatataaaatccatcgttttagagaaagaaaactgagttgtttttagagattaagtgattcaccaaaatgtgtcatgagggcagggatttttgctattttcttcactactgtgtttccagtgtctgtcacataataagctctcagaaatacttgatgagtgaatgaatgccaaattgtcacatggctagttaggtagaa

SEQ ID NO: 48689 - DNA, 1034 bp, Homo sapiens
tggccaacatggtgaaaccccgcctctacaaaaactacaaaaaaaaggaaaagaaagagagttgtccctttttctctgctaccttactcacagctgtctctttcaccttcacttctttgaaaagattagggtaactcacaagctagtgaactggtttggactaggtaagttaggggagaatcatgttacgggctggtgaaaggagagaatccatggctatttgagaagagtgaaaatattttaatgaaagtcatcagctgggcgccgtggctcacgcctgtagtcccagcactttgggaagccaaggtgggtggatcactcgaggtcaggagtttgagaccagcctggccaacatggtgaaaccctgtctccactaaaaatacaaaaattaaccaggcgtggtggcaggcacctgtaatcccagctactcaggaggctgaagcaggagaatcgcttgaacccgggaggtggacattgcagtgagccgagatcacaccactgcactccagcctgggaaagagcagaagactctgtctcaaaaaaaaaaagaaaaaaaagaaagtcattaattggtacttaacttcaaaggaagatggcagtctaggaaaatacacaaaaaaatgaaccagaaccaaaaaagaaatttcaactatagtcaaactatgcaactgacatgacccattacagactgtgaagaataacttcaatttgtacccaaatcaaggaaagcggtgagatttgacaaacatttcctccaaatagtcactccgtgccatttttagtgagtaaacgagatgttcctgaaggcccagaagcaatttgaaatgtgaagaaataagaactgggacctaggtgcaccacggaaaaattaagaaatacaccctggggttcattttcagacgttaaggaaggtaggactgaagaagagaagatgtatcttgcatttttatttattttcaggactcagtttgctgacccatgactgaaaattgggaagtgaagggaggctgaagggttaacagtgacctgcaagg

SEQ ID NO: 48690 - DNA, 1068 bp, Homo sapiens
tcagaatactctaatatagtaatgggggtacataaatcacttttaactgtagtctaaagtttttttatgtattaaaatatagctataataatttggtcatggatagacaacatacaaattgtaacatcaataacataaaatgtgggaagaaaagttaaaatgcaaagttcttgtgatgaaagttaagctagtgtcaacttaaaatagactgtgataagatattttatgttaggctcatggtaaccacaaagaaagcagggcagtcaaatcttaaagctccaaaatgatcacctttgactccatgtctcacatccaggccatgctgatgcaagaagtgagttcccacagtcctgggcagctccacccctgtggctttacagggtatagcccccctcctggctgctttcacaggctaggattgagtgtctgcagcttttccaggtgaatggtgaaagctgtcagtggatctatcattctggggcctggaagacggtagccctcttctcacagctccactaggtggtgccccactaaggactgtgtggaggctctgattctacctttcccttctgcactaccctagcagcggttctccatgagggcccacccctgcagcaaacttctgcctgggcatccaagcatttctacgcatctttggaaatctaggtggaggttcagaaaccccaaatcttctgtgaacttgcaggctcaccaccacgtggaagcttccgaggattggggtttgaaccctcggaagccatggcccaagctctatattggcccctttcatccatggctggagtggctggaaagcagggtgccaagtccctaggctgcacacagcttgggaacactggacccagttcatgaaaccattttttcctcctgtgatgggaggggctgccatgaagacctctgacatgccctggcaacatttcccccattctcttgggaattaccattcagctcctcattacttatgcaattttttttttttgagacagagtcttactctattgcccaggctggagtgcaatggtgtgtcttggctcactgcaatctccgctt

SEQ ID NO: 48691 - DNA, 1033 bp, Homo sapiens
gtgtatgtgtatatatatatttttgagacagtttcactctgttgcccaggctgtagtgcagtggcacagtccagtcatggctaactgcaccttgaactcctagattcaagcaatcctcctgcctcatcctcccaagtagttgggactgtaggcacacaccatcatgccctgctaaattaaaaaaattttttttttttttgtacagacaaggtctcgctgtgttgcccaggctgatcttgaactcctggcctcaggtgatcctcctgcctcaacttcccaaagcactaggattacaaatgtgagccacctggccctattttatatttatagtatctcttaatcgctaaaaagatggaaccacataattatcttctaaaaatgtagtagcctccactgagaaaaacaagtcttgtcctttagttgacaataagcatgtgcaatttgtatatatacaaatgggagagtgccaatttcccttggaaaacattcttcactttacaaagaactcacctttggattcctctaaatgagacattccagtatacttaaacacgtcttcccataattatcttaccttaattcgtattatgtaacttttagggaaacgtctgttgtataaaatcaataatacctgtatttacacctttccatctgattcattgtaagagcatgatttgtttgcttatttgggtaacaggctcactgtgaagtagtaaatagagcaatatatgagaacaacataactctccttagtggactgcttttatttttgttttttgagacagagttttgccttgttgcccaggctggagtgcagtggcacgatcttggcttcactgcaacctccacctcccagttcaagcaattcttatgcctcagcctcctgagtacctggaattacaggtgcctgccaccacacctgactgattttttgtgttttagtagagacggggtttcatcatgttgcccaggctggtctcgaactgcccatctcagcctcccaaagtgctaggattacaggcatgagccaccg

SEQ ID NO: 48692 - DNA, 1033 bp, Homo sapiens
aatttctcagaatgtatccctgttgttaagcaacatatgatggtagatctgacattggatcagatatacaacatcctttatattattaatcttatattttaatctattttaagattatttacattgaaattgtattcacattattcaccttatggcctcttctgacatctatgttcgcttgctcttttacttgaaatcagaaccacttttaaagaagttttattgtcatcacacattatctgtgcctttatcttcattgctgtaaaaacttttgtacacatttcacctgtgttaagatagctccaaaacaaatcaagtcagacacatttgctgctatcaaggagtttttattttaaaatttgtataaaagtaaaatttactctctataaagtattgaatctcacttggcaagtagttaaccacttaactacttgaaggacgcctctatttccgttctgtatcaagtctgaattcctgtttgactctatgtatgtttgacccatcttcatatttttaaattactcatctctgttctgatttttttaatcttggttttgtcttaaacttatggactcttaaagtgtatactcatttggtccagcttctttcattgaccatactgtctgtgagattcatccatattgtgcatggatcagtagttcattccttgttattgtggggtagtattccatggtatgactttatcacattttgtttattcattcttctgtttgtaaactttggggttgtctcagttttggctgttgtgaataaagctgctatgagcatttataagtctcttttgcaggtacttttttttttttttttgagatggagttttgctcttgttgcccaagctggagtgcaatagcgtgatctcagctcactgcaacctccacctcctgggttcaagcgattctcctgcctcagcctcctgagtagctgggattacaggcgcgtgccactgcgcctggctaatttttttgtagaaacggggtttcaccatgttagccagtctggtctcgaactcctg

SEQ ID NO: 48693 - DNA, 1028 bp, Homo sapiens
ggatgtgacagtgtcctcagactatgtggggatgtcccctccatgccttccaagtgcaactgcctcttcttacccccccgggaccctagccattctgctgcagctccagaacaggctcccgtgtgatggaagcctggagtcctctttgtcctgttcagtctagacagatcccacagtgtttatcgtggaggggcccagaggcagctgtcttcactgtactccacatctgcctactcattcactatacatttgctgagcccagtttgtgtgccaagcattatggaagtaggttaatgtctctgaccttggtgagttcacagccttacaggaaagactgcaggtaaaagcagtgaccatgcagtgcctgtcagatgccttttcagagggtgcttgctccaccttgtgttcagggtggcatcaagggctttttctacatcatctcatttcattgtcacaacagtcctctgtgtgacagggacaattaggtccattttacaggaaggaaagttagggaaactagacttagagaagtaatttactggtggtcacaaagctagtaagttggcagagctgggattcaaacctgagtctagctggattccaaagccctggacattccaggacacggtgcttcctcccaatctccaagaaaggagggtacagtgggagctggatggtgagttcagacgcccacaccaggcttaatgactgtttggaaagatgagggcccaacagatctatcagttagttcaccctctcagggaagtgaaggccccctctggtccccaggtaagccctcagctagcacaagcagttctgcaaacactgtcagtgttacccagctaaggagatcctggctgagttgtaatcagctagtggaagcctttgccttctaagacaatggccaaatattagaatccttgaatctcagcactagaggtatcctcagagtttttagtcccatggctttcagctttcttcaccagggaacaccagccaattaaaatctttcttctaattccattatg

SEQ ID NO: 48694 - DNA, 1049 bp, Homo sapiens
tcctgcctcagcctccctagtagctgggattacaggcatgcgccaccacacccagctaattttgtatttttagtggagatggagtttctccatgttggtcaggctggtctcaaactcccgacatcaggtgatccacccgcctcagcctcccaaagtgccgggattacaggcatgaaccaccatgtccggcctgtggaatttctaatcaggttatctttttgacatctggaaatgcctggatgaagaatacgaggggaaaatgtgttacattgcatttgggagatttttatctatgagacactacattgaagatggttacaattgttttctgtagtcctgaccttttcttttccattctatgactctgagaatattatttcatccttcctatagcctaacaggggaaaaagtgagacagtttcttctcgaaacttatcataaagggttgaatctcatctgtctggattgctttgaatcagcactttccaatcactgtagaaggcaactgtgacagcagcaggaggagcactggggttgaaatccgagaacttgggttcaagttgtgaattttttctttattaactgtgcaggtgttttataaaataaagaatgttttacacatgtggtatattatggtgtcaggacatagtagtgatggtgcatcatgctgtactcattcatctgtgtggcaaaaaggttctctccatcatttcatgaccacttttcccagaatcctatggagactttttcccatagatcttagcagttaagtcatgatcactgaacctagacagatctaatgttgaatcttagcttaacaacttactaactgtgtgatcttgggctagttacttaatctccacgagcttcagttattgaagtaaaatggggataattctgacaaccttatgaagtttttggaggggcttaaacaagatcatgcatgtaaagcattttccacacttcctagaaaacattcttttttggtggggggaaactgagtcttgctctgtcgcccaggctggagtgcagtggcacgatctcagttc

SEQ ID NO: 48695 - DNA, 1035 bp, Homo sapiens
cataccttttcatctccactgttacagtcctgcgctaagtaaccgtctttccctgtataattgtagtggcatcctaactggtcttctacttccatttttgtctctttcagtgcattctgcatccagtatcaagaatgatcttcagaaattttcaaatcctgtcattcccgtttaaaactcctcagtagttttctgcacttataacaaaatctgaattcttcaccatggcctacaagattttgtatgttctagtgcctctccagattcattttgtgccattctttgccttgctctctataccctagccacattggctctctttcatttccttgaacatgccaatctatttatcacttccatggactttccacatattatttccccctgcctggagtgctccctttcttccagtcttcattcaaatgtcaactcttcaatttaagaggccacttttgaccgtatccaagtttcatgtgtcattcccgtccatgctgcctccatctctgtaggctctcacaaagcaccatatttttttcatagcatttattataatttacaattttttttattgtaaaatcatttacattagggacgttgattgcagaaatcatgtctgtttgcttcaccattgagttcttaccatctagttcatagtaggggccccatatgtatttttaactgtggccttgctacatggtattagatgtccattaataagacttaaattcttcagtggtctacagaataaattccaaattccctagcatggcatatgagctccttgtgagctggtccttgcttatctctccactttcactgctgggttatctttaatctcagtgcctatacacagtgttccctttgccagaaaagccctttctttttctttgccaggctaactcttactccttccagcccccagctgggttaggctcaaccttatcctcctgtgctaacctctctcataggcacggtcactctctgttgtaattgtctgtttgcttttgttttccctcactgggccataagctcctt

SEQ ID NO: 48696 - DNA, 1050 bp, Homo sapiens
aaaaacacaaaattagctgggcgtggtggcaggcgcctgtaatcccagctactcaggaagctgaggctggagaatcgcttgaacctgggaggtggaggttgtgatgagctgagatggtgccattgcactccagcctgggcaacaagagagaaactccatctcagaaaaaaaaaaaaaaaatagcgtaccaccaagccgactcttcatcttagtattccattcactcattcaacaggtatttatttgccttgcgttcattctcctaggctaaggtcaaatcatagatacaaaaatgaaccagaaattatacctcctctcaagtatattacatgttcctaataaaaatagtggaagataacttagtagtacttttatttcttattctactcatgataaattacaacaacgtagatataacccaaattcatatactttgttcttgagactttttaattgccttgctatgtaacataatgaattcttagctttattgggtccaatcactctgatcagaggccataatttgcttcagctttaatatcctctagattcatatatccgtttgtatgtgttctctgtgtatatttgtgcattaatatttgtgcattatgaacagtattaacaagggtgaaaatgctgcttccagtatgatcactgttaatcttgcaatcatgctagtaaccataatttattgttaacaacttgccagattgaaccaaaagctttatatgcaccagcttttgtagagatgcagtataatatgctggtcaagaacagggcctctggagttggactgcctggattcaagtttcagctctgccacttatttgcagtataaacttgagcaaactatttgatatctctgtgcctcacttttcacatctgcaaaatggccatacaggttgagtatcccttatctgaaatgtttgggaccagaagtgtttcaaatttcagattttagaatatttgcattatatacttaagggttgagcatccctaatggaaaacctgaaatccaaaatgctccgatgtggctgggcacggtggctc

SEQ ID NO: 48697 - DNA, 1233 bp, Homo sapiens
agagccacagcttccccaactacggcctgagccacggcctaacctcccgccagtggtggctggatgtggtcctgcagaccttccacctggcgggtgtccaggatgctcaggctgtagcccccatcgctgaacagctttataaagacttcagccacccctgcacctggcaggtgttggatggggctgaggacaccctgagggagtgccgcacacggggtctgagactggcagtgatctccaactttgaccgacggctagagggcatcctggggggccttggcctgcgtgaacacttcgactttgtgctgacctccgaggctgctggctggcccaagccggacccccgcattttccaggaggccttgcggcttgctcatatggaaccagtagtggcagcccatgttggggataattacctctgcgattaccaggggcctcgggctgtgggcatgcacagcttcctggtggttggcccacaggcactggaccccgtggtcagggattctgtacctaaagaacacatcctcccctctctggcccatctcctgcctgcccttgactgcctagagggctcaactccagggctttgaggccagtgagggaagtggctgggccctaggccatggagaaaaccttaaacaaaccctggagacagggagccccttctttctccacagctctggacctttccccctctccctgcggcctttgtcacctactgtgataataaagcagtgagtgctgagctctcacccttcccccactaaccagctcctagcctctgccctccctcattctcattcacacctgtgtcccttttccactaggagtcgacttcacatccaaaggattcacagagggccccactagcttcaaaaccaggcactttcaaacttggttttagcagcagagtcctttagttatgggcgatctgaaaccccattatgcaaaactaaaaacagaccctgaaaaactgctggagttgaagcagaggtgctaaggtctctctttcagcttctgaaaataccctctggaagcctggggtcagtgcttagtttgaaaagcaggatgctaagccattctgtagggacactgtccattagcaccacatagtatgaaggggagaatttaaacaaggaaccccatgacagtcatgagaagaaatcctgttgacatatgcctgccccgtgttaggtaaggtgctgagttacctccatgcacatataaccctca

SEQ ID NO: 48698 - DNA, 1048 bp, Homo sapiens
aaaaaagccggccgggtatagtggctcacgcctgtaatcctaacactttgggaggctgaggtcgggagttcgagaccagcctggccaacatggagaaaccccgtctctactaaaaatacaaaaaaaaaaggagccggggatggtggcgcatgcctgtaatcccagctacttgggaggctgaggcaggagaatcgcttgaacctgggaggcggaggttgcagtgagccgagatcgcgccattgcacttcagcctgggcaacaagaacgaaactccgcctcaaaaaaaaaaaaaaaaaaaaaaaaaagccgtgggtcaggagccagagccctctgctctagtcttagctgtgccaatgtgactccctgtgtgatttgggggtaaattactgcccctcactgggtctctgtctacccacctgcaaaatgagaggatctttggatgagtctccttaattcatttcctggacaaacttcctccaaggctcccccagatttaccagtgacgcccttccctaagtatcaacttagccgtactttgaactctggcccctcaggtttcaaggggacggccttgtctgggatcagctctgtctggggaaagaagctgcaccagcctctggatagcaggctgagtcacttgtttcttgtgccttgagtcagttctctcatcagctctcctcctaggccagtgttattacctccagtaaagatggaaaagttggggttcagagagggctagagacagacagcctgctgtgtcctgtcttttctcctgtgctgtacaggttcaccaatttttaaaatccaaatatatctcatggtacagtggaagaactggccagagagtctggaagtttgggttctggtcctggctgtgccactgactcactgtgaccttgggtaagtacctgcccctttctggctcagtctactctgcccagcagccaagatatcgttcatatgctctgcaaggccccttctgtctttgacatccctaataatgataatagcaatcataataattgtgtcctgtgtgccagacagctgg

SEQ ID NO: 48699 - DNA, 1046 bp, Homo sapiens
agctatatctagagtgcttatgtgactcacctaaggccactcaacaagtttgtggcagaactggattagaactgcacagaaaacagccaagctgggatttgaacccatgtagtccaactccaaggcctctgcccctaaccactgtgccataccacctcccaataatcaacagcaaaattataggtctaacaatgttttatagacacccctccatttatgtgatgggtttgcatcctgataaacccatcataagttgaaaatatgatcataagttgaaaatatgatcataagtcaaaaatgtatttaatatacctaacctaccaaacatcatagcttagcctagcctgccttaaacatgctcagaacacttacattagcctacagtgggcaaaactatccaacacaaaatctatattgtaataaagttgtaaagaattttgaataaaaattcaatatttgaagtacagtttctactgaatgtcttgtttcatactgttgtaaagtcaaaaattgtgaattgaatgatcacagttcggggaccatctgcaattagccccagttatacggggagaccaaggagaccaggcacctacttggttgcaagtgatggaaatccagttcaatagcaaagaaggacatgattggttttcataactggattgagataaggacaggtgtggttgggcccagggtcaaaccccatggaggtctctgtccctttctaactctcgtctgtgtttgccccagctttatactcaggtgggtttttgccacttgccagcaacatgatcctcaataattctaggcttaaatagtcgttaagatttgtaatcccagagaaagagccttcctgtcccatcactcacatagcaaatctctggaggtctctgattgggcctgttcaggccacatggtccactcttggctcagtcactgtaaacaatgggatgggagatggcgccacaattgaccaggtaggcctcattacacagaacgctgtcttggactgagcttttgcaccagtggcctccttggcttggaatgct

SEQ ID NO: 48700 - DNA, 1028 bp, Homo sapiens
cctcagatctgttttgtaatgctgagcaagttatttttccttctctgcctccgtttttgtttttgtcttgcttttcttgtttttgtttttttttttttttttttgagacggagtcttgctctgtcacccaagctggagtgcagtgatgggatctcagctcaccgcagtctcctcctcctgggttcaagcaattctcctgcctcagcctcccgagtagctgggactacaggcgcacgccaccacgtgcggctcattttttatttttgtagagacggggtttcaccatattggccaggctggtcttgaactcctgacctcaggtgatccgcccgtctcagcctcccaaagtgctgggattacaggcgtgagccaccgcgcccatctgcctccgtttttccaattgtacaatgtaattagctcctgcagtccgtctggctcactttcagctctgtctcctaaccccttgttccgtccttacagcatataggcgggagcagaaaggcaagaaggaggcctcagagcaaaagaagaaggacaaagacaaaaaaacagactcggaagagcaagacaagagcagggatgaggacaatgatgaagacgaagaaaggctggaagaagaagaacagaatgaagaggaagaagtagacaactgaaaagggcgggagactgtggcaccttggaaggtaccacttgaaatgagacgtgctacgtgtttctgtgaagcttttccatgctgggcagagtagtctcaggcaaaagtgcctgaaaagatcagaataaaaactgactagaaataccgtcaaaaccagcacttaccaaactcagagcatctgagtagcagaatcctgttttgcttcatcaatctgaaggttatggccttttgacaagagggattctgaacgactaaattagtcagtttgctcgcttttgtttacttaaatgtatggttagatggtttttgatctgcagtcttccctagtcccccaaataagtaataataacttccatgctgcctgctgtgttccaga

SEQ ID NO: 48701 - DNA, 1033 bp, Homo sapiens
atcttcctcttctgctgctgagagccgccgtgctgtgccggcctgcgagtttttaccaatcagctacccaggaaaaatgatttttcctcatataggccaccttctgagaatcctctcccagaaacaggacaatcagtgtgtctctaacttgagtctggtgctcatctctgcagagtttgtggttgtttaggacccaaaacgtgctccagatgccacaaagcgtattactgcagcaaggagcatcaagaccctagaccggagattggcacataagcaggcttgtacagaaccagatcatttggaccatataattccagaccacgacttcctttttccagaatttgcagttgtagtagaaacagaagatgaagattacacctgaggttgtggaaaaggaagattactcagagattatagggagcatgggtgaggcacttgaagaagaactggattccatggcaaaacatgaatccagggaagataaaatttttcagaagttcaaaactcagatagcccttgaaccagaacagattctcagatatggcagaggtattgcccccacctggattctagtgaaaatattcctcaagaaaaggatattccagagaatatcctttgtgatgccaagaaaatgtttgaattccaggttatgcctcagctcctaaactacctgaaggctgacagactgagcgagagcattgactggggcatcctggctgtcttcacctgggctgagagctgcataccggctatacagaataatttgtgtggaagcaggatgtaacagatacactgtaaaggcatcttagagccttaaaaaaagttaataatcttttataccttgcaattccatttctgggacgtcatcctaaggaaatacttataccaaaaatagaggtgcagagatgttgagacattgcttacacagtgtcttcatattagtgaaacaaaagtgtccagtgacagggaattaaatacattttggtacatccacagtggaaggctacacagtcttaattatacacacctatat

SEQ ID NO: 48702 - DNA, 1043 bp, Homo sapiens
aggggagctgagattccagctggccagtgcctcactccatctggacctctgtgcactctaccccgaaggctggagagaccccaggatggtcttctgctcagaacccacgagttcagaggcagtcctcagaacccaccgagccatttcactctgctcagagcccacgggggagggctggacccacctgggagggagccgcgctggggatgttgcgctggacacccaggctaggcatggtgggtaggtggacagcaatggatggggacccataggaaggagattgacattcactgagcagcaacaggtatcccaccccagcttcagggtcatatttgagcccctccacacacacaccaaggcacagccaggtggaatggtttgctcaacatcccacagctggtgcaacaggcaaagctgggactgaaacctacatctccctgattccagaacaggtgtttctttcctcatgcctgggtaagccctggcactcaggccctggcactgggtgtggagacaggcatagggatgaggtggattgatgactgttatagtaataagaatggtcataggtgatgtttatggaccactctcttaaataatttgcagttggggaagctgaggcacagagaggttaaataacttgaccaagatcattcaacaagtaggtgccagagcaggagttggaactcggcagcctagctctgaagcccacgagtgacaccacactctagcagaactagacttggtagttgcgggatctgcagctggggaggcctggcccaggaacaccgatgggtctggagccttggggttggggcaggaccagggagcccagctgtggggcagggagccaggactggtcaggagtcactggtgggctctgttctctacactggcctctggccagggtttatagtgatctcactgcatttgctgccatgttgccacctcccccccagcccctgttcctccatctcagctgaagagggatctggaagagctgaggtgaccagaaattacccaagaaggaattacggagatga

SEQ ID NO: 48703 - DNA, 1031 bp, Homo sapiens
gagcctgaataggaccattcctctcagccagtgctttgctgtctctgtagcggtttatggaacacctgccttcccctgtgacaacttgggattgctggaagctctttccaccaaacagagccaagcccatggaggtcagagcctgtttgaacatgggctggccccagctgccctctgagtgaggacttcccaagctatcaaaggggaacttggacaaagcactgacttaggactgggggtcttcctcatttctgtgccatagacccctctggcaggctggtgaagtgctgggaccccttcttagaataaagctttaaatgtttaaaataaaacacaatacataggatgacaaattacatcaggaaatacctgatataattttcagaatatgaaaacacaacgtaaaacatgctactttaggacagcaataacagggttgagcagtgagtcagtaactgctgtaactgtgaagccaagaagtgcataaatgggattttgtgacatctgtagcagctggaatgtgacgtgaaagatcagtgctctctgtgggtgaccatgaccagttcctctgaggctttgttgcttctgttagcaatgaaaggaaacgtggcctttcagttagaggttaatggaaatgaagatgtaacagttcccccagccaagttctcgggtgcctgcattccctcccaggagcactggtttccagccttatcctgagggctctgcttgccttaaccttctagagattctgggtcactctctctttccactgacgtccttttcttaagaccacagggagggaggcgtggagcaggtttcagcttagcaggaggaagcctggtctgttcagcagggcacaggcctggttacaaggaggcagtgacttctgccccatctcaggaaggcttcatgcagaagcttcccagagagctccctaatgttgtgatttggtggtcaaatatgatagccagaatagacaggctggtagaaaagcacagtgctggcccagtgttgaggttgttcttgtgatc

SEQ ID NO: 48704 - DNA, 1057 bp, Homo sapiens
actcactcttggcctcagtctccccatctgtacaaccacggaagacccccatggctcctccagttctgagagtcttctctgcatcaggaggtgctggaaaatatttgggggaggcacagcaaggaatgacaactctatattcccacctcttctgtgtatatttgaacaaggactgcagcattcctccagagagagaaagagcttgaaataatcacctttattcaccactaagtgccgctgtgtggtctacaacaccacatattagtaagcttttgctgcagtaatgctgagtaataaccctaaaatgtggacaacaacccaaaacataacatggccaaaatcccttcctgcatggagctcacacactcctcatacctctgctaaatcacttgtcacattgctttaacctcttcgtgggtttcccttccccaataaacagcgagagctggtgcaaaatggaggcccagaaagtgtggaacagaaactggaaggaaagcacacactccccggccacttgcaggattatcttctactatgcggccttctaaacattcgcctcccacatggtaggaaaatgttctttgttctagtgttcagttgggcaagatgacatcaggtggctggctatcgatgaccgagatgccccagacactggccccaaatggagccagtttccatttagcctgaattcctcggatcatgctgtgtggttattgatcccaggttaaatgtggctcattctgcagccatttcccctcaaagcagacacagtcaatcaaaggaaatcagatccagctttcccccattcacaaactgtgttgattttccatttgtctaacagagagccagccctgagcattttatgctgccttcacacaatatcatttcccccataaagatgttggccgagagagcagagtgaaagaagaaaggcctgcctgttatttcttgaattcttcatctagtgccagcatgcctgtggcagaggggcttaattgcacagattctgggatcctaccagctgggttctgctttccagagtagtagctttgtcacc

SEQ ID NO: 48705 - DNA, 1025 bp, Homo sapiens
cctagggggcacatgaaactcgaaatattgctgtggccatttttggaaaagtacactctgcctcagtagatttgggatggagcctgagagtttgcgtttctcacaggctcctaggttttgctgatagtactcatctttgtcattttagcagctataagagagtgcctgagattgggcagtttaaaatgcatataaatttattagctcacagttctgaaggctgggggagagagagagacagagagaaagagagagagagaaagtgtgtgagagagaaagtgagtgacagagagagacaaagttggaaaggtggagtccttgtggcctaatcaccttttaagggtcccatctcttaatactgcatgagttttagtggaggacacacattcaaaccacagcacagttggtccatggacaacacatggggtcttgctttcaaattgctgacagtctagtgaggaagagggaggaggaaatagcaaactgtaataaagtcagacctgttaagaagtaccatgctcttaataggagtactacctgataactggataacaattaacatctctgatgtacaggcagtattctgggcactttgtatatatcagtccttttaccctcacagcaaccctgtggtaagggtgctcatcccttgtttaccgatgtgaggctcagagagtttaaatgatttacccaaggtgacacagccagggcgtgtggagccaggcaggctgcttccaagtccctgtggccactgcacggcccttcctgtgctgggacctcaggtgggagcagtcagtccaggtgaggggggctggttgtggctgcagagaggaagtggatcttgagctggacttctcttggttagcaggttcttgctgagcctctctatgtgcctgacatgtaaacatgagccagaaaacacatgatttttgcccctgtgaagagtgcggtctggttggggcattgaatgtggaagattatgccaggcagagaagtgaaggaagagctcttccaggaagaattgg

SEQ ID NO: 48706 - DNA, 1003 bp, Homo sapiens
tgtccatgggttgccagcacctggtgcccaccaaagtgcctgcagtgctccaacaacaggaaagactcactgggccctggggcacccagggagggacagggccaccccctctgccgccatcaaacagctctctccaagccccgctgctcaaggaaaatgaaaacacaagcatgctcaggagacattttgtagtttctccttcccgcatttttttctctgacagcagaagggacaacattatagattttgaatcacaataggaaaaaatgataatatgaagcccgcaaaaatacacatttgctacatttttgtgcttctacttttgagaaggcccatctcaatactctaaaatggcaacaacttagtcaaaatcttataaattagagatgtcaggttttgaagaagggaagcaactatctaagaactcgatggttgaatcataaaaggaacagaacaaacaagaaggatcccaagccactgtgtacagtaggtcagaccaaaagagatctggaaggacatgacacctgctggcagctgtcacatcccggtaaattatttctcttttctacaactagcaagtattatttttgcaattggaaaacacagtaaagattttaaaaaatatgtattacgctctgctaagggtgacagccagaatccgccactgtaaacttactattttccctttataattatgaagtacactgatagagatattttgaaaccacacacagaaaatcctttttctgcttaaactcatgcccactttttttttttttttttgaacagagtctggctctgttgcccaggctggagtgcagcggcaccatcttggctcactgcaacctctgcctcctgggttcaagcgatcctcctgcctcagcctcccgagtagctgggattactggtgcctgccaccatgcctggctaatttctgtatttttagtagagatggggtttcaccacgttggccaggcgggtttcaaactcctaacctcaagtg

SEQ ID NO: 48707 - DNA, 1040 bp, Homo sapiens
tgaagtggaaagaagtgttccagtgtgcagaggaaggcccatgtggctgaacgtggaaagccaggtggggagaagatgccttagcaatgctgctgaggaaacagcctgattgcacgggagatgtaatgcacccaagactgtgcagctgtgaaaagacgatgatcaagatctgcagttattaatgtggaaagatgtctgtgggctgttattaagtgggaaacgtgggctgcaaaaccacatagctaacaggatttcatctgtattctatatgaatgcaaaaatatgcatagagaaacatctatgccggacacacaccacagtgtcaacactggttatctcaggtggtaagatgagggatgattttcactttgtttatgtccttaggcggcgtctgaatggagcaaatattccttttataatcttaaaaacagcaacaataaagtgatttccgttcggaaacaaggcagagaaaaaatattccgtagaagtgtccactcactttagtttgcctctcagttgcaggcaatcaaaggctttatttgctcataaaatgcccgccttcagtaaagtcctttctatcttcaatcccctccgcagtaaagcattttatattcctgctgtttattgtactttcccttccagggccccttggatatgctaacacctgcctacactcacttgggcatccaggactgattaattctgtttattgccaatgcactttcagtggaattaggcatattgaaatggaataaaggggcttggctatgtgggcagtggagccaagaaaaggttttatttgtaaatagggctccttgctgctgtgcagagcttccctggagagaaaatgtgccttttgctttgcttccagctgctcagcccacttagctcctgaagggcctggtttgagtctggggcgggggatgtcaggacggcactgccctaagtggagaagcacttggggggtcaggcaggttctcagcatttgccctgggaaggccccatggaacttggcaccttcccactcccccagtgggggc

SEQ ID NO: 48708 - DNA, 1030 bp, Homo sapiens
ggcaaggaagcgggttctcctctggagcctctaggagaagtgtggtccttttggcacactttatacttccaacctcccaaactgtcagataacaaatctatgttgctcttaggctctgactgtggtgatttgttacagcggcggcagtgccctggggtcaacactggcaaaggagtgagagacacagggcagggctgccgtgccttctcagcacggatctcggcaggtcccacagggagctctggagctgggatggcctgcagaggtgtccagaattgaggctggggctggcttttacccaccgccatcagccactagccacagagctgcctccagggagggttgtgaccctggtgaggtgctcccttggcctagggcagttcttgaggagagactcgctgccctgaggaggagcgccttggtcctggagggggagcagtgtcccgtcctgggtggccttgttctttcctctcagcattctcttaccacccggtgactcctgagcttctggagtgacccagcacaaggcctagcacagactccaggctcgaaagcctgtagatggaactccagcctggctcacgtccacatggtggtcccagcctgcacagcagcccacagtcatcatctcccctgaggaaggccacacctgctttccaggtcgcacctgctggcttggctgagatgccactgtgaggataacgacagccactgtttcctagtgcttccctgtgccagccacgaccctacgcactctacacaaatggacccattcatccctcacagcagcccaaggaagtgagcgtgactggtttccccattttctagatgaagaaactgaggcacagagaggtgaagcaacttggccggggccacatacctagcaagttggcagtctggctccggagcctgaacatgcattaaccaccatgtggtttcctcccaaatatgcaaagctgcctgtgacaagggaccagggtgggccttgaacccaggtgccctcagatctgctcaagccttggagctggca

SEQ ID NO: 48709 - DNA, 1033 bp, Homo sapiens
cctgcaggcagcttcctacaaagagcaaggacacagccgtggcctcggaggggcagccctctggccttcaagtcctgtcaaaatctcctgctgctgctgatagtgccgagttggggtgcgtatcctgccataactgagatgctccaattgtccttctggtgttttcttaaaccctgtggaacctcagagcccccaggctctggatctggttcagtgacctggtagcaacaccagccagcatagctcaagtgctcactgctgggatgggagaaactgaggacagttttccaggcccagaagtcaggtgcccataggtgcaaccctcagcctgcctggagttatccctgggtgtcccagagcccctgatctctctgctttaatgacctgtgaccaccatgagagcaaatacagtctttccttctaaatacagccctgaatcagaaagacatagaagtttaacttgggacaggatcttagcaaacaggtccaacctgctcattgccagagggcaaaaccaagacctagcaaggggagaagtaaccctaggacacccaccaagctaatggcacaacagggacctgctgggtctctgtctcacaggctcaagctctgctgcctgaggctactcactctgtaggctgctctggtgagagaagtaaaatgagtggtctggtgcacgtaaccatgggtgaggatctcgcgatcccccaggtggcctgagcctcagggatcaaggtagcaatggtgggtgagtttgaaaggctggcagggtggctacaggggaaaaaacatgaccagctttgtttaggaaataactctcctgttgaatgatgcccgttaaaataagcaagcaatggtttgtagaaatggagacaagaaggcagtaggagcagagaccgtcctcttccccttccctgcatgacccacacacattttagtggcattaaacagcaatggatggagctgttcctgcaggattctgatggccactgcaccaagaccatatcccaagagcctgcgtagatattgaaag

SEQ ID NO: 48710 - DNA, 1017 bp, Homo sapiens
cttccctgttctcccctgggcacactgtatgcattttattgactagatttcagggacagaggtggcattgggcactttttcctttttgtttttttcctttttcctctctcttatctctctcaccatgccttgacctttgtcaggtttttattttgtacgttgtctgtggaaattccctgatagataactggtgacttgtgaaattatctcattgaatggtggagtctctgaatttgtctacactgcctgatcagcacacttcaaggatgagaggagggtctctctcctgggcctcatgtgaaaggctggtggtcattaactctgctgtcacagactggacaagttaaaggggcattttgtttggtcataggaaacaaatggaatagaggaatttgtctaggctgttaaataaaacgttttttctccccacccccccacccccactttttttttttttttaaaaaaaagatagggtcttattctgttggccaggctggagtgcagtggcgcgataacagctctctgcagctttgaactcctgggctcaagtgatctgcttgcctcagcctcccaagtagctgggactacaggtgtgcaccaccacacctggctaattgtgtttatttttggtagagatgaggtctcactatgtcgcccaggctggtctcaaacttctgggctcaagcgattctcctacctcggcctctcaaaacactgggattacaggcgtgagccactgtgcctagcctctttattttaattacctaacatatatggacttaattgtttttctttttttgagatagggccttgctcagtcacccgggctggagtgctgtgatgcgatcctggctcactgcagcctcaactttccaagctcaagcaattctcctgcctcagcctcccgagtagctgggactacaggcttgcgccaccatgcccagcatggtgtgtatatatatttgtgtgtgtgtgtgtatttttttttcttttgtagacgtggggtttcaccatgtt

SEQ ID NO: 48711 - DNA, 1050 bp, Homo sapiens
cattgataagtaagagtggcatccattcctgaggaccagaggagctggcctttggagagccctgcctttgaaaattcacgggacagtcattctgcacacatctgctgaagaaagtgcttcccctttgccagatcttatgccagatgctaactatgaatgtatcctaaagatgctcttatactagggctgtgaaataaataagaaaacagctcatgatacaacctcagatgaatgtcctcagatcagaaaaaagaactgctatgatcatcagctctaagacccatctactaggcatagttccaagattgcccatttctatgagtttttaattgtttgcatcacattattgcacctggaaattccccaggcattctagtccatagagttaagctaagaattaagctccagctcagtcctcctgcactgagagcatcaccatttctccttattccacagttggactcctgtaccccttccccaaggactgctcccaagcaatgctgaatggagacacgacctctggcctctacaccatttatctgaatggtgataaggctgaggcgctggaagtcttctgtgacatgacctctgatgggggtggatggattgtgagtaccaccagggactgcagagccctcaggcctaggggaagagggagagggcaaagcaggggaggagaagagggtgatctcctcctgatgcactctgacacccccatgtgtgaggccttgcaagatagtgcctgtcacacagaggcactcaggaattctctcttaaacaaaagaatgggaaacacgctggctactttttgaaacggggagataagtttcttgtagtttatctcatccaatcctcatcaaacaactctgtgatgtataaatgacagttgatcattgaacccattgcttacattaattagcactgactaagcatttattatctaccaggcactgtgctaagagtttaagatgaattattccgaccccattaccataggagctgggtagtgtatttttgaattaataaactctatttttttagaacagtttt

SEQ ID NO: 48712 - DNA, 2475 bp, Homo sapiens
cctcagctcctctgtggcagacctaggattccagcccagatgcagttgactttcagccccagaagcagccctgtcttgcagcctgaagagcattcatctctctgttctcctcccagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactggtgagtctgccctgagcttcctccaaactctaggttgattctgaggttagcagatctcctcagccagggtgtcctcacatgagaaagccaaatgcaaaagcaagccactttctccatctctgaagcccctgaacaccactttgaaagggctgcttactcgtcttttctacctcctgtcaactgatacagcaaatttcccccactgggaaataggggttttaaaatatttcttcctaggagaactttaaacatcagggtttgtgtttgcatttacctatgatttttgttttcttttcttaactgtgcatcacagcatcttttcaattgtttcttgtttatttccttcttttagcctaataattaatttacttttcattttacttcatttaaagatgaccaagatgttggtaataatattttttttgttgttgttattttctacaaactgtttttattccaggtcttttgctttctgccaaggttacccctgaagagtggcacacggccctttgagacttccatggtgccctctcattttctcttttctcttagtcattaagacattaacctagtttgtctatgacgacagcttaatcctgacattgtggcccatgcaacttgtgtccattctggcccatgcaacctgttcactgaacctgaggccatggttactcggtggctaaactgaagagacaaccaggtttttaaaatatttcttcctttatgaaaaataagcctattcaattttggccaccaaatattcgaaatgtataggtggaaaatgttacttttccagggtttggcaagtaatagtctttacttccaatttaattagtaagcatgtattgagtacctactgcatacattgtaccgtactgatatttgaggaaaagtagttcccaaagtcagcattgttatgtggactcatttgtgcctgctcatagtgcttgcggaagactagatactcagaatgctagacagaactcgagaaaaagagtgatccaaggaaatcaggagagctggcaaaggtgttatggcaagggatgttattccagttgaagcttgatatgcaagaaaagggttagaagtgtggacatatttggaaatggcttgaagagtctttctcacaatatcttcagtctcaaatcacagtcacttacttaagatagaagttggttttctttcttataaaatgaatctggagctgggaggtacagggataacttagtagtttcaaattgtcaggcacccaggctgcttctttcttttccaccatttttagtccttggcttccattctcaaagtcatctcagtgtcacaacatggctgctgtaatacagccattccatctgtgttctaggcagcataagggaggaagaaccaaaactcccaaagaggagcaccttctgggtgagtctttctggaaaccccaccaatcacttctccccatagttcattggccactcctagctgtaagggaggcagggaaaggtagtcttctgtctgaacatgttacttccacataaaattgaggtcatttgtaagagagaaatttggcagacaatgagcagtccctgccagagtctgaaatgagtttacgtggtcaattctgttgactctgcattgactgcttcccacccaactataagatgtttataaaggatgctctgaaagaatagtttaattaaaaaataaggtggggggcggggatagaaccaagaagaaataaatctatagtagagatttaaatttcagctttataaacatgagcttgttataaagtgtcaaggggcaacaaatgaatcagaaatgcccaaaagatgaaatccctctcttttctttctctttctctctctttcttccctcttccctcactcctgctcttcttcctcctcctccttcctctgcccctctcccttagctttcccttgagtttgataaatgctgtatctaagagagattcctattgcccctcaatcattccaccttctggtgatggccacattgcctccttcctccagtgagaaaacctcacacctgcgcagtcactgaagaagttttatctccctaagatcctgaggtgtggggcttctcc

SEQ ID NO: 48713 - DNA, 1026 bp, Homo sapiens
aatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagagggtgagtgccagggcgcagaccagcatataatggccatgatggagtggactcctagtatgggttggaaaactacgtttatatatataaacattcatgcacactgattctttgtacgtattaatatatccatttaaacacacacccataatgactttttaagggggccctgtcattccgttgttacaaggtgacctatttaagggctgaagggctcagagaggttatataattgtcccagggacacacagctgacacatcacagagctggtattcaagtctgcctaactcatctacatagagtttaa

SEQ ID NO: 48714 - DNA, 1062 bp, Homo sapiens
taagttatcggttactgtaaaagctaactgaagtcaatgtgttcttcaaacatggcctgagataatgtgtattctctaggatagtgggataatttaaggtattttggctataagtcttctacctgacatacaaatcttaccatgcccctcctttgatagatccccactacttatagaaggtcattttctgccagacatggtggctcatgcctgtaatcccagcactttgggaggttgaggcaggcagatcatccgaggtcaggagttcaagaccagcctggctaacatggtgaaaccctgtgtctacaaaaaatacaaaaattagccaggcatggtggtgtatgcctgtaatcccagctacacaggaggctgaggcaggagaatcagttgaacatgggaggtggaggttgcagtgagctgagatcacgccactgcactccagcctgggtgacagagcaagactctgtctcaaaaaaaaaataaacacataaaaataattttaaaaaacatcattttccttagcttggcatacaagaccatccacaaactgtcctcttcatgcacattccacacgaacaattccgtttcatttctccacacccttacaaaggttgtttttctctgcctgaaatgtgctttccatttttcactttgctaactcccactggttcttcaaggttcatctagagcatctcctttgcaagtcttctctattcctcatccctttttcctgaccccaccctagctgagtgtcattcctgtgttatcacagttcctagatttcttccatcacagtttcctcactgtctgtctgtgggtctgtttccttatcaggcagacaagatctctgcgaacagaattgtggagtccttcacggtagtatttccaacccataacagtgctcagagtaaaggggacaccaaaccagtgattgaggaatatatgactagataaacaacaaatgaaaggtaacaacggatttatctttgagttcatttattaccagattatacatagactaaactaactaggtgcttgtgtacttatttgtaatgctattac

SEQ ID NO: 48715 - DNA, 1034 bp, Homo sapiens
cagtattattcatgatagccaagatgtaacaacctacatgtccatcaacagaagaatggataaagaatatgtgatatatacacacaatggaatattacttgaccttaaaaaaggaaattctgcaatctgcaataagaggaatgaactttgagaacattatgctaagttaaataagccagacatggaaaacaaatactgcattagctcacttaatatgaagtatctaaaataatcaaattcatagaaccaaagacaaaatgaatggtggttgctaggggatggggaagggaaaagtgattagtgactaatcaataggcataaggtttcagttaagcaagatgaataagttctaggactctgcagtaaaacattattcctatagtgaacaatactgtaccatacacttaaaaatttgttaagagggtagatctcacggtgtgctcttcccacaataaaaaataaagaattattactttgaatgactaaaatgttgacattcaatgttgatccactggcctgaatgtatttgactctttgaacccctggtacagatttaatggtgtctacattggcagaaaaccttcttacttcttttcccatcctgggcaatctagcaggaccctataagcagcttccccagcccttattccaagaaaatagttggtccctggggtggcttcaggtcacagctttgttgtcctgggacaacaataaataattacatttattaatgtataaatacattaaatattttttacataaaataatcaagtgaagggaaaaataaattgatatagtagtcctaggcaaagagcaggtgtggttgggctgacaagcaccctcacttaggtcctctcaggttggaggatggatgacataagcctcttgattacttcatggacatacagctcatttccatttatagaaagcctatgtaccattggacagtcctctccaacagtcagagagagagagagactcctggatccactttctcctactgtttcttctaagtagcaatgcctataagcttt

SEQ ID NO: 48716 - DNA, 1004 bp, Homo sapiens
ccatccatccattcatttatccttattccatcctatgtatttaattcctacgatgtgttacacattatgctaaggaaaaggatgcaatagtgaattaatatagatatagttcctacccctccagaccttatactctggtgaagagacagactttaatcacataatcacacatctaattaaccaatttcaactctgataagagctatggagaagaggtttgtgatgctattaaaaagtagaaagatttgatctagacagggagctcagtgaagtccctgaagaaatgacgcttcagctgagatcataaagatgagtaggagttaattaggtgggggtggagaagagagaatttctagagacagggaacaatatgagaaaagctctggtacttagagatttctcctgtctctggtttatctcatgttgctccttctactagtaacgcattcagacaaacaaaccatccttcaagatctagctcaaatgttacctctccaaaatgccacccctaatagcctcaggatgctgtctgctgccatagcctcttgtatttgattttgtgatagctcttcaggattttaaaattctctctttaattgtctatctccttcactatactgtgcgcatcatccatttctgtatcctagattgctagcaaaatgtctcgtatttgtgcaaaactttatcaaatatagattccataaatgtttatttagtaaaacgatggatggatggatggatggatggatggatggatggatggatgacaggcaagaagatatcatagatgactcaaggagagcatagttactattttcactggactaacaccaatgtattcccagaactggaacagtatctggcatataagaggttctcagtgaagctttggtgaacaagtgagtgaatgatcactttggacccagcatggtgcagaaaacaggggctcaggggtccccaaaccctttctttatcttggatacctctggatattcaaggttgat

SEQ ID NO: 48717 - DNA, 1043 bp, Homo sapiens
tcagagtgcccaatgtagaggagacacatggtgttttcttccctcctcttgcctctttgtgaactgcctgttcagagcctcctctgttacaagcttcctcacttatcacagatataaagctgagaagaaaagggtggagattttcaggtattgctaggtctaacctggaaaggacttggggacacctgttcatgcaggctcaagcggtgaataccattgtacacacactagtgattccaaagggccttccacatgccagatgatttctatatgctagctctctgactctgcaccaccttgggagactatcattattagctccccatcttgcagatgagaaaatagaggcttcagaatgtttaaagcaaaactaacctgtctcaggcctcagtaccagtcagtgagttggtgatgcaggattccaaaccccacttcaaacacttgagagcttttcagcaagtgagagtaaaaagaagggggaaaaaaaaggtattttcttcacaacctgaaaaggctgactgctgctttgtctttttaatcaccaataacctttatccttattatgtgcctggcactgagctaaactcaatgtgcatcattatcttactcactctgcccagcaatgctaagaggtaactattcttactatccccattttacatcttaaaagaaactaagatgcaaagagatgaatcagtgggctgtcaggtggcctggcactcctcagcaccatgccccaggaggacggcagagcaggagtcagggtcctctcttcacagacgaagaaactgaggcatggagagaagaatcacatcttgataaaatcagagctctgagcccaactgccagattccctgactccccaagcagctccccaccttctcccccaggcggcctcccaagaaaacctaccacccacagcatgaacaccatggtggccagtttacatttggggattctcagcaccatgtggctaggctgtcccataaatggcttggccacccactctgggattgtgttagcaagccaggtccatgattaag

SEQ ID NO: 48718 - DNA, 1077 bp, Homo sapiens
agtcttgctctgttgcccaggctagagtacagtggcacgatcttggcttactgcctctggctccctggttcaagttattcttgtgcctcagcctcccgagtagctgggactacaggcatgcaccaccacaccggctaattttcgtatttttagtagggatgggatttcaccatgttgcccaggctggtctcaaattcctggcctcaagtaatccgcccatcttggcctcccaaagtgctgggattacaggcatgagccactgcgcttggcccactaatagccacattaaaactttttttaataaacaggtgaaattaaaattaataatgtgttttgtttgatctaaaatttcgacattttaatgtgattaatatcaataattattgtgagaaaaacctcattacctttgaaatccgtggtgcatttttgacttgcaacacatgtaaatacagactaaccagtgctgaatttcaagtgctcagtagactcatgtggctactggattaaacagggccaggccagatcattcaggaccagtaggccagcaacaacgtctggactttagcatcagtgcaatgggatttttaggtatccttctggtagcagggtagactgtaatctttcagcttgtagtttccttctagctaattgcaacaaggtaggaagctcaaagaaaagcaaaaatcagaataaaggatgaaaagagaatgactagctttggatggaaaagagaaggatactgttgctttaccagaaaaagtgtgaatgttgataataatggaaccaaattcctaactgaccaagattgatgacaatcgagaggtcagatgtcttagtgagtctggtcacacaatgaagtctatctaaacctataagtctggctaatcatcagctctgtgaattaactagtgaccagaaaccctctcattcagaacctgaggctgttaaaagaagaggaccaggtcaatccaggaagccacctcattttccttgctgccagttgcagattcaggttgtagaacccatctcagcctgaggagaaggagtttggcaacccctcacctctgagcctatgaa

SEQ ID NO: 48719 - DNA, 1007 bp, Homo sapiens
tctataccaggtcagcctgagaggttgagtgagctctgcaatgctcctggtttactcaggaggattagggcaataggcagaccttttcttgtttttcttactgtctttccttttgatcaaaatgtccatctcaaaatgtttaaatcatctccagagcaagttcgagttctcctgtgtctgcttttgatgacctttctgtctcttcctttgctaccacactgccttctgtcacttataactgtcgttaaaaaaaaaaaaaggtctctgaattatataatgggcttggtaatgagaaaggcatgctctcttgagctttatcttaataatagttaatagccctcaggtgaggtcatgaaagagtctcctacaacattataatagttgttttgacttctagatttttctatcttagttttggggtctttgttcctggttgggggaagatgcttggtgggttcgtagggcatatgaggtgtttctgaagcaagatgccagccttattttggaaggtatgatagccgtagaatttctaaattttatttttttattcatagttaatagctgtgccaacacacagctgctttagtagagataatacagaatttagtggaagacaaaactgggttaaagtctttgctcagggtttacttgctatatgacagggacaagtcatacaacctcagttttcaaatctgtacaatggaagtaatccactcccttctacttatcctctgctgacaattcttcttcctcttcctcttcatcttcattcttttaaaaaaattgtttatgtttttacttcagtacgttttagggaaacaggtggtatttgattacatgaataagctctttagtgatgatttctgagattttggtgcacccatcacctgagcagtgtacactgtacccaatgtgtagtcttttatccctcgccacccctcaccctttcccccaagtccccaaagtccaatgtatcattcttatgcctttgcaacctcatagcttag

SEQ ID NO: 48720 - DNA, 1113 bp, Homo sapiens
atttctcgctgggccttagctgccttcccacggggcagggctcgggacctgcagcccgccatgcctgagcctcccacccactccatgggctccggtgcggcccgagcctcccagacgagcaccaccccctgttccatggcgcccagtcccatcgaccacccaagggctgaggaatgggagctcacggcgcaggactggcaggcagctccaactgcagccccggtgcgggatccactaggtgaagccagctgggctcctgagtctggtggggacgtggagagtctttatatctagctcagggagtgtaaatacaccaatcagcaccctgtgtttagcccaaggtttgtgagtgcaccaatcgacactctgtatctagctgctctggtgaggatgtggagaacctttatatctagctcagggattgtaaatacaccaatcagcaccctgtgtttagctcaaggtttgtgaatgcaccaatcgacactctgtatctagctgctctggtggggccttggagaacctgtgtgtcgaaactctgtaactaatctgatggggacgtggagaacctttgtatctagctcagggattgtaaacgcaccaatcagcgacctgacaaaacaggccactgggctctaccaatcagcaggatgtgggtggggccagataagagaataaaagcaggctgccctagccaacattggcaacccactcgggtccccttccacactgtggaagctttgttcttttgctgtttgcaataaatcctgctactgctcactctttgggtccacgctgcttttatgagctgtaacactcacagcgaagatctgcagcttcattcctgagcccagcgagaccacgagcccaccgggaggaacgaacaactccagacgcgttgccttaagagctgtaacactcaccgcgaaggtctgcagcttcactcctgagccagtgagaccaggaacccaccagaaggaagaaactccgaacacatctgaacatcagaaggaacaaactccagacgcgccaccttaagagctgtaacactcaccgcgagggtccgcggcttcactcttgaagtcagtgagactaagaacccaccaattccggaca

SEQ ID NO: 48721 - DNA, 1078 bp, Homo sapiens
gagtaggcagtcacacggcaagagaggtattgagtgagagagcaagagagagagagagagagagagaaatagaaagaggaggcccacacacttttaaacaaccagattttgtgtgaactcagagcaagagctcactcatcaccaaagggatgacccaagccattcatgagggatccactcccatgatccaaatacctcccacttaggatccacttccaacactggggattacatttcaacctgacatttttaggggacagatatccaaaccctatcaattgacagataaaaattgtatatatttatgtcagataacatgttgttttgaaataggtatatgttgtgggatgactaaactaagcaaacctttggtcttttattctgttcttcaaacacattaggcatactcctaccttacagcctctatacttgctacggtctcttggattgctccaaccctagatcttctaagcctgtcttttttcttgttaaccaaattctatttcagacaccccctcttcagtgaagtcttctctgaccacccagtcaaatgcagttgactccaactcgccatcaactgtcgtccaacctctatcacagcttcatggtttacatctttaatggcctttgccactacttaaaattatcttgaccatttacctgctcactcagttatcatcaccacatacctccctttagtctctgcttcatttaaggaaacagatgctcaggagtgtagtgtaactcaccagaagtcacatcaccactaagtagtcatcccaagatttgaacaggtctgacagattctgcaaacgatggtttcttctttactacgctgttctctagacacagcaataactagagggttgcacttgttttatcaggacataacttgaatcatgaatcctaaggcatggtggtataggggaaagagtatgaattattgggttggcaagcctagattcatggcctggcattgacattttccagtattaaacatctctgcattttttctctcaaaacagaattaacattcttacctcaaagaggtaacatacattacgttcaaagaggtaat

SEQ ID NO: 48722 - DNA, 1031 bp, Homo sapiens
aggtacctggtgggaggtgattggatcatgggggaggactttccccttgctgctgtcatgatagtgagtgagttcttacgagatctggttgcttagaagtgtgtagcacctcccctctctctctcttcttcctgcttcagccatgtaagacatgcctgcttccccttcaccttccaccatgattgtaagtttcctgaggtctctccagccatgcttcctgtacaacttgtggaactgtgagccaattaaacctctttttaaaaataaattacccagtctcaggtagttctttatagcaatgtgaaaacagactaatagaatcaatttcttggggcacaaaaaagcaggagggggatgaagtctcaaagtctgtggagggagtgctgaggaaaggaagtgattctccttattgggtctccagagcagaggattggaactatgtggagtagatttcactagaagacgaaaaaagcacactctggaaaggcatttcctatcatattgggagtctcccgtgggctgctgtggggcatgagctccagtgcccacaaagtgtggaccctcgtgtgaggaccagccagcaccacatggccaggtgacctccaagggccacctggggcagggtgggaagcagagagagaaagttcagggttctccttttccctcacctcccatatacaacctgtggtcaagtcttgttgatgccagagcccaattacatcccatcctgtctgtggcttccagcttagctgctagcagcctagtccaaggcattctctcctctcctcagacagctgcagtaacaccttaactggtctcctggcctcaactgttggtactctatgtctactgtcttataaaatgtaaattagatcatggctctctttatttaaaaaaaaatcatccaatggctgcttgttaggaaaaaatccaactctatccaactcaagagaccatgcacaatccatgtctgctcacctcttctgacctgcagtgagcaagggccacgtcttctctgtcttcctcaaatg

SEQ ID NO: 48723 - DNA, 1093 bp, Homo sapiens
ccagggacagggaactcactgtctcctaggatggataccctattgatagacaggtctaattgttccactgttctcttggctggacagtgatcagactttcataataggcatggaaataaaatcttctcccctgcctcaccacagggaagtccttcaggggcttgacaacagcacccaggtcttccctgagcttgtcaccctcaaagacaatatggaaggcagagtccactgactggtctctgatactgctgtgaaatgacagggtcttgggataactgactgttttgtcttatgtcccagaggtttgtggagtggtagacaaatcttggactttgaagtcaaatagacctgctctgctgtttactagttgtaagacatcaaacaagtgccttaacctctctgaaccttggcttgttcacctgtataatggggggttgaaatagatggttattaaggcctctttcagttgtgactcgtggagttccacattgcttgtctctgagcctcctgcttctatttcaggaacttgttcctgtctctgaccttctgactcttgtcccctgcccccgaccctctatcatagtccctcgtttgttgcactaactctttggctcccttcaccaggctttaaaaaagaattctgttctgaccaaatcactccctgcatctgtctttatggctcccagcagttgctagtgtatgtccaagctccctagagtggccctcaaggctccagtatcaggccttgccagtatctccagctttataaacaactctccgcttttcctttggaattctccaaaagcactttcactccatgcttcacagacactgtttcttccacatgcaaactcctattgatcctgcaaaaccctattccggtgtcacccttaatatctgaagctctttcagaccactgctctccctgagacaaagttcatcatttctccttactcctttgcaagcatgatcgctgaatgaatcatggtgtgtttcaatagtcattttctgtggctgtctttcctttgtaagagttgcaaggcagggagctactgatttcttctctgtgtccctagcactggggacggggcct

SEQ ID NO: 48724 - DNA, 1106 bp, Homo sapiens
cgacagtgaggttggcccagtaaattcctggatgagaactgtcttggatttggtaatatgacagaaaggattgctttgctccatttcagtgacttattttacactaacaaaggccatcatacaacctaacacctcccattaattcccagcctaatcagaatggaaaacttctcattcactcattaatctactcatttattcatactcatcctctcagtcagcaaatatctatggagcacctcctatatctccaatactgtgtggaggtacaaggatgagcaacagagacatgacccttgtgctcactaaattccttgccacactgagccacaggaagaaagcagatggggaaagtagatttattgggtgcctactgtgcaccatggatggtgctaagtactttatgcacatgatctgctttcatcctcacacctgggactcaggaattaatatccaccttttagaggggaggaagctgaggctcagagagagatgtgattgtggaagggcacccagctagccagtgtcagagctggggtggaaccctgatctgtctgactccagagctaatactacaggagtgacaggaagaggatagcagtgactttacaagtatctgtgttccatcatttcctcaaatctagagctaaaaagtgacccactttggaaaacttgcattcatgggtgtcctctgagttcaatgtaaagtgggacagaacatcctgttttgagaatcaggaggtctagggttctcatcctggtgctgtgtgaccatgagaatctcctcctttctaaatccaatactgggaccgagcaggcaggcaaaggggacaaagagatggcatggggaagagtggattcccgtgttggacctttggtttgattctgttagaccccaacctgtgactggcatggggcagcaggggaggctggatccagtcctttgggttgggggaggtggctggccatcattaggcaggatgtcagcatcccagccaagcaggccatgtccccatggtgggacactggggcacaaggaatggtcactgggcaatgacatacttagattggaatatgaattaatccatccaacaaatagctattta

SEQ ID NO: 48725 - DNA, 1035 bp, Homo sapiens
cagatgaagttcaggtctggagaggggaggcactatgatttgaatgtttgtgtcacttccaaattcatgttgaaacttaatctccaatgcagcaatattaaggggtgcaactttttaggaaggaattaggggatgagcaaccttataaaggagtctgtggccaataagataggttttatttgccctttgtaccttccacgatgtgagaacacagcatttgtcccctctggaagacacagaagtcaaggtgccatcttggaagctgtgactgagccctcaccagatactaaacctgctggtgccttgatcttggacttcccagcctccaaaatggtgagaaataaatttctgttgtttataaattaccctggtccttgggtattttgttatggcagcacagattaagacaggaggtaatttgcttgaagttgcacagctgataaatgacagcagtgggataaaactcagatcttcccaacacccaggtctgtacccataatcactctgctgggctccctatcacttggctccatgaattcagattctatggctgcaaccattggcgtgctcagtcaagagctatccaggctggagtcatgaattcatgactgaaggggtggggaaaggggtcggggaggagatcaagatttaaaatgaaaataagggactggattcgtctttgagggaggagatttttcagtgtttgtaatggtattgtcagttaccttcagcgtttctggctggagaaaggttttgttgttgttttactttaatggggatttgtgggaaacgtatgaaagagagatgggtcagtacttgggggtaggtattcgggaaatggacacaaatgtgatggaggccttggtattgagcttgctatagtccaggggtccctaactcccagaccacagaccctcttaggaactgggctgcacagcaggaggtgagttgtgggcaagtgagcgaagcattatctgtatttacagccactccccatcactcacattacctcctgagttctgcttccagtcagat

SEQ ID NO: 48726 - DNA, 1026 bp, Homo sapiens
gcagctggtcaggctggagtgcagcccacactggcagcgtctgcttccacttgcggcccactcaggcagttcctgccagtggtccaaagtccagccctgctcctggtgaggcccagaggggcctcatcctcgctgggaggcaggcagttggagttgcttctgactcaaccttttagacctctttgtcctcagggttgcccaagtcccctcttttcccattgaccccattccctgggaagccgccggccttgcctgacccgagagggcagcactgggcagggctcacccctccagctggatcacaatgggactaagtgcatggtggctaccaagcgccctcccacacgtgcttctctcaaatgcgaaagcacctccttgttaacaggcattcacgggagagcttaattacatggtttcaggtctaaaacgaccctctgtttgtattaatgccactttctcgttccaaacagaacagcatgtggtcccagctcgtgtgtgacactggccgacggtgtgggcagacacagggaaataagagaacaaggtcgccctggcctcgccctcttctttagccaaaacaatggtggggtcgggggccacagacagagagtgaccaggcccagggctcctttgtggtggaagccagtggctgggagcccacctggagagtgtggagtgggtgtgggagggagagacaggtgggcgaggtgtggacactcaacataggaaagtatttggagacagtcacagttacacactcaacatctgctggcacctacccaagcccagagctcccagagccccgcgggcccccgaggcactcccagtcaagcatgggagacaggccagcacacaggtgatccgtggtcgtgataaatggtcacaaggggccgtgggcacccagaaaatgagctcctactcggccttggaggtgagcagggaaggtgtcctcgggtgaccctggatgaacagtaaaggccaactgggaattgtggggtggagaaggggtgggggtggggctcctag

SEQ ID NO: 48727 - DNA, 1034 bp, Homo sapiens
atgttctgttgagatcacttttcttattaccattctcactagcattgttttgctttatttaagtcttaaattagtaaatgataaatggataacatattcctttcaaaaaattagtctcgaaaatatctggattcattatgaaggtagtttaatcaactctcaggcaattcaagcagacttgaaagtgatctgttagtttcaccataaggaagattttaaattaatatttgatatttggaagaataaaaggctacattagagttagcattaaaattgtatggaatataattttttctatgtgatgtaaaatatcttcctcatggagggctgcagagaatcattacagaagtgtgtctgtgggctgtgggaaatagctcaccctccccatgcctaggaaagaattgccagttgctaaccatcttaacacatccaatactgtttggaatttcaggatccctgcataatccataaattattcaatttgttgggggttcagactttaaattaaaaatggcttccttcctgtagacttactaatggaacacatacaggaaattcgaactttgagaaagcgtttagaagaatctattaaaacaaatgagaagctacggaaacagttggaacggcaaggatctgaatttgttcaaggtaaggaaagaccttcctggaggactgtacatgtctgtgagtgcttcactgtgacgcatttgcctgagtaagcatctgtgtacaaagcaggtgcttgataaatgttcatttttccatcttggagaagtctgccagcctctggcatcctgaattgtgactggcatctcatttaactttggaagctggagagaaatagataggaattttaagataaaacaaagcaatatattgtcttttcatctataatggattataaaaatatcagcattttagcaatctggtaaatttcacatgccagtctaaagatcacacatattcctgcataaacacagttagctccgaatagagtgatcgtccatgaagaacttaaaaacattaccgcccac

SEQ ID NO: 48728 - DNA, 1660 bp, Homo sapiens
ctgggactagacatgatcacatttgccatttaggaagactgctggggttgcttgcagaaggagttggagtgagggatggaacctctttagcctcctcaaccaatgtgccactccttttcatttctgacagatttgtttttttccttctgttctgcctctctcaactgtagtttaacttgggccacttctaagtcaattaagtgggtgcccttggcccatgctgcacttctgcaagccagcagcaagcctgtgcatccatcacactgtctgggcaaagttgcatcaggtgtttacctgttaatgaatgcattgcagccttagagtctttgctgttgtctgagctcatgaataatgagactgtggctgttgacaagaagtaataggaagacgtgggagaaaaaaagagcatcaattaaggagtttatctctaatggagattcatgtgggcttttcacagcattttttttttttctcatggcttaggtggtccttgggaaatacaggttaataaccagatgattgctagaataacgatattgaaacctgcttgggaaccatgagagttttgagatttttaaatccataggccatctcatggttttgggctgggctctcacattctcctggggccttggagccaggcaggcctggttgaaatctaaactgtgcctctgaccaagccgtgagacagtgggccagtttatgatgagccccagttcccccagtctaaatgaggatagtaatccctacctcaaagggtttctgtgaggcccaactaaaatctcaaatgcttggtatagagaggttatttggtaaacagctgccgtcgacccaagtcctcttgggtccctcccctgtaagccatgctgtgggacaggcacaatcccctgcttccccttgttggcttcaaactcaagcgcactgagcctttcttgcttttagaatgtcattgcttaatgctgtagggaaataaaaggtctgactgaagttgcaaacattggggagttactaagagtaaagtaatcgtaagtattcgtaagtcatagtcctggcttgggattttagcatgggagatgatttatctttcaatctcaatggttaaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaaggtaagctaagcctcattaagtgttttaaacatggcctgattaaaacaataatttgccatcttaaccttagtaagcagagtgtggtgacatttgagtatttctctgatgaaaggagatcccattagggccaatgctggtcattcagagtatcctttatcactagagaaagctatggttgttgaaagtgttggcgattggggaaaagccatttttattttttaaatgacgacttaatatgtgacttgccatttcctgcaggctgtgtgtcattgaacttgtatgtcagtgcagatttggttaatttcctattgtttatttcaaactcatcctaaggcagggtcatttcagagactcttctgctttgagttgcccaagagtatctag

SEQ ID NO: 48729 - DNA, 1047 bp, Homo sapiens
ggccgagggtttccaggaacagctgaatcaatgtgctgagctgctggagaaattggaaaagctatttctcaacggtaggtagggtgaggtacgcgagtcttaagacatcagtaattgacccaggacttcttggaggggcacaggaggagctaactccttggccttagttatctttcacccctctgccttgatgaggtgacagcagaaccacactggctgctgcttcctcccagtgaccacttccacatggcttgtggtcggcactgttacaaaccaggagtccagtttagacgcctcaggggccgggctggtgaggtacatgagtgaagccagccagaaggcactgcctctcactcagcagtggtcacgtagttgccagttcttgcatcttacaaattttccagaaaagatgggattttttatttatttatttttttttgtgaaaactcatgtgttttaaatgttggcaagcaaaaaatccagtcaaccaagcaaaatttttatcagttaaaaagtatatcgaagagttaaggatggccagaggaagggtgaaagaaacctttgctatgtgctaggtaaaatttttaaaataatttttttttgagactacagcaaagaactcccatttactgtgcacccagcttcatcagttgttagcatttgccacatttgttttatctttccctgtctgtacacacacgcgctctattattatctttctgagctctatgagagtggattgatgctatgatgttcctttctccctagataattcagggtgtggttcctcagaccaaggaaattctcgtgcataaccatggtattgttatcacaatcagaaaaggtgttgtctaatatactattatctaatatacagcctatatttgaatttttataattaattcaataatgtcttttatgacagtttattctggatcctgatcctggtccgggatccagtctccacgttacatttagttgtcatgtgtctctcgtctcctttaatccggagtagttcctcaccctttcttcttttcgtgatgtgaa

SEQ ID NO: 48730 - DNA, 1266 bp, Homo sapiens
aggagttgataatcctatggcttacctcttttaataggatactctgatatcctgttaaaaggaacatcactgcagcccgagggtgagacaaggagaccagatatccttacagttgtttagttatagaaacacggagaccaagtatcctttcaattgtttagttacagacaagaggatggactttactgatatacatgtgtttgcatccggcctggccacttacctgctttgagcctttggcaagtgtctagtacagtaccttgtacatggtaggagctcagactgtgtgagttcctgtttcccttccattcccaaggaagaaattccaatgtgacatcttcaataatgtggtaggtgggactctgtttagagtccataaggtagcattttgtgtggtgttattttagaacaagcattaggttgactgacggcagtcttccagcttgaaattggctttggcatttgtgcacttgcagatatgttttctgctgccatatgacacacagatttggatccaggaataaagattggtggagactgaggacgaagcaaatgattgttattttccagccctctttgctgaggcatccacctcctcccacgtggtctccttttgccacctcaaactgttcttatccttgaacctgctctctcctcttacctggaatttcagagcagaaagcatctcacttttccgaactgagcagtggaccctgaagagctagtctgaggtctgactcttgaaccttcttgcactgtgacattggactagttgtttgacatctcggttcttcatctggaaagtaagaatgataatgtctcttatcctgtgagttctgggaatgcagagtttacttctggattatgggaaagtgtgcttgaaagcattttatatcctagaatgttcaagaaggggcccttactcttctttccttcttaagagacctcagtgatctcatttcttgggtcccaaatattttctgttttcctcttgggttccttctcctctgctatttaaaaactttaaaaaaaacacagccttattgagatttaattcacatgtcatacagtgcatccctttaaggtatacaattcagtgggtttttttttagtctattcacagagttggacaacaattttaaacattttcatcatcccaaaagaaaccttgtactcattaacagtcatttcccatttcccctgaacttgcccaccccagccctaggcaaccacgaatctactttgtgtctctttcaatttgcctat

SEQ ID NO: 48731 - DNA, 1031 bp, Homo sapiens
gctaaatgggtttagatgatcgtgctgtgtaatttacctgagagagctcctgaaatggcttggaaggaatcttgccagtcatgaaattaagtaattaggctgcatgctagtggctgtgaggggacgtcagcaaagcctcatgtaagcccattataaagaggagaaagaaagctttctttgggaattattcctgggagcccccagaaaggactgccttgctgtcagcgagaggaatcagccctaccgaaatatcttccagtttcgacaacagcttaaaaaataccattgtagttgtgattctgctgtttttgctgagcttgaattaaagttctcttctcattatatctgttgggagccattcctatgtgaggagatactacaggttgttttccttaaaacaaaaaaggagaaacattcagtacatttgtattttttcaattaatcctttaggagtaatttttgcccctttcatattcttcctagtccatccataacagctgcttgggctttggaaccaaaaagagctgtggttttatctctcagtgcctcagtttctctgattacttcttagggttgctgtgatgaataagaaaaaaacgtttaagaaaaatggctggcatttggtgtgatgcgtgttcaataacagtttttagttctcctcctgaatggatagagaaatggaacggtaatgattgcccatgactcttgataagagccaggaaccctagtatttcttctatcattgatggactaagccttacaggcatttcttcagctaaaaaacgggattgaagcattctgtttttgtgagctcagcaaagctaactcctccccaatccctgacatctgtccaatatttttctagcttgagtcttcttggaagacatggtcagtggcaattctggcttattatcagaagtagttaggtgaccgtagtagttggtgcttgagaaatggaggatttcctaaacatcagggtcccaaattttacttcagagttaaaagacactttttgtctgagggccatgtgg

SEQ ID NO: 48732 - DNA, 1090 bp, Homo sapiens
ctgattcgccacaactagcaactctaaccttggttaatttttatttcatggctttggcatttgtttcttcctcttttttgtttgctttttgttttgcattaaaaaaaaaaagacatcactgacttattcatacatattcatgctgcacacttttttgggttgcattttcacaccattccatgctccatgtagcttctggctagcaaggaggacgaggacacgatcaaaattggggaggatgacgagattaatttcctgagtgaccagcatttgcagcagagtaatgaggtaggaacctttcagttaactccttatttcatctactccactctatgtccaaatcagtcttcgagtctggaatgagtccagtgggttttctgttcattctgcctatatcctgtacctttcatgtgccagtggaaagcaaagactaggtcttttccttcttataagttataaactgggtgacagagccagtcatgaaacatgaaaacgagcataaacttgcaaataaaaatgggcttgttatagtagaatagcaggcattggatgtttgacctggacaaatctttagtgatgtaatccaacccattttatgaattagaaactgaaggctttgaggactgatgatttatttggggcacagagtaagttagtgatagagttgggataagaacccttgtttctggactgtgtaaactaccagatcatttagttgaggtgtaaagacctactgatggaacttagctccccttcctaggggccctctgcaatctcctcatctggaacccacgttactgtcatttgggcattgtgagaatctcacccccgtacacatagagcactcttccaatcacattgatactgaacatgtggagcaagcagtctccaaccctctaattcataaaataagtaggagactccaagcagtctccaaggttgaaagaaccctagagactgggatgtggtgggggtaagatgctacagatttggcatttttggccttcagggtgttcaagtttgtggagtcacaaatgggagatcttaaaatgtagatagttttagaaagcaaagtaattaaaagtggggg

SEQ ID NO: 48733 - DNA, 1054 bp, Homo sapiens
ttcttgctgatacactccccatcttgaggactagcacagtttccctgtaactcaggatttctcagcctcagcagtatgaggctttgaggctggataatttttttgtcatgagggcatgtcctgtgctttgtaagatgtttaacaatccccggcctctaccatgggagggtcggcacacctgatcctcccatggcagttgtaacaaccaaaaatgtctccagacatggccaaatgtcccctggcgggtgggggcaaaatcatctccagatgattatcattgctgtaactcatgaaaatcagcaatcttggctcataaatattgtcttctgtatgggagttgttagagtatgtggaaggaaggaaatgatgtttgttgagcatctcatatgtgttagcccctgtcctaacgtctttcccatgtaatatctcatttattcctcaacacaatcgcaaagcaaaggtattattattcccattttgcgtgaggaaatcaggactcagttagttgaactggcttgcccagtagtggtggcgtgctattttgagcttcgatctctctaactccttgtttctgctcctgtctgccctgccccagttccaggaagaggaaggtttttgtttttttctgagtgaagcaccttttgttctcccaactcctcacaccttgaaaagattctcaagttgggaaaacataaatgacagacacaggagcagcagctgtgtacttttcaccctgtcagaaaatggaagagggagtgaagcagttagctttccccagccctaatcgcaggagcttctctaaaacagtctctttttttctccctggttaaatgcctctgcagcatgactgcatccaagcgagtgctgtgctgtgacacctctgtgaggtttttcatcagccttacaaattgatcattatgattgtcttaaaatggaactagatacaagttgctagtagggccctttcccttgcgtgaagactgcttcacaatgaactgtcctcaaagcagcaagcatagaagattagacataatggtttattttccttccaatg

SEQ ID NO: 48734 - DNA, 1033 bp, Homo sapiens
aggatagaggccttgttctagccctgactctcccactttctagctctgtgtccacaggcaagtgctgctctgggcctctgtccatgtgtctgtacacacagggttggcctcagggacttctcagaattgagaagtcctttttttttttttttttgagatggagtcttgctctgttgcccaggctggagtgcagtggcaggatctcggctcactgcaacctccgcctcccgggttcaagcgattctcctgcctcagcctcccaagtagttgggactacaggcacataccaccacgcccggctaattttttgcatttttagtagagatggtgtttcaccatgttagccaggatggtcttgatctcctgacctcaggatccacccacctccgcctcccaaagtgctgggattacaagtgttggtcacctctctctacacagtgggatgggtacagctgaaaggatatgatgtctgggattcatttccaaacagtgcagaagctgaggacgtgggtgggaatatcaaaagaacaagattggccctggctctctgattgttggggctggggtatgtgtagatgggggagaggttcattacagtagttttttttttttccttttgtatatgtctaaaattttctataatgaaaagttaaaaaagaatcacccctcatttctccctctcatatgtcctctgctcttaccatagtgagctctttatcgttccctgggctgtgtgttcctgcctgtaccttcacctgtgtttcctacccttctattcccaacctttcccctactttgtctcctcccagtcctttagaatttagcttgaatgttacatttgtcaggcagcccagctaatccccaaaacagttgcctctctgtgtttctgccctgcgtggggaggtcaccttctgtagccgtctgtgcctgctctgcctcctcacctgtgttggagctccctcagggcaggggtcccaccttactgtctctgctccccagggcctggtacagagtaggcatttgggaaatgttc

SEQ ID NO: 48735 - DNA, 1035 bp, Homo sapiens
catttagttggtgctaggcatcatgctggatattctgtatgcattaactttattttaacattttttcttattttgaaatagttttaaatttgtagaaaaatacaaaaataaaggattgtatttttttctgagccttttgagagaaagttgccaatgtgaagccttgtcccctctgaatgtgctagtgtatatttcttgtaaacaggaacattctcctgtataacctcagcccagccactacaaccaggaaattagcctggactgatttccttcattgctaccttctaatcctcagactcatttgaatttcatcagttgtctcaataacaccctttgtagtgaaaggatcctattcaggatcatgccttgcatttaatagtcttgattctttagtctttagtttggaacagttctaaaatctttccttgactttcataaccttgacacttttgaagtgcctgggccagttataccatagaatgtcccttcagtttgggttgtttgtctggtgttttcttgctgattagattcagtttatgcatctttggcaggaatatcacagtagcgatgctatgttcttctcattgtgtcctgtctgatggtacacagttggatttgccccattactggccatgctaactttgataactttatcaagatagtgtctgccaggtgtcttgactgtctagttatgcttttttccctttgtatttaataagtattttgggggaggtgttttgagtctatgtaaacatcttgacttttacctactagttttagcatccttttgtgtttcttggctgaattatttattactgtgatggttggcgaagggtgatttttctaattccattattctttttacatttattagtcatcatcatttttctataaagaaaaacctactctttttccctcctattcatatcaatatggatttatgaattcctgttttatttggtgggttataatctgttactatcagttattatcagtgggttataaaccattactcattatttcaatgctcaaatc

SEQ ID NO: 48736 - DNA, 1093 bp, Homo sapiens
tagcttaagagtgctccattgtgagaatgtaccatagtttattcctctgttggtggacatttggattgttcacagccttttgctattatgaatagtgcttcagtattgcaaatagtacatatttaaaggtagtcacaatcattctgtatacggtttttttttcctttttctgtaacatgggaataacatgaactttttttatgttattataaattctttgtaaatggtattaagacagtttttttcctgattatgaagataatacaggattatttagaaattgtggaaacttagaaaaataagtaaaaaaaatggaaaattacccacaattcctctacttagatatactgttgttgttttgatgtgttacctcagccttatgacatttgtattaacatttagaaaataatgagcatcttattatctgtacagtttgatactctggtttgttttgactcataattgtgggtgtgtgttttttaaataccgtactctttataattatttctctgttgttgactgtctagtttctttctggttttccagcattttaaataatgttgtgataaatatctgttcataaatcttttgccaaatttcagattattcttatagtggtttttgtaagattttaagtgagaaggatttaaatatacacttgtatactcccttaaatacatctattatcttgctctcttgtagcagtaatttagcaagtcaaacacataagagattgaaatttttgtcaagtaaattccattttttcattttcttctggtaggatcttagaaatgaagttgaaaaattacgcaatgaagtgaatgaaagagagaaagcaatggaaaatcgttacaagagtcttctgagtgaaagcaataaaaaattgcacaatcaagagcaagtgatcaaacatctaacagaaagtaccaatcagaaggacgtgttgcttcaggtactgtaacttttgtatttaaattttttaatttggcatgggttgatttttttaaaaaataattcttttgcagaaatatttatgattacagtaatcattgctatgtttcagaatactttagagctttaattatgtcatttg

SEQ ID NO: 48737 - DNA, 1036 bp, Homo sapiens
caaacatgtatatttatatttctatgtctttccaattctctgtgtgtgtgtgtgatcatgaattcagactgatagcagagttcattctccccttcctttactttttttttttttttttttaaactgagtcttgctgtactgcccaggctggagtgcagtggtgccatcttggctcactgcaacctctgcctctcggattcaagtgattctcctgcctcagcctccttagtagctgggattattggcatgtgccaccatgccctgctcatttttgtatttttcatggagacagagtttcgccatgttggccaagctggtctcaaactcctgacctcaagcgatctgcctgcctcggtctcccaaagtgctgagatgacaggctaacttttaaacttattgtttaataagtaagcaggttctccctcctttttttaccccatgtaatttgtttgttgaatatgttgggttgtttgttctttagagtttttcacattatggattttgctgactgtttctgtaatgtcatttgacttatttctctgttgactgtttctggtaaacagtctaactaccatctaaagtggtagtttagataagatgcatggtcaaattcaggttaaattttttggcaatgttacatcataaatggtcatttgtactttcaaatatttgatagtccctctttttgtgatgttactagctattgatcatttgcaaatggtgataatttgatttcattattccttcttttatagctgaatacgtctataaagagaaacttggtttttcatcacctatttagttaccctgaggtgcagctcatacaggaaagtgaaaacaagttccctagaatcctccaatggtggctgtattattagcttctattgctgctgcaacaaattaccacaaacttggtggcttaacaatacaaatctattatcttgcaattctagaagtcagaagtctcaaatgggtcccactggactaaaatcaaggtgtcggcagggctgcattcctcctgaaggctctagaggag

SEQ ID NO: 48738 - DNA, 1068 bp, Homo sapiens
cacattgtggccgggcgcggtggctcacgcctgtaatcccagcactttgggaggccgaggtgggtggatcacctgaggtgaggagttgaagaccagcctggtcgacatggtgaaatcctgtatcgactaaaaatacaaaaattagctgggtgtggtggcagacacctgtagtcccagctacttgggaggctgaggcaggagaatcacgtgaacctgggaggcagaggtttcagtgagctgagatcgtgccactacactccagcctgggcgacagagcgagactgtctcaaaaaaaaaaaaaaaaaaaaaagcatgttgtgatatccttcacagtgctaaagagggggacttacaattcaactggtagctcctggcagggaaagcaaaaagagaaaatcagttacaaggtctgcagtgtctgtaagatgaacatgtcaagtaaaaggacagcttttgctggcactgaggcccaaggaaagaattgcctctggtgagcttttataaagagtactttgagcagtttatagcatcttcaacaataccccattcaacaaaagcaattctgcatggggccagatcaatgttatccaagtcagtaagcttgaaagtagaagcttttcagtccctgggactatatctagctgtttcccattattctcttttcttggacaagaactacaaaatcagttagaaatgctgcagccctgttttacagatgagccctgacctaaatcctatgtacaggatccagatcaagcagtcctggtttttgtagcgttcttgaattttgatggtaagccaaccattactcttggatatgatcaaaccatcctttgctcatgccaacaacatttattgccagtctcattgtgcctcttctttagcattttgtagggaggcaattcttctgctgaaaattgagcttggatcagaggcttatgaattcactgtgtctcattgtgcacgaacactgagaagttgagccccgagagtcagttctccatgtttgtttgttttaattgcctgtgattgcagtgacctagtgccggttgactcagcatgtgttgt

SEQ ID NO: 48739 - DNA, 1102 bp, Homo sapiens
agctgcatgtttcatagtcaattcttgtatctttcactattagatgacctttttttttagtttaaaacaattatccctcatcccttactgccattataatgtttgtttggtaaaatttggatggccgaggatgagggggtgatacacacacacactctgtctctctctctctctctctgtctctctcgataatatataatatgtagtttttttatatcataacttagtctttgtaatcatttgaaattgctgtataacattacatcaagcgtatatactgtaattttcttaggtatacctctgttgttagacattatttgttggtttcataatttacttattcatgtaaactctggtgcttctagaagaattttgggctgctgtggataaaaagatgtattgctacataacatgtatacgtcttcatatggaggtatttgggaaggagtggaaggggactatgatggcaatagggcagggattggggtgagtatactatgggtaggactttcttgtgagtggtagaaacctagcttgaactaagtttggcagaaagggaacttgattgccttgtgtaactaaactgctggaaggacggggcactggaacactaccaggagcagactctctctctgagagctggcttctttttcttgcatccatactacagttccaagtggctggactcattgccagccacgctgggatcacatcttcccgatttactgcagaagaggaagaagaactcccacactttgctgccctggctggtttcttgtcaggatggccagacgggtgatgtactgagaatcccaatttgggtcacatgcttattgtgccttggcagaagggtgtgtgtgtgtgtgcgtgtgtataacatcattggcagcctccctagaaccacatgtttggaaggggatgagcgggtacccagaaaaagtggtattttgtttcagggcactgggcagaccaaaagcagctgtatactctaagtgctgtcctcaggtgaacatgccagtgactcaggcttcctggcatctcatcgtgactacctttacacatcaagttacatacatgtttccaacaagatgatttggccgtg

SEQ ID NO: 48740 - DNA, 1071 bp, Homo sapiens
atttttagtagagacggggtttcaccgtgttggccaggctagtcttgaactcctgacctcatgatccatctgcctcagcctcccaaagtgctgggattacaggtgtgagccactgtgcccagctgagaatttgtgctttttttctggtcctttaagaaaatacttctttcatacaaccatccacatcataagaaacattatcttatgttattccaaaatcttcctattatttttgctttggtttctgaatgttgtctatgttaatctttttcttttctttttttcccccacggcgaaaaagagcccaggtttcttggtttgtttcatgaggtatgaaaattagctcatcttgcttctctgccttctcttctaggggtctgaagactatgagactgctctatcaggaaaggaagccctttcggctgcgctgcgctcacaaaacctcaccaagagtacagagaaccacagactgcgtagaagcattaagaagatcacccaggagctgagtgacttgcagcaggagagggagagactggagaaggacctggaggaagcccatcgagagaagagcaaaggagactgcaccatccgtgtgagtaccgccctgcccttctgacacagtggacagtgcttttggggctatgtggctgtgtctggttgtagggtgatattcagtacagaagacttaagaaaatatttcacttattatctcagtacctagaaatgaccagcttcatttgatctatttggtatttcagtccttttattctcctcgctctctctctctctctctctctctctctctctcacacacacacacacacacacacacacacacacacacacacacacagagttgttatcgagttgaaaatacagttttgtatcgtgcttttttaagtttaatgttctctctctggtttgttgccatgtcatgaatgttcttcaaaaacaattttttttgtgccagcataatatttcatcacttggatgtattacagtttatttaactagttcttttttgaacggcatttagattattttactttttttttgccttatgacttctgc

SEQ ID NO: 48741 - DNA, 1167 bp, Homo sapiens
gcaactccctttgttccagtcagttaagaggaagacatttggttggagaacattgcggtgctccttatagacagcttgccccatgtggttgtagctttaagtgagaaccctgaaatcttatattgaaatgacacatgccatgatgtggtctcctgttttccatccacatgttttatttttttttaagctgtaacacgttcccactgctgcatccaccacatgcatgattgtaaacaaccaccagtaattgctttggaatgggaaaaacacaccgcagaattgcttgtaaatttgcttggtggagggcatacaatttttaaatcagccttccttgtatgacatttatgccttgatatttgaatgctctggctgttagaagcttggagcatttacataattgttccaagtctcacaaaatctaggtctttcttttgagaccaccagtgtttaataattcccttttccctgtgccctgaggctaatgagggtttttggaatctaacatctgcctattacaagcatcctgtagtcagtctgtgctggaagcagtttccccattgttgacattcataggtcctctattttacattgtttcttttctttcttaatcttgttttgtagaacattgagctcaaggtggaagtagaaagtctgaagcgggaactccaggagagagagcagctgctcatcaaagcctcgtgagtaccatcatccgttgaaagcttgcaagtcgcccacactgggttggtcagtgaaatagagccgtacacttttctaagacagttggtttccatctggactctgaggactgcaaggaggtttttgtttttacttaattatttacttttcaacaagcttttaagatataccatgcttatagaaaaatgaacagatcttaagtgtacagcgtgaatgttcacaagcaaacacacctgtggagctaccatccagatcaggaaacagaacatgccagccccccagaagccctctttgtgttctcagagctcacctttctcccctaaagataactaccattctgaccactgttagttctgcctgtttttaaactttatataaaaggaattatatagtagattctcttttgtgtctggcttctttcctcaacaatatatttgtgagattgatctatgttgttaattatatcag

SEQ ID NO: 48742 - DNA, 1035 bp, Homo sapiens
tcttaagtacattagcatgtgtctctttcttaggacattttcctgtaaaatcatattattacctaatataaaattgttattcaagtttccccgggtatcatcatatggttgtttctgtaaaaaattcaagattctattgtacttagtagtcatgcctcttcaacctccttttatttagaagagttcaccaaacatttttgccttaggattgccattaagatttttgaagagttcagttctgttgttttgcagaatgttcttcaacttagatttatctggtagactcctcttgattagatacaggttaaaggttatagacagaagcactttggatggaattatttgctctcattgatttatttcaggaggaaaataatgttagtttatcccttcaatggtgataagagatgaatttttttggtcaagatggtgttcgcaagtttcctaaattgtaaggttaccttttccttttgtaattaataagccatttgtgggtgatatgttatgactgtctgaatattatgttctgtagtgatctttcatctaatgcttttagtgctgctgattcttaccttaatcaatcattactgtagaggttttaaaatagtgattttctgttccttgtattctacatttattaactggatttcttttgaaaagaagaaattcttcttttccttttcttcttattatcagtgtggagttttgaattctttctttattcagtcattattcattcctgtcattattcattttaatgctcaaattgtactaactttggctagtgggaaccacttaattcttctgggttagtagaatggtagcaaaaataagctttctctagtatttaacatttgaatcagttttgtagcctcgtaatccatagcgactaatgtatgtactatctgttggaccctctgtcttttgtttgcttttgatgacccttctgtgatatttttcagcaaatcactgaattgaagaaagaaaactttaacctaaagctccgcatctatttccttgaggaaagaatgcaac

SEQ ID NO: 48743 - DNA, 1034 bp, Homo sapiens
gatgtactagcgtccaagtgtagcttttcacattttgccctatttcattttagttattttaaaaatcagctttattgagatataatttacataaaataaaatgcaccaattttaggtgttggatgaactctgacagatgtatattcccttgtaatcactattgtaatctatatgtatgtatgtgtggttatagttttttatatgtgtgtgcagttcttggcacgtgtaatgatcaccacaatcagaatatagaacagttccgtaatatcaacaacttcccttttttttgcttctttgtggtcaaatcctctcttcaccccaagcctgtggcaactaatgccctgttctctgtccttgtaattttgcttttcccagaatgtcgtataaatggaatcatacagtatgtaatcttttcagactgtcttctttgcctcagcataatgtctttgaattttatttacgttgtgtgtttcatagttgctgagcactattctgtcatatggatgtctactgtttatccattcaccctctgagggacgtaagagtttctcccagcttttggtgattattaataaagctgcagtaaacatttatgtacaggttttttgtgtgaacataggttttcatgtctctaggataaatacctaggagtggaattgttgagtcacatgttaagtctagttttttttgcaagaaattgccaaactatatctagagtgtctgtgccattttgcattcgcatcagcagagtatgagaacaccatttattctacatcagcacttggtattatcgattaaaaaattttattttaccaggcacggtggctcacatattccagcactttgggaggcccagtcctctcatttaacagatatggaagctgaggtccacagagaagtgatctgccgggccaggcagggtggctcacgcctgtaatcccagcactttgggaggccaaggcgggcggatcacttgaggtcaggagttcgagaccagcctggccaacatggtgaaacctcgtctctatttaaaa

SEQ ID NO: 48744 - DNA, 1024 bp, Homo sapiens
tctgctctaatccaaagattccgttgactacaaccactgccctgggttctgccccatcagtgttcagtttctgtacatccttctgtgatgtttctttgaccttggaataaaatccctaatcttggcccatgagaacccgtcctgtgtgatcgacagcttcctgtctttctgaactcagcatattcctctccccgtcgtacactgctctagccacacaggctgctgttcctcagccacacccagcttgtccctgtgccagggcctacgtgcatgctccaccctctgcctggacaccctttctccctttccttgaatggcaggcccctggaccttcttgcctcaacttgaatgtggccttgttagagaggctaccccaactcccttctcaactcatgattctgtcttctagcaagtactcagcgccctgtctctcccaccatgactcttgtgacagtttgtggttatttctttattagtgtacttgcttaacatgtgtctctattcaatgtctggtactcaacgctgaacctaacaaaatcgtaggcatctaatatttgttgattgaatgaatgtgtaaccttgtatggaatactaaagctccaaattttggttgctttatctgtaaaactgggaaaaatgtttatctgaggcttgtggtgaggagtaaataacatgctaggatagtgcctgctataccagatctttagcaaacagggcggctactgtggttattgttactaaagtggctggagaggagatatacctagagacatatctagaggcagacagcttataatgaggatgggggcatgcggggccagagtcaggaaagcaagcagtaatgagggcaaggtgaggctaagagtgggagaatgagggtgaacttagaacatggcaggagtgtaagaattgtgtgggatgccgctcagtggaagtggctgaagaccaggtctgtagctggcagagcgagtgtcatagccactttccacggagctctgtgcacaacatatagcctgacggtgct

SEQ ID NO: 48745 - DNA, 1029 bp, Homo sapiens
aggctggtgtcgaactcttgacctcaggtgatctgcccgccttggcctcccaaagtgctgggttacaggagtgagccaccccgcctggccctcattgtggtattgattacatgttaatggctactgatgtgttgagcatctttccatgtgccttttagccatttgttcactttctttggagaaatgtgtattcaaatccatcgtccatttaaaaaacgtgaatatattttgacccagcaattccacttcttgtcatctattctagagaaatcctcatacttgtgcatatgggaccttataaggacattcatatgacattgcatgtaaaagaaaaacttggaaacaaattgaattatcatcagtaggggattgggtaaatacacatcctttcaaaagtatctttcagactgtggcccgttggtagctcatgaaattcaatttagtaggttgcaaccaggatttagaaaaatagaacagaatagaaaacatttcaaggatgaagggtaataatatttcttctgtggctcatggtcagtaaggtttgaagaacactgctgtagaaagctttgtaggagttgaaaactttgaggcatatctatttgtactgtcatgaaaacatcatgagggcatattaagtagaagaaggatgttgtagcatgatgtatactgtttgattgcatgtgtttttaagcagcaaaattgaaactatctatgtaaaaacacataaaaagttctggaagttataggtctttttgaaaacagtgattacctcctaggcgggttctagatgggagcgaggaggagccaaggagaactttaggcttatctgtatttttttaaatttatgtatttttctctaattaagaataaaatagaatgaaaaaggggttgttaaaagacaaaagtgagtttgtttgtgtaatcgttgtcagaatgtgatatctggtctcatccatgactctcatgaaacaatttgtcaaggagacataagaccccttgggtcttatggtttgagtggacaattgttgc

SEQ ID NO: 48746 - DNA, 1054 bp, Homo sapiens
ccaccgcgcccggcgtgagaactattttttaaatataaatctgctcttcacagtctgctgctttatacttttaatgctgcttattgctgttatcataacttccattattattctctcagatagccattcttatttcagtgctttttggccagacacttgggttttggggtcccaggcctagctgggttttaatcccagttctgctacttaacaaccccttgatctggggcaagtcactcatcatctgtgagcctcagtgtttatcatctgtaaaaggggttggtataaagcctagggttggcataaggattaaaatgaatcttaaaaagtttagctcagtgtctgacccagagtaactactcaacagatcagcaaatattctcctttccctcatctccctgcctttgcaggacgtagatactgcatacattccatcttaaccattttaaagcatggttcagttgtattaaatatatttgtattattgctcaacggtcaccactatctatcttcgtaactctccatcttgcaaaacagaaactgtgtccctgttaaaacagtaactccctattccccccttctcccagcctctgacaatcaccattctactttctgtctctatgattttttttttttttttttgagacagggtctcgctttgttgcccaggctggagtgcagtggagtgatcttggctcactgcaacctccgcctccagagttcaagcaattctcatggttcagccacttagtggccgggactacaggcatgccccactacgcctggctaatttttgtatttttggtagagacggggtttcaccaggttgaccaggctggtcttgaactcctggcctcaagtgttgtgcctgcctcggcctcccagagtgctgggattataggtatgtgccattgcgcccagcctgtctctatgattttgactactctaagtgtcgcgtataagtagaatcatacactatttgtccttctgtgactggtttatttaacttagcattatgtcctcaaggttcatgcgtgttgtagtatgtgtcaga

SEQ ID NO: 48747 - DNA, 1427 bp, Homo sapiens
cctgtaatcccagcactttgggaggccgaggtgggtggatcatgaggtcaggagttcgagaccagcctgaccaacatggtgaaaccccatctctactaaaaatacaaaaattagccgggcatgctggcgggtgcctgtaatcccagctacacaggaggctgagacaggagaatcgcttgaaccggggaggcggaggttgcagtgtgccgagatcatgccattgcactccagcctgggccacagagcaagactctgtctcaaaaaaaaaaaaaaaatcctattataccttttaaaattgaatgctatatattttagaataataatagcttaaactgaatacttgctaggcattatcctaagccctttgcagttattaatttatgtaattttcatagcaaccatataatgtagacactattattattattctcatttgtacaggaaaaaaaatgcaagttaggtaatttgcctaatttgctgcataactgccagtaagtaaaagagttggaattaaaacatttgcagtctggatctagagtatatactcctatccactatgctggtacagcctttctcaaaatctcagatattgagcaaagagagtgagtattgtaagaaattcaatgctgtggtgcagacttcttgatattttctaaaaatttcttctagttgtcttttggtaatcagacactgaccctggtgtgatgtagctcatgttatgtaaataataactcttctttgtaaggactaatcctagttttggcgtagtagaaattagagcatgaaaggaccagccctttgatgaacaaataccaattgcaatatctgttatattgcccttcctttttattaggcactttggaatattgcttttgctcttgtcaagaaatttataatctaatctgtgcaaaactatgaaacacatacaatacaaaatagtttatgaatatctgcttaatttgtaagtatagtagttcagagtagaaaaagaacaggagtaagtaaattaaagtgtaataggaaaggctttccataggaggtggaggtcttacaggttatgatttagagtggcagagagatgagaagacctatcaggagaaaaaaaaaaacatgaaaattccagtgaatttcctgattatacaatgacataagaaatctgatatcctaacaccaaattctcttctgttgtgacctctctgttctcttttaaaaaatgagagtagaaaagtggattcaattctatcctgattccctcatatattgaaagtctatggaactaacaattggcttttaaaaaattcatttccctattctttatgcccatatatttcagtgggagtcaccccagtgagggtagattttggctgcaggagccagatgtgggttgagcaatgtctttgtgtgcaaacacaaagttctttatgtac

SEQ ID NO: 48748 - DNA, 1087 bp, Homo sapiens
agtcatgagtgaaagtgaaagcctaggatattattgtacactactgtagaatttataaagtctgcacacttaggctacactaaatttatttttaaaaagttttcttcaatagtaaattaatcttagcttactctagctttttaacattatgatctctgatgttttaaactttttgactctttttgataacacttagcttaaacataagtccattgtacagttgtacaaaaatattttcttttttatatccttattctataagcttttttctattttaaaattttattttttacttattaaacttttgtgttaaaaactacgacgtaaatatacacattagcctaggcctacacaaagtcaggaccaatagtactgtcttccacctccacatttcatcccactagaaggtcttcgggggaataacatgcatggagctgtcatccatgataacagtgctttcttttgggatacctcatgaagaaactgcctgaggctgttctagttaactttttaaaaatcgtagatgtacactctaacataacaataaaaactgtagtatagtaaatacatgaaccagtaagtcatttattttcattattaagtattatgtactgtgtataattgtacatgctatacttttatatgattggcagtgcagtaggtttgtttacaccaacatcaccatgaacacatgagtaatatgttgcagtgtgttaccacagctatgatctcactaggtgatcggaatttttcagcttcattataatcttaagggaccatcatgatatattccatacgtcattgacggaaatgtcatcatgttgcacctgactgtattatttttccctgttctatatggactattttctatgtgtgcctacctgatagcttctgttatccttagtagttttcctttttttaatgaggtaacacatggttttatattatcctcatagcatcaaagtgtgttgatttctaaaatcctttatcatcttcttctaagtgaaatctggaaggatcttccttcccctgcagctcatgcaggtaatggttgttttctgtctcacactcttacttctggacctgg

SEQ ID NO: 48749 - DNA, 1084 bp, Homo sapiens
tcttaattttcacagcaactccttatatataggttactaggtcacaaagatagtaagtgccagagaaagaattccaaattaggtcttcaattccaagtccagtgtcttcactaccatagcataccgtagcatgtagattctataatgagaaaactgataatcactctattctttgagattgagaatagagtggtagcttaacgctgttccctccactccccctaaaacatgctcatacaagttagattcagaagtttcacattgcttaccgttttaaaagataagccattgttaagtttgttcattctggtgtctcatggagtgtccactactttctttggaataatattctgcaaacatatttgtggagaaatagaaaagtgtttacttctaggcccagtgctttattagaagagaaagaaataaaggaaggattaagagagagttttataatagaagctgtaaaagaggaaaaaacagtaatactgatatttatgtactatcttactgtattcataattctactgcaaattattcctgatttatcttttctctgacagttaatgctaccaagtttaatgctgaaaccctatcctgaaaataggtggtaaccataaagtaatggaaaagtacactagactagtaatctaaaggcctagggcaggggtctgcagagtatggcctatgaacctaatccaccccactgcctgtttttgtaaagttttattggaacatagttccatgcatttatttatgtattgtctatggctgcttttgtgctatagtggcagcattgactagttgtgatagagactgtatgggctgcaaacataaaatatttactatttggcctttttggaaaaagtttacccacgcctggtttatatggtggtttatatccaatcatggtgggtatttttaggtaatcatgtaactttaggcagttcactttaacctttattttattcattattttattttattttgagacagagtcgcaccgtatacccaggctggtcttgaactcctgggctcaagcgatcctcctgcgttggcctcccaaagtgctgggattataggcatg

SEQ ID NO: 48750 - DNA, 1069 bp, Homo sapiens
cataataacatgcacatgctcttggcatttatttttctggctatcttcatctctcaattggattttttttagcaggctgctaaaaagtctctttgcattcattctttccctggtccattttcacactgtagccagaattatgtttctaagatgtagatctgattattcttcctctcttgtataaaattcttccatggctatccagttgctcttaggaaagtccttcacctgtcaccacttcttaccccattctgtgtcccagccacaatgcactttttccagttctctatagtactatgctctcttttgccttgatgttgttacacatgctgctccttgccttggggatactcctctcctctacccttagcttagctatacctcctcattcttcacgtccatgcttagatatttcttcctctagaaagtctgaattaggtggttctccatgtgcaaacacatgtaccataatgttctattcatatttctgtttcaatacttatcacacgatattgcttctttgtttttctctctgctataagacattaagctgtataagaacaatgaccacgtctgtctttctcattgttgtatctccagcacctagaaattgtagtctgtatttctggcacaacactagtttgttgatgattgaaccagtgattaatgtgctttgccaggaatcttttctctagaaacctcagagaagaattacagttctctggttttgtgctctgcatatttttctatcttctattcatactaattcaattatcaacagaacattgctttgaaccttttaaacctctctaccttgcccagaagcacgtgtaaagaacatgtaaaatgaaaaactcctgcatatacttaccatacgcttcctatgtccatcctatctaaaattgcactcccacaacacacatgtagttactctccacctccatctcccctgtctccctttcctgctgtttttcctccttaggatttaactaccttctaacatactaaatacttaacctatttaagtaactaattgtgtgtccatttctaagatgtaaggtccatgagg

SEQ ID NO: 48751 - DNA, 1048 bp, Homo sapiens
gtaagattgagagtaggaattcattgagattttaatgaattccatggattgtcttaagagctatctaaacttggaagaaaaataacttccagagcatctaaaattgaaaataaaagatcagaagcaaatgaaagatcaattccacacagcttttcctctcttagacgtccctcttctgccatatcctgtaaacatctgaagtgttctgagtacatttggagagaatatttaatgatcacactgtgattagacatgagtagtccctgccagtgggatgttcctgtcctttgcattttaaccacatgttctgtgctctctgtggtaaagataatctaacagtaataaaaacttatggagaaaattacccagagctcctttatcattacgatttttaatactctcttctaatccttatgcacatgtgtatggatttatgtactgcaaatcattgttttgtaatacattctcaaaaatgtgctttaggtttttacaactaccataatattttgtaattttccttcattactgtaatttgctaaaccatttctgttttggtagataattaggtagtttccagttctgctttttagaagatactacagagaacttctttgtgcatatttccttagaacaagttccagtagaagacttactcgcaaaagcagtggaattttttcttagtattttctgttacaggtacagaagagtgcatacaacacacagttttgtcgaatagttatgaagtgaacacttgtctaaccactgcccgagtcaagaaagaacatttctaaacatgtttgccaatttaatagatataaaggaagtatctcaaggttgctttaactgacatttctttaacacatgacaacatttttatgggggaggggactagagagaaaatgacatatttttatgtgtgcttatttgtatctcttgaattctgtctgcatcttttacccattacactttcaaatacttgtgaaatcattggtcgagatgaattatggctataaataaaatttcactaatctaattatcactgatttag

SEQ ID NO: 48752 - DNA, 1004 bp, Homo sapiens
aagtatgggctttatctgctgggacatgcctgaacacactcaccgggcacacggaatgggtcaccaaggtaggaagacttggaagaagtctcctgcttatcaggctttttgagggagggcgtggaggatggtagacactgccttataagtgttaggtgagtcataagatggaattgctgtacctacaaagcataatggtacacaacagtgaccagcaagtagaaggtacttaatacatggtttaacaaataaatgacttatggacatggaaagttgcccacaatatattaggtggatagagggggcaaataaaacagattacatacaaaaaaatatgtagagtgtgataccggtttctgaatgtgttcatgcatcaaaatgttgaaggtgggtatttctggtgggattgtgggcgtgtttttccctttagaataaacatgtttctttcttaatcagaaaagcaattttcattttgaaaaaataacgcttacaagaagtaggacaaagaaaactgtacaggatctttagtaaaatattgtaatgttttcttttttaaaaaaaacaagattgttgtgaggatcaaatgcagtattaataatggatataccacgcagaagcacttttcttgagtttaccatcccattctatgagggggctgagaaaacaggagtaagcaaaatagacccagtccttaccctgtggatgatagtctaataggagaaatagttttattaaacaatttcatgggtaaatatatcatttcaaattgtgttaagttttgtgaaggaacagtacagtgttctataagacagtctagggccaggcacagaggcttacatgtgtaatcccagcactttgggaggccaaggcgggcggatcacctgagcccaggagttcgaggccagcctggccaacatggtgaaactccgtcgctactgaaagtacaaaaatcagccaggcgtaatcccagctactcaggaggctgagacaggggaattaacttg

SEQ ID NO: 48753 - DNA, 1024 bp, Homo sapiens
cggcccaacatttcttttttaatgtaactattaggacattttaaattatatctgcagtttgcattatattttctgttggatagcaccgttctagaccattggctctcaaaatattgctgatgagttagaatcacctggcaaacttttaagattattggaccctgcctcagatgttccccaagttaaactctctgaaaatagggacctgcctgtgtgttttgataaagttgtatcacatggccattgagaaccaaccaagtcctacccctctttttatacagaaggaaacagtctaaatagcaaagtgacaataaatacagtctttatttcagtatgctatcatagttttcccaggttaaaattcatactctagctctttcataagtgatggctatttttccattgtctcaaacagtggttcttgactgaaggtagaattgtggctggctttagtcatttcagctttttaaaaactggtcatttggtgctttcctaggatactgtgccattatcatagtgactgtatttagtggattctcaaaaatgtctttttatttgttgaggcttattgaagggtcattgtaagaatgaattaatcattaggattttaaacttaaagcaaagtcctgaattgtcaccatgattagtatagaattttcatcagaggcagaaataaagccaacttttcccttcagaatcttaagaggctttacaaactttttgttgagttgtgaatatctggggataatttatcccaggttttccttgaggtttcttccttcacgtatttcaagatgactggagcaattagcagttagcttttgcagaagttagcccaggctctgaggtttgtccttgacttgccttagagtggaatatatttcagcaaacacctttactatttaacaatccttatttgttcagaactgttgggtaatggacaagcatgcaagtgtaaacatgcagtcatgtgtaatacctatttatttgaagtcaaatcagagagctcgtgatagccaaggat

SEQ ID NO: 48754 - DNA, 1051 bp, Homo sapiens
attttttgtagagacaggatttcaccatgttgcccaggctggtctcgaactcctgggctcaagcactccgcccgtctcagcctcccaaaatgctaggattactggtgtgagccactatgcctaggtcctcttgctttaaaaagtttttttcttctctcatcaaaccttatttttgaaatgtagtaaaaactgcagttacttggagtggaagtaaatgggaaatattcactgaattctctaactacctggaaagttaatatctacaattctacattttaagattattctcttggtgggtctgtatgttaatgtgatttttattctgattaaattcatcaggtttgcatatttaaaattacgctgtgcagtggttgaaaatgatccaaagtattagtttaatttttctaacagcagcatccctggaactgtgaagagaggtatttgtgacagaattgtacatgtgtttgtgtcatcttgttacttaagagattgaattctcattgtggtggaattgggaaaccctgaatttggcaataaacttagtgactctcacattagtgccttgagtaagcaatagacagttttattgaagagattaatggctaatgacattgaggtagttatctttctctttcgcaatttatttctgaaatggtaagaaaggaatctattatgctttgtgctgttcagtagatatttacttatgggatgcctactgtttgaaaaacaatgtgagggcatacacggatgaattagagcagttttttcttgtggaacatacacactgggaccaggaagatgacctgactgaggtaaaagtctctgtgtggactatagcaaatcaagaacacttgcctttctaaagagtgcagctggtgctccattgtaataaattattgccatgtgggtgggattcagggtcagagttgttagatctgacttcaagagaagcctgaaatctagagttctgtgcaatagtctgattttttttaaagtattattaagatttttaagatactgaatggggagggatttttttctttcgtgcagt

SEQ ID NO: 48755 - DNA, 1137 bp, Homo sapiens
tgttaaagtatgttttctcaaatgtgttttcttttgtgtgcatggaaagtgttcagataaatatggtgtattaactgtaaagttgtaatgtaactacgcataaagttgtaatggcagattttttacactaatttttaatacttcatttgttagcagtcttgcttgaacagtctttttgagcagaactaatacaatattttgatgtgccacaggtaaatttttccataaccttatggagagaaaggactttgagacatggcttgataacatttctgttacatttctttctctgacggacttgcagaaaaatgaaactctggatcacctgattagtctgagtggggcagtccagctcaggcatctctccaataacctagagactctcctcaagcgggacttcctcaaactccttcccctggagctcagtttttatttgttaaaatggctcgatcctcagactttactcacatgctgcctcgtctctaaacagtggaataaggtgataagtgcctgtacagaggtgtggcagactgcatgtaaaaatttgggctggcagatagatgattctgttcaggacgctttgcactggaagaaggtttatttgaaggctattttgagaatgaagcaactggaggaccatgaagcctttgaaacctcgtcattaattggacacagtgccagagtgtatgcactttactacaaagatggacttctctgtacaggtaagagatgttgaaactgctttttgggttttgttttgtatttcatagggtgtaatcttgaaccagtcttgagctttgagaatgacaagtgttgattatatgagatatgtacagtgactttttttctctaatcctgagtggttccccccccttatcctcttccttctctctagagaacacaatcatttttataaaattttatgagaaaaacacttcagactgtcttttaaacattatgtgaattacaaagctatagattactttttctttgtgtttcctccatgtgtagtcctctgttgctaaattctgtttctttttctgttggcactgatatttgaggaaaaaaacagtggaaaaattggtatctaatcctagcaagtagttagatcattatggccaaattacttaacctctc

SEQ ID NO: 48756 - DNA, 1046 bp, Homo sapiens
gctgtggcctccagcttggctggttttgcaggccgccagcaggaaggcgaaggtggtagtacagcaagaggcactggcggggcagcaggcctgcaggagctgtttttccattgctaggcctgacccctctctacctgtgagcgttcagggggtccctgagatagtttagatgcccccccatcttagacctcagctcccacagtgccttttaagggggacctcacctcctgtgcacagcccacccactttcctctgcttccctggcacagcccaggcatagacgagctggcgttggacccagttcttcccccttttcagccccacagctgctgccacaggggccaactagggccaggtggaaggggagctgagaagccaacccctagcccaggggtgctgtgggaactgggatccaatttgtagcttcctgcctggcttcagagagcccagcaaccttctaggcctgctttccagacttctgagatagcctgggatgagcaatcctgttatagtacatctggaccttccctacctgggctctggggaggctgtgggcctggagagggaaaaggagggagggggtgtctgcaccacctgggaagatagcacaaggcctaatgaggtcaccctgactccccaccccagcatttcattcataccagataatagctgcattactgccaactgaccttataaccctctgcaccttcaaaaagattcatggtttttaattgctgcttttaataacatttgttaaagttataattaatgtgtctgatttatgatttaaaacctccctttgaacaatcacttgtcttccctatagtgaattagctgctgggtggcagaaggaattggctctggcttttgcacttggtttactggaggctgaggaggaatggcaggaccctgtcctctggccaccttgccactcctaccactgccagcaacattctcacccttactgccagagagaatatggaatcttttgtgagtacccgacctttgggggcaaaaaacattagttgagtgccactgagaggtaa

SEQ ID NO: 48757 - DNA, 1037 bp, Homo sapiens
ttattggatatgttttctgtaacttgcaagtataatttaaactagtggatctttcaaccaaccctaaaaggagacagcaaactacaacttatcatcaacctaaaagaggtctcggccaggcacggtggcccatgcctgtaatcccagcactttgggaggctgaggtgggtggatcgcctgaggtcgggagtttgtagaccagcctgaccaacatggtgaaaccccatctctactaacatacaaaaaattggccaggcatggtggcgcgcacctgtagtcccagctactcaggaggctgaggcaggaaaatcacttgaacccaggaggcggaggttgcagtgagccgtcatcatgccactgtactccagcctagcaacagagcaagactctgtctcaaaaaaaaaagtccttaaacctgttctaagaaggaaaaactagcatttattgagtatcaactgtcaggtgctttcatgtccattatctcatttatcttccccataagccattttacacaggaggaaaaggctgggaggctcagagctatgaactgatttgcccgtgttcacacaggggtagttattagcactcacaatgtctgactccaaaattctgcctttcccatcactccatatatattgtatgaaaaaacgcttaattttaaattaagacataaataaaagaaggatgatatcttaaggcacagggtccttagtttgcagttggcttcatgctcctacttacctgggtaagtcttgttactttttccaactcttccttgagctggttggcttcagcatcccttaggtttagccgagcctctagctcagcttcataggcactgagatctccctgggtctgctgcaaagatgcattcacctcatgctgctcttggagggcactttctagctctgcaagctcctagaaagattcagtgggtttaactatggaaccctcactgtgctgcttaagcatttgcaaggcattataagtaacttgagcactgtaaaccaaatgctggccagctactgatgcctgcc

SEQ ID NO: 48758 - DNA, 1077 bp, Homo sapiens
cttatctacctctaccaagtctttgctaagacaagtttttcagagagttgaaggcggcataatctatatttttctgaatctcctctagattatacaccccacggcttttaagtactttctatgtaatatattaaatcctatcttacgagtttcctcttggctcagcgtggtggctcacgcctgtaatcccagcattttgggaggccgaggcaggaggatcgcttgagcccaggagtttgagaccagccctggcaacccagcaagacctccatctctacaaaaaattttaaaaagtggccaagccaagtggtgtgtgcctgtagtcccagctacatgggaggctgaggtgggaggatcacttgagcctgggaggtcaaggctgcagtgagctgtgatggtaccaatgcactccagcctgggcggtagggcaagaccttgtctcaaaaaagacaaaaaacaacctcaggctattgttttgtttttaaaaagagctgctgcttacctgattttgtccaagttgagagtcctctgtgagggaagactccagctgagacagactgggtgatgacgctgaatctgcagaggtgctggtgaccaattcccctaaagcatctacttgtctcctcaaactgtgtaaagtgccctctgtctgccgctttcctttaattaatacttctgcttgcttggacatacagtgtcggagttgggcctgaaaagtgtgataagacttagggttttacacagaagaaatgtaccagaactgccgctcagcttcctcacatacatttgataggcaaatctggctaacagtaggaatggctgtcaaaaatgctcatctttaaaaagaattgtaggaggtgccaggtggatacttagtgtgcataaacctttacttttctgtgttgtcattaacggggtctttcacttggcccagtttttccatgctagcagtgcttaggatttctgtatcccttgcttctccattaaattattgcctcatctcttttttccttttctgttatgactgagaagatcagtttatacttgacaactggagtgtctcctgattatgtattt

SEQ ID NO: 48759 - DNA, 1555 bp, Homo sapiens
cgcggcgccggcctgacaggactcctgggcgggggcggaggtgtcccctgcgcggctccggcctgagcctcctgccctccccaaccggcggggcgctccgaggcgtgcagggaagggtgtgttccggcctcgccttccccgccttctcggcgcggctgggcaggaccgcatctcccgcgggcccccctctcgccgctgttccccgcggccgcagcccgcccccgcagggtgtacccacgcgtgccgcgccgccctgcagcccgcaagccccagacgtggcggtcccgtcccgtaggccgcgtctggctctgagtacaaaggcagctcttcgcagccctcttggcgtctcggggcagctccggtgtccttgtcgatgtggggagcccggccctgcagccgggccgggccggggccggggtctgggtctgtgcgcctgtgcttgcgatgtcctggttttggtgcgttcctgtgaggcccgtggacagcctctacggccctgaacctacagagcatctagaaataagagaaagttgtggcatttctagaatctaagagaagacgacagagctggagtgttttaagcgttttaactgtgggccaggtacatatttatgtatttttgtacctatttatcttgccccgcgtagccctcggagataagttgtctccacttcataagtgaggaaactgaggcctaaagttgtgatgtgtgtctggctgttgatggtacattacaaactggcttcggctcacactgtggctggtggtttctgtactacattcaaaaattaggctagggttacagacatgaccatttataatgtagttacaactttattccttttttactgtgttcgcattggatgacagctgattacccttttatgacctaaagtccataaagtcaaccactacactggcaaatcctcatgcttacaaaccccaaaggagagatgccaggatttcagtttcatatatgaagaagaaacgggttccaagaggacaggtgccttcctggtgaccccacagcaagtgtcagagcccagatttgaactcttgcaaagtttactgctcatttcgttactatcccaactgcctttaaaaaattcttttatttttctaaggtaaatattgtagaggaacaactgccttttatttagatttgattgttgaagacaaacttgaccttgcagtaatccagctcctacccctttattcccccaagcctttccaaattttttcttccaagttctgtttaggcagttttatttgatcatgcctagaggtatgtcgtggttaagagttttggagtcatactgtcaagggttctccctccagtactgccacttcctagttaagtgatcttaagcaagttacttaacctttcggactcagtgtccttatctataaaggggataattggacctgcatcttagagttgttgctaggattaaatggggtttaaagaaagcccttagcacattgcttggcatatagtaaatcagtgcctgtaacagtgccaggcacatagtgggtgtttaatatcttttgaatg

SEQ ID NO: 48760 - DNA, 1096 bp, Homo sapiens
tcctctaccccatgaggccctagcaggattgtccgtcacttgatcccactcacaagccccaaacaggtcctggttccaccacaagctaacccaactgactcttccaagaatttgtatcttgagaaaaaggatacttggccagaaggatattgacgcagaatcatctggaaagcaggccctaaagagatgtccaggaatttttgcctctcccgaggcctgattgttgaagttctcttttggttccaggagccacccaatatacttccagtacattctctttctttgcttaggtttgcttctgttacagagcatatagatatcagcacccaagagctgattgcagacagcagactttgttatgagttgaattgttatgagttgaatccccaacccctacacaaaacagtgttgaagtcctgtcctctaggatgtctgaatgcaaccttaattggaaatagggtctttacagaaataatcaagttaaaatgaggtaatcaggctaggccctaatagtaatataatgtgactgatgtcacttaaaaaggggaatttggacacagaaacagacaaatacagagggaagacaatgtgcagacacacagggaaaatgctatgtcaagatgatggcgctgcaggcgatgtgtggggttatgaatgggccacacccaaactacccaagcccgctggtggtgggagctcaggagcaggtgctggcagttagttggaactacctctcccagccttgccttacatacatcacagtatcaagagtccatggtctactagtgatcttagatcacgttaagtttcccatagacgctgatattgtccactggacattactagatggcacagagacatgggcaagttctagaagttggtggctccaaggcagtggttcaggtatttcaagggactggggatattctccaaacatcagtgtctgaggatatgctttgttgggtattagttggatcgggaaaaacccattgacagaggtcctcttgtactggctgaagatttctttgatatcatgcgatggccaaccaatcctcaacgtcaaatctacccagaggacatgattcggaccagcatt

SEQ ID NO: 48761 - DNA, 1027 bp, Homo sapiens
caggcactagtcaggcaagtcagtttcagaaaaagaagcatatggaaactgagtatgtagaaattgattttcttaaaactactctggcatacgccctagaaagttttgtggaccacctgaggtatacatacccccggttgaagagtgctgtgtgtccccatgaggttttctccagttcaacccctcctttcacctgtccataggttattgcagccgaaggagaaatgaatgcatccagggctctgaaagaagcctccatggtcatcactgaatctcctgcagcccttcagctccgatacctgcagacactgaccaccattgctgctgagaaaaactcaacaattgtcttccctctgcccatagatatgctgcaaggaatcataggggcaaaacacagccatctaggctagtgtagagatgagcgctagccttccaagcatgaagtcggggaccaaattagcctttaactcataaagagagggtagggcttttctttttccatatgtcaattgtggtgttcccagaatgtatagcagttataaaaataggtgaaagaattgttagcttgtaaatactgagagattggtgatttatataaggtaatctgttagtcttaaaatagttaaaagtttgtatttttagattattatgtagtaggttagatccctcttgttttgacttccactgactcattctgaaccccctaagcacccaggccagaggcaagaacctgggctgtaactgccacctgacaccgctgactggctaaatgctttgcagaaagtgatgaccttacaccacaaccagcttctccaggtcatatgtgccttacctccagagagtctttttttttttttttctgagatggagtttcactcttgttgcccaggctggagtgcaatagcatgatctcggctcactgcaacctccgcctcctgggttcaagagattctcctgcctcagcctccccagtagctgggattacaggctcatgccaccatgcccagctaatttttgtattattatt

SEQ ID NO: 48762 - DNA, 1048 bp, Homo sapiens
actataaagtccatcaaacattttaaatcggcatgtaaaaatttttcatcttgaatttatgtacttgccaagaatataattcctggcatgttgtaaatattgacatttttaaataaaactgttaacatcattcttttaaatgtacccaatgagaaataataatgatttagttatccattaaaaatatgtaagtaaactcttaacagtcaggagctttttattgtttttttcttcttcttcttaaacctaagttttttattgcatcttcacttccgccagattcttttcctaacatacattttgtcatgaattattttattaacatactgcaacatatttagtccataagttagaattaatttttaaaaatttcctgtaactaaaaacaaggttctacaaacatttcagaatttctcctaaataagaagtcaatttttttttttttttttgagacagattctcattctgtcagccaagctggagtgcagcagtggcatgatctcggctcactgcaacctcccgggttcgagcaattctcctgtctcagcctcccaagtagctgggtttacaggtgcttgccacaacgcccagctaatttttgtacttttagtagagatagggttttgccatgttggccaggctggtctcgaactcctgacctcaagtgatctgcccgccttggcctcccaaagttttgggattacaggtgtgagccactgcacccagtaccagaagtcaatttttactagaaatgcttgtctttataagatgaatgagaattaaatcgtacatgtatagatggctgttgtttaatgctagaatgagacacgattcagcatcaattttattcctatttttcatttttatagctataaggactttgaaaccttatttacataaataagtagatggaaatggaagttctgtttaaagtagtatcatacagttcttagcactttgaatttatgtgctaaaaaaatcatatcacagtctttcatcaaaaaatatttataatgacctgtcagctttcagtttagtaaggtactca

SEQ ID NO: 48763 - DNA, 1033 bp, Homo sapiens
ttgtcatatagacagtctcttgctgttgccattaggaaatttttgttcttccagggtagagacaggcttttcccagggactgtgagagaacaagaggaaaaaaagattcatgctggcaaccagaagtagaggggtgtagaaatacaggggtagtgcaggggtttaacacgtgggctgtggagacagaccacccaggttccaatcccagcctcctcgcttaggccattgacttaaccttcccacgcttcagcgtcctcaggtgtaaactcacgttagtaactgtgactaactaattggattgttgtgagaattcactgaaataatgactgtattcattgtcagatatttttaagcacctactgcgtactgggagctgtgctggggctgtaggtatagtcataaaccaggcagtaatggtgcctgcccttctgggaactttccgtctagaaaagaaataggcattaagcagacagttatgcaaatagccattggagtgtgataactactctgaagaaaaaataatgtatactgtgggcttagcattgtgcaagatgcagattgagttctcaaaaaatttcttgatgatgatgatgaaatactaagtcggggaggttatagagaaaggaatggttgattctatctccaaaagccgtgggaagcattttgggaaaggtgagagagaatcttaaatttgaaagatggctgtttttctagtggatcatttataaaaggagggagggatgtggatgtggaggatgagggaggcagcaaccaggccatgcagacctggaatgctctctcaggcctggggaccttgttcaccgtgccttgggcagttggtgcaggcagggcttatacttcaaaaaatctttctctgggttccagagaaaagctaagcaccagccaattcatctacggaaaggcagtggccaactattcagtagctttaaagggggctctgaagtccttcaggcaaaaggcattctcctccctttctgccaaggtggctagaagagtctgagcttttcattca

SEQ ID NO: 48764 - DNA, 1071 bp, Homo sapiens
tgcagtttcaggtacattgcaggcctctgagagttggcccattgtgactattacctttggaccgaggccatcagagaatgtgtctgaacttctggataaggaaatgtggttacagtagtcataggaaagcccccaagcagctgggctcatttgagataagagtcccaggggtagatgatatagtctatagtgtagaacctgcagatatcccccatctgataacctgtgactctgtgagagagagaaaatgcttgctgaatgtcagagcagaaaaggctctagagtttcccaacacgtgttacaatgacgaactagaagtccacagagaatggcatggctgaccattcctgtggccactgaccattcctgtggccctgggtctgctgtttaactcccatctgcgtcagaaaagaagcatctggactccactaaaaacacataaatggagggcttgctgatgacttactcaaactcagtacaggcacgaaaaaggagagtgagataaacccgtcaacatcccattaaggacctttaaaaaaaaaaacaactcggtagaaactccaggctaaacagatcaagcataaacccagctgcacacaattaaagacacactaagcctaaagtgggacacagggaattgaaacagtctgtgagaaacatctttttctccaaggttcctaactactctggtttagctaatgcttagagggaaatgcctcgcacagaacaatggaaaaagtaagaactcaggagtcaggcagacttttattcaaaaccacctccatcatggcacacctgtgcactctggtaacttaaaaggatgttcttaaagaatagtgaagtccaggaaaatatgttcatcatagtttgggtggaggaaaaagctttcaaaataacaaatacggaggatctattttatatagataaggaaggataggcaccaaagtgttcactggttgcttctgggctgtaggatgagaaatggtttttattttcatcttgattgcccatggttttattttttctttatagaggatatatattatttttataaagagagaaaagcaatga

SEQ ID NO: 48765 - DNA, 1135 bp, Homo sapiens
tagtggcggaagggtctggtggctatgggaaccacgttctgaacaattgtgagggtttcctgtaaatcacacctgcgctttaacaagcaaggaacccagacagaagatttgaaactggggcagtctggccaactcaggatctacagatatagttcctggatggccatactcagggccaaaatctttagggtgaggccagagtacagacctcagtgctgtctgatacattaggaggatctttcctacagtaagcggaggaacaagagatcttcagttttatcttagaggcaaaaatggcaccgcaaacttgaggtggggtcgggagacctcagttctcatcctgaccatactgccagccagttgtgggacccaagggaagtcacgtcacctctctgagcctccgtttcccccttgacttttgagagtactgggtgatgatgatccctgaggattcttctagttctaaaaattcaatgattctatgagtattaataatcttgatttgtatggcactattctggcaaagagcagaagtattcaggaatccaatgagtgacggagactattgaccaggtagtttaatttatttaaggcatatacatggaattcaaaggagaaaatattgctctggataatatattgaactgttagtgtcttcggcatagcaaaagctttccagagggaaaaatttcccatcagtgcaaacttgacatttttcacttcctggtccataactgccatttgtccagcacacttatatttactgtaaagggccaagtgtacgaatgctttggttgaatattaaataactacataaacgtcaaggtcacagttgcaagaaagcctcagtggaaggccctgggaggcttgcattgatctcttgtgaagttccattctcggatcctgctgacaaggggaaacaattgatgtggaccattattaaggctttaagtgtttctccattgttaaagatcttttacaagcccagaataagtgatagtgcccaaggaattggcaaaagctttatttagaaatataggctggtcaaagagataagcgcaaggcacaagccagagtgcagatgtcctggcttgggcttacacagcaaaggtggagagctgagaggagtctgtca

SEQ ID NO: 48766 - DNA, 1088 bp, Homo sapiens
actaatgatgttacaagaaaaaaaatccaccaaccttttttttttttttgagacggagtcctgctctgttgcccagactggagtgcagtggctcgatcttggctcattgcaagctccgcctcccaggttcacacccccaccattcttttaatgttttataacagtgagacatttcaattccctctgggcaaattaatgagataggatcaatgtcagtgtcagtccttataactgaggaactcctacagattgcatttttcccttgaagtataaattttggtattctttttatttcctgtccttcattcaaggagacagattttatgctgaaagatgtgtgttttcctattccatgcctttaatactcatgaaacagtaaaagaagtaaacttaattaagcctctcataatgtaaccagagtccactagatgatattctctagggtacaagacggaaggaatcccagaagcacgtaaggtggccccaaattaaagaaggtattaaattttaagtgcaagatataaatgcttccctattcattacctaagggggtgacaaagaataaaagaataaactaggtgaaaactcattccttcaaactgatgcttcatttttataaagagaaaagaacacccgtccgttacctcaagtttttcattaactcagtagttctttccaaaccatgagtcaccgctgtggggaacaactcagaccttttttaaaaatcctgcctgaaaaagagaatatgtcgggtgggtggttttaaaagtcccaaataatggctgttttatagctagtagcccactgttgttaaaacctcacagcgtctcttctccccaggcatgacggagatggtgcgtaaaattactctgagcagagcagtgagaaccatgcagaatctctttcctgaggagtacaacttctaccctcgctcatggattctgcctgacgagttccagctctttgttgctcaggtagatggcactccgtccccatgacccctgaattatattatgcttgcaactgtgtcctgggtcctgtgtgctgggagctgggacagggggtcccagggagctgcgactaaggga

SEQ ID NO: 48767 - DNA, 1138 bp, Homo sapiens
ggaagagaacattcccccggcacaacgactttaaagtgcagaaaataccacaacactatttggtcaggaggcatcctctacgtggagtaaggtgctgtattacagttagttatgaaggctttcagttcaatacggtaacattttaatgttagtaaacctcaagcaaaaggattccaaaaaagttgaagttttgctttgtttactttgcggtcagctctagtgtttattatgcaacaattctaatttcgagggagaataaaaggaaatagctgtgattttccagactcccttcttgggaagctcagaacagtgtcctcagtgagttttcttgactattgaacagtccatgttagagcagtttattagtgctttttaagctcctttatttcttacttaatccttccctacatccttctaaacaacaactaagacctgggcactgacgtcttgaagctgggatctttagatttattgcactttttaatacgctgatggaagcaagaagttggttcttaaaactttccttcccagatgtttacccttttctttctgaacgtgggaatttagaggaaactcattcattctgactgcccatttggaatgtgtgataatttgggcatgccaagctgacatggaactttgtattttctattaaaaatagctttgccaagcacatttctagtatcagtaatggaactgtttggtctctttcagggtaaaggccatttgtagccaccatttttggcaatgatatttgtcttaagaaacaagcatgatagccgggtgcggtggccacgtctgtaatcccagcactttgggaggccgaggggggtggatcacctgaggtcaggagtttgagaccagcctggccaacatggtgaaaccccttctctactaaaaatacaaaaatttgctgggcatggtggtgcacacctgtaatcccagctactcaggaggctgaggcaggagaattgcttgaacctaggaggcggcggttgcagtaagccaagatcgtgccattgcactccagtctaggcaacaagagcgaaactctgcctaaaaagaaaaagaaaaagaaataaggatgatgccaggcatggcggcttacacctgtaattccagggctttgggaggccaa

SEQ ID NO: 48768 - DNA, 1042 bp, Homo sapiens
gggcaccatctaatcagctgccagggcatctagaatataaagcaggcagaaagatgtgaaaatcctggaatggcttagcttcccagcccacatctttctcccatgctggatgcttcctgcctttgaacatcggattccaagttcttcagctttgggattcggtctggcttccttgctcctcagcttgcagatagactattgtgggaccttgtgatcatgtgagttaatacttaataaactcccctttatctatctatctatctatctatctatctatctatctatcctattagtcctgtctttctagagaacccagactgacacatccccccttcagctttgcctgtcaccactaaccctctgctcctgtgtgtggaatttctgagcattccccaagcatactgcctggctcagaggcatgacttgcttatgtgttgaataaatgaatttatggaccggcaacaccatggtgcctttagaccaacgctctggtgggactttttattggggaaagtactgaattggactgggttcctggataactggggaaaagctgccctaagagaagtcaggtgtgactttggataaagttgtctgatatcctgggtgggaggtaagtgttgctgaaatggaaacctgatttgcattgtttccatttcagttaataaaccatttaaagtttcgatatggaagagtctaggtaatttgaggcctagtggtgaattgatataatttaccaactgtgaggaagtagagaactgggagattactgttgataatttgcagggtataatggagttcatttataatttataattgatattggaactcttttccatgggctgaattatgttggaatggagtaagagtcatttaaagagattattttgttgtttgtatcaccctcatgaattggaaagtggaaaaagaacatagtgctaaattcgtatctaatcttttcagagctatttgctaaataaactggaattttaattaaaactgcaagccaagaggtaaatcgctttagaagtttgtgaagttt

SEQ ID NO: 48769 - DNA, 1032 bp, Homo sapiens
catcatttacttaattaatgccctattgacacacccttggctacctacagggtgttaccactgtatgtaaagctgcaatgaccatatccttgtatatatgtctttgtgtacttgtgtaagaatatcgtaggataaaaatctaggaatgacatcatgcatttaattctcttcaaaactaaggtataaaatttggaatgttttcactctggtaactattgtggagtgaaagaattaggacttgagatttggcttgtcataagaagtgggaaattaagtacattgtttacatttaaaaccttttgctcaggctgggcatggtggctcacacctgcaatcccggcactttgggaggcagaggtgggtggatcacgtgaggtcaggagttcaagaccagcctgaccaacatggtgaaaccctgtctctactaaaaatacaaaaattagctgggcgtggcagtgggcgcctgtagtcccagctacccgggagactgaggcagaagatcctggctgcagtgagctgagatcgcgccattgcactccagcctgggtgacagaacgagactctgtctcaaataaattaataaataaaaaatcttttgctcacatagagttttgtatcctcttctcatggtgccttggatttagattctgcagcagtaatattggcagatttataaaccaatgcaaacctactcttagtttatcttcccacatgaataagttgtctaccagctttccgaagcccatacctgtcaaagaagtcagattcaccgtaatagaaacaaagtgcctcttttgtttttgttttgagtggtagagaagcaaacacatttgaggacttttctgtgttagggagtttttataggttattttattaattcttacaaatcctttgaggtgcaattattattcctgttttccaaacaaagaaggggatgggttcacaaaggttgagtgacttgcccaaggtatgcagaactaggatttgaactcaagtcttgatgtcattatgatatgggctggctttgtgtcc

SEQ ID NO: 48770 - DNA, 1065 bp, Homo sapiens
aggagccagactaattggattctgatgctgactcgcatcttacaagctgtgtagcttttgcaaatactacacaggtttctgagccttaatttgttttgttgtgtctgcctttcttaaacattttgttacttcaatgtcttaagccagactagtcatatttgaatcccagttcccccagttaccaaatgggtgaatttgggcaagttatttagcctcactaacccacattgtcctcatctgtaaatggcacagtaatcataagctttagaaagatatttccttttttctgctttttccattcaaatagattttatttttttagaagttttacattcacaacacacttgatcagagagtaaagacggttctcattaattccctgctcccatatggacatagcctctcccacgatctacccactgctagaacataacatttactacaatttataagcttatacaatggtccccaacttacgatggttcatcttaaaatttttctttatgatactgtgaatgatccatgttcagtagaaaccgtacttcaagtacctatataatcattctcttttttcactttcagtacagcatgcaattaattacatgagatattcaatgttttgttataaagcaggctttgtgttagatgatcttgccaactgtaggctaacgtatgtgttagcacatttaaggtaggctaggctaagctatgatgaccggtaggttaggtgtattaaatgcatttttgacatatgatattctcaatttacaattggcttattggggtatagctccatcataagtggaggagcatctgtattgacatatcattatcacccaagaccatagtttacattagggttcactcaatgttatacattctacaggttttgacaaatgtataatgacaggtacccactgttatatagtatcatatagaatagttttactgccctaaaaatcccgtgtgcttcacctgttcatccttctctccctctagcccttagcaactactgatctttttactgtctccatatttttgccttttctaaaatgtcatttagtt

SEQ ID NO: 48771 - DNA, 1002 bp, Homo sapiens
tatttcactctgtaacctgaaatgaataggaacaagggttttaaaccatgttacattaacttttctgacattataaattagcctagaatattacaggaacatgattgttatataatttatatcagaacctttctataaatatgtgcttattacatttgaaatgcttccaatgtactttatttgctgtttgtaattccaaaaaggatatgcaaaccagtctgtctatttcatggatatttaatagtgagatcttccatgttgaaggtaatgtatttttttttaagattttaaaattgctattttgttacaaaatagagacctattaacagtttgagagctccttatgtgccctcagggaaagaaccctctgtgcaacagaactacacaaaacatcttcagcacgttctgagggtgaatatatactacataaattgatcttgtgtatttaaccttatctttttaattttaaaattgaaattttgaaacttggttgtgctctgctggagggggttgggataaactgcttagatgtttgcctacttgtccagtgaaattacatttgcatcagtatatgtatatacctgccaaccttattggtatgtctcagaacatttatattaaaataatgcttgtcttgcagcaggtgatcccataaaacaataactccctgttcttaaaaacttactctctttttcactaacaacataggaattgtttctgtgttgagattattctgtgttgcatccattctctatgtagtggtcaccttctgtctgtcatggtgggcttaatgtgaagtaaagccattggttctctgccactttcgaagaaagggcagttcatctgatccttcttcagaatggtacctactgatatcatcgaggaaaatgttacaaatcagacctaggatatgactttttaaaattgaggcatttcccgtcatttggcctttttaccaacaagatgtgatgtacaaatttggaatcaaaggatacaaagcaa

SEQ ID NO: 48772 - DNA, 1036 bp, Homo sapiens
ctaactagtattttaatttttatcataacttttggaaaacaggacttttcaagccaggagtggtggctcacacctgtaatcccagcactttgggaggccgaggcgggtggatcatttgaggtcaggagttctagaccagcctggccaacatggtgaaaccccatctctactaaaaatacaaaatagctgggcgtggtggcacatgcctgtaatcccagctacttgggaggctgaggcaggagaattgcttgaatccaggaggcagaggttgcattgagccgagatcatgccactgcactccagcctgggcgacggagggagactctgtctcaaaaataggaaaacaggacttttctagttacttctgatacttctagtgataaagacatgtctttgctagagactcctaaagtttgctgtagctttcattaaatatgtatagtcacccttaacagtttgcacttaaagctaatttgtttttaatgtcatttcttttttctcagggaggagcaaaaaacaattctgccggtaacttcttgctttagccagccactcccagtgtctattagcaatgcaagttgcctccccatcaccacatctgtcagtgctggcaacctcattctgaaaactcatgttatgtctgaagataaaaacgactttttaaaacctgttgcaaatgggaagatggttaacagctgaaaggaggttcatctttcaaatttgtgaccacaccatggaagcatttacactagctttttatatatataatatatattatataatgtatattttttttaaaaaaaagatattactgggggcatccatttcctgtggactctttgatacttcaagccctcttgcattagcattatgaaaaaaaaaaagaaaatttactttactagggtaacatgttcactttccagaaatgattggaatttggacaacatttaacttaagcttcaagcagctttttatgagtttgtagcaatccggtgcagtaactgagccatttcctattttaaatggcttctataga

SEQ ID NO: 48773 - DNA, 1641 bp, Homo sapiens
tctattttttaggttaccaaaagagatgaagactcttccctaatgcagctgaaggaggaatttcggagttatgaagcattacgcagagaacatgatgcccaaattgttcatattgccatggaagcaggactccgtatttcacctgaacagtggtcctctcttttgtatggtgatttggctcataaatcacacatgcagtctatcattgataaggtttgtgaaattagagatgctgatgttctatcattgctgttacattgaagagtattagaatattctaaagagtctatacacaaacagttggagattcctatgtttttaaatgtcagactcttataaattatccttattttctttttatttttctacttgcaaaataaagggatgcaacagggaaacaaatacatgatactagcataaaagcagtgaggcttacaaagtctcaaatttatctatattctgacctcagagagttaatacagcttataagttttctaagtgtctaatgatgaatttcatagggcagattctgaggtgaaaatttaattcatcactgatactcctactgtggaatctgaagacacttgaaaacgtattaaatatgttgataaattgaaagtatttgagtataaatgtgtcataagaaccaaagtaaaaagcattctcatttctgtttgttagctacagtctccagagtcatttgcaaagagtgtccaggaattgacaattgttttgcaacgaacaggtgacccagctaacttaaatagactgaggcctcatttagagcttcttgcaaacatagaccctaatccaggtatgtgggaatatgctcagttgcttatatttttttctacttttgaggtgaataacacaagagaattactgctaacattcttcccccccaacccccatgcccttggtggcttattttagacgctgtttcaccaacttgggagcagctggaaaatgcaatggtagctgttaaaacagtagttcatggccttgtggacttcatacaaaattatagtagaaaaggccatgagacccctcaggtaagtacatttattacatttctgactgctgttgtctctaactcagtttcatcctgaacatcttaaccagctgttttgttaattggactccgtatgtgactcataagtttctatcatctctattcttttgggaggaacccagtttttagtgtacttggtaaacatttcatagcacaccaagagtttagagggtatcttgggtgtgagtatactttattgcagaatatttttgaccaaatgtagataattgattccaaacgttttgtctcattcttttctactgtgggaaattgtcattttttttctgtattgaatttctatatgtaaatttatggaatttgaattttctttcttttttttttagacaaagtctcactctgtcacccaggctggagtgcagtgacgctatctcagctcactgcaacctctgcctcctgagttcaggtgattctcctgcctcagcctcccaagtaactgggattacaggcaagtgccaccacgccctgctaatttttgtattttttgtagagagggttttaccatgttggccaggctggtctcaaactcctgacctcaggtgatctgccca

SEQ ID NO: 48774 - DNA, 1712 bp, Homo sapiens
agctatgcaagaagaggccttgaagctggtgttactggcattagaagatggttctgccctctcaaggaaagttctggtactttttgttgtgcagagactagaaccaagatttcctcaggcatcaaaaacaagtattggtcatgttgtgcaactactgtatcgagcttcttgttttaaggtaagcagtaagtatctatgtaaagacatgcctgtttgtgagacagagacttcctgaaattcatgttacccagtctagaggccctagcaatgcagaatgcttacaagagttgagaggaaactttccttctgcattgattgcatctgtgataccaccttttggtagtacccattactatctattggcaaaataagagcatatatgtgaagatgtcagtaacggaaagaacataaggaaatcatttggtaaacttgactcttatcaagtaaaagtggactgcagaagcctcatttctttacatttagtgtcttgaaatcagactatattggaaacttcataaggagtatgtaaactttgtaacccattattatgtttgttatctcattctctgtagtgattagattaacacctttaatctgaaaatggcctacatgttatctcagatacaaccaggaaatggaaagttgaggagattggcccactctgcttttagatgttgttttttgtttagtggaaagggtagagaagaaccccaagatattttaaaatgtagtttcattgtctaatagtctagcgggtagtgacagatactgaaagcaagctgaatccttaaagtgtttttatgatccaagagtgtaggttgctggctgggtcttgagaaaggctcatgtacttggaaatagaaaggcctattggcttctatgaaagtaaaacatttaaatttgaaaccaaagcttatttaggttattttgttggttttatagcccccaagagtgaaaatagtacagacagaaaaatgtttctttggcagaacacttagtttgagataacaggtagttgataatagaaatgtgttgaagtgaattcatttaactccactaatgaggcttggacactagctgcctcatagtcatagtgtttagtttcatgctcttagggcaacaattgaaattaatctctggttccacacacaacctcactaggccctgtaaaactctgtatcttttgaatgtgtagttttttttactacttaagtagaaattaaagctatgtaaataccctgatgataatttctctggtagcagaacatttcttcttttcattttttttttaaagcaacagacttttgctctgttgcttaggctggagtgcagtggtgccatcatagttcactgcagccttgaactcctgggcgtaggccatcctcctgcctcagcctccctagaaaatttcttaattatcatgtggtagtggtaatatatgcctacctattagctggattccttgcttgtctatctttatcctctactgttaccaaagtgatgttttttaaagcataaatctgatcatgtcacttctatgcttaaaaatcctcaatcagctctgtgcagtggtttatacctgtaatcccagcactttgggaggccaaagcgagaggattgcttgagcccagaaagtcaaggctacagcgagcctagattgtgccactgcactccagcctgggtgacaaagaccctgtcctctccatccccac

SEQ ID NO: 48775 - DNA, 1008 bp, Homo sapiens
gagaggttactggggaaatttatagcagatggataaagtctgaacccactgataaatcttagcattactaaaagtgaggcaaattttccattatacaaagttttaagatattttaaaaatctacttttatatagaatttaagaatgttacctttagatatttcctgatgtttactttaagaagcactagactaggtgtcacatctcttttgttctacagctcagaaacaaaaatacaacctaacttaaaagtgggtaaataacttgaatagacatttctccaaagaagagacacgatgactaacaagcacatgaaaaaaccctgagtgtatttagttattagggagatgcaaatcaaaatcacagggacatacttgtttatacccacttggccattattttatttcattgttttagagacagggtcttgctccattgctcaggttggagtgcagtggcacgcttatagcccactgtaacttcggaacttctggcttcaagtgatcctcccatctcggcctcccaaaatgctgggagtggccataatttttaaaatggaacataaccaatgttgatgagaacgtggagaatgtgggcacgtaaaatggtgtgctgctttggaaaacaatttgtcagttccttaaaaagttaaacaattaccatatgacccagcagttttattcctaggtatatacccaaaagaatagaaaacaggtattcaaactaatacttgtatacaaatgtttattgcagcgttattcacaatagtcaaaaggtggaaacaatccgaatgtccatcaagtgataaatggataaacaaaatgtaatgtatccataaataggctattcctcagccataaaaggaataaatactgatacatgctgcatgtggatgagcttcaaaaaaactacgttaggttgggcacggtggctcacacctgtaatcccagcactttgggaggccgaggcgggtggataacttgaggtcaggagtttgagaccagcctga

SEQ ID NO: 48776 - DNA, 1062 bp, Homo sapiens
ttctcctgcctcagcctcccaagtagctggggttgcaggtgcgtgccaccatgcccagataatttttgtatttttagtagagatggggtctcgccatattggccaggctggtctcgaactcctgacctcaagtgatctgcccaccttggcctcccaaagtgctgggattataggcgtgagcaaccgtgcccagcctctctcttcatgttctttattcattcatatctcacagttctcaagggagccaatcctgaccaccctaattaaatttgtaacccctcgctagtatttccagtcccccttatctttgctctataatttcacctcttggaacactacaaatttattatgtttttaatttattgattggctacctcttctcctctccactagaatgtgagctccacaaaggcaaaacattttgtctgttttgctcattgatatatccctggtacctataactgtgtccagtgcatggtaagcactccataaatataattatttgttgaattgcattgaactttttttttttttgagacggagtcttgctctgtcgcccaggctggagtgcagtggcgcgatctcggctcactgcaagctctgcctcccaggttcacggcattctcctgcctcagcctctggagtaactgggactacaggtgcccgccaccacgcccggctaattttttgtatttttagtagatacagggtttcaccgtgttagccaggatggtctcgatctcctgacctcgtgatccgcctgcctcggcctcccaaagtgcgggattccaagtgtgagccaccgcacctggcctgtattgaacttttatagcggcactacaaaatacagattttcatcttcattttgcagatatggaaattatgacttggagcagttaagtaatttactcaaggtcattcatagaagtagcagagctgcaatttttacccaagttttgacctttgaatgagaacactctgtcttaataatgcttatcttaagtaaataatatagtaaaaaggtgataagtgctttggggaaaaaaaaacaactgtgtcttt

SEQ ID NO: 48777 - DNA, 1050 bp, Homo sapiens
ccctggtgcctcgagggttgggaactgagggccgcacctgacactcggatggaacccgggccctgcggaggcccctctctctggtagggctttttcgatgcggagcgaccggctcaaatggccaccttccttcgacactggccgagcggacgcctctgacccctaacgaacccacccaagcaaaggcccggcttcactctcccttttctacaccagttagtaagggggtttggaagaggtcctcgaaaccaagtcttctcctagcttttcagctttctgccctggggcttcccgagaccctagcgtagagggtggtggaggcgatctgagtggtaaataggaaccccggccaaacaatgccctgggagggcttaacctcccaggatggggacggccggacctgagtggttgcacaggggttgtggctaggagcaatggcatgaaacacagccaggaaattctgctatggctttcttctttccctctctcatttttcctttttggtgtagcctcttgaggagactcttccaccatcttagaagaatggtagaaagcatctttgtttcccagagaagcagctgtacttttttctatccttagctttcaggatgggagaagatgagggtagctgtcatttccatccttcaaatcccaaggcagccgtttaagataccggcagataaatccttcacaccaaaattgactcaagtaatcactggcataaagtaaatctaatccagtgatttatttatattttcataacccttgggttccctttttaattcctcctctccccttacccacggccttcctttttttcatttctactctccccctacccattgtgggtgggtgagtttgtatcccaaataaagtgctttaagtaatcttttttccaattttgtattggccaaacttttaagttccagtaggaacttttggttaacctgagaaagctaacgttgctataccacagtggtataaagtcactcaaaagcaaagaaacaaatgttagccagtgcagccttttaatggttaaacatacaaact

SEQ ID NO: 48778 - DNA, 1030 bp, Homo sapiens
ttgttcaagaaacattagttaagcacctactgttgctagacactatgctagatactgaggataatgaaggtaagattgatatagtccctgccctcatggagcttatagtctcatgtggtcttagtgaaacaaagtctcaatttgcttttatactagaaataataaagaaagctgccttgctgtattcgatcagttaaaatcagcaactttgtgcttttgtatcagtaaaacatttagttctcaccttttgaaaatgcaaaccactgaagtgatttacagtctcctccatttttggctggagaggtgttctgtttctgtgagacatttttctaatttttgtggaacttcactttcctccttctttgcttatacgtgtttgttagattatattgcaaagaagtcaagttactgatatccagtattttacagaggaagatgactttcaaaactagtcatatttctgtagaggaggaagatttttaaaacctttatcattcagcatttgtattttatggatccccaggagaactaaaaaggagatgactctctaccatagtttggtttaaaaaaaaattactctgtcagttatttatttattatttaatactaaactccaaactgaagtggctctgaggtaaatcagatatgattttaatttaagtttctttattagcagatctataaatggaaggtgaccaatgtcactgcttctaaaatactgtcctaaacaacccagaagattttatttcagctcatgaatagctgttctaaatctgttgtatgttagacatactatgaactacctcttcacttattatggggaagtttccttaataaaagtgtgacgattaaagctctggtgtcattggttattttctcactctcccctccttctattcttttttaattgctttactttgaatacaggaaggtcttctttatgtatagtcttaaaaatacatattaagcatgctgagcttgccttcagaaaaaaatacgaattaatcagaaagttgttactagattcatt

SEQ ID NO: 48779 - DNA, 1030 bp, Homo sapiens
caatttttactgaatgattccagagaggtgaaaatctccatattacagagttccgaagtggggagacaattgctcttatcctgttatagtggtgtgctggaattccctgagatggaactggtaaattacttgactgctgcaagttttcttcagatgagccacattgtagaacggtgcacacaggccctgtggaagtttataaagccaaaacaaccaatggatagtaaagagggatgtgaaccacagagtgcttctccccagtcaaaagaacagcagggagatgccagaggctccccaaagcaggactcaccttgtattcatccatctgaagacagtatggatatggaggacagtgatattcagattgttaaggtagaatctattggggatgtatcagaggttagaagtaaaaaagatcagaaccagtttatttcttctgaacccactgctttacattcatcagagccccagcactccctgataaattcaactgtggaaaacagagtaagtgaaatagaacaaaaccatctccacaattatgccctttcttatacaggcagtgataacatcatcatggcctcaaaagatgtctttggccctaatattcgaggtgtagacaaaggcctacagtggcatcaccagtgcccaaagtgtaccagggtgtttcgtcacctggagaactacgccaaccatttaaaaatgcacaaactctttatgtgtctactctgcggcaagactttcactcagaaaggcaaccttcatcgacacatgcgtgtgcatgccggaattaaacctttccagtgtaaaatctgtgggaaaaccttttctcagaagtgttccttacaggatcatcttaaccttcacagtggagataagccccataaatgtaactattgtgatatggtttttgcacataaaccagttttgaggaaacaccttaaacagctgcatggcaaaaacagctttgataatgccaatgagagaaatgtacaagacctcacagtggattttgattcttttgcatgtacaa

SEQ ID NO: 48780 - DNA, 1029 bp, Homo sapiens
gaaggggaattacatctaaaatcttcaaaaatttttcaagaagaatacattctgtatatattacttaaaagttgaaacaaaagcttgataacttggagagtatcgtgtcatgaaagttacctaaaagaagaacaagattaaggtttatagagagaaaggctgtagtataatacagcctctttagaaaaagaacataccatgtcaatgagggacaaagatttccaagtagttttgagtggtaagttgaaagataagggcacttttatgagacaggtgaggaagcaaactgatacctagcttaagaatttattatacagatagaaaaattttacttgccagtagttattagaagcatttgagaaaagaaactattttctcactgcctgtagtatagcaatttacattgtcccacctggaatattcagtaattagtcattttttactatcctcatttgaacaaagggaaaatttcaaattagttataattgtggaaggattgtataaatataaatgaagaggaagtgagaatattcccattacattgatgtttgagaaatatcattcaaaacttgctaatagaaactcaacagtattcagatttaatctcagtaactgaggcaatagataataaagacctgaactatggcaatgatgtaagaatggaggagtgaggagttggtgatcattctgaggaaagaatcaacaaaatatgatgactgtgtctctgatctacctgatcagttctttactttccttcagttacaagaagcttgactataacctagaattatctgagtgatttttatgattattttgagtaattactgctatacttagaagttacctacagttggggattgtgaaatcaaatatattcataatttttattgtctgctttatttgcaaatggcattaagtttcagtccacaaagataaatacacaaaagatggaaaataatataaagtaaaatagatgagaaaggtataataaggataaaggcataatatgcaatcaggaatatgactaat

SEQ ID NO: 48781 - DNA, 1029 bp, Homo sapiens
ctgtttaaaaaccagatctggttggccaggcgcagtggctcacagctgtaatcccagcactttgggaggccaaggcgggtggatcacgagctcaggagttcgagaccagcctggccaagatggtgaaaccctacctctactaaaaatcgaaaaattagctggcacggtggcacaagcctgtaatcccagctagctgggaggcgaggaaggagaatagcttgaacctgggaggcggaggttgcagtgagccgagatggcgccactgcactctagcctggatgacagagcaagactctgtctcaaacacacacacacacacacacacacacacacacacacacacacacacacacacacatctggttaaacattaattatgacgaaggccagtgtcatcctgctctaggtaatgttgctttgcgcaaacatagccatgagcacagaactttcccaagttcctgtcctctgagctgtaaatatgttagtgaggcacttttcagtaaattgcttatcttagtaaaatctgacaagttctgtaatacaggtagaacttaaagaaagaaagcaccatgttataaaaactcctaagctgccaacaaaacattaaacaattaaagttctaaactgggcgcaatggtgcccacctggagtccagcagctcaggctgagggagggatttcgcttgagcccaggatttcaaggccagcctgggcaacatagtgagaccctgtctctaaaaataaaaaaaaataaaaataaactaaggtcctcattgtaattggatgtgttacagcagaaggcatgaactcagaacaacactggaaagtgacaagccacagcacatgattctgacctctgcactcccaccacctcaagcaagacctatcacttgcatgactccttctcctcagcatcacactgcggacatcgactgccttacagacatttggaaatcatggggcacttgcactttgagatctaaagctagagcttgtttgatttcatctgtacacccttccagagaaaaca

SEQ ID NO: 48782 - DNA, 1044 bp, Homo sapiens
ctcgtaaaggaccaggagggccaggctcaggggtgtggactggattctctgggctgtagggagccactggacagctgtgctcaggagggtcatgtgatcacaaatgcttattagaaatgtcactggctatggaggaccatgtctgtggttgtaagttacgcctttccgtttagtctggacttcctggtcaaggtacttttggtattagagtggggaagagaggcccagagagttggacaggttttctgaccattggcttatagtcagtgagcaccccacctttattttgacatgacagagctttacagaatcttccttcttcaggcgttttctttcctgctatcctaaagattcacgtacgagggcaggataaatgaaacattctgtctccaatctaagttcggcttggggcctcagaatatgaaggtaaaggggcggggacggactgactgccccttgcttcagaatcaagtcacatggcgggaacgctctatggagcagattgcttcctttgtacatgccctaggcccgtgttcagcaggcctcagagaagcagaggtgctggcctctcgtctccagaggctgccagctactaagggaggtggaagcaactacccctgggggtggactgctctgggccgggcccgacgtcaggcgtaggggactgaggtgaatcagacgtggtggctgcattgaggaatgctcagtgtagttggggtgtttgtagcgctttctgctgagcatggtctttcctctcagaggggtttctaggcacgttgaagggagctgccgttcagagcatcggagaggtgccagggacgtgagctgctgccagtctgacgtgaacagaaggtgggaatagctggcgctgccgtgcgttgataggagcacagtgtccgctgcgaaggggcggctagggctggagaaagatggcctgatagaagcgcctccacaggcgctgattcagcgaagccccagcagccccgcggggcaggcgaggatcacatgcagctcggagaagaggaggcacttgcccctctgcct

SEQ ID NO: 48783 - DNA, 1081 bp, Homo sapiens
tttttttttttaattttgggtgaatgtttgaaaatcatgaatcagccaccattattaattgaagagctgggaatacctcgttaatgtatttttaaaactggtgttggaccctctgtgtatttcaggttaatacttttaagcagttttcagcacgtttatctcactttattctcgttctcctcggaccttcgtagccatatcacttgtataaaataggctgagatatagtgactgtaagctgtgatctcagtatacaaaggtaagctcttttattttctgattaaagagaaaaatagtcaattaagacaacatgcatatatgacaatcatatatgatgtatttgatctcttaggtcatatgtcatcgcattacctttaaaaattgtatggtctaaatgtaaaatagttatttttcaacatttgttttaatacccttgtaactgctttttactcaagacagacatttcacttacactaagtgtgtgtgtgtgtgtgtgtgtgtgtagaaacttaggatataacacgtatgtaaattacacacacatacctgtttaaatgtaagaattcagtgataggaacagttcatctaagaagattttaatgacagggcactcttttggccaaagcagtggaatttcctaagcagcaaggttggtaatagtgctggtaggatctgtatgtgtaagctgttacacaagctgaggatcaaagtgccaatttctcaaggagaaaaacttctccgagaaatgaaagtctctgatctgtgttgtatgccctaatacaacaacagcaagaagccatagaaaaaagcaatagaaaatgaaaaaaaaaaaaaacaaaaacaaaatattatggtaactatggaaaagtatataattgactgagctaagttaattatttgcagaaccaacttcagcaagactcgggtggtgaatatcgagtctgcagagaccaaatagacttaaagcaatccatctgtcttttccaggttaggtagctagattatttatttcccaccttattcaaccatcatggagttcatgtaaagatgtgagggttaggcagacattttaataaagatt

SEQ ID NO: 48784 - DNA, 1067 bp, Homo sapiens
tagaccttgcccttgggctcacgacctgactcatgtgcctgttttaatggccattgagacctcagcctgctctctcactactttctgaagatacttggaaagttctgtttgctaactttgagagattggtagtttgagtggttttaagtattcttttgttcaacaaattatatttagagagtggctactatatatatcatacattctgctaggttcagatgatgcgacgacggataagtttgaccaggtctatgctactctagtggggaacccagacaaggaactgatagttaatagagtgtggggtcagtgagtgcagtgagaaagagatgtaggacagtctggcacatctaggagagccttgtaggccatggtgaggagctcccacatcttaagcaggcacacagagagtggctagactgggaccattctggcagtggttctcattcatccaacatctggaagaagtcctccgggcccagggtgctgagcaggtggtgcttgtgaattgggccagtgatgattgccctgggtcttggactgatctgccttcttcttctttgcactaggctatggaacaccatatggttacagcacagctgcccctgcctatggtacgtacaccatcttactgatatctcctcttagcgactgtcacagcaatccaaagcacagtttctatctagggtttttgtaaattaattggaggatctcagatttattcattctagtgacccaacttaaattccttttgaaaatgccacaaccttgtggttcttggtttggttggagttgctcttctctccgctttgcctgattgaaggactgcttgttctaattgcctgtttctgaccatattgaaattaaatattttaagtagttcttcttacagccaactgatactccattcaaaggctactgaagggccatactcagttgctagcttggctgcctaccagttttaaagccacacttaagtttctggtttggaaccgtgtgagttgtgggtaacttaagtcaagaataggaactgctcacttcaaatttgtagccttcattcttttcca

SEQ ID NO: 48785 - DNA, 1040 bp, Homo sapiens
gccactctatttaatagtattttaaatggctttgtttctacataatcagtatattttgcaaaaatgtatgaattcaaaatataaaatgttatttcaaaaacttgtgcttgtcttgttggttttaactctgctttaatttttataccatttgctgttctgttttactttgtctagtattgcattaagttattgctatcagccaacttattctatgtattttggcttaatggtcggatttcaggattaaatgtggtccaaaacagaattgttttcaaatttactcattgctccaaaattacttgcatcctggttgggcatggtcgctcatgcctgtaatcccagcactttgggaggccgaggtgtgtggattgcttgaggccaggagttcaagaccaacctggccaacttggcaaaaccccgtctctactgaaaatacaaaaaaatcagccaggcgtggtggtgggcgcctgtaatcccagctactcgggaggctgagacatgagaattgcttgaacccaggaagcggaggttgcagtgagctgagatcacaacactgcactccagcctgggtgacagagcaagactctgccaaaaaaaaaaaaaaaagaattatttgcatcatattgctcttgacttctaatagctgtataatctcataagatttgtacatgtctgtgtctagatttgttttatagtgtaagggatgtaaattgggggactgaatttttttaatggataatgtttagtaaatttttttttaggaggtttgtgaccctgttaacattttgaatatgatttatgtgagaatcatgctttaaactaactttcttctgaagttaagaagaattgctgtctggcagcgtcatcctcataaaagtagagaaatgtattcagttattggtagttttgagaagttcatgatggaattgtggtgggcttctttttctgatgtttttatcctgtcaagttagcttgtttctgcctctcattccctagaaacttgccaggtggtatttctcctgtgtcaaacctttgaccag

SEQ ID NO: 48786 - DNA, 1025 bp, Homo sapiens
ttgttttgtcacataaggcaccagtgattgggaagggctaataactgcctcttttagcaaagggatgtgtttttctgttatccactcttttgattggttattcaataagagcttttccattttgctcactgacagtaaatattcaggaatctcattctggttcgacttagctggctcattcagtatattttaggttcagattatagccgtcgcatcttctttgtacataccgttaattgagaaaagacctttcggcctctgcccattattgcaagccttcaagtgatatggtagaatagagcttttccatcgttataggtgtttttgggtaaggaggaatagccggaatttggaactaggtgaggattttatattagctattgataagtaattgataggtttaaccttcttgcacgtgccttttttttttacatgaaaaagaagcttccagaagaaaatattgaaattcagtgttcttttcacattactattgcatagaaataatgccaccatgtagagaaagttgaatttatttgaagggatttggggagagtattggatttatatgtatttgctcttactttccttagtgtgttctttttttttttttttctttctgagatggagtctcactccgttgcccagggtggagtgcagtggcacgatcttggctcactgcaacttctgcctcctgggttcaagtgattcttctgcctcagtctcccgagtggctgagattacaggcatgtgccaccacgtttggctgatttttgtatttttagtagagacaagatttcaccatgttggccaggctggccttgaactcctgacctcaagtgatccacccatctctgcctcccaaagtgctgggattacaggtgtgagccaccgcacctggccccttagtgtgttctgagttgattcatctttgtattctccatgctaccaagcatatacatacaaattaataggcaattaataaatatatatttacttgtaaatctcacataatttatctttttttc

SEQ ID NO: 48787 - DNA, 1050 bp, Homo sapiens
aaagttatcaagtttcgaaaaacgaacctggtggctgtacttttccatttatcagttacacattctgaataactgagattttgtcaggattcttcttgaattggagaatttgttgcatactgagaaaacaccagtcacaagttcatggcgttatattgctgtcccttgagtttcagtacgctgattaggttggaagggtaatcttccctgcttatataagactgtgcttttcaaactactaccatgactgttagtaaatgaaccttcattgcggccttgggagcacataggtgggtgatgattatttttcaggaaacagaatttacagagccagggaaaagcctttatggctgagtggccatttcaacactatagccctggtctcctgacatagttctatttttttatttaattttctttgaagtctagtcatcagacctgaatttgcacttaatctctgccatttactagttgcatgatcttgtgagagttttaaaatttatgagtctggcccttttatctgtgaaatactgagattttgaaccacacaggaatgtctgtgatgcagaatttactttgcttaatttttaataagaattgctttgtataacgctgtatgggaatgcgtatttgtgtatttaagactcaaatttattcacttattggtgtcttgcctggtaggaaatgtctctatttctagattgtcttcaatgttcttatcctgcttatctgtggataatattcttgatagtcatgtgaaggatctatcttgggaaagccaaggacatctgggaatgtttgacaggtgaataacaactaaataactgaatcgacttctcacatcattgctggcgttgcttgttctttcctccttttctgtctcttttttggctagggaggggcgttgggggtgtcagtattatccaaatagttggatagtttaaaaccttgcagctaataaatatacgaattttagtagtttgaagtttgttttccactggaaattcaggcaagagatccattttacatatgaaaatcattcgacaaatg

SEQ ID NO: 48788 - DNA, 1036 bp, Homo sapiens
ttctacttaataaagggaaaataattttacaatatagagatctgtcattcaccaccttaatgaagtgactaaaacttaagatcaaggagctggtatcaagtaccccctgacttgatgcagtaagagctatgcaccatcacctttgtttaaatcattgccggaaatgaagaaacaatcagagaaatcagaatgtggagcgttctttaaaacccttggtctggattcttaaaaaagacgctgaagtatttatttaggggtgaagtcaagatgtctgcaacttactttcaaatggtttcacaaaacacagagatacagcaaatgtagcaaaacgttaactattgatgaacctaaatgaagagtacacaagtgttaattttaatagtcttttaattttcctgttttcaaagtgtagatttttaacagttaattgataataaaatatgactctgaagggtcttaagagatcttctaatccaaccccttgtttttacaaatgaggaaagtgcgacccagggagacttgtctgaggacacatcagctggttactgatagagcgtgaagagcatgcctattctgtcttttgccaccacccgtggaggatgtgagtggcaagatgtgggaggaatggcaaagggacagagagagggtctttgggaggaagggctctccggagtcatggtaggaaaggggcaccccttagtaggagcatgttgtgggtcacagccacagccaagatgaaggagattatgacctgaaacacaggcaggcccgagagacccaacgcttcacccagcttagctcctccttttctctttttaaaaattctttgttgttttctttctctaattattctttccactaccttaaaaaaaatctctataaacaaaaaacaaacgtctctattttattgtcagttggtcattttgctttttccaccaagaattaacgtgatgtcatggaaataatataaattttggagctagatagacctgatttcaaattccaatcctgcgtactagctctgcaacttggaagt

SEQ ID NO: 48789 - DNA, 1085 bp, Homo sapiens
ctgcaattagtgcagcctatattctgcaattaacattatctttcattaactgtatcttacatctatgcatctattcactccactatttaaccttcattacatcttactttttgcttcatttcaaaataagctgcagacatccttacagtttacccctaaacattttgacatacatataattagctggagtttgatacttgttaacacttcttaaagttcaaatttatatacataagcctggcataggggctcaggcctgtaaccctaatgactcttgggaagctgatgcgggaggattgtttgaggccaggggtttgagactagcctgggcaacgtagtgagacccccccatctctaaaaaaataaagaaattagccagatgtggtggtatgcgcctgtagtccagctacttgggaagctgatgtgagaggatcacttgagcccaggagtactaggctgccatgagctatgttcacgccactgcactcccagcatagatgacaaagcaagaccctgtctttaaaaaggaggaaaaaatttacatacataaaaatgtataactgttagtgtgccatggatgacagtcattaattgagcatctggcatttttcagggtctttgctagtcttgcagatagagagatgagtaagacacagtttctgccttcatggtgctagtaggataaatagaagagatgtctaaaaacgtagtgttttatttggagcttttagttgcaaataagaatcagctgtcttctacagataatcggtcttccttacagaacctgagggcaggaattcagtggggctttgggaagggctggaaccaagaaccagaaggctcacaggactgttttttcctaactctgcccatttcgttctttttcttcgaagatgtacttttttctctttttagtacaaatggtagaacatggctgtccgtagagcttttattttacatctaacaattctcagccacatagacataccagttttctctgttaatttcattccaaattcctgggaggtagaatctggccccaccctggttcagcttgcctgagggctgagctgttggaagctcac

SEQ ID NO: 48790 - DNA, 1038 bp, Homo sapiens
gaatcaaagataatgcctagatttttttttttcttttaaaacttggttggatgattattgttatccagtgagattggtaagacttgggagaggaacaaggtatgttttggagaaaaaaaaattgatttttttttttgtgtgtgcgggttgacaaggtcttgctctgttaccctggctggagtgcagtggcacgatcacggctctctgcaaccttgagctcctgggctcaagtgaccctcccacctcagcctcttgagtagctgggatcgtaggcgtgcgcaccaccacaaccagctaattgaaaaaaattcttttttgtagagacaaattctccatttgttgcccaggctagtcttgaacttctagactctagggattctgctgcctcatcctcccaaagtgctgagattataggtgtgcaccactgtgcccagttgatagtcctttttaaatcactttgttttttttttttttttgagatggagttttgctcttgttgcccaggctggagtaccatggtgtgatcttggctcaccgcaacctccgccacctgggttcaagtgattctcctgcctcagcctcccgagtagctgggattacaggcatgtgccaccatgcccagctaattttgtatttttagtaaagatcgagtttctccatgttggtcaggctggtcatgaactcccaaccacagatgatccactcgcctcagcctcccaaagtgctgggattacaggtgtgagccaccatgcccggccaatcactttatattttaactgatgtttgccatcaattggatatacaagtttggagtccaggcggaggtcaggattgttgatatagtgtggtgatttgtatatagacattatacagagttataaaactgggagaggccacttagaagacagtgtgataccagagaagggggcctgggacagagccttggagcactggcacattatgaggtctggaggaggggaaggcagagccaacaaagcctaggaaggtttagccattgatgctcttgtatgtttgcga

SEQ ID NO: 48791 - DNA, 1009 bp, Homo sapiens
tcattggagcagttttaggtttacagaaagttgggcagataattcagagagttcccatataccttcttccctcatgactttccccttttattaacatctgttaccatggtaaatttgtgaaaattgttgaacaataatgcagtattaatgcattattattaactagtctatggcttatattaggactctgtgacttgtacaggtctgtgggttttgacaacaaatgtaaaatgacatgtgtccactgttacagtatcatacagaatagttttactgccctaaaaatctgttctctacctgttcagccctcctgtacccccagttcgtggcaaccactgatccttttactgttaacatagttttgccttttccagaatgtcatatagttgaaagcatatagtatctgaccttttcacactggcttcttttgctaggctatatgcatttaaggtttctccatgtctttacatggcttgataactcttactctccccccatctctctttattgctgaataatatcctatagtggatgaaccacagtattcaactgtgattatatcacaatttgtttatccattcacctattgaaaaacatcttggttgttcccagtttttggaaattatgaacagaactgctataaacatttgtgtgtggacttttgtgtggatgtaagttttcagatcatttagataaatatctaggagcacaattcctattgtattgtgttgtaagactacatttagccttgtgagaaacttctaaacttttccaaagtaccattttacatttccctcagcaatgaattattttttattttaaccattccgatacttatgtagtaattcttttcattatgattggatttgcatgtctctggataatgattttgaatatgttttcatatgcttatttgccatctgcttttcagtgaaatgtttgttcatgtttttgcccattttctaattggattcttgttttttaatttttatttgttttaactgttgag

SEQ ID NO: 48792 - DNA, 1035 bp, Homo sapiens
tttgggcagtaagttgaaaaaaatatttttggattgtagaggagtttttgctgtttttcaaaggatagctttttgaggggggcattgggtagtggctgttctccccttttataataaattcattgattggtattttttcaatctggttttttcaaaacttttttttaaattattgttgttatttaattaattgcctgatgacattttggtaaaatagtaatggattaacattttccagatcttgatttctaagttcaaggtgatattttactatattggtgagaaatagtttgttagtaggtttttacaggttgttttaggccaagaattgacttacctttactgtgtaataacattactacttgattgaataagatggttatagtcacttttgaaacagtattttggcttacaaagcttttttgaggggaaaaaatttgtttgtattggcagtcagccaatattttataagctacaattttcctttgaatagctggtggtttgtagctccataatttgtggttcttctgaacttgtaaaaagattacacatatttaaaaatggccttatcactttaatgttttaagcaatacacaactgtcaaattctgttatgttatagtattgttgttttacttaattttcctgggctgagaatctaacttaataatttatacagtataattggaatctcatccccctaaaccccaatgaaactccaaacaaacctaaaaaccaaaaactacattagtaatgtaacaggcactgttaaaggcaaaggaaatgtgagcgactctacatcggtctgccaaaatccttgcagtattcatgctagtccattatttagccactgctgcccggatgtgttgaattatgtggtatgtgggtttgtttgggtgtatatggtgttcttatgtgacatttagttttaaattaaggtttttgtgatgctgtcaatgttgccttttcacatgcagttggaaaagaatacttcattcgaaatgtttcatgttctgtaccttgttctcctggtttg

SEQ ID NO: 48793 - DNA, 1030 bp, Homo sapiens
tgggattcaaatccatatctatttggcttgaaaagttgggtgttcttgtcactaaatttgggaatgagcaggcaaaaagaaacacatggaaggaatcatctcgtttgagggattcagtactctcttagcagtacagtgtgtaagggaaggggatttgagtttgttagtcctgttggtgtttgttagttgccactttatcctgtcccactatgatttgtatgcacaggaggaaaaacaaaataggaaataatctttggaactctttatggacattatcatgaacaattagaagaaatggcaatgtagcttctgacatttgttcttagaaattatctgtttctttttttcttctcttttaatgagtctttatatgattttattttaaattcataaattgatttgcttgagtggtttagtctgagcagtattggaacttgattgatttcccattttaagatccttttaaaaagtggtgattcaattccagtgaagcataactcaaattgtgtgtattgaagacttttgtaattacatttttgcccctattaaaaaactttattttagcttttttaaagtttgaaagaacttttggtaggccagttgtcagtcattcctttgaaagcccctagtaagtcacctcataaaccttgtcacttttctactgtgttttggcccgaatcatgttacttcccttcagtaataggccctggggtaatatgttaaaatatgctggctttgggtaaaaaggatggtatcatgtaaaatacagctctctggctactttggacaaagagatttttttaaggttatgtgagcataacaagaatataaggtatagcaatagcagccatctacaaatgtcttgagtgtgtgtattgatagttatccaaagaagtatagatttttgacagtgaccttgtgactttcgctaatatctaaatactaggtacttccataaatggattttaagcttttaaaaacttttatttaaaagttttaaaatgcccttgtagcttggctcaaatattac

SEQ ID NO: 48794 - DNA, 1119 bp, Homo sapiens
ttgagctcaggagttcgagaccaacctggacaacataatgagaccacatctttatagaaacaaagtagctgggtgtggtggtgcttgcctgtagtctcagttacttgggagcctgaggttggaggattgcttgaacccaagaggttaaagccgtagtgagctatgatcatgccactgcactccactctaggcaacagagcaagactagcaaaaaaaaaaaaaaaaaaaaaaaaaaagaaagaaaggatgtcttggaactgttgcaacttggtaactactgaatgtgagggctgagcaacaagcctgacaactacagggtttcaagcctacttgattggcagcctggggttccctcagtataagcagggagcccaagagaagtgagatcaggaggaaaatttgtttggttttggtataacgtttgcaggtgtgatggttatatacaggtgatgatgattctgataaaaagaaaattagtattctctttagaaaggatgtgcatctgttgctttcgtgccttcattttgatatagctaactcccagaaagagaagtaagactcagttgctggatctattgctggcatcagaatctagataattgatttggaaaactttgacacagtacctgaatttttcttttcatctgtaagtagctcaacccttttcactaagtttgttagataagttgctctggttgtaaaaacactatgtattctcagtagcttgatacaacttacaggttatcctttgaaatctcctttactgctgcttcattggttatggatatctaagtagtgcctttcttacgtctttgaagaaaacagatgagcagttgagtgttcccaactagtaaccttgatcaccttgagatgaaggcagtgtttatttgaattaaaaggtttgcatgcttttgccataccatactcctgtttttccccttaggacatagagccacattggaagaggacaagccttttaacctaattagtggtagttaagatgttagttgccaaaacatttctttaacagcctacatttaacaaaataccagaagatatcagaggatgtagctttctatgccaggcagattcaagaacaacagtgtaaggttcttttag

SEQ ID NO: 48795 - DNA, 1026 bp, Homo sapiens
tcttcagcctgagcagaagcttgtgagagacattgggttctagctatagcccaagattgtttctaagcaggaatttccagagacagaggccttctttggctcagtgaattcaattctttttttgggggtggggaatgcagtggcgctctgtcgccaggctggagtgcagtagcacaatctcggctcactgcaaactccgcctcccgggttcaagtgattctcctgccccagcctcccgagtagctaggactacaggtgcccgccaccacgcccagctaattttttgtatttttagtagaggcggggtttcaccatgttggccaggacggtctcgatctcttgaccttgtgatccacccgcctcggcctcccaaagtgctgggattacaggcgtgagccatcgcgcccagccaaattcaattcttatatcagaaataataaacataatacattttcctatgtattttgcagaaaattgattactgactgagtgactggaatagaaaaatagagctatcccttctgctagtgacgtcaagcttccttgttctgatttactgaatactccttcctttttcaagttttagttatcaaataattacccatcatttggtatttccgtatgctttgacaggtaatgctctatttgagggggaatgatttttaaatgctttcttaatgttgtgtttggtttacaagttgtaaagagccttccaggtgttggtcatgattgacacagcaaaaatgtaaatagcaaattgccttttttttttttttttttttttgagacagggtcttgctctgtggcccaggctggagtgtggtggtgtgatcatagctcattgtaaccttgaactccagagctcaagtgatcctcccgccttagcatctcgagtagctgggactacaggcatgtgccaccacatctggctattttttttacttttagtagagaccaggtctcaaggtcttgctgtgttgcccaggctgatcttggacttctgggctcaagcgatcctcctgtctc

SEQ ID NO: 48796 - DNA, 1053 bp, Homo sapiens
ccgtgttgggcacacggacttggtgcctggccctttaatctggcctgggttttcttgaatcacagatcttcatctccactgggaatatcaaagtgcttgggaaacttagaagactggggcagcagaaggggatgcaggatctttgaagtggagaggagagattcattcctcctgacttcttgccccaactctcacttccaattgcacattaaataatcccagcactttgggaggccaaggcgagcggatcacctgaggtcaggggttcgagaccagcctgggcaacatggcgaaaccccgtctctactaaaaatacaaaaattagccgagtgtggtggcgcacccctgtaattccagctactcgggaggctgaggcatgagaatcacttgaacccaggaggcggaggctgccgtgagctgagatcacaccaccacactccagcctgtgcaacagagtgagactctgtctcaaaaataaaataaccagctttgtggacagcaagatggggctgattaagagtaagactgtctcctggagtagctgagcatcctgggactcatcagggcccagaaacactagccagccactctctggccagtccacccctgaagttcatttcttccttcccagctgatgtccatccctccatcattccatctgtccattcgtgcattcattcattcagcaagtatctttgaaaacctactaggcgcaagcacggacgatttttttaaaggaggccttaaaagggagtccccatgctgactcttggttgacttgcattttcccaaaatgaaattttcctgtgtcaaattttctttctgaatcaatgataggtttcctagtcccttaaaactggccgttggcaattggaagaagacttttttgaagatttgtgggggaaacattccctttacttttcaggtaacattacttggttaatattcagttactaaatctcttcaagaagtactggctacttccattactattcagagcacagctgatgtgacgcccaggggcttccgtggggcagggatcggggtaggagg

SEQ ID NO: 48797 - DNA, 1044 bp, Homo sapiens
ggtgactttggaaattttagttgacaaggatagcacaatgggctaagaatacctgcttgttttagttttcgctactagctgtgtgacctcatactagtcccttaacctctctgggcctcctgtttcctgtctctgtaacagggaaataatccttctctaacttgcctcaccagggactgtgaggttcaaaagaaagaacagaagttaaaatgctttgaaaggaaaacacatcatataaatagaagagattattattaaaatccagtgtccttcaacagaaccttgctgatagcacacagctttggaaaaccagggtcctcacgtccataggacttttctggaaagacctgtgggtaccatggggagatggaagatggagtggtcccatttcatcttcaggatatcaaaccagaacctcgtgcggctgtaactgtactctcatcctcacaccgatgcttgtaacctgggagttttgccattttacagaagagttcactgagacttaagagagattaaataactcgcctaagtggcagaaccaatactgaagtcaactagaaaatgacagaaccaactcgtgaacccatgggtttctaacccgaagtctatttcttggggtttaccccaccaatatttctttcactttaagaagttattttcccatggtgtaggtcaaatcccaccagactctgcagtcctcaaggacaaggactgtgtcttattctctgaatccccctggtcctggcccccaaatacttagttgttccataaagacacacaggaggaatccttccactctgtgacagtccatctgcttcccctccagatgtgtttttcaggaaagcaggcactttgcgttgaccatcgaagaaaactccggccttctccccgcttcgccggccctctctcccctcctgccctggcccagctcgggaagtgctggaggaactgtcgaattgaactctccttagcaaaagatcgccaaaggcccagtctttttgaactgacttaagaagcagcagtctgtgtagccacatttcaacc

SEQ ID NO: 48798 - DNA, 1057 bp, Homo sapiens
ggaggagatgtgtgtgtgagtgaggtggacagggtgtcataagcaagaaaggcagctggagaaggtcacttagagccttgagtgtcatgctcaggaaccaggctggccccacctgcatggacctgtgcagtcacacagggccccaggcttggcttaatgctctgctgtcaccgtcctgaaattcctaacatttttacctttgaactggtgtggggatgttttgtttgttttgtttcaagacggagtttctctcttgttgcccacgctggagtgcagtggcgcgatctcggctcactgcaacctctgccttctgatttcaagcgattctcctgcctcagcctcctgagtagctgggattacaggcgcccgccaatatgcctggctaattttttgtatttttagtagagatggggcttcaccatgttggccaggatggtctccatctcttgacctcgtgagccacccacctcagcctcccaaagtgctgggattacaggcgtgagccaccacaccaggcctgaactggtgttttataaatgggacagtagagtaaggacattggcaaaggagacacgcacagaacatgtgtctccatggggcctcgccatcccaaccccatacaattttctagtgcctgcagcaccaaattccagtggacccaggatgtggggacattcagcaggactctacgtgctcacaaagtaaacatgtccatgtctgacagccccaagaggccacactttccattagaaccagaacttgcttcaaatacagaaagaaggcaataatgtttttttgttttgttttgttttgttttgtttttgtttttttgggtttttttcctgagacgtcttgctctgtcacccaggctgaagtgcagtggtgtgatcacggctcactgcaggcttgacgccctgggctcgagacttcttcctgcctcagcgtcctgagtagctggcatgacagacttgagccactagccaagcccggctagttttttttttttttttaagagatggggtctagacggggtctctctgtgttgcccaggctggtc

SEQ ID NO: 48799 - DNA, 1144 bp, Homo sapiens
aaatagcctgtatttctatatggtgaaacagaagatagatgaggatagtgctaacgtagttttttgggttgaaataatgctcataaggctcttctgtgctactgataggagtgttgaagtcacttagcagtttatatcaacagtcttagaaatggccaggcacagtgactcatgcccttctatcccagcactttgggaagctgaggcaggaggatcacttgagaccaggagttcgataccagcgtggtcaatatagtgagaccccatctctataaaaattaaaaagaaagatttagctggacatggtgttgtgcatctgtagtcccagctacttggggagctgagctgagaggatcccttgagcccaggagtttgaggctacagcaactcatgatcatgcccactactctccagcagcctgggtgacaaagtgggacctcatctcttaaaaaataagtaaataaaagagccttacaattgttcgtgctctgtcagcttcaggaaacgttttctgagtcactgcactgtgcctggccctgtgttgggcagtcatccctaagttctaaatgtgcacacttgagtaaaggaagtcggctgtagatgcaaacacttccaacaccacgtggtccgtgctgccctgatggggactgtggagccccacagaagacatcaaactcagcctggaacagggatgcctgggttcatgttaaaagttgtcactcaaaggaaatttgtgtagggacccagtcacggaggtaagcagcagtggtgttgtgtggctggaacataccaggggagatagggagtggtgggaacagacagggtccagatttggggaagcccagaaatgcacattctggtcctcaacccaaaatgacagtgggcagtatgaccagtgagtttgatttcagcactatgtgagcagccccgtgaagacagctcccaccaagggcaccggcagcacacaggctgcggttttccccctacgtgtaccagcgcatcaataacggtgtcccaatagcagcttctaattaaattttatcacagtcctgaatgcaccgctgacccacacactcttccaagtgggtccgattcacaggatatttgcgcagttccgcagatctgcagatttgaagaggtattt

SEQ ID NO: 48800 - DNA, 1013 bp, Homo sapiens
actgatgttaaagatttccatggctctttgaagccatttgttgagggcataccagtgccaggggctgtgcgaagtactcttaaatacactcccagctattccttgaaaccatctaaaaagatattgctgttgttccactttgatgaataaggagacagaggcataaagagagtagttgactatgccaaggtcacatggctgatattcaggtctcaaatccatctgactaactcctaagtccatcatcttaacactgcgcttctgtagatagcatgccgtagataacctccatctcaaagcactgaccacctgccaggtattatgtgaagcacctgacataatgatatttaatgtactctccccaaaaagcctaagaggtgagtggtattatccctgctaaatcaatgagcaaactaaggcttcatcatagcagccatggtcacggctagatcttgcaaagctgggaactgagcttcagtctgtctgctcactactccccctaaataatttttagaaagttattcatgttgctcagaaatgtttctctgtagccatgttagaaagttagtgggctcaaaatagatcaagacctaaatttaagacctaaaactatgaaaacctgtggaagaaaacattgggcaaaagcttcacgacactggttttagcaatggcttcttggctatgacaccaaaggcacaggctacgaaagaaaaactagacaaattggacttcatgaaaacttaaaaattttgtctatcaaaaagacaatgtcaacagcttaaaaaggtaacccacagaatgggtgaaaatgtttttaaagcatatatctagtaagggattaacatccagactatatagagaattcctaaaactcaacaacagaagaacaaacaactgattcaaacataggcaaaagacctgactcgatatttctccaaagaaaatgtacaaatggccaataagcatatgttcatcactaatcattcaggaaatcaaatcagaatgacaatgag

SEQ ID NO: 48801 - DNA, 1058 bp, Homo sapiens
atgtccaggcccccctcagagatttctgtcaagttcctgtgatctgaaatcagagccaaggcccaccatcttttcctagtgctggtctttaaaaaaaaattattttactattgtattattattattattttgagacggggtctcgctctattgcctaggctggagtggcatgatcatggctcatggcagcctcaacctcctaggctgaagtgatcctcccacatcagcctcccagctagctgggactacaggtgcatgccactgaactcagctaatttatttttaatttttgtagagataaggtcttgctatgttgcccagctggtttcaactcctgggctcgagtgatccttcagccccagactcccaaatctcgtgctgagattacaggcatgagccaccgtgcccggcatgctggtctttttgattgtcagtaatgtttcatgataccacactgtgctaaacatctttatataaatctttatgcatggtttgaattattttcttaggcggattccttgacatggatttactgggtaaacggatgtgagtccatttaaggcctttggcacataaggtgtgagagaaagctggtgagcagacacagggggatgtctgcagggaatggcccctgaggcgggtgccagggcagggcctgagaacagtaggtcactgggggcagaatgagcctgcagggtagaaggccaggtatgtgaacgccacgcagggcagcccagctgcagtgctaccagccctctggctcacctgtgctccctgcttcacagtgcctccacaacagtgcccaccatgcagggtcctggggtactgcccatacaggtgggggaggtggaggtggggtcatggctgtcaggttactgcagtcacagtgctgtgttttgttggaaacagaaacatgagggacctaagcgggctcctgtctgctctgcttctgcctccctggaccctgagcagttattcacctctccaatcctcagttccccttccataaggtggatgtgtaatcccctccttgcaggagtgtagtgaggcttaaataa

SEQ ID NO: 48802 - DNA, 1066 bp, Homo sapiens
tacctctcaacacaaggaggctgtgctatcatgtgtgagaccctcactgctctgggggctgttatgccctgtgcaccaccctagacagtaagccccaaccgcgtgtcagatgcagcgccaggcccctcacactcacctgctctccctggggcttcacagtgcacctgtgcagtagcggtgatcagctccactttacaaatgaggaaaccaagactcagggaagagaaacaacttagcccggaaaagccagatggccccggagcccctgctttcccactgggcctcgccacccctgttctttcacgggaccgctcctccacgcttgagaaagcagagcctcctgggtctcacgcctcatggctcctgagagtggttttggtgtaagtgaccacaatgaagaccgggaagtgaccttgcccacctctggcccttccccctttctgggcctcgttgacttatctatgtcccctgcctgcctcaggaagtgactcgtgattgcaaggatgtgaagacagcaggtcttctctgaaaccaagggcagtagcagtcctcttagcttcagagagaagttcttctttgctgtttctctcctcggcctactcttggctttctggttgaggagaatgcaggaactggcctagggacctgggtcaccctgcagaggggagaatgttggagggaaaccttgccgacaggcctgttctcccaggagcacagggctgccttcgtcttgaacgggtgagtgacgctgtcacacccagcctagtcggagtcagaatcagagttgggtgtaagggaccagcactggcttcactgcctataggccggggctgtttgtttctatttttactttaacctatagcatttaattagatcaaatcacaaaagatgaggggatgtgagacaatgcattctttatagaaattctgattgtgagcaggggtcacgcttccttgtaagccgcaattatacattggtaagtatctttactgctctgactccgtcgtgtattcaagtaaaacacaaagagtaacagcaaacaccttgtttccccatcacccaggac

SEQ ID NO: 48803 - DNA, 1048 bp, Homo sapiens
cccttctctgtaaaatgggtattgtatctatgggtattgcaaagttgttatgtggattagaatagatgaatttaaagttcctcatataatgtctagcacatttgttattggtaggtaacataaatgataatgtatacacacacacacatacacaccgacccctgaaatcaacggcaggaccggtgtatccaaaatgcccaggttttaaacccattggagtttagttctcatgcctttgctcagtcactgacttaggcaacccgtggctccgtgaatgaagcagttggcagaggctttctgaattatagtgtcatgggatggcatgtgtgcaactggggaggagatgcttgctggcagctctccaagtactttgtccaatcagaatggacagttagatcacatctcttgatgacagaggaagcagcaaatacaaaatattcttctttgaaacacattatgcccttcatccaaccttaactgctttttctgttgtaatcatggcaataatcgttcccatctgtattagaactctgctgatcatttaacgtatattttctttgattctagtaacaacgtgctggctggaatccaggattccattttaaagataaggcaactgaggctgtgcagttgcagagccgctctttaggggctaatatcaaggttgatgctcttcctgctacccatgctgtttccaatgctgcccacgttttgaaattcttctgaagtttctaggcttgggaacaaaatgtcatattaggatttttgttgtgaaaggaaatgtaactatgcatacgtttattaaaacagtttttctccaaatagtgaaccatctgtaattttctgtcagaagcaacagacattaaagcagctgtgtgtctctgtttctcttcacagtgctcccatgccctacctcataggaatccatttaagtttaatggaggtaagttggcttctttcctccccagatggctctacctggggctttgtttcattgtgtggcggtggagagacccagtctcagcagtcacagctctgcacgtgggag

SEQ ID NO: 48804 - DNA, 1003 bp, Homo sapiens
gaaagaaaagctcacataagacctccttcagagtttttctttctgactgtgggatcccctttgcctgatcagggtatttaattaagaaggtggtggccctctgagaggtaaggtgacactgtgatgtgtatattgtaacgtggatacctatgtgtaaacagtgatctttccaaatccctgggctgccctaagctgtgttccttcatgatagcagaggtgttgcccacctggaggtggagggaccgcctctcccttgtttcctctcccctcccactttgtcttgggaagctgtattttttttttttttaagcagccagtgttcctttatttcactggactcatttccaattagtagctgctcacctcaggggaacatgattaacagagccctggttatctgggggaaaggaattaaacaaattgtgaaagtgcggtaataatgaacaaggactacaggatcgttagtaagtctgcagtttccatattcttgcttcttccttgctgggaataagctcatgccataggacttacctgtcagagaagcgctcagcatcacaggcctggaaccaagaggactggcgaatagcccttttggtaccccagcgctcttttcctttcagcttaagtactgagtatgtgctgtgtgacctcatgtgcagagcttgggctgtctgttcagcagccttgcgtctgaagtacggcttcaccactgaccagctgtgcgatcttggcaaattttatctttctgagcgtgtttcctaacctgaaaatatggatgatcgcaccaccttgcagagttcccttgagcattatgtgtgtaatgcataaaggtgactgaattatagtagctcaataaaagttccttttcctcttaagaggattcaaactaaagatatcttccaggtaaaggttattctgttgtgtctgcctcaacaccagcaacagagcccttttccttttcaggggagaaggaaaaaagagtcacttttactctcacgtttgt

SEQ ID NO: 48805 - DNA, 1030 bp, Homo sapiens
aacatagtgaaacctcgtctctactaaaaatacaaaaaattagctgggcatggtggcggacgcctgtaatcccagctatttggaaggctgaggcaggagactagcttgaaccagggaggtggaggttgcagtgagccgagattgcgccactgcagtccgcagtccggcctgggctacagagcaagactccgtctcaaaaaaaaaaaaaaaagaaaaaatatctagtatctgttgatgtagctccacctccaccactaccaccctggtccaagccaacaccatttcttgctgcattgttagaactggtttccctgtttctaatcttaacctcctagatgcagcttttctcatactgcatttctcatctgatcccagaacacaaaacagaatttgaatgacactgttttctcagttctcccaaggatggtacatattatttttgctgtgtcaattactatggtcttaatatctatctagttctctacgtcttcttttcttcttggatgttctgcttttcttggtattgtgcctttccatgtaaattttagattcagtaatattatcaagtctcataaaaaccaggttgaaattttcactgaatacagataagtctggaatgaattgacacctttatgttagtgagttttcctgcccaattcctgaacatggtgtcagtttatttagattttattttaatatcttttaaaaacacttcaaaatttcttccataatggtcctacatatctttgcttcatttttttcccctaaggacctatgtttttacgggttctataaatggcatatatttttaattacatttttctgttctcgtgttgtttagaaactcaattgatttctgaatattgatcttttgcccagctacctaattctagtagtttattatatatccttttggatttcagatataaaattatgtaatttataaataaccactttaccttttttcccctttcctattctttgtaccctttatttccttttcttgtccagctgtgctgcttaatatctt

SEQ ID NO: 48806 - DNA, 1050 bp, Homo sapiens
tgcaaatttttcaaacttttatgttttatttcccttttaaaactgaatgcctttaacagcacccaagtcacctcttgaatgctttgctgcttagaaatttcttctgccggataccctaaatcatctttctcaagtacaaagttccacaaatctctaaagcaggagcaaaatgctgccagtctctttgctaaaacataacaagagtcacttttgctccagttcccagcaggttcctcatctccttttgagaccacctcatcctggaccttattgttcatatcatgatcagcatttttgtcaaagccattcaacaagtctctaggaagttccaaacttttccacattttcctgtcttcttctgagccctccaaactgttccagtctctgcctgttacccagttccaaagtcacttccacatttttgggtatcttttcagcaatgccccactctactggtaccaatttactgtattagtctgttttcacactgctgataaagacatacccaagaatgggaagaaaaagaggtttaatggacttacagttccatatggctggggaggcctcacaatcatggtggaaggcaagaaggagtaagtcatgtcttacatggatggaagcaggtaaagacagctggtacagggaaactcccatttttatagccattagatctcatgagactgattcattatcatcagaacagcatgggaaagacctgcccccatgatttgatcacctcccacagggttgctcccacgacatatgggaattgtgggagttaaaattaaaaatgagatttgggtggggacacagccaaaccatatcatgaggtagctcacttttgttggtggagatgggaaatgggatgaaacctgaagagcaactaagaatgttacccaggtggatggggaggtgggacaggaatgggagagaaggcagagcatgataggcaggttggacagcacgggcagaggcccaggaccaagggagcacagtgcttctgcagagtggtggagcattcagtatgcctggagcagaggagaatggcag

SEQ ID NO: 48807 - DNA, 1049 bp, Homo sapiens
tttcccactcagccccatgacaataaaattggagaagactcttagaaggcaaactttttgggaggataggatacctttgcaagtctgctgaaagctccaggaactgtctccaaaaaaatgtttatgtgggtttccttaaaaagttctatagacattataggttttcacagaaccccttctgtggtctctggatcataggctaaaaatccatatttaagatcttttcttcacttgctgtttttttcaccattattaagaattacccaagtactgtatacctcttctatgataccagggagcaaatttcacactacctattgtgggtgcttgtgtgtgagcaactggtaaaagccagaggctcctccctctattctcttcattcattttttaatgctctgtgctgtgtactggggattcagctgtgaataaagcactatccctgtcctcaaggacttcatggtctggtgcatttcggaaatggtcatttttggaatggctaaagtatgttcgtgtgatagggagaggcagcatggagtgtggtggaagaatctggattcatagtcaggcttggattcaatgtgagacacgttattattgaattatctgaggggcttttgtgtcaagggaataatgatgctaatgcctaccttacatcctttacaaatgagagcttttcttcgtaaaaatgacttcttctgaaaatgaaatacatgtaaagtcctgagaagaacacttgttgcagactaggccattaataaaggttgcccattattaaaaattaacacattttattcaacaaatatttgagagggaaatcaatgctgtgagtcaggtcccattaatagagatggatgtataaagtcgtatcatagtgcaacacaaactttgatatttaaggtctgcattcactaatgcccagtaagattttactaaaaactggtttaagtcgtgagtagaaattatattaggttgtgcagtttttcttacttactaaaagctgaacgtgtttttcttttgttgtttgttgtttacctgttagaatttagttt

SEQ ID NO: 48808 - DNA, 1043 bp, Homo sapiens
ctctttaacaaatactggttatgagtcccttgatagatgttaacatgttcagtgctttacattcaggatagcgtttctcttatttcaatttcttactcttctaggaagttttctcagctaagactgtcaaactagtgggctcttttaaatggtgtttgaaagaattttctcatataaatttcccagaaggatatcagtattttggggttagaaaatggcttagaatgtaagtggcaaaacttcaataacagctcccaaatggcagtccatttactcacatttgaggggattaattatcttggaattcaggtgtctttgttttaacagtattgttttcaaaatattttgaaagatgagcattgcttatgatttatacctgtctcttgtctaccccctttgaagtgctgctgatggctgctaagacccctggaaagagtggattttgaaatttcattttggggatgggaggagcggggagtacttttgccacataatactcttttaaagatcgaggaatgtgtacaaaaatcttagcttctgctacgttttttccaaacacaactaagctttctcagtaaatttaatttggactactcagttgtatagtgggttgccctttaaaaactgagttcaggctgggtgtggtggctcacatctgtaatcctagtgctttgggaggtcaaggcaggaggattacctgaacccaggagttcgagaacagcctgagcaacataatgagaccccatgtttacaaaaaattagccaggcatggtagtgcacacctgtagttccagctacttgggaggctgaggaaggaagattgcttgagccccaggagttcaaggatgcagtgagctatgattgcaccactgcactccagtgtgggcgacagagtgagaccctgtctcttaaacaagtacaacaacaacaaccaaaactgagttgaattaaaggttaaattaaacattttaaatatattccatatgagatgccaatattaattctaacctagcacaataataattttaacccaggcaggatta

SEQ ID NO: 48809 - DNA, 1044 bp, Homo sapiens
ggtaaggtggtcgtggacatctcaccacatcacatagtatagtagatattgaaaggtagaccaattgtcataggtgagatgtatgtgggcatacatgtgacaaagtgtacatgagcctaggttatgctagcttgcagatgacacttggtaatgaggtaggcacttacacactgttgatcaggttgtaaaatggtccaacattcttggaaaacaattggcaatatatattcaaaacctttaacattttttccactttggggaatctgttttatgaaaaactcagaaatataagtacggatatatggacaaggacatttagcatatagagtgaaaagttagaaacaattttaaggcctagaaatagaggatagttaaatttaattagataccatgtagccattaaaattggttttggtgattatttgatgacatggaaaatatccagtacttatagaagaaaagcaagagacaaatttttatatgtgatgtgatctccattttgtaaaaagtatgtagaaaaaaatgacgtgggggatcggatcccaaagtattaatgagaatagttaagtaatgttatcatgggtgtttttaattctctttaatgaagtagttatcctggctgttctatcaagcccaatccaaatattcactgcacaataatttacatattttttagtttggaaaaattataaccaccttcatatatctatctcatgatttcaaatatagaatgccacaaacggcagtactttagctaccaaaatagtaactgatactctaatgtgtgtttccccactaagtttgtgaaacggacttacgctctgaaatcagaactgtgttcaaattttgattctaccccttactagatctaaggccaaaacatgtcatgtcacctttctgagcctgtttccttaactgtaaaacagaaagtacatctcatggtagccttaaagattacgaggtatatatatttttaatttaaatttaaatttttttattttttattttttttttgagatgcagtttcacttttgttgcccaggt

SEQ ID NO: 48810 - DNA, 1046 bp, Homo sapiens
cttgagcccaggaggcagagattgcagtgagccaagattgcaccacttccctccagcatgggcaacacagtgagaccctgttttgttttgtattttacaaaacagaacaaaaaagaataggaacccggagctggagaggtagttcagaagtgaacacttgaatttgagagtcatttaccttgtgctgttaattgaaactaaggtataggtaaactgctaatagaggaggacgcagagagagaaggagaaagataaagtcctggaaaggagttgagaaggggcccagaaatagagcagtgagagaggcaggaggaggcccttctgtagtcttcatctaatggaacgtcattggacaagcaatgtgttttgagtgagtggggagtagagcaccagaaaaggctttctgctctttcaatattgctttaaaaatattctaagccaaacaaaccccaaattgaagagctctccattatccatagagcatgaattcatttatctgtcaagaaaacccatggaccttacctatagaaatgaactatattgatctaagaattgtctctatgaagagtccatgccacaaaacagttgtgagttttggatggtggaaacatgttttatttttaattatttatactttaaacatttttttaaaaatagcatatttgtatgcggtaggcatttggtcatttggcaacaatcacatttgaatcgttgaattaccagagaaccaacatgactggcattggcattttaccttttaggatttctgaatttgggtttttgggtgttggtgagtttgtttgggttatgcggtgtggccaggctccttaacactctagatcgggtttggcagactatagcctgaagccagctggtcacatcctgcccggggctggattttgtatggcctatgaggtaagaaggttttttacccttgttaaggattgttaaaaaaacaaacaagaacatgtgacagagaccataagtggcccgcaaagcctaaaatatttacaatctggcccttttgagaaaagtttgccggctcc

SEQ ID NO: 48811 - DNA, 1054 bp, Homo sapiens
acaaagctagcactgcctttagagtggaaaaagaagtaagaagaaaggggagggataaaagagagttacaaatctgtggtcccggagatgtattactgttgggccagttgtctgcgtgggatgataatccattttgatcttctctgtcttaattgtctgctaaagacaaatgggcagtaaaagttcatcagtttcatctttttgcttctcgtttagaagcagaataaatgatccatcactacagaagaagcctttctttctgtcacggaagtaatgcagacccaacacgttttattaaaatgttttcccctcattatttcagtcctctcagctctgatagatcttactgtttcataaaaaatgtaatctgaaatgtaaataagggtctcgatacagaaggaagaagtaatgagcagcctgattgtaattactgacaaagtgatttctctgtgccccattttttttcctccttaagttgtctgtgacaccctcagaccacaatgacatctatggtttaaaaccattaaatcactgtagcactcaatatttcatttaaaatctggtaagcctgctatctttaaacctggaaatacaggctttgttaattcctgaaagtcatgcgttgcctatattttttttaaaagaaaaaaaaaaaaacaaggcaaaagcaggggtttttcagagttcatattatttattcatctgcttttgtttaatgcttagctagtttaaatactaaaacatcaacattggtaggatcctgacttgaaaagaatcctgtatttttgaaaaattttaataacagcttacttatgaaattttcttaaattctatctcccttaactgtaatatgacgtagtctaaaatgtctttttagggttaagattactaaattacagtgtaagttttcagttactttggatttgcatagcttggactagattcttttcagtctcttactgtaactttaggtaatgtggctcttaataaaagccaattggaaaattttgttaaaggactgaagcacaataataatgtatttctttcatttcta

SEQ ID NO: 48812 - DNA, 1044 bp, Homo sapiens
tttttttttttttgcctccagcacaccctacccttccttttgcattttaaagctccctttggaatttcacttatgtttgatttttggattcacatagcataaatttgtttaaggatcagacttatattccttttgtagatgaagttataaaaaatatttcaaactatcagtaagtagtggcatttgctggttaaaatccttccatattctccagaaagaaagatgaaactccctagattttactgtataatgtcaatggactcattatttgtacaacagctgatgtatttaggacttgttgattcacttaattggtaactgtactacattcataacttcaacaactgaaaacaataggtcagtgtctgctgtttatgcataaatagtcacatcggagcaggatatgtctgaatggcagaatatgttagtctgaggaggaatctggcatgtgaatggctccattgcttgccatactgaggtgggtttttgctgtctttccttgaataatgttatttgtgtttttattatgggtgttgatggttaactgttcctatgttatcaggctggctgctgtgaaattgcatttgattatactttaaatgccagtgttgggggaaaatggtagactagactcatggttaaaaattgggatgatttaaagtttttatgtcttacagccttcatgtgctaaagcaaaaagttacacctagaatagattttttttaaataacaaatttcatttgtacgtggaatccaaataaatgttcatttatagtccttcaaaatgattttttttctaatttatgaattagacgtctttcaaattttagagtcaaatctgcattttagaatcagtattttttgaaaagagtaatttttaattaaaaaaattcaaaaggaaaaacaacctaaacctttttgtttcattgtcaaaaaaaggaaaacatgctggtgatttttaaactctgtaaaacatttcaaacattcttttcaaaaatatattatttgtaacaagtaaattttaacaatcgaacaatataattt

SEQ ID NO: 48813 - DNA, 1904 bp, Homo sapiens
ttgaaaattttctgttgacaccccctagtaagatcagcatccattacagaatgggtgtcaccagcttgagaaaaaaaatctcagaggcagtagttgcgcttttcttcttttttcttttctttctttttttttttttaaaagaagagctgtgtcatcagtgttcccaggagcattgggaacacgaatactttcactaattgattgtgcttatgttttactttttatgtatgtatagtagtattatataaaaaatctagagaactgtatcaataagtgtaagttaattttacgtgataagaaaccatggtaccaaactttaattgctctctcttcttttttgttttggtgtttcatgactaatggtgcattttattctcagtggcacttagactctgaaatatggtaacttgcttcttgcccacttaaaaatattcattatttattgggtaaatggagccaagctttctttcttagaaggccttcttataggacatattttaaaatgaactttgaactaattttactcattctagctttaaataaaatttataagagataggtaaaacctatgttcttgaaatgaaattttattctattgtttggtaccacataatgaagttaatctttttctccaaaacagtaaacttttagtaaggagataggttttattttattttctaatcatttaatcttacactagaatcgatagctaaagcttttttccccaataaattaacagtttacagtagtaccttagatatagattgggaggtatgctggtgttattaaaaaatcagatgaactctataaacacccatttggaaaaatagctattttgacatctttcttttctttactttttggctttctcagttttgaagctacccaatgtattttgagtttaaattacatatattggtgaaaaaaaaaagttaacagtatgtagtccattggtgattttccaaatccaaaaattgatttaccagcaggtactatacaaaatttcttcacatcgcattcagcaaacaactactgagatattatgttagaatttacaaagatgaatagaacaccactgtcccgccttcagagaactttcaatctattgttggcaagtgattgcgagttaaaggtcttgttaccccactctggatttgagtggtactggggtttagagtgtaagagcttaagttttggggtgtttctagatctgagattaagtcctggttctgctcctttgtcagattctccctactttacctctctgagcctgtttcttctgtagggttactgtgaatacctagcacattgtagatgttcagtaaatgttagctggtgataatgagaattatcaccttgataattctcatcttcatttcagtgttatgaaagaactttgattttcatgtcaaatagacctggccagatttcagttctgatgtttattaggtgtgcgataccacagtgcctactgaatggctcttcttgactttcttctcatagacatctcaaattgaacttaggatcattctcctaattttgcttattcaacagggttcccctcttagagtttcttgtgccagaaacctgggaattgttctcttttccctccgtctctcttggtgtttcttctgtcttacatactcactcacctttcccattcagttctatcatcttatctcaagccggctgacttccttctgctcccacgctatcacctgcatcaagtcctgcaccacttcccactcaggctactgtggttacccagctaatcttatatttcattttgcctaattccagtccattctccacagaacagctagagttatgtttggaagacacatgggatcttttcgctaccttttactcctttttgcttaaagcttctcaggggcttcctttta

SEQ ID NO: 48814 - DNA, 1050 bp, Homo sapiens
cgagtagctgggattacaggcgtctgccaccacacccaactaattgttttgtatttttagtagagatggggtttcaccatgttggccaggctggtctcaaaccctgacctcaggtggtccgcccccctcggcctcccaaagtgctgggattacacttgtgagccactgtgcccggccctcttttccctgttttgaagggaaaactttccacatttcacctttcagtaccacggtggctataggtttttttaattgagttttttgattgatttataactcacatatagtaaaatgaacaaatcttaagcatacagtttgaattttgaaacatgtatacacctgcgtaattaacacctcagtcaagatgtagctcagtttcccatatactcttctctttatttccaattcctttaccccaccagagacaacaactgttctgatttatgttaccatagattagttttgcttttcttaaaccttatagaaatggtattctatagcatttccttacagaaatggaattctcttggttctggcttctttcactcaacataaagattttttgagaatcatccatattgcttcacctatcagcagtttattctttttactggtaagtagtattccattgtataaatattataatttgcttatccatttggatgaacattcaggtgagacacagtttttaaaaatagataacctttatcagattaagacatctcctttgtgttattggaataaattcaagtaggttgtcatgtattattatttaatatattgctgcattccttttgctaaaattttgtttagaattttcacatcaatgtttaaatgagggataaatttcctttcttgcattgtctttagattttagtatcaaggttttactggcctcaaaacgagtgtttcctctttctctattctctggaaaatttggtgtgatattgatatgtgttgttccttaaaaggttggaagaacttactaatgaagccataagagcttgtagttttctccattaaacatgtcttaattatgtgttccctgta

SEQ ID NO: 48815 - DNA, 1034 bp, Homo sapiens
tgaagctggttttaagacccattgatgtgagttatcaatacaaaagatctttctaaagtctgaaaggtgaatatctctcatttgcttactagaaagcttaggtgcagaaaaatatataggctatttctttttcccagttaaataattacatcaaacatggaggcacattcaggactatttactgctagtgaagctcatgatgacttttttttactaaccatttctgaaattcatgtattatgcctaaaaaagctcagagtaggtcttgggaattaggaattggcagggttctcacttgatcattataggaaatttcacatttctcccccctaaggaatttgtggagaaaaaaattgtctgccaaaaagtgtaaaattctgattttttttccagctatttgtttttgtttttatgtttagaaaaacttttttataacatgaaaaacaggaacaaacaggaaaatgcagaaatacaagttaacagtttgatggattatcacaaagttaaaacatccaggtcaagacatagaacattagtaagcatcttgccagccatccttatgtgtctttccaaacaccattccctcaattagagaaccattacctttttgtttttttttctttcgtttccttttttttttttttttttttttttttgagatgaggtctcaccatcgttcagaccggagcgcagtggcgcaatcatagcacactgtagcctcaaactcctgggctcagaggaccctcctacttcagcttcctgagtagtcgtgactacaggcatggaccgctcccccggacccccaacctggctaatttcctgctgtgctgcccaggctggtcttgaacacctgggttcaaatggtcttcccacctcaatcttctgagtagctatgattacagtgtgagcaaatgtgcccagctaaaaccattatcttaacttctaatagcattgatcatttttacctgttgttcaacatatatacatggagttatatagatggagtcatgagtgtatttaatattttacttggt

SEQ ID NO: 48816 - DNA, 1032 bp, Homo sapiens
agcttatagttacattacttgtgcagttgttagtttgcctgagcttctgtactggaccttaaactctgtgagggtagtgatcacccagtattttcttcaccactgtatgaccagatctcaatattaagaagatttagtgaatatttatggaatgaacaaacactgaaaattaggtaatttatgtggaaatgcctttaaaatgaaaattactggagaaacattattttgatgatctcttaacatttaaaataactgtgattagtttattgaatttataattttttgtttgagtgaagagaaattctaaattctcatggtatttaagggtgcatcatcttggatagatccacttattgctgattagtctttgtttactggaattatggaattggtataacaataacaaagtgtacggtagggtctctctggaaagcactatactactttctaaatgacatcaccttggtaattatcacatttggtttaagatttcacttagcacaaaatgggttgcagaaagtcaaactctcgtatatatttaagtaaaggtgatgactttcttcacaatagggcagagatgaaatagcttccacatttgttattctgaatggagccttgggatgaaattccaagcagcagaatgccacttaacattctgcatgctattttgctctttagtagcataattgtaaaatgaggcaataaaaccagaaaagatataatatttatacctgtgtaggcacttcacatgataaaatgtcacacgagactgtttactccatgctggttatttggataacgccccacctgcctagtaacaggcggtgctgagtcttgcataaatcttggaaagaaggttagggttaatatagtgagttcttcagtaggaaaaaaaatacagcatatgtgataataataatggcgactctttgattactatttttgtaccggcactgtgctaggcccttggggacagagtgtgacaaagagggagataatataagtgagtacctttcatgtgtcagctattct

SEQ ID NO: 48817 - DNA, 1037 bp, Homo sapiens
ttaacaagtgttcgaaggattagtaaaggaaatgtagtttactctgcagcttttatgacaaagaatttaaaaggttttgctctaagccccaccatgtgtttcttccttttctccaaaacatacctttaagttgaaaagagagatgaatctcttagggagaaactattaactctgagggagtttatcattgtttgagaggaagcagagcatttacatttgaatcaactctgagtgtagcttgtgccctaatctcattccttctagaagttggtgaggagtttaagtacttcctactttgtgttctggtcctcatagtgccatcctaattttcctggggatcatacatttcgtaattcaaagtaagcaaactggacacggtgccttggttatgcatggaaatattttctgtagttgtcaaagttctctaagtagggccattggccagaattgtctcattgtcatcgcacttattaccatgctaaaaatgctataaaaaagaccaaatactacagaaagtttgaaaaagagataaaatataagcacctccatcacaatcctattttcaagttttgaagattcccatttgatgtatttgcagttgaggtacagtttaaatgagagaaagcaagatcttaatgttgaccacaaacattttcatcagtttttcatggctgcatcagagttttatagtttgatcaactagctcctgattgttatacatataaatcagctcctttaaaataagaccagttaatactactctcttatttgtggacttctgtggccaaatctttggtactgccttttttcgggggtgaggggtggtggatgggaaggaaggtagaggaacagagagaggctgactgtgccaaagataaactatgttacagatggaaatgtttttttctaagtccaaaatctataagaaaccttaaagtgagccattttctgagatcaaaaatgtgtaaacttgtgttagtgttttgctctgtggtgaatgaaagcaccactactttttaaaaagccacatttatgga

SEQ ID NO: 48818 - DNA, 1077 bp, Homo sapiens
tcatatatggataagtttgcatatatttgtacaaaacagcaaattatttgtacactagccctgtagagagagcagcccaggagatcatgcaagtgctttcatcctcatgttggcaggatggaaacctctactttgcagcctttgtgggggccttggcctgggtgctagcttttggccagcagaacctggcaactgatgatgttataatcagcatggctcctgagcttgggactcaggttgagatggtttggatgtttgtcgcctccaaatcccatgtggaaatgtgattcccagtgttggaggtgggacctggtgggaggtgattgggatcgtgggggtgggccctcatgaatggcttggcatcatccccttggtgatgactgagttcttgctctagtagttcatgatctggttgtttaaaagagtgtggctcctccccctccctcccttgtttcactctcactatgtgacacgctggctccctgtcaccttcagccatgattgtaaacttcctgaggcctctccagaagcagatgccagcactgtgagcctacagaactatgagccaattaaacctcttttctttatcaattacccagtcttgggtatttctttttttttttttttttttgagatggagtcttgctctgttgcccaggctggagtgcagtggcgcgatctcggcttattgcaagcttggccttccgggttcatgccattctcctgcctcagcctccagagtagctggaactacatacaggcgctcgccaccatgctcggctaatttttttttgtatttttagtagagacagggtttcactgtgttagccaggatagtctcgatctcctgacctcgtgatccacccacctcggcctcccaaagtgctgggattacaggggtgagacactgcgcctggcattgctataaagaagtcgcaggtactttatagcaatggcaggaacagaccaacacaggtgcccttcaagaccttgagcttgacaaaggccttgatggtcttcattttattggcctgtgtcttttgacccttcttgtgtttcttggcaaagtgcatgatc

SEQ ID NO: 48819 - DNA, 1030 bp, Homo sapiens
ttaccgtcaacaatgcgattactgaaaatagttatgtttttggctttttaaaacttggcagttcttttggtcgttagggtatatttcactgggactgtagtcaaattactgttttaaagtcagtagaattggtttttttctgtggttgtgtctccaactcaatacaaagttagttttttgttgttgttgttgttttgttttttgagacagggtcttgctcggtcgcctgggctggagtgcagtggcacgatttcggctcactgcaatttctgcctcctgtgttcgagtgattctcctgcttcagcctcttgagtacctgggactacgggtaactgccaccatgcccagctgatgtttgtatttttagtagagacagggtttcacttttttggccaggctggtctcctgacctcaagtgatctgcccactttggcctcccaaagtgctgggattacaggcaggagccaccgtgcctggcccatagttaggtttttataattttttcttttaatctgttggaattactgtttaaaaataatttgatttttaaaacaattacttaaaatatttatattgtttcaaagccaaagctacaaaacaggcatattcataagtctaacttctatccctgcctaccaccgtgttccttccctgacataggtaccgagtttgattttagattttcatttgtccttccattaaaacaaaaaaggcagccgggcacagtggctcacgcctttaatcccagcactctgggtggccaaggcgggcagatcacctgaggtcgggagttcgagaccagcctgacccacatggagaaaccccgtctctactaaaaatacaaaaataagctgggcgtggtggcacatgcctgtaatcccagctactcgggaggctgaggcaggagaactgcttgaacctgagaggcagaggttgcggtgagccgagattgtgccattgtactctagcctgggcaacaagagcaaaactctgtctcaaaaaaaaaaaaaaaaaagcaaatacgtagata

SEQ ID NO: 48820 - DNA, 1094 bp, Homo sapiens
gggaggccaaggagggtggatggcttgagtccaggaagttgagaccagcatgggcaacatgatgaaactctgtctttacaaaaaaatacaacaattagccaggtgtggtggcatgtatctgtggtcccagctacttgggaggctgaggtgggaggatcacttgagctcccacagagctcaggagacggaggttgcagtgagtcaagatcacgccactgcattccagcctgggtgacagagtgagaccctgtctcaaaaagaaaaaagaaaaaaaaaaaaaaggatggctttgagagattttaagtagaaatgacaagacttggtgacaaattacacgtaagaggcaaaagaagaatcaaagatgacttgccaaggttagcagagttatgttacaaatggagtatttgtgaggtgaggactggttatatgtttgcttttctgaggaaaagtgaaaagttataattgggataaggcattttagtctgcattgagaatggaaggaatctttgagggatccatagtgaatgtgtgtgctttattgaatgagtaagacttgaagtgggctggactaaattgctgaaggcaaatctgttcatggtagatttagagagggggaaaagaaaaaccaccttttgaattcactttagccacaggaaaggtttgagggtgttgcattgatctcgcataggctgtatgaataaatggaaggaaggaaaccaatctagagaagatactgtttgactccacgctggcagttcttgaactccggggtgtgagaggagccaggggtatgtgagcattggagtactgagttcccagaactatacattctccctctgagttctaaatttctgagcttcaggttaaaaaaataatatttatggaaggaagctaataaattaacctacagggttgttgtgataattaaaagagatattgtgcctagttctcagtggagatatgactgcttattaaatggcagctatcattaatattgcttggagaggagaaaacacagttgtctgaacaacctggagttaaaaaacaagttaaaaaacagcaagtatgttcctttttatagtattacagttttt

SEQ ID NO: 48821 - DNA, 1035 bp, Homo sapiens
tgtggcaaaagtccagcaagcaaaaaacttctggtcttgtgaccagagacgaatcagagagagaggtgagagctagattcagagatagtgttgaattcgtaagtgtttggagacttttaactgtataggtggaattgaaaggaagatattgctaatgaaatgttctgtgtcgtgatatcaaagagaaaatgggacttcaccgctctcttcaaattgaattgcctttgctaacttgggtctcaggtacataataagcactaaaaatccttcctttatctaggttgtcttttttcggttacttgagccaagccaagatttagaatgggaagattttcattgggaaaagaaataaaagatactcttttgttattcactgactttatttcattttagaattctatttggtaaaaatttggaatcataaccacttattgaacagtggctttcagggggagaggaggaaaccagcacgaatttcaccatcaaaagtgaggctctgttagaaatccaagaggtcgtctgtggttagagtttcgcaagctcttggaacaatggatttccactttcttgtatatgggttaaagaaatacaagaaatgaaatataggaccgagtgttactggtttgtagcttagaatcttataagttttgccttggcaggtaatttggcataaattgttaatgtaaatctggtttagtggtgaagacattattttagtaaaaaagataaactgctgattaattcagcatagaactcaattacaaattgaaagtgtctctgcgggactcccggaccctaaagacagcagatgttgaattgataatccagcatatttcacagcggtatgaaatattcacatggtttattgtacttgtgtggtgtgcgatatcagaaaggggggtggtgggttcatgggtgtgcaagacagtcacacactgcacatttgctaatatacacggaagcatgatgaagaattttagcaaagatttttcttctttttattagctctgtggaaaattaagtttaaaataatat

SEQ ID NO: 48822 - DNA, 1170 bp, Homo sapiens
attttcccccaaccttcccagccctgggcaataactaatccactatctctgtacacttgcctattctggacatttcatgtaaatgtaatcatataatatgtggtcttttgtgcctagcttctttcactttgtgtaatatttcacccgtgttgtagcatatatcagtattttatttctttttgatggtcaaatagtattctgttgtatggacataccacattttacttattcattagttggacatttggattgttttcactatttgactatatttataatgctgctgtgagcattggtgtacaagtttttgtatggacatatgttatgatttctcttgggaagagaaattctaggagcaagattgccaggtcatatagttactctatgtttaaccttttgtggaactaccagagttttccaaagcgtctgtgccactagcagtgtgtgaaggtttcgatttctatatgtcctcctttccatatatccttccatatatcctctatccttgattgtcaccaagacttatcatcctttggattgtagtcatcctggtgggtgtgtgtgacttggtatcttattgtggttttgatggattttttgttaagaactagtgcaactatggaaacgtttagatgggacaattgaaacatttgacgtgcttcctttatacactggatttgtgccgtaattgggttgatgattgtacatttgtttaaatattgaaagggccttttcagaggctccccctgaggctatttctgtcatttgcttttggtcgtaattcctgcttattggctttccttaagacctgaagcattagacataataaattgtctttattattggatcaaaagatgtatcagttttccccaataattttctctctggctttatttagcataaaacgttaggttttagagatgtctgaaccctaacatacaatccctggggtcctgtatggaattattctaagtagtgatttctaatagtgctattaaccagttaattttagaagtgaacagttactgaagttggcatttatggttcagtgggtgattcggaaaatcacccattatgtctttagaatagatgatgatgagaaactctgttgaaggtgaaaggttcccaccagcaccagatattttgagttgtcccccttttaagaagtga

SEQ ID NO: 48823 - DNA, 1027 bp, Homo sapiens
tgttttacactaaaaatgataatgtcttgttccaattaagaatagtaaacaggtccaagtatagacaataaatgagattgggattctgttctcatttctcaatgtgaacagttactcccatatcagcattattttctatttggccttcttaaatacagagaaaaaataggatatattaatagtaggtcacttgaaaaagaaaagaaaaaaagttccccagttttctaactataggagaggagttcctaaggttctacgcatccattagaactcacagaggtacaaggaggcgtactcttgagttttgtttagaaaatcacctcagtaatgccaaacccttctttaaaacacattaatcttttcaaatcttcctgaaagctttgtctatctccagttgattgggacttccgtatgttaaagaaaaatgagaattgtaggaaaagttgagagtatgaggtacattagaagtgactttaacactccaccaaagtaattttaccttatttagagtttggatttgaaatggttcaaaggctgtgaattcaatatttgatgtgattttgggaagtaaaggggaatgtcagcatcctttcgataaaattgatattatcaatctgaagaatgtttcttagatcagttgtgtccataacttgggagcattagctgtgagaccttgaaacagattggccatattcttatttcacattgattatttaaatggacaattttaggttactggtctttattcacttgttattgaaaccacatgcacactgacaatcagtgaaaatcactttatttattttagagacagagtctcgactgggcgcagcggctcatgcctataatcccaacactttgggaggctgaggcgggtggatcacttgaggtcaggagttcgagaccagcctgaccaacatggtgaaacctgtctctactaaaaatacaaaaaattagccggacgtggtaccgggcgcctgtaatcccagctactcgggaggctgaggaaggagaatcacttgaacct

SEQ ID NO: 48824 - DNA, 1116 bp, Homo sapiens
tatgaagaaggtgagatttgagtagaattctagagtagaagccttacattgaaacttggcaggtacattttgacctagaggagtgattgtggtccttctttactacttaatctctgagggattggggtatttgatttctatctgaacctcaatttccttacctgtgaagtggtattggtaatacctaccacaccaagttgtaatggttggaaataacgtatataaagcatgtgctccaatgcctggcctgtaaatagtagttatttttttgccccctctcttcctcatttgctaaccagctttttgcatttatgttttagctctagctgctagattaggagattttttgacaggctctcactctgctgcacaggctggagtacagtggtgcaatcacagctcactgccacctcgacttccccgggctcaggtgatccacccaccgcagcctcctgagtagctgtgactacagccatattctgccacacccatctaatttttgtattttttgtagagatgggattttgccatgttgcccaggttggtctcgaactcctgggctcaggtgatctgcctgctccagcctcccaaagtgctgggattacaggtggctgataatttttttttttttaatgactgcaaaaaatagtgataaaattatatttagaagaattgggattttcaagttctaacatttacattattgcttctgggtcaaattgcataggtccagaaattcgaacaggttgtgtgtatcgtgtagctggtgtttttccagctgtcatttacctcttaatattttctgtcttggtgtcttggctccacatctaggaaaactgctgccttgagtagtttggaaattgccagtttgagactttgctatgccattgtgttgttatctagcctcttacaaggtttttatataacagatgttcactgtttgttggggagaatgatttatccccagataccatacggatgaatctttgcagttattctaaaatgaagatacttatggtaattttagaattgttctgaattgctttattcaaaggtattaggtatctccatcaaagtattgcttttatttctccccatctgatacctttaaatggt

SEQ ID NO: 48825 - DNA, 1029 bp, Homo sapiens
gggcaagttcttaatgtctctgggttggttttttcttttctaaaatgggaatgataatgttgtcttttaaaggggactgtgggctgggtgtggtggctcacacctgtaatcccagcactttgggaggccaaggtgggaggattgcttgagtccaggagtttgagaccagcctgggcaatttggcgagacgccatctctccaaaaaaaaatacaaaaattagccaggtgtggtggtgcacacctgtagtcccagctacttaggaggctgaggtgggaggattgcttgagcctggggaggttgaggctgcagtgagccgtgataataccactgtactgcagcctgggtgacagagtgagaccctgtctcaaaaaaataataataatgggggctgtgaggctgagctgaaatcaggtgtgtggagtgcctcacataatttatagtttatactggctgacagtagatgttcatctaatgttcccttcccttttttgttcccatcaaaacaataaccccttaatgaaacagtcttaaggaaaactttttgttacctgacttctcatgcaacttttggctaagttacagtgatgctttgtggactcatgttttttttcttatgcatactctgatcaccaggtatcaaggttacattggtgcagccctagttttagggggagtagatgttactggacctcacctctacagcatctatcctcatggatcaactgataagttgccttatgtcaccatgggtgagtgtaacgttttcctgatgtttaagagtactcttacttaccacgatggtctcttgaagagctggtctgttttctcttagaagaggaggtgcaatacaatgctttgattcattcagcaaatatatactgagttcctactatagattaggccgtgttctaggtgcttgctatatagcagtcaacacaattctgatagtgattcctgctctcgaggattttgtattttagtgagggtaaatagacaataaacaactgtgagaagtatatttataatac

SEQ ID NO: 48826 - DNA, 1046 bp, Homo sapiens
aatcctgggctctgagctaggtgcattgctctgttacccatttcctacatttgtttgtttgttcttgatttcctgggggaatgggactgatggagacagacaaacccactgtgggcagcatctaagccatgtccaaggttggtcgaattaagggaaccctggcctctcagcaggacagaaagctgagctgtggttccaggccctcctctctgggcccctggtgtgtatcttttttccttgttgcttttgaaatttttgcaattattttaagaatccagtctttcagaccagcccttttattaagctttgaatttttaattgatttttttaaagtaaaaaaaaaaaaaacccaaaaaacaaacaaaatttaacaaaaaaatccgctactcttactcccctgcctccccctaccccagcccatgagagttcccttgcactcccctctgcctttgcaactgatcatcctccctttctccttggcttgaagcatctatgtccagtatctgtgaaatgatgttttatctgtgtgtcaggatgagaaacggcagtcattccaccaagtgttggaaactggttagcctggagacaagggtttctggggccacagctcagggatgtgtatttaattacaggatccccagaaactcctctctaggctgccacagcaacattttttctgggcttgggagccatacctgaactgtttcctccaaggcgggaactccagagagcctgccaagtctggagcaagctggggcttctgctttggccagacctgggccaccatgagacttgaaggcttctagctgtcctacgacacgagccacggtggccctgcctctccccgctcatagaagcctggtccctctgtctagcccagttcccatctagcatccgtcttctgggcctgaagccctaaatggaccacagcctgcacaggaatcaactgtaggctcaaagggaggcggtgagtaaggtcagagcctgctccaagcccaagaacaaaagttgtgttatgggtggaggctagtcccccagatctagcc

SEQ ID NO: 48827 - DNA, 1049 bp, Homo sapiens
agtagatttctatcatatacgtattttgttactctgggtggggtcgaggaagaagatgaacatttttttgagatggagttttgctcttgttgcccaggctggagtgcaatagcaccatctcagttcaccgcaacctccacctcccgggttcaagcaattctcctgcctcagcctcccgagtagctgggattacaggcatgtgccaccacgcccggctaattttgaatttttagtagagacatggtttctccatgttggtcaggctggtcttgaactcccaatctcaggtgatctgccctcctcagccttccaaagtgctgggattacaagtgtgagccactgtgcttggccgatgagcttttgaatttcagaacaagagattggcaagatgtaaatctttaagacatgtggccctttaaatgaaaagtaaagtatgttgctttcttttcacacctccaggacagtgaaaatgaggtaacagccgaactattaatacatttggtgttgtattccagtgacagatctttgttctctacctatgagctgaaataaagacatgtgagatgttattattggaaatagaaatacccaaagactgtcattgaccatggaacagcagagaagcgattgtaaagattttagaacttgaaattagattgaaagagacctcccagccaacaagcagcatacatctagctctaacataggctatgtatgtttcttactccaaattcacaacagctttttataaagcagaccgaccctgttgcctccatttagcagatgaaaatattaagattctagcaaagttgagaatagaaccttggatttttaactcaaagaggctagggagagggaaggattagttactaagtgcttactttacatgcaaggccctaaggttggtgttttatccataccattttatgtaatgtaacataaaacaagtaccagtattttctcttttcatttcagtaaactgaagtccagagaggcagagaaacttgttcataattatacagaccaggaagaaacaggatttggaccct

SEQ ID NO: 48828 - DNA, 1062 bp, Homo sapiens
actccctttcaaaaaaaaaaaaaaaaaatcagtatccctgggctgaaatgaaagtgtttgcagagccacactcctttcagaagctctaggggagaatcggttccttgcctcttccaacttctggtgactgccgtcattccttggttggtggccagtttctgcctctgtcttcgtatcaccttctcttttgcatgtgatgtgtttcttcttctctactatctttatcagatcttcctctgcctctgtcttacgaagacacttgtgattgtatttcgggcccacccatataattcagaataaccccctaccgcaagattcttaattcaatcacatctacaaataccctttttcctttataaggtagcattttacaggttccaaggattaggacctgatatctatgggtcgcagttattctgcttactatagatggcaatcataaagactcatctcaaagttggcatatattaagggctccagaaatgcaagccacctcctttctctgcatccctcctgtatatactaccatgaccctctgctaacattgccttcgaaagcttttcctttcaggaatgtcattatcacattaaatgtgtacctgctggggtaataataatgaaaataatagctgacagttatcaaatgtctattatagcccacacactgcaatgagaactttatccatgggatataggtattattataatcaccatttaacagatgagagaaattagaaaagtaaagaaggtcaatttttccctagttcacccagctagtttcagagctagggttcaaattagaatctctctaattataagcggtctctaattcatggtataatgatgtgcctttgtttttgtttatttgttttttaagagatatggtcttgccgtcgctcaggctggaatgcagtggtgcaatcatagctcactgcagcctcaaactcctaggctcaagcagtcctcctgcttcagcctcctcagtagatgagactacaggtgtgtgccatcacgcctggctctataacgatgttcttgattattataccttccctcttactca

SEQ ID NO: 48829 - DNA, 1112 bp, Homo sapiens
cccgccttagcctcccaaagtgctaggattacaggcatgagccactgcgcccggccaaagctcaggttttaatccaggcagtttgacttcacagcccacgctcttaatcactatatactgtactaggttttgatagagaaattagtgaccagcctgagatcacaggcctagcttaatcctcaccaattttgtatgaaggtggggagtacagatgtgtaatacaggcggtaggcttcttttgatgtcccagagctaagagggaaagcccatatttcaataggcaggaacatcacagtgactcaaggcaataaacaagtctgtgtttcgtgcaaagacctagcttaccattacaggatgtgaatcagccagcttagcagtagaaaataaaaaggactgagaggtttgagttactatacactcaggactgatcaataatattaacccattatcttttatgcagttgtagagtgtatactttatacccgaaaggtaataaattctattgcattcatttaaaacgtagtatccaaaagggagtgggaagaatgatttccctctctttcctgtactcatcaagccacagtagattctgagcatgatattttcatgtggcatttccaagcaagaatatgtccagaggaaaggcagatggccacccactgtgatggggaaatgatatataaatcagttgtgggactaggggtattaaactccaaaggttgtcaaactcttggtggaaaacgggagggagcaggcttgggcaggttgctcagtgttcacagattatattaagaccaggatgtcttcattgcagggaattatattttagcatcaaataaggaagtaagctctttatcactggagatgttcaagctcatgtaggaaagttactgtaaaaatgcagttatgaaattagataaaggagttaaatgactctgctaaggctccttcagtaatattatagttaagactaaattcttactcctcatctaatattctttctactacctcctgcctctgatcagagtggtatctagcaagtgtgacatctgggaagtatcttgaaactctgaaaccagtgtcataatttctaatatgacaaacatataggt

SEQ ID NO: 48830 - DNA, 1068 bp, Homo sapiens
atgagttttaggggaatgaagcaagaagcttagtttgaaggtgtaaacttttggctgagggtaaggattgggggtggtgaaattagtaacttttgctttgtaaaaggattttgcagacctagtttcctttctccaaactaatatgtataaccagagcattcttgcattctttcaaactagtatagataaccagagcatggaaatgaagggctagagttaaagtaagccctgcaaacaactcttagctctgtgtattaattttcttagaggaatttgccttgtcattgtttattgtaatgacagaaaacagggaatcccacttctgcacgccccccataccccccagaaaaaccctacatacctaacattgagtttccgttttgtcttttccttagaccgaaaggttttggctttaaattttctaacccagtctggaagactatagcatagaatagttcttgaaaaaaaagaagaaaagccccacataccagaacccttttaaataaattcttttaaaatgctgccttttaattttaggatcttagcttaaagaagactggaggagaatttcccatgaaatggttcccataatagttttcagaaagacgtgctaggcagtattgttaactaaagaaaataagtctatcagttccacttagataacctttggtaataaacgaactccgtacacgttgtgaccttagagcctgaactttgcaatcacatgaccagcttgtaaactgacctgtgaggatgactgtcgtagtcccggcttagaggaattgaccaagtgtcggaagggtagtcatcaagctggacttgtcctgtaatctctgtttcttcatggctgcaatagaacttttcagcagactacaagaagcatgaaatggagacatgggaaggtaaggaacagtctggggcccaaatctaagggttagaaattttctttgaaggtttagagcaaatagccttgagggagaagggaggcagtccacaggcaactgttttttttgtgtcttcgcagagttcagctagaaagttttcatgtatgtagcaagtggctgtaaa

SEQ ID NO: 48831 - DNA, 1056 bp, Homo sapiens
tttaataaataatgccaaaaataacctctcaaaatgttgtaccaatttgtataatggttgtgtgatggaagatgtgaaagaaagaaagaaaagaaagaaagaaagaaagaaagaaaagaaagaaagaaaaacccaaactactactttgcattgacattgataggatatatgggggtttaccttacccacagtacaagagttgtaactgaaattggatcatttttaagggtataattccttggcaggcaaattcttagattggtgtgatttgcaactggcccatctgctaacccagttaagtaactgagaagaggggagtatctatgaggttcctttgcatagtgctcagatgtgagctccccctgcttatgttcctggtactcttccctttaggtgcagtgctattttaagtcctgaagagatgctggggtatctgtccaagcaggcttgtcaagaagggatgcttgaagaagtcccaggaaagcattttctagaagtcattggtctcctctcagtcctggaactgtttttttctctgctttccacactgatttgtccttacacatctgagcccggggtcagttctatggagggtctgcataagtcttgtcttttgttccaaatgaaggttgctcctgggaatctgggtggactatgagagtgaggggcagaagagaagagtggttcaagtcagcagtggaaacctatcctttgttacttgacatctgctttaaattccttgtttagttttgtttggaaaccttatcaaaaagcacaaggttctgggacacaaggagctaaacagtatagctgcacagctcagctatcactttctctgggaaacccttccagatattcatcagatacatattaggttccaagaaaatagtggtgagctactggcaccccagctaagacaagcacctcttctctgagcacaccttgtattttgcccctcttctaagatagatatcattatcccttacactggcttgctggcttgagctcttcaaggataagatcttgactcattcatcttgacctacccatccccag

SEQ ID NO: 48832 - DNA, 1051 bp, Homo sapiens
cataatgcatcgcctgtttagtctccccaggggttgggcttcagtaatctttgttgcttggcaagattctagttgataaaggtttggcatggccagtatatatacctgtttaagaggaggtgacttttttttatcttggtgccagttaaggaatcaaggacactgagtgttaggtgttgctagttgtggataatcccagttatcttgcaggtacgagggtctgccatacctcccaaattttggaagccctggttagcatgttctgtggattttgcctttgtcttctgatcacttttcttcactccccaggcttaatgtctgcatcctgaggccttgttggtctgggggatgctgccctctgctggtggactctaggacacccacagcggtttggatgggtccaatcactaggggaactgacaaagctgtagggagccactcataaagctttctatagtttccaacttcataacccagccctaagactttttcctttgaaaatagctcatcagacactagaaaagatacaagtacagaaactttccctgtagcattatttgtagtggccaaataataacacctaggtgccctgcgctagctaattgtgtttccattcagttgactggcttacagctgctgaaattgactatataaaagacaaaaatagaatgaaaatatttaccacaaaacaaaaaccaggcagaatataccaattgcagccattgaagaaatgccttatgtaggataagggccacccgggaatcttcaaaattggctctcaaagctggagtgatttccttttatgttagtggtgctaataaacaacgggagggaggaattagctgaatgattggcagcctggctgaaatctagaatgagtgacttgcagattgactgggtgaagtctaaaagtctggtttctaatctccttacccatctctccatcttggctcttcctctactgatcagtatttaggtttcttctgactttttaaaattgtaataaatgtgccttatacgtatatttttgtgaacatgtgtatttctctaa

SEQ ID NO: 48833 - DNA, 1032 bp, Homo sapiens
cgttctgtctctgcacattctcaggctaagcagggacatgatgccaacagagattttaagaaaagatacctaatatgaaactaattggagtggctggatattacccattcagagggagaatgaaatagaaaaggtgtcttttcagtattcagcttagtattcgaaaattgacctgaagaagttcagatggtaacattctcatctgtctgaggacaggatgctttggtttgctagcctagcttacccacggctgtgatcccactgctgccaccatgtaccgggaaactgccacagccctcaagaacgatagaacttatcatcatttgcctggaaggaaatctttgcaaagagaagagtacattaactcttgcccctgtgagtcaccatacctttgaagtcttggtaattactaattgttgccaccagtatggcatggtagttaagagcttgtagtactccgacattcctgggttcatattctagctctgccctttactagctgtttgactttgggcaacttaacctctgagccttagtttatctctgaaatgggaataataaacttacattcagacttaaaagactctggtgaggtgatacatgtaaaacagttaacactggtgccaggcacaaagtaagggcttaataaaggtagaagaaaaagtgtggagaaaggggaggaggcttatgttgtctgtcaaacagatgttagtgggtggttagacatccattcttctttaactttctggtctaagcagagataagtagtttttccttcaagaccccatatagtacagctgaggtagggctagaacagctaaaacaggcttccctcactaaatattcagggggtagggaggagaaattaagacaggatattatgattctaagtaattggactcaggctgggtgtggtggcccatgcctgtaatcccagcactttgggaggcctaggtaggagcatcacacgagcccagaagaccagcctgggaaacagagtgagaccccatctcttaaaaaaaaaaaaaaaaa

SEQ ID NO: 48834 - DNA, 1068 bp, Homo sapiens
tctagaggaaagtgaccctgtcttagtgttttttttgtaattctgtgtcagcagagtacattactttatctcatttggggcatccttttcaatttgagttgtacatatggaaaaatgtaatggcagatctcatcatgttaaacaaatctctgtgagggtaccataatcaagacagtgtggtattggccaaagaacagacaagtagatcagtaggaccgaatagacagcctagaattagatccttgtaaatgccgtcaactgatctttgacataggagaaaaggcagtaagatgcaggaaacagtcttttctttcaacaggtggtgctggaacaactagacatcaatatgcaaaaaaatgaatcaagacagggaccttatatccgtcacaaagattaacttgaaatggatcacagacctaaatgtgaaatgaaaaactataaaactcctaaaagataacaaaggagaaaacatagatgaccttgggtatgatggcatgatgttttagatacaacaccaaaggcacaatctgtgaaacaatgaattaataagctggacttcatcaaaattaaaacttctcttctgttaaaaacactgtcaatggaatgaaaaaacaagccacagactgggggaaaacatctgaaaaaaaacatacctgatggagtactgttacttaaaatgtctaaagaacctttaaaactcaataaaacatacctgatggaggactgttacttaaaaatgtctaaagaacctttaaaactcaataataaagacataatttgattaaaagattggccaaaggccttaacagatacctcaccaaagacaataatataagtggtgaaaaagcataagaaaagatgctccatgtcatatgtcatcagggaagtgcaaattaaaacaacaatcagaaaccactacacaactattagaatggccaaaattcagaatactgacgacaacaaatgttaggatgtggaagggcaagaacttttattcattgctggtgggaatgcaaaatgatacagctactttgaaagacagtttgtcttacaaaattaaacatactc

SEQ ID NO: 48835 - DNA, 1070 bp, Homo sapiens
ttccttcaatgattaatgatgttgagtatttttaaaaatatatctgttagccatttgtgtgtctgcttttgagaaatgtctcttcatctttttttcccattttaaaattggattatttggagctttttgctattgagttccgtgtatatttagttattcatctcttgtcagtgggataatttgcaaatattttctcccattctttaggttatctctttattttgtcggttgttttctttgctatgcagaagctttttagcttgatataaccccatttgtcaatttctgcttttgttgcctgtgcttttgaggtctaactcaaagaatctttgccagacccgtgtcctgaagcatttccccagtgttttcttgtagtagtagtgtagtctcaggtcttacatataagtcttcaacccattttgatttgatttttttatgtagtaagagaacaggatctagtttctttcttctgcatatggacatctcgctttcccagtgccatttattggagtgactgtccttttgccaatgaatgttcttgatgcctttattgaaaatgatttgactgtaaatgtgtggatttattctgggttctctattctgttccatcggtctatgtgtcttttttttttttttttttttttgtgccagtaccacactttcttactatagctttggtagtatattttgaagtcaggtagtgtgatacctccacctgtgttcttttagttcaggattgctttggctatttggggtcttttgaggtttcatatgaattttaggatttttctatttctgcgaagaatgtcattggtattttgataggaattgcattttatctgtagatctctttggatagtgtggatattttaacaatatcctttcactttatgaacatgggatgtctttccttttttgtgtgtaatcccacaatttcatcagtgttttatagttttcattgtcgagatctttcacttttttggttaattctatttctaggtattttattttttattttttagagcttttgtaagtgggattgctttcctgattttgttttcttattgttt

SEQ ID NO: 48836 - DNA, 2311 bp, Homo sapiens
caggactgtctggttttggctcgtgcctttgtccatgtctggcttagttcctctctgtctatgcttgcctctacccccaccgccccaggcggcacaagtgtttggccacacaaaactagagatagaaaaggtggtaaaaacttcaaacttttctaaattctccaacagtttatttcttgtgaatttcttccttctttaaatactccattttaagaaaacaaaaaaattaattatctaaaggcaaagaatggaaagcaacctttgtgttccttataataactgacttcataactctctccagctgcgttatgggatgtgtataaaaagcttctgttctgagaacaaaggagcacgtgcagaaatgagacgaaaaaatccactgacagtattccattacacaaattacttaaaagattttagtcaagcccctcaacagattcaattttaaaatggcttttagttaaaaaaaaaaaattgaaagtgcttacccagtaaaagaaccgaagtagtcctgaactgttacgtaagactttttacagttggatctttgtcaaaaggggatgggggtgatgggagaaagcagcaacgacaatcaaaaaagttcgagctgctgtggctagaggacaacttctgtgtttccagataggattcttgctgtagaaatggaacttccagccagcacagcatcctgtcccagtagagaaatgagtttgtcagttaaaacaaaaaaaaaattagatactggaacccaggctagacgaggtattgaaccgcgccagatttccttgcagccctgtctgctcagctcgcattgaactatatatgacccagatgatggacagaagcacatttagtcatgtgcacactggaagaaagcggatttgctggtccctggcagtgcaggggtttgtcttctgattgggctgtgccctgatcggtgaaatgtgaagccctcaccattcagaggccgtaattcaggactggcagtttgagtgtctggctgcctctagtcactgagagactttgaaggtgttgcttttgtttggtggcattacccacccagaggttgcttacacctctctacttgtgtcagaagaaatactagtctttctgaaatacaaataggcagccgatttttcctgaatcctaaatcaccctattgttgataaacttggctctaactgaaaccaattatttgatttgaaaatttattgtgatcctaaccaagcttcatatccagaccaacccttggtcttgattttataggtttgataaggtaaaaataaaagtggcatatttgactttgaagcctctatatgatataaattgctcttaatgaaaattggatagatggacaacagagaagtgaagttttagattctggagtgtttggatgtatgaggaagaagctttatgtctttttatcccctttgtgagactgtcactcttgtcccagtcctagtcacattaggggttgctgggggggggaagctatgaaagcatggaccctactgagctgtgacatagcctttaatcatgcaagacagccacggtctgctctcttcagtctgtctgaactagggtccttggggtttattttccatctttctgagccactgggaaaccaggtcattatacaggactgtcatttgtgacatttttgtttagtacatggcagttgctttgtttatttaatgcaagttgacacttctttaaagtttcaaaacagtaaagttgttttgtgagaccttgactctgatatatgaaatctactctacatggaccaatcatttttttccgtggactttcttgtctctttagaaattagcttatagagtcctaaattgatacttaaacataccaatagttctgtttatttcttgcctttctcacagttgttgaaataattccatctgtctcttttgctgtaaattttgggtttggatgtttgtacttggaattttttagatgttgactatattatgcagcaccttccatatgaggactaccccagaattattctcttgtcttaacccgagaaaagctgttttgatgcactattagatataagaatgttcgaaagaagaggagatgagcactctcttgctttttgtaagccacaagacaatcttttttttttctaagttgtggtaaggtatatgtaacataaaattgactgttgtaataatttttaagtgtatagttctgtggtgttaagtgcattcacgttgttttgcagccttcaccaccatccatccaccacagaactcttctcctcttgcaaaactgaaattctctacctacctgttaa

SEQ ID NO: 48837 - DNA, 1014 bp, Homo sapiens
ggagaaacattcccaagtatcattttattcacacttaattttctatcccatacccccaaaataaggctagctatttaattagttggctgcttttctcttaatttttagtgtttctgttgataatgtgtaagtttgggaaaatgctaagtagcttttcacttagaacactgttattttctctttaaagttttctaccttacatttattatagcatagttatctttatagcatagatgcagaaagtaagagagagcttgttttttcaagaaaacaaccctttaaaatactttccaacccatgaagggaaaaatcctccttttttcccccaagtgcattctacttattactttgcatttttctcccaaagtccaaatttatgcaaagaaaatagaaacaagttcaaatgcaatgcattaaccaaataaaacaagtctgcttcaaattaggaaccaacctaagcatttgtaaagtgtagcagaatcagaattcttttaaaaattagatttggaacctgaactatataattcataattctcatttttctgtggaaaattattttatctttctcctgtatacctgaaaaaatgtccataggcttaaagggtcatgcttttacattccttccatatcacaggtactatgaagtaaggagacttttaggtttctttttgtcttaaactcagacagctttgtaagcagtagtgtgtagattacaagagttagacaaaagcaggcgcgactgagaagagttggtgggggagaagcttggggcacttcctgtcactcaacacattccagatcactaaaaaatttccacaccctctgcattcccccttgcccactccagttcccggtattttctgattccatatgttgtggtatttaccatacttctctccctcactaggctctggcaagactgcttcagaggggatgcattcctttagattgcacaaagcggagctgggaaaatggctggcagtttcagaatctagtcacgatcgcacgcatgag

SEQ ID NO: 48838 - DNA, 1022 bp, Homo sapiens
ggaggttacagtgagccaagattgcactactacactccagcctgggcaacaaagtgagaccctgtctcaaaaaaaaaaaaaaaaaaaaagaaccacatagaggtaattccgccaaaatctaggtcacaataacagataaccaaattggggtcttctttttttttggtgtaactgtctaatttgctctgaatacatttgccagacctcttttccacttgactttgatattcagtgaacaaagaaaaagaaaaagccacatgatattgagtctactagtgagaaaaatctaggtggaaatccaacatctttaatatcaggtaactggaatataaatttcttaattggaacttttggatcttgggagcttcctgctctgtggagataatattgcttcattgtggcaaatgcgtgtactttaccccattggtaacaacaacttcattgtattagtcctaggacaacaaagagtaaattccaattggaagaggggttaatatttagacactctgtaggcgtctttctggttcgtaagattaattgccacagaaacccaatagtgactctggtctctcattctgttcatagttatcgtccatgtctcaaatattcttggttgttaagagcccagattagtcatgggttgagtactacctagctgtgtaatcatgatcattatagcatgtgtcattaaaggaaatggtaactgctgagaacatagtcttcaggaaggagatgaaggaaacatgctttacatttaatgctcctgtgtatcatgatctgctcctgcaacatcatttcatacccagactcgctttatttcatcctctccagaaattatcttgttcttaaacatctattaaaaggtgactcagtttttatatgagagagtggtttaccatagatctgactaatggtcattatggaaccagcctgtgtatttgaaggtattttattttcttaatggcttgatgactccattgaaagtctgttaagatcttatagtttagcataattctttggtt

SEQ ID NO: 48839 - DNA, 1051 bp, Homo sapiens
cgttcataagtttgtctagtacttactgaggacttgccatatatctgatattgtgagaagaactgtcccaaacggtgacattactatttcattttgcatttgaggttactgaggatctggatacttaaacttccaatgtcagaatataaacaagaaagtaatcatcactctataaactgattctttattgccacaaatggattatcactactttaggagagatcctgtttttgaagtctactgttttagaagtctttttagagcttgtactaagtggcctttaaaaatctcataataatttctaacactttcttaataacttggcagtatggctttgtcatttaaaacaaaatctggaggaaaggaaaatatttatttccctgtggcatgaaaagaggctatatgtaggtcatttttttttttaaataaaaggcaagaaagtctccctccagaccacatcagaactatgccagcttggtacggggcccttaccagagtaatgatgtaagaatctgagagtacatagtgcagctgccaaagctcataatgtttaatttcagcactgtctgtttgccagagtttgcagctcaatatttttttctgtatggatcaaattataatcacatatatttatcttattggggtaggagaagtaaagagttattgtttgataaatttgccgttttcctagggaatggtgctgttttgcctgtcacatgcttctgagcattattcccccactgattcctaagaacttattctcctgggtgaattcttctaacttgtgacacagaggggcaattcacaccttgcctgtttatattttgcaagaaaacccttctcttagcgtgggtatctattcaggcagttccatgtgctacattccatccatttgccaagtcttggactcttatccaaagtacaatatttgagtatacaattacacctacacgtaccggcaagagcgtactttttcctagcctctcttggagaacgcttgaagccagaggagcaaatccagatgttctggattgagtttggcaccttcaat

SEQ ID NO: 48840 - DNA, 1025 bp, Homo sapiens
tagctgggcatggtggtgggcgcctgtagtcccagctactcgggaggctgaggcaggagaatcgcttgaaccaaggaggtggaggttgcagtgagccaagatcatgtcattgcactccagcctgggcaacaagagcaaaactccctctcaaaacaaaacaaaaaacaaaacaaaacaaaacaaaaaaacaaaggttagttgcggtatggaatcagaaactgtatcaatgaacttttcatactcgattttattaaaattcatttgtctatcttgcatttttcatggatcttttacccaagcatgattttgtgacatcatacattggtcatttggaaaatacttgttcactgagttatgcggattttctaaatattgacacatttcataatatcaaaaaattaagtttgtaaatatcattgaactcatcagatacatctttaaatatttggaacctgtgaagctcacagtgacagataaaaatatcccaaaattctaattttggcttaaaagctcaaatgttgggctgagtgtggtggctcacgcctgtaatcccagcactttgggagaccgaggtgggcagatcacgaggtcagtagttcaagaccagcctgaccaacataacgaaaacctatctctactaaaaatacaaaaattagctaggtgtggtggcatgcacctgtagtcccagctactcaggaggctgaagcaggagaatcgcctgaacccggaaggtggaggttgcagtgagccgagaccataccattgcactccagcctgggtgacagagtgagactccatctcaaaaaaaaaaaaaaaaaaaaagctcaaatgttatcattggcaacaaatactgtcacttgttttccttgaagtgacatactcactttgttcattttcaagaaaatatccatcagatacccaagtgtgaataaccacaatttgtttagtaagtaaaatgatagtcaatgaaaaaaatgggctagttcagcttacaacgtaacaataactccagtgctgcttcttga

SEQ ID NO: 48841 - DNA, 1050 bp, Homo sapiens
aatgaactggagagaatcttggtttgtattgtagtgtgtgaaaagtgttggccgagattttaaaagttctttaaagccaataggcgtgtgttttgcaacaaccagttaatgaaataaacaagaacagttaccaaagaactcaatctttccttttttacaattatgaagcgcagatgatgtatcagtgatataagactatttcttcctctgacttatttttgtttattgggttaattttagtcttatagtaatttatactttaaaaacttgagctctgttcttagaaagtttattattgcctcaggtagagtatagatttgtgttaaggctttgtaagttattggtaagtagacatattcatttcataactattttgagttattcataacagggaaaatgctttttaatgttgcctttcttggttatttccagcagatagttgagtttttccaaaatatgatgtcttaaaacttttatttaaaaatgtgtgttctgtagaaaagctatgcttagatctacctcatactttcataaatgaaataatactgtactagtttgggcaaactattgatacttggtttattgtttttggacctatctctccattgctaacctgaaattgacaatgccgatgtttgagtgggaatgctaatcatgaatggggaaataattctgggttgaataaatagaaaataagtttcaacctacaattttgtaactttcagactatcaggagtgttagaggtcatttagtctcatggtttccaaacctgctttgcatcagaattaaaagtgtaggctgggcacagtggcttacacctgtaatctcagtactttgggagtccacagcaagaggatcacttgggcccaggagtttgagaccagccagggcaacataaggagaccccatctctactaaaaattgaaaaaattagcccggcattgtgatgtctgccagtagttctagctacataggaggctgaggtggcaatattggcttgagcccaagacttggtcaaggctgcagtgagccgtgcttgtgcaactgca

SEQ ID NO: 48842 - DNA, 1028 bp, Homo sapiens
ctgattcggcagtagaatcctagggattgtttttcctgtatataaaacccttgccatcctggagcccactatctgactagggagctacacgtaaatataactgatgacaaagaggatgcctggtggattggtgtgaactatattaagggagaacagagaaaagaggggttaattctgcctacaagtgccaggaaaggtatatctaagtaggttaacctggtttgagctttaaaaggttagttgaatttttactagacagagaaagggggctaattccaatggaaaaccatgtacaggaaatcttagaggcagaaatgtttaggtaatggtgagtagtgagattaatgtctcagagtgtcagttaactcatctttaaaatgtgagacaaatagcacttgcccttcctgcacacacagccatgaaaatccaataaggttatgtatctgaaagagcatgcaaatgtaattgcttctcttgtctcccattgcttttgtttcatatgtgcgagaatagaataaatgaaataccttattataataaacttttccaaattggatgattctttggccttcttgctttttttccctttaaaatgaccatagttaaaaaatttcatgtattaaatgtttggagaagcagtatttacagcatagtaaagagcagattttggagccagaatcgtgactttgaattttactagctatgtgatctttgacaaattacttaacctctccatttctttgcttccttatctataaaatggagatttatatgttattttaaaggtatttaagttgttaagataatttacaactattatttctatgttaataaataaaattgcttgttttccccagtatttggcttccaggccatatatgctaataaaaaacctgttcttttatagttaaaacaatctctgactagctgttgtattgtatgtgtacatatatgtgttttaaggacatatttggaattaatgctctaccacttttttggtaaggttttcatttcccataacgttttag

SEQ ID NO: 48843 - DNA, 1042 bp, Homo sapiens
gggagttttatgggtgatgcaaaggttcgaaattagattttggtgatgcttgcacaagtctataaatgaatgaataaaagtcattgaattatacacttacaacaggcgaatttaattgcatgtgaattatacctaaacaaagctgtttaaagaaatatttaagattggctggaagcaggaaaaggaagggacgtcttgacaaaatgatttaagttcattgatcagatggggccccactgattatttgctatgtcattattcttcaccttggaagcttataatcccaaagccttaccctgtgtcctaccccactacagagtataatagcaacttcttgtttgggaggtgactcaagtgtttggagttgctactgatggacctagagtgaatgatatttcccatccagtctgatgacacttacatgcagaaaaggccttcttttaaccctgggttatgggttaactttatccagacatcttgcacacatatactgctggttgacaagtaggcaagagtttgggtagtgagaggatcttgtctgaactacttgtctgtacctgtggagcagcaccatcagagactaggatactttggcctataccttgtgctgtttgcagagcgctttttcacatctgagatggagagggtatatttagtcgtccttttacagagaagtaagacttaaacagggtgactggcttgaccacgaatacataatcagggcagagctgaacttagctgaacttaaattcagattttctgactcttgtatttcaagcgatttcttctatacctaccgttttttgccccaactacttactgggaagaggagagaaaagggcatacgattttgattggttgtgtgtttttcagtagatttagtctgaagaacaggaagggaagttgggctacagtgtaagttcatgggttctgtggcaagtatagccaggataattttatcctgatatttggtagctattaaaattatatataggctgaaactgcaatgtgtgggacagatagatagctgaaggtatcctgt

SEQ ID NO: 48844 - DNA, 1031 bp, Homo sapiens
agcactttgggaggccgagatgggtggattacttgaggccaggagttcaaaaccagcctggccaacatagtgaaaccccatctctactaaaaatacaaaaaactacctgggcgtggtggcaggcgcctgtaatcccagctactcgggaggctgaagcaggagaatcgcatgaacccgggaggtggaggttgcagtgagccgagattgtgccactgcattgcagcctgggcaacaagagcgaaactccgactcaaaagaaaaaaaaatctgataaaggagttgcatctaaaatacgtaaagaactcttacaactcaataagaagacaactcaatttttagaaattaacaaaaaatataatgattccacttatgtgagattcctagaataggcaaaattcattgaggcaaaaagtaaacaagttgctaggggaaatggaggataagtagttattgtttaatgggtacagagttcttgtttaggattatgaaaatgttctggaaatggatagtgatgctggttgcacagcattgtgaatttaatgccattgaattatatacttaagtgattaaaatggtaaattttatgtatattttactacaataaaaattaaaaatatgaaaacatgggtaaaagaacatttcatcacatgcaaaggtgctctaaattagtcattagggagatgcaaattaaaattggaatgtccactgtacaccctcaggaatagctgtaatcgaaaagactgtcaaaatgttctagaaagtgttaggatgtgtagaaactagaaatcttgcgtgttacaatggtaatgtaaatcagttggaaatcagtttggcagttcattaaaaagttaaacttaccatatgatccagcaattccactcctggatatccaagagaattaaaaacttatgtccatacaaagactgtatgtaggccaggtgtggtggctcatgcctgtaatctcagcactttgggaggccaaggcgggtgggtcacctgaggtcaggagtttgagacccgcctggccaaca

SEQ ID NO: 48845 - DNA, 1023 bp, Homo sapiens
ggcatagattaatggattaattaggaattatttgctgggcctgagatgagagaggatggggatctgagaaatgcagtgagaatccaggtattaattgatgcttgacatttggcaagtagaagagagatatattcaggtcacgcagttactggctgtgggtataagctttaagacccagagctcttggtcttggaatgctaatgaccagatgggctgagagttaagacctgggccagtgggaaagggacccatgatagccatcaaggcatgctgatgggcttaatcatagtgaccaaggccagctgtaacactcagtgtactactttgcctgggacctatttgagtacctaactggtgataaagtctgagattgtgtacttttgccctagtcatcattggccctggggcttgtccagcttatatatacacatggaaggcactaaagactccagtagttatggcttttgggaagagagaattgaaaataactctttacagttttgggctgttgctttctggaactgaaaatgattccataatcccaagatgagtttatacctctgccttcctctggaagttttccctcctaagtgaaattttgagattaagttgtatttaagcagtttgggtgccaaagacatttatatctggcatgagtgaatgaggaggtcaaaaaattctctctccccaaattttcaaaaacagcaaaggcttaaaacaaattgagaagcatttattcatgaaaaccactgtacttggggtaagaacagcaggagttttgtcgtgttgcctgggcctgttcctatttctcccagccctgacagtgcagtagttcaaccagggtggggctggcggtgaaaaccagtagctttatgactgctgcaggagggagctttcttgatttggaatgttgtcagttaaatttgatgatctttgtggcaagtgaaacagggccagcaaatctgctactctgaggttgcagttctgtttaggataaacagtgggccagtagactagccaggg

SEQ ID NO: 48846 - DNA, 1025 bp, Homo sapiens
aaataggagaacagattttctttggcaaggaattgtttaaggcagtggtgaaggaagaagatcagttaagggggtgtgagattccatgaagtggtggatagaatttatagggctgtgaaaattaagataatgtttggggaagaccactagggtgtaaacagtgtgacctggcaggctagaatagattgcttggttatggcaaagatgccagcttttttttttttttttttttttttttttaaaccttagctgacttaggcatgtaaaaatctacttaacttgcatgttcctgctttccggttcataattattcattggcagtggactattatgtacaaataggcttggagtaaggatgatagatgcgctttaacaattgggtatggttcatatttgaaacatgacatatgcatgtcaagatttaattactggaaaatttcaaaataaggatactgttaatgtaatacctatcattatacaccacatgaatcaaactaacttgaaaatgatgatgctgaatgaactgtaattgaagagtaaagcaaaaatagcagcaattgaaaactaccactaatttcctcaacagtgataatggagttcttctgagaactgtaagatttccagctgatcttacgtgtgcaattgcggaaggatctttgcaacttttccacccatttttggcaactaggcttagtagaatactagagtctcattcgtttataaacattgaattgtattaatagtcacttaacaagttacttgcatgtagcttttaatcacaggcagaaataaactgaacaccagtcactcataagatggatgaatgttggattaattcaccaggaagatcctttataccttgagaatcatggggctaagaggttgggaaggaggaggataaggtagaaaaatagccttaggctgaggctcattgcaatgaacctttgatgctaaatgtgaaatagaaagggggtgttttttctgtgacttaaagcaaaacctcaacattgtgtgtgtatgtgtgt

SEQ ID NO: 48847 - DNA, 1085 bp, Homo sapiens
tcttggtgccatactgccttcaaaagacttttttttttttttgagacagggtcttgttctgtcgcccaggctggagtgcagtggcgtgatcttggctcactgcatccttcgcctcccaggttcaggcgattcttgtgccttagcctcctgagtagctgggactacaggcgtgtgtcacctacctggctaatttttgtatttttagtagagaaggggtttcgccctgttgaccagtccggtctccagctcctggcctcaagtggtccccttgcctcggcctcccaaagtgctgggattacaggtgtgagccattacacccagcctccagaagacttttatttttccttaatttctcattttgggcatattcccttttatttgttgaatctgcattagtttaatttttcgtgtagtcataaaccaactaataggctttctagatgggcataagcgctctctcctcctccttcagtttttaagtctccatctagtggtctattctggaagcacagaggtgagaacctgtgttaatgtattggtgggtatgccagttttgtccattaggtggcaacaggccctaaccaaagagggaagagcactcagactgaaaaatagaaaacctgtgcttgcaaaactcggaacaagattttctggtacagctaggcttcaaaatcttggagaagggagttgtatacccttaggtcattctaagagcatgtacaaaaactctaaaaatatatggggcctatagtcccagctcctcaggaggctgaggcaagaggattttttgagctgcagagttcaagaccagcctgggcagcatagtgagactctgtatcttaacaataaagacacatgggaattcatttccctgtctcacttctcttgcctctcaagcttgaaaatcttgacttactcagtgggtatccagtggtcacttttctttgaatattggcagtaggaggtaatagggacagaaggttaaagtaatagagtagacccttaatgcaaggggatctgagtttggggatggggtgagaaggatgtgcctgaaacctactttattaatgataaaaagaagaaat

SEQ ID NO: 48848 - DNA, 1032 bp, Homo sapiens
gacatgcatttaaaaaattctctctcattttagctgccagatttccatggctattctgccaaattgagccaataggttctagcttccacttaaagcacagattttacattcagaattctgttatcttgaaattgttctaaggaagggggaatcagagtcctcaagtagcaggaaccatctttgaagtctgagaataaagtaaaagacttctacagcattttcaggcttctacttgcaaccctgcttccattcactagtaaagccatcagaatttgcctccttttcagtgtcaggcttgaggcttgagccagcactattgataatggagggagcttcttatataaattgggctatcctgacagttgcagggatacctgctgaaagcgaccctaatgaaatgcatgggtgcatggtacagtggaaaaaacatgagtgaaagttagcatcctggccttcctgctttcttgctgagtagcataggcaacgtgtgaagctcagtttgttcatctttgaaacagtagtaattcttgttaaatgttgttttaaaaaataatgagataatatacatgaattgcccagcagttagctgctctagtcctgcatgtttctcttttgtggaaatacaagacaaaaggtttctaatttctttttgttaatatttgatgagcatttactgtatgttaatgactttaaaacatttatctcatttactcttcctggcagctctacaaggttattctcaactcttgttctgccccattttacagatgaggaaactgacagtttaacacttggccaaggtcacacagctggtaagtggcagagatgaaccctgtgtgatcccaaagtccatgtccttatctttttaaaattgaggcgtgacttacatgcaatgaaacgcatagatctaaagtgttaaggttaagcatttttataaatgtgtgcaccctagtaatccacattctatcaagatacagaacatttccatcccttcagaaaattcccttttacttttcccagtccatcccacta

SEQ ID NO: 48849 - DNA, 1050 bp, Homo sapiens
agaaggaatgagaagaaattctgaggctagttaggttctgcagttgttctttccatgggagcaatattgcagtaacattttcagatgagacaaagacttttaataaacatttgttttattttattaaaaaaaagctgaaaggggttgcttaaattcagtgcttgataacaagggaatacatgggaattcttctcttccttttttgaactcttgccaaagagaaaaccttctgtgttaggcaaacgtatcagtagtggggggataccctagattaaagtcactgtcttcaaagttgtacatagttttacaaattaactttttttttctaaatatctcacatattcttagcatgctgaggctataataactcagttctaactgaggccctttctgggtactctttggtcaaccgggaccactctttgcctctttacctgaagctactttgtttttgttttattttggtccagtatttgtcatagatatgatctgaaagaaaagataagcctctctctttgaagagagccgacagtcattgtgaaccaaaattgaatgtgctttgttggtaagcataagaaaatcaaaactgcaaaataagattcaaagtgaaaatacagtgttaaagatctttttcatctgttagtacaaaattccatgtcctaagtgtagtctgccctatagatgtattttgtttgacttccaggatgtttaaataaaatcatgttagttgtcaacatttaaaatgttcaagatggccgggcgtggtggctcgcgcctgtaatcctagcactttgggaggctgaggtgggtggatcacctgaggtcaggagttcgagaccagcctggccaacatggtgaaaccccatctccactaaaaatacaaaattacctggacgtggtggcgcatgcttgtaatcccagctacttgggaggctgatggaggcaggagaattgcttgaaccctggaggtggaggccgcagtgagctgagattgcgtcattgcactctagcctgggtgacaagagcaaaactgcatttcaaaaaaaccca

SEQ ID NO: 48850 - DNA, 1048 bp, Homo sapiens
gagagagaatgaaaatgtcctggtgattgactatattattcgaggggactgttgggaagggtggtaaagtgggagcccaggaggagtctttggggatctctggcttgggggatgagagttggtggtacctggaacctgagtgaagaacacaggagaaagaggattcaaagagaaaataataggttcagtttgacatgttgaaattgatggagcctatgggttatttatcctggtagacattgacaatagacatttggatagatgggtctgtggttcaggagaagagtctcatccagaattgaaagtttgggggagaggggaatcatcagttgggaagtgtaagtgaaagtgtatgtggatgagaccatccaacctaggatgagaaggttgtgtgtgtgctgggataggcctttcttgcctgtgaggacatttagtaaagaacatgtcaggctggacgtggtggcacatgattgtagtcccagctactcgagaggctgaggcgggttgggttgatcccttgagcctgggaggtcgaggctgcagtgagccataattatgccattgcactgtagcctaggtgactaagtgaaactctgtctcaaaaaaaaaaaaaaaaaaaagtcagacaaggtctgtataatcatctgtaaggatgtgactgcttctaggggaaatagttgccagcagtggaaggacatccaaaagatatgtatggctgagtattattgataatgtgtctgtatttacattctttctttcctcccttactagtctgattcaagtgccattttgtcattaacttttttctagttttccctaagaagaaataaatagtgtgaccactgctgttaatgtctccattagggcatttacttcaaaagtccttgtatccagtcagttttctattttctatgctagattttaagaatctaggggtagccagctttactcacctatttttccaatgcagtctgggatagcagcctatacatggaaaacactaggtaaatatttgttgaatttgattttagaatataggaaagtttag

SEQ ID NO: 48851 - DNA, 1049 bp, Homo sapiens
gtaggacagtaaaagtgccttatttcatgtgtaaaaacagattctagtcatgtgggaaaaaggtcagaattagaaaaatcaaagttctgaatcaacagataaacacgcttgtatttcaataaagaataaatgtgcttgaaacagtttttaacagaaggtagctatctaatctgcccacataagtagtgatctgatatacccaactctttgtaatactttgagagcatttccaaaaccaattaagttgtgaaggaaaatgtttttcacacttctgcattaagatcaaccttaactttttaattaaagttttttcctggctcaggtaatttcttaagggtttatggatgccttcgataactagggttcagaaataccagaattattaaaaatgagcaagaaagtggtttggtactgagcaggtaattctttcttgggtattgagctttttagagcttaagtttcagattcagctgagcttaaatttaaaaaacgtctctagatgtaactttgatatacagtatttctagaatccagcccagtcttttgttcattgattgttttccaacatggcttgtctttaagaaaaagacaagggtgttagactgtaacacccttagtaagtaatagaaaatcagaagaaaaccactgtgagatgtctaacctgtttttcagtatggcggagaaatagccacaggaaaaagaggagagcatcatttgaaagaataaaacatttcctacggtatttcgttcttcattctttgttacctgctattaaacagcagcctttgtagaaaagcttctcaaaaaaacccagagttttttcagtggttacagttatttaaataagactttactagtgtaacccggtaattctaattaacagtgatttagtttgggagcggaccaggatttcctcagccggctgctggggagctgaattgcttttttccccacccccagctgcaccaaatcttttgatccccaagctacagtggttgtcatttgagaaagcaaactgagagaaaatacgttgtgaaaatagcctactt

SEQ ID NO: 48852 - DNA, 1049 bp, Homo sapiens
cttgatgggcttaaaatacactagacgctagaccgttgtgggatatttttcagtgtaaaaactagcattgtgcaatgttttacaatttatgttcattagcacttatgaagttaacatgctcacagaagaattgccaaaaatttttttaagtttgcctatggaacaatgggcacattttttcttttttgcttcctaattaatatttttctccaaaaatatatgaaactgcttgttctgagtagaaaagaaatgaattatctgttttttactcctagtgactgatttctattttatatgaactattttcaagagacaactatacagatagggggtcttttggtctctgtcatgaagaaataaactggaggtggcattttagaaatgttttcctaccggaaacaccattgatgctgaatttacagtcctttgaatggtttttattctgtcagaacagagtttctttctagccttttgatgcaccatcatccttccaggaattccctgtgctgactgcgctattttcagttgttgcttgtaggttttcataacaaacatgaactcatttagttgtaatagaggactgctcccttttgggatttcaaaggaagatgaatgatttgaggaagtgtatgctgaatattgcatttgttcattttaagagaatgagggaatatacttttaaatatttaaagcaaaggaaggcaaaggaaggttataagccattataagtaattaaaagcatattttatgtaattacactttagaggaaatggggagaagttcactgaatagcacggtgcctttttcttctgctataaccatgccgtccaaatgtttatgctggaaaataaattggcaaatatttcccatgatgatttaacttttcagttctgtgatttaaaaaattaagttaattctgagttgccccagaattttttcctactcccattagaaaaaaacaaaaccaaaaacatgctgtagtactgttgtttcttagtacatacagcacgcaggtttttcttttttttttttttttctttttttgtagc

SEQ ID NO: 48853 - DNA, 1009 bp, Homo sapiens
tcccaaagtgctgggattacaggtgtgagccaccgcccccggcccaaaaaacatctgaacctcttggtgtaggttttgtttggaggctgtatttgaaatttcagagcaggagttcccttttgcctgatgccatttgggtcatggaaatgtcaatgcaactaccaatgggccagccctaaccttggtgctggccattaggaagagaggctggcacccaggtcctgcccttgccccctcctagctagggcaagtggggatgtgggcatttctggagtgagtgctgagggctcctggtggggtgaggatgggtaggtaggagcaggatgggcccggggtggttaccatgcgggaatagccggcgctggccagccacagctcgtcgggagagaaggctatgctcttcacccaggtgacatggcccttcagttggataagcaggctgctggttgtgggcttccagatgtggatggtcttgtcccaggagccggatgcctggacagcagacagctctgatccccagggtttggggcctgtgagctcactgggcccctaagtggcctgggacccttaagggcctggctgccagcaagggaccagcctggaacccaggacaccccacttaccaggaggccggatgctgaatagcacaggcagctgatgttggcactgtgtccctctagcgcctggtgggagactgctggggtcaccatccgcaggtcccagatgtgtacggtggagtcccaggagccggtggcctgcaggcagcttctgtgagtctggcccagccagctctccacccactctgcatctaggcgggacccagagtccatccccttcccaccactcagctccaagtgggtatggggccactgaggtggggcccagggcagagggtaggctcaccaggcagttcaccgtgggtgagaagtcgctgctctggatggagtcacggtgcccaactaagaggcgcagcatctggccggactagagagagccctgagctgcagaa

SEQ ID NO: 48854 - DNA, 1037 bp, Homo sapiens
ggagccggggctcccccgctgcggcgccattggccgcgcccgccgccacccggcagtagttgcggaggtcagccccgcctacttcctctttccctcggagcgggcggcggcgttggcggcttgtgcagcaatggtgagagctgcggaatcgggcgccatccgagcgctgtgaggcgcgggggttggggaaggcggtgcgggctgagcccgcggattctatctgccacctaggcctgtggggcgccgcgcagaatggtctggcgccaccacaacccgcctcttcgcttggcgccgggagaggcgcgcggcccgggcctgggttactctgcccaaggcacggccggcgagggagactgtcctgagccctggttggggctccggcgcactcgtagtcgatggcgagtcgcgcgcctttgggggctggccacgcaggtgaaggggatatggccccgcggcctggctgaggcacactctctcttgcgcgcaggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatgtaagtgaggcggccggatcacagccctcgtgggtggggagcacgtgtgcatcgggatcgtcggaggatttcaaagttggcttaaggagctggccgcttagatgcccactccgtgcatcctggcgcgcatgggagacccgttgtgtgcttagcctcttacctgccttgaccttgcggtccttgtgcctggaatgcatccccggagacccatcttaatgctgccttcaaagcctacccggaccccttccttccgcttcccaccaacacttgagtttttaacccccttggcaggtgggtggcttgcaccctggagtggcagcgtaagttattttacatggctaagagtgcgggagacttgtgaaaggaacatgggtttggagttcatcaacctgggtacaaagtccacttctcaa

SEQ ID NO: 48855 - DNA, 1042 bp, Homo sapiens
tagctactcaggaggctgaggtaggagaatcacttgaacccaggaggtggaggttacagtgagccaagattgcactactgcacgccagcctgggcaacagagtgagactccatctcaaaaaaaaaaaaaaaatagctgggcgtggtggcgtgcgcttgtagtcctagctacccaggaggctgaggcaggagaatcgcttgaacccagcaggcggaggttgcagtgagctgagatcacgccactgcactccagcctgatgacagagtgacactccatctcaaaaaaaaaaaaaaaaataggccgggcatggtggctcacgcctgtagccccagcactttgggaggctaaggcaggtggatcacgaggtcaggagatcaagaccatcctggctagcacagtgaaaccctgtctgtactaaaaatacaaaaaattagctgggcatggtagcgggcacctgtagtcccagctactcagaaggctgagggaggagaatgacgtgaacccaggaggcggagcttgcagtgagtggagatcatgccactgcactccagcctgggcgacagagcaagactccatctcaaaaaaaaaaaaaaaaaaatactgtgtgaagatgttaattgctgcattcttttagatgggaaaaacagaaagcctaagtaggcagcacagtaggcaaatgggtcagtaaattacaaaacactctagaggaaataataatctgaggtctaaagattacatggagacagaaggacatttaagagtagggaaaagatacaaagttttacattgtcctattaaaactttatataaagctataaacaaaagtcattaaaagagagtttaagaaaatacgttagaatgctagtgttttataatggtagacttatgcagtatcttttttctcaggttacatttttctataatgtacctgttttatttaaatcgctttgcattttaaagccatttgttaccactcttcagcttcttgtgaacagaaagaatgcttctgcttccctctcaggtgagagaactggagcagacc

SEQ ID NO: 48856 - DNA, 1047 bp, Homo sapiens
aaaaaatttaaaccctaatgtatttaattttataattcataaaaatttaaatattggaactaagaacagagcaaagcaaagggaaaaagcactcctttgttttcaaattgcacaaactgtccctggagattctgatagtctctcatctctcttaactatcactgtaaacaacatagaaagcataagactgcaagaagtcagttatacacaaaacaaaatgaagcacagtggaattttctctttctttatctgtatatttctgaagttggtaaagcaactatcttctctattttacagaagagaaagctgagacccaaaaagctattcatagtgatagagctagaactaaaactcagatctcctcatctcagcccagtcttctcagtagctcagactgctttctataatgaacaagaaagaataattagggatttgtattttggcacaaaacagtatcaaatttttattgtaaaaatccacaaatctgacattttatcttttattctagccaggatgtattcttcatttgcatgtgtgtgtttctcttagaaagtggtgctctcaaacctttcaaagcacagaatttattgtaccctctttatttttaccaaattgaaacgtttcaggatttcagaagcaaagtgcaatccaattgtggctggagttttcctgatagaggatccgggtggttccctcccctccaacttctggctactgccctttatttcctttgtgcaatagaattccctgaaacagattatgtcgtaattatactgatttagtcaggataatgggaaaagcgacaaatcggatttatgtattaggtattatggagctttctttagcactctcctccaagtttaatctctgacatgtgtgatatagtaactttctgtctctgagaagcagtttggacccagctgaaaaattttatttatggagacttgtaatcagcctgatatacagagaacactctggactggaaatatagtcaggtaccaaggtctgctaatttggccattgccagtgattcaaaaccacctcccc

SEQ ID NO: 48857 - DNA, 1050 bp, Homo sapiens
ttttaaaggtatgtgtcccaggcaggaaagttgagaacgctttcctgaagtttccttcccctttgaaacataatttccatttaagcatctttttactgtcacttttctcctctttgcagatcaggcatttctccagttttttggagatgaatttcttcgcttgctcctcacaagatttatcttttgttcagccaccatgaggatgcacaagatttttcgggtaggcaaagaacattattaaagacgaattttatcattttaggtatttaagaaccatgtattatattttacctgtataaaataaggttataataaaataatattattttggataaattcaaaataatatttacaaatgtaccgtcacactggtctgctaagtaaaaaaatacatttgaatacgtaaagtataaagattaacaatattaaggcacatttgagtacctatcgtttgtttaaaagtagaacattttctggctggccgtggtggctcccgcctgtaatctcagcactttgggaggtcgaagctggtggaacacttgaggtcatgagttggagaccagcctggccaacatgctgaaactccttctctactaaaaataaaaaaattagccaggtatggtggcacgcgcctgtaatcccagctactctggaggctgaggcaggagaattgcttgaacccaggaggcggaggttgtggtgagcagagattgcatcactgcactccagcctggacgacaagaacgaaactccaactcaaaaaattaaaaaaaataaaagtagaacattttcaatacatccctgatcctatctccctctcaaatgaaacttacatcctgaattttatttatttatttatttatttagagatggagtttcactcatgttgcccaggctggagtgcaatgactcgatctcagctcactgcaacctctgcctcctgggttcaagtgattctcctggctcagactcccaagtagtagctgggattataggcgcccaccaccacacctggctaattttttgtatttttagtagatacagggtttc

SEQ ID NO: 48858 - DNA, 1022 bp, Homo sapiens
ctctaagaacatagtatgttttggctgggcgtgctggctcatgcctgtaatcccagcattttgggaggccgaggtgggtggatcgcttgagctcatgaatttaagaccagcctgggcaacatggcaaaatcccatctctactaaaaatataaaaattagccaggtgtggtggcatgcacctgtagtcctagctactggggaggctgaggcaggagaatcgcttgaaccagggagacggaggtttcagtgaaccgagatcgtgccattgcactccagcctgggcaacaagagcacgactcaaaaaaaaaaagaacatggtatgtctttacatttgttcaagtcttcattcaagagtattttaaaaaatgtttttgttgtttgattttttatttctttttaagtttactcctaggagttttatttttcttgttgctttaccacacagcttatgattttacttcccttgtagatataccttcagggaaaggatatgattaattatgtagagtactttagtttgagtgtcagcttgttactgtaaatcacagattcacattctggtcttttatgtcattccatgagagcagttattatgacccacaataagagatgactccaggaatcaggttttggagctgaaagccagatcctggatcttggaaagttcacctttatatatataagtgtgtgttgctcgatggattggcctcttggtatacagccagatgacttctccgtgcaaaactacaatcatgtttatgccttgtgtttaaaaaatcagtagttcactcagtaaactatttcaattgagagcctttaagaaagcctattatgcatggtacttatatatgaatggcagtctccttagctgttgctgatgtttctgcatctatttatgagtttaagggcccaatctatacactaaaaatatgctttggaaaattactaagtaactatctttggtcaaatctttaatgcaagttttaaattcttatatattacagaatttcacaaacttgttt

SEQ ID NO: 48859 - DNA, 1068 bp, Homo sapiens
atatacccctccctccccagtcttccaaaaacatctctgatcttctctcttccctggcccctgattgctcagttctcttcagccacactgacccccttgctgttcctgaaacatatcaggcagtcatctgccctagatctttacattcttttccctctgccttgaatgctcttccaaagatacctacattattctttaggtgtttgagcaaataaagccttttaaaaggtcttccctaattgtcctacttaaaattatatgcctccccagtactcctcatccacctttctttttcttaataatcataacagttaacttttctgtagtgactagcaatatgcactgttctaagcattttatgtgtatacgtttaattcctgcacaacacagtgtgttgcttttattgttcccattttactgataagaaaaccaaggcacagataaaggttaagtaatttgcccaagatcacacagatagtaggtagccaagttggaatgtaaaacaatggactgtaaaacctgtgctattaactatgtgctgtgcttccatatgtagcacttgtcaccttctgtgatattatataacttatttatttagttggttagtttactgtgggtcacaatctaccatttctccatcccccatccaactcagctctaggccgggcacggtggctcacgcctgtaatcccagcactttgggaggctgaggcgggtggattgcctgaggtcaggagttcgagaccagccttgccaacatggtgaaaccctgtctctactaaaaatacaaaaattagccgggtgtggtggcacatgcctgtaatcccagctagtagggaggctgaggcagggagagttgcttgaacccgggaggtggtggttgcagtgagctgagatcgccactgcactccagcctgggcaacagagtgagacatcatctcaaaaaataaaaataaaaataaaaaaatacttacataaatgtcagctccagaagatagagttttttctgttttgtttactgttgtatctctagcacctgtagcagtgtctagtccttaggtccatgag

SEQ ID NO: 48860 - DNA, 1063 bp, Homo sapiens
attgactgcggaaaagtgcacatgctgtaagtgtgtttttaagaaactgaatacatccatgtgacttgtattcagatgaagaagtagcacacacagcacctcagaaacctcccctgttgtgttccctgttacttggactttttaactcattatgagcagagtgaaaaagggcatttcagtgcatgaaaggtttcagatttttgtatcatgtctcatttgggatataatagattctctttttacgcttggaggtgtgtctttccacattatattaagctgttcatctaagttgtcagagcctttcattttcccagctgtgaatatcttaatggagtatttttctcaactgaaaataccttcttataatatgtgcataatagtttatctcttatttccactcactgtgtaagaaaacataatccagaaaaataagaattggatgaaatgaatgatgtttcgcatataatggctcttgcatgtagttgcaataataatgaagtgagaataatgttagaaaaagctttgaatactgtcagaaaatgatcaaaagcccaagtgcttgcagggttctggttgccatggtgactaagactgtcgaagcagaatggaatacttagtgagattatataaggcagcatctcgagacatgtatttgagaaacacagctgtgtctatcagtgatatccctaacttgcagtgttttgcaaaagcagaggcctccaagtcactaattatttgactacagaggagcaaatacacaaagccaaagaaggcttgggaggccactgatagtatatataatattattattatagtacatataatagtatatattgtgtgagtgtgtgtgtatatgtatatttttaattgggaggtgccccaaagtgaagtgtactagtcttaaatgaaaataattacagaaattatttttattaaatatgctcctagccaggtgcggtggctcacgcctgtaatcccagcactttgggaggctgaggcaggcagatcacctgaggtcaggagtttgagaccagtctgaccaacatggagaaaccccatctct

SEQ ID NO: 48861 - DNA, 1035 bp, Homo sapiens
tatttttagtagagacaagctttctccatgttggccaggctggtcttgaactcctgacctcaggtgatccatccacctcggcctcccaaagtgctgggattacaggtgtaagccactgcgcccgactgagatgatctgttttcttacagtatcttacacttaaattatatttttgtgatttgattgtaatcagaagaattctatatctgtcttggataaaaaatactatcagatgatataactaaggtttttttctatttttatttttacctcctgcatgaatgaacatatgttttcttacaggactgaatttgctcttaaagaaatcatgtcctctggaggtgctgaagatgatatcccacagggagagaggaaaacagttacagatttttgttatcttctggataaatctaagcaactgttcaatgggttaaggtgagtggactcttggtgttttgaacttttctttagttctgcatttgttttttttctggctgatgtgtggtaagtttccgaaaattatgggtagaatgtcatataaatttctgtattagagtgatcatgattttttctttgacatcatttttaaaattcttggataaaaaaacaataggaaaagaggataacttacactgttttagtcaacttaaaaagagctattttgtgaaatggttttgtatacataactcacaccagatctgattttaatctggttttgcacattagggtgttgaggtctgaggagcctaaaaatgcatatgcaattgaatgtggagcctcctattgcatttttgtaatttgtttacttgcttgtttcttttattctttctttctttgttttctgggatgaaatgtctgtgcctaaagtaatgatggttacctttgtctaccagattggggtggtgatggtggggggtgggtggaaaaagtaatgatgaggtgttataaaccatgctatttatgatttaacctgtatttcagttcttgagagtcttaggatattcactgacttcagacctaaagcttcattagctt

SEQ ID NO: 48862 - DNA, 1050 bp, Homo sapiens
gtggagacggcagcagtacagtccagcttccgctcggcatcagagggagaccgtggaaagagagggagagggagactgtggggagagggagatggagaggggagaggggagagggagcttatttactcattttaaaatttatttttagagatggggtcttgctctgttgccgaggctggagtgcagtggcacaatcataactcactgcagccaggctcactccccagctcaggctgtcctcctgcctcagcttcctgagtagctaggactgcaggcacatgccatgacacctgggtaatatttaaaattttcttagagacagagtctcactatgttgcccaggctgctcttgaattcctgggctcaagttatcctcccacctcagcctcctgaatagctaggattacaagcatgagctatcttgcctggctctggttcttaaaccttggaggttccatttatatggttgtatttctttttcttttctttttctttttttttttttttgagacagtgtctccctctgtcgccaggctggagtgcagcggggcgatctcggctcactgcaacctccgcctcctgggttcaagcgattctcctgcctcagcctcccaagtagctgggactacaggcccacaccaccacccttggctaatttttgtatttctagtagagacggggtttcactatgttggccaggatggtctcgatctcctgaccttgtgatcctctcccctcggcctcccaaagtgctgggattacaggcgtgagtcactgtgcccagcctgttgtatttatttttctagattacagttaattttgttttcatttcttgaaacctagtagaatatgtatctgcctataattcaagggcaattgaaagaaagaaaaataactcaaggccaggcatggtggctcacatctgttatcccagaactttgggaggctgaggcaggaggatcatttgagcccaggagttcaagaccagcgtgggcaacataatgagactctgatgctacaaaaaacttaaaaaaaaaaaaaaaaaaatta

SEQ ID NO: 48863 - DNA, 1057 bp, Homo sapiens
ggttttggtcagctgtgtttttctatgaagacaaatgatctgttcaaggtcatacatcttataatgaataaactttccaatcttaaactttttcaaatggtgtcataccaacataatacgtatgtttaaatttgtaaactcttttatcctctctactagaatatcaactagtgggtagattctgtatttactaaaacttcctatcatctgagtcttaaggcctataaacagatatttgaattaaattaaagcatgcttggggccagacatggtggctcatgcctgtaatcccagcactttgggaggccgaggcgggtgggtcacttgaggtcaggagtttgagaccagcctggccatcatggcgaaaccccatctctactaaaaaatacaaaaattagctgggcgtggtggtgcgtgcctgtaatctcacctacttgggaggctgaggcaagagaattgcttgaacctggaaggtggcggttgcagtgagccgagatcacatcactgccctccagcctgggagacagagtgagactgtgcctcaaaaataaatacatagatagatagatagatagatagatagatagatagataaatggaaaccttgatttaagtagttgcttcagtagttcatttgggctttgtcagtcaataacacattttacttctgtagtaatgggttactgataagggaaagatatgttagggtatgtattgaataaaaaggtgggaatggtgaattgaaagtatagttctttaaattatttactcatttttttaaaattgtttggtgttttattaaatacatggcactttaataacaaatgtaagctcctctttctctgttaccagagacctgtcttttattattattattattattattttttaaaattgataattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttgagat

SEQ ID NO: 48864 - DNA, 1027 bp, Homo sapiens
tgcccctatagttataataactatgttaatgtcagtcctgttctgggttggttttgattggttgatttttcttatattttcttctttccgtgtctggttatctttgagtagatagtagacattgtaaagatacttgagttttttttcttttttataaatttcttgagacttttcttggcacgcagttaaattatttggaaatatttctgttctttaaggtcatacttttaagctttgttaggtggatcagatcaccgtttagggctgtcatcactagggcatataactgtactaatgtgacatgacccttctgaatgccataccagggaattataaggtttttcaagtctggctggtgggaacaggcactattatcgcttgtgtgtgagttccaggcttccaggcactgttccctctaatcctctcagatgattctttcctctctggtagttttcttctacacatgggcttatcagtacttggcggaatacttgagagaaactctccctagatctctaatattttctctctgtgcagctttctcctctacagcattctgtcctgtgcactctagatgccttagcgtctctagacactcagctccatctttttaactcagggcctctgcctgagttcctcttccctgcgctacatcctagaaatgctctcaaggcagtcagctggggtagttgtaggccctcccttcttttgtcctcagagatcactgtccttgctgcctaatgtccaatgtcttgaaaaccactatttagtccagggatgtacaatctttggcttccctgggccacactggaagaagaacagttgtcttgggccacatataaaatacactaacactaatgatagctgatggactaaaaaaaaaaaaaaattttcacaaaaaaagtctcataatgttttaaggaagtttgcgaatttgtgttgggccacattcaaagccatcctgggttgcgtgtggttcatgggccatgggttggacaagcttgatttactctatttcatctgcttt

SEQ ID NO: 48865 - DNA, 1025 bp, Homo sapiens
caagccaacagcttgactcattgtcctggcttcacaagggctgagttatgtgaatctgtgattttccttggagagtctcctttcttccagcactggcttcattgtacccaaggggctcaatgtccagctaagatttctcttatcctgtataggtttctgatggacaaagagagagaatgtgtgtgtgtgtgtgtgtgtgtgtgtgtgtgtgtgtgtgtacgtgtacgcacgcatgcatgagagagagaatatgtgtgtgtgttttggaagcagctatcttttttttttttttttttgagacaaagtctttactctgtcgcccaggctggagtgtagtggcgtgatcttggctcactgcaacctccgcctcccaggttcaagtgattctcctgcctgagccccttgagtagctgggattacagtgcctgccaccatgcgtggctgatttttttgtattttttgtagacacagggttttgtcatgttggccaggctgatctcaaactcctgaccttaggtgattcacccaccttggccttaagaagcagatatcttttgattaaagggcagttcagttttatttttctttcttttttttttggagatggagtatcactctgttgcccagactggagtggagtggcacgatcttggctcactgcaacctccacctcttgggttcaagcaattctcctctctcagccacctgagtagctaggattacaggcatgtgccactacacctggctaattttgtatctttagtagagacagggtttcaccatgttggccagcctagtctggatcctgacctcatgatcctcccacctcggccactcaaagtgctgggattacaggcgtgagacaccgcgcctggccttcatttttaaatttaattttattttttttaagacagagtttcgctctgtctctcaggctggagtgcagtggcgccatctcagctcactgcaacttccacctcccggatttaagcgattctcctgcctcagcctcctgagtagctggg

SEQ ID NO: 48866 - DNA, 1123 bp, Homo sapiens
aacagagcaagactccatctcaacaaaaaaaaagaaaagaaaagaaaaactgcagcatagaagtgatgtgaactttcattaaagcttctcttttttatgttaggaacccatagtaatcggtatctagatttatgaattcattagggttgcaaatgttgaaattctaattgttttgcccatgcgtggtggctcacacctgtaatcccagcactttgggaggctgaggctggtggatcacctgaggacaggagttcaagaccagcctggccaacatggtgaaaccccatctctattgaaaatacaaaaatcagccaggtgtggtggcacgtgcctgtaatcccatctacttggtaggctgatgcaggagaatcacttgaacccgggaggtggaggttgcagtgagccaagatcatgccactgcactccagcctgggtgacagagtgaggctctgtctcaaaaaaaaaaaaaaaaaaaaaaaaaaagaaattctaattctttcattccttctttttatttattttttttaagttggagtctgcgtgatctcggctcactgcaacctccgccccctgggttcaagcgattctcctgcctcagccaactgagtagttaggattacaggcgtgcaccaccactcctggctaacttttgtatttttagtagagacggggtttcaccatgttaaccaggctggtctggaactcctgacctcaagtgatcggctcgcctcagcctctcaaagtgctaggattacaggcgtgagtgccactgtgcctgtctcattccctcttcattattagctggaatacttccagaaagagacatttcccttactgactgaaacaattttttgaattttatttatttatatatgagagggagttttgctcttgttgcttaggctggagtgcaatggcgtgatctcggtgcactgaagtctccgcctcctggattcaagcgattctcctgcctcagtctcccgaatagctgggattaaagttgtgcaccaccacacccagcaaatttttatatttttagtaaggatggggtttctccatgttggccaggctggtcgtgaactcctgacctcaggtgatagacctgcctcagactcccaaaatg

SEQ ID NO: 48867 - DNA, 1126 bp, Homo sapiens
tgccgggcatgctggctcacacctgtaatcccagcactttgggaggcccaggctggcagatcacgaggtcaggagtttgagaccagtctggccaatgtagcgaaaccccgtctctactaaaagtacaaaaattagccgggcgtggtggcaggcagctgtaatcctagctactcaggaggctggggcgggagaatcgcttcaacctgggaggcagaggttgcagtgagctgagaccacgccattgcactccagcctgggcgacaaagcgagactccatctcaaaaaaaaaaaaaaaaaaaaaagaaaggtattagtatcagttttatactgtggctatagaaattctgaatatcaaatgatataaattcctggtaaacacttcaagatgaattaattgaggcagatgaatggtgtgagcccaggagttcaagaccagtctgggcaacatggtgaaacctcatctctaccaaaaatacgaaaattagccaggtgtggtggtacacacctgtagtcccagctagttgggaggctgaggtgggaggatcagctgagactgggaggtggaggctgcagtgagccatgattgcaccactgcactccagcctgggcaacagtgaaaacctgtctcaaaaaaaaaaaaaaaggtaagttaattgttgaatgtagccttgagtaactgattgaacgggtctgctatgtagagttgttgacagttatattacatatgtagtacattttagaaaacagttgacagaattatggttttttttttgttttttttttttttgtttgagatggagttttgcttgttgaccaggctggagtgcaatggtgtgatctcggctcactgcagcctctgcctcctgggttcaagtgatcctcctgcctcagcctcctgagtagctgggattacagacatgcgccaccacacccagctaattttgtatttttagtagagatggggtttctccatgttcgttaggctggtcttgaattcctgacctccggtgatccgtccgccttggcctcccaaagtgctgggattacaggcatgagccaccatgcccagcccagaattaggattttaaaaatttttatttagttttgagatggagtctcactctgt

SEQ ID NO: 48868 - DNA, 1054 bp, Homo sapiens
ctataatcccagcactttgggaggccaacgtgggtggatcacaaggtcaggagtttgagaccagcctgaccaacctggtgaaacccccgtctctacaaaaaatacaaaaatcagccgggtgtggtggcggcttgtacctgtaatcccagctactcaggagtctgaggcaagagaatcgcttgaacccgggaggcggaggttgcagtgaaccgagattgtgccactgcactccagcctgggtgacagagtgatactgtctcaaaaaaagaaaaaaaagaaaaaaaaatggtggttttttttttcagggaaagtttttgagagaatggcacagcagattcttgtagatttccctggaatcaaaaatcttgtttgtataaacatttaatagaaaaaatttgtttacgtgtattttatttttttgttaaaatcaaatttccaaataattcagtatgtaactctttattgtagttataaactatatgtttgtacagtttgatataatttgaaaagaatattgtggctattgtattgtttgtaactgtaaacttttacttcacagggtgattttgtagacagaggttactatagtttggagaccttcacttaccttcttgcattaaaggctaaatggcctgatcgtattacacttttgcgaggaaatcatgagagtagacagataacacaggtctatggattttatggtaagaattcctatttctctgattctgaatattattttactttcctctttggaaaacaaagctacacaagtcatacacatgctttatgtatattattttccccacatcctcactccttcactcctcccaaacaattgaaaatcttatgctcgagagaagaccactgttaactttttggtgtgcatctttctagatctgtgcctcaaagtgtagctggaatcacctgggttctcattaaaaatgtagattgccggccgggtggggtggctcacacctgtaatctcagcactttgggaggctgaggcaggcggatcacaagatcaggagatcgagaccatcctgaccaatatggt

SEQ ID NO: 48869 - DNA, 1043 bp, Homo sapiens
gaggctgaggcaggagaatcacttgaacctgggaggcggaggatgcagtgagccgagatcgcaccattgcattgcagcctgggcaacagagtgagactgtctcaaaaaaacaaaacaaaacaaaaaaacatatctgtaaacatcaatagaaaagtttaaggatactcactcttctaccatatttttattaaaaaactgacttacaaaactttttaatgttcacttcctgactttgtgtatataactactcaattttttacataatagaattgtgtagttataggtatagttttgtattccattcttttccctaatgatttttgcattttgctacatggttttcgtcataatttttattcatggcctcataaggtccttgagttgctagatcttaatttaagatattcacttatgttagtcatgaaggctgtttcttttgatgttttaaatgttgtcataacacttttttttttttgagacagagtcttgctgtgtcatccaggctggaatgcagtggcaccatcctggctcactgtaacctccgtctcccaggttcaagtgattctcctgcctcagcctcctgaggtagctgggactacaggtgcccgccgccacgcctggctaatttttgtatttttagtagagactgggtttcgccatgttggccaggctggtctcgaactcctgacctcaggtgatccacccgcctcggcctcccaaagtgctgggattacaggcgtgagcctctgtgcttggcccactttttttttttttttttgagacggagtcttgctctgtcacccaggctagagtgcagtggcgtgatcttggcttactgcatcctccacctctcaggttcaggtgattctcctgcctcagcctcccgagtagcagggattgattacaggtgcccaccatgatgcccagctaatttttgtatttttagtagagacagggtttcaccatgttggccagtctggtcttgatctcctgacctcatgatccacctgcctcagcctcccacaatgctgggattacaagtg

SEQ ID NO: 48870 - DNA, 1009 bp, Homo sapiens
accgcgcctggcaaaaaaaaaatttttttaagggatagcgtcttgctatgctgtccaggctggtcccaaatgcttcaggtgattctcctgccttggcctcccaaaatgctgagattataggtgtgagccactgtgcccagccaacaaacacttatttacatggttccttgtgttgagtactgttccctgtgggtgccaggggcagaattggatacttgtgtctgcctttgaggggctttcaatatagtaagggaggtaaggaggtaaacaaagactgtaatagaggctgaccagggtgttggcaaacagaagaagcagtatgtaactttagagtcagagatgatttcataaaggagcagttacgaggggcagagttcaggtagacaaaatgagaaggaaagaacatgcaaacagaataaacaccatgtgcaatagtataatgtaatttgcaagaacatggctggttcggggaacttgaagtggtttggtatggctggaggtggtactggaaagaaagatgccaaatcatagaagagtaggctgttaaacttagattgttattttttaggtggtgcatgaacactatgaaatgtttttatattttagggaaaaatcatactgtgattcgtgatactgtttaaaatgtagctaactaaaaataaaagtagattcaaagaaaattattacagggatacactgttgtatgtggtaggaatatgacaaaataatgaaaatggtatttggtgtttgggaaacactgccataaatggaggaatacgcttgaggagtttttaagaaggagaatgacagtaggcttttgaaatgtttattctggcagcattgtggaccatggattggaatgcaggaaaaatgtcatagaagcagtaggcccggtgatatgagagtctgagataaggcaatgataagtgattgttgtgttggaaaggaaatgaagaaggtatagtggcacctgttaacagatttggtctaggttatgatgaagagagtt

SEQ ID NO: 48871 - DNA, 1324 bp, Homo sapiens
cttcagactgaaatgcggggatctagatgtgctaatgcttgtcagtaacaactaacaagtttttctgtatgtaacttctaggtgaaagacccctgacaaaagacaatcatcttctgggtacatttgatctgactggaattcctcctgctcctcgtggggtcccacagattgaagtcacctttgagatagatgtgaatggtattcttcgagtgacagctgaagacaagggtacagggaacaaaaataagatcacaatcaccaatgaccagaatcgcctgacacctgaagaaatcgaaaggatggttaatgatgctgagaagtttgctgaggaagacaaaaagctcaaggagcgcattgatactagaaatgagttggaaagctatgcctattctctaaagaatcagattggagataaagaaaagctgggaggtaaactttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttaagtctcgaatgtaattggaatcttcacctcagagtggagttgaaactgctatagcctaagcggctgtttactgcttttcattagcagttgctcacatgtctttgggtgggggggagaagaagaattggccatcttaaaaagcgggtaaaaaacctgggttagggtgtgtgttcaccttcaaaatgttctatttaacaactgggtcatgtgcatctggtgtaggaagttttttctaccataagtgacaccaataaatgtttgttatttacactggtctaatgtttgtgagaagcttctaattagatcaattacttattttaggaaatttaagactagatactcgtgtgtggggtgaggggagggagtatttggtatgttgggataaggaaacacttctatttaatgcttccagggatttttttttttttttttaaccctcctgggcccaagtgatccttccacctcagtctcccagctaattgagaccacaggcttgttaccaccatgctcggcttttgcattaatctaagaaaaggggagagaagttaatccacatctttactcaggcaaggggcatttcacagtgcccaagagtggggtttt

SEQ ID NO: 48872 - DNA, 1055 bp, Homo sapiens
aagtgctgggattataggcagaagccaccgcctggccagactgtaatttaaataagggttaaactatgtgacaatacacttaattatcttttatccttttaggttacccatgcagttgttactgtaccagcctattttaatgatgcccaacgccaagcaaccaaagacgctggaactattgctggcctaaatgttatgaggatcatcaacgagccgtaagtatgaaattcagggatacggcatatttgccaaatagtggaaatgtgaagtactgacaaaacttttccctttttcaatctaatagtacggcagctgctattgcttatggcctggataagagggagggggagaagaacatcctggtgtttgacctgggtggcggaaccttcgatgtgtctcttctcaccattgacaatggtgtcttcgaagttgtggccactaatggagatactcatctgggtggagaagactttgaccagcgtgtcatggaacacttcatcaaactgtacaaaaagaagacgggcaaagatgtcaggaaagacaatagagctgtgcagaaactccggcgcgaggtagaaaaggccaaacgggccctgtcttctcagcatcaagcaagaattgaaattgagtccttctatgaaggagaagacttttctgagaccctgactcgggccaaatttgaagagctcaacatggtatgttccttgttttctgctttgctaatgagatctccttagactctgaattcaggacattgcatctagatacttagataacagacatcacagtaaccatgtcttttttctaggatctgttccggtctactatgaagcccgtccagaaagtgttggaagattctgatttgaagaagtctgatattgatgaaattgttcttgttggtggctcgactcgaattccaaagattcagcaactggttaaagagttcttcaatggcaaggaaccatcccgtggcataaacccagatgaagctgtagcgtatggtgctgctgtccaggctggtgtgctctctggtgatcaagatacaggtaggtcat

SEQ ID NO: 48873 - DNA, 1056 bp, Homo sapiens
aatgggaccagcggatggggcggatgttatctaccattggtgaacgttagaaacgaatagcagccaatgaatcagctggggggggcggagcagtgacgtttattgcggagggggccgcttcgaatcggcggcggccagcttggtggcctgggccaatgaacggcctccaacgagcagggccttcaccaatcggcggcctccacgacggggctgggggagggtatataagccgagtaggcgacggtgaggtcgacgccggccaagacagcacagacagattgacctattggggtgtttcgcgagtgtgagagggaagcgccgcggcctgtatttctagacctgcccttcgcctggttcgtggcgccttgtgaccccgggcccctgccgcctgcaagtcggaaattgcgctgtgctcctgtgctacggcctgtggctggactgcctgctgctgcccaactggctggcaagatgaagctctccctggtggccgcgatgctgctgctgctcagcgcggcgcgggccgaggaggaggacaagaaggaggacgtgggcacggtggtcggcatcgacctggggaccacctactcctggtaagtggggttgcggatgcagggggacggggcgtggccgcctggcctggcgtgagaagtgcggtgctgatgtccctctgtcgggtttttctgccagcgtcggcgtgttcaagaacggccgcgtggagatcatcgccaacgatcagggcaaccgcatcacgccgtcctatgtcgccttcactcctgaaggggaacgtctgattggcgatgccgccaagaaccagctcacctccaaccccgagaacacggtctttgacgccaagcggctcatcggccgcacgtggaatgacccgtctgtgcagcaggacatcaagttcttgccgttcaaggttcgaccgggtttttctcatccagttagagaacgggtgggtggtgggagtatttagagttataagtctctggaaaagtgttgagacaacagttgaaggttatagacatgatgtatgtaataactttaatactatta

SEQ ID NO: 48874 - DNA, 1046 bp, Homo sapiens
aaagctggacgtctccacttctgacatttgtgccactaattagtttctgcttggtattaaattctatcttctctgtcttactttgaaaaacttacataagtgtaaatacagttctacatatccagattttcacttcagtactcacgagtggaggtacagtttcagtatctgccctgagcatgtgaccagtgcttagatgccacatttataccctcttatattgcattttatttacatagcactataaaagcaaatctgctcaaaggaggcccaattaaaaatgcaatcttcaaagcaattagcattttatcatcaaataccagttccatcatagttaaatgaatgaccacctccctgctatatgcagggatgtatgtgacatataagagatcactgacagatgctatcccctcctttacagccaggcaaaccttggaagggacagtgccttgccaaggtcccacagctgaaacatggcagagctaggatttcatcctaattctaacttcaggaattatgctttttttcctctgtgtctcaggcttttgttaaaccttaatttaaacagaatttaacaattaatgcaaaataatttgaactaattggaatattaaactttacatttttttaaagtcatactaatacataactttttcttagctgattttttttttttttttttttgagacagagtctcgctctgtcacccaggccagagtgctgtggcacaatctcagctcactgcaacctccgcctcctgggttcaagcaattctcctgcctcagcctcccaagtagctgggattccgggtgtgtgcctccatgcccagctaatttttgtatttttagtagagacagggtttcacagtgttggcaaggctggtctcaaactcctaacctcgggtgatccatccaccttggcctcccaaagtgctgggattacaggcttgagccactgcgcccagcatctcagctatttttttacaactagtgtctcagctattttttacaaagacagcttgctcctgtgacttaaccctgttccta

SEQ ID NO: 48875 - DNA, 1101 bp, Homo sapiens
tggactgcagaggaagagcctggtgaccaggaggccagtgatgagactgtcacactcaagcactagcaggtgccccctgagccagtgggggctctgtcagtagacagctatgtctatcaatagacagccatgtaaccttaagcaagtgtcttaatctttctgagcctcaattctatcctgcgtgaatgggaatatcagtaccaatggctcagggttgctatggggaacgagtgaaatcccacatggaggctgtggggcgcagggtgagaggcagtaaagaagacgttttgggaatcttggaaaggacagagattcttcaaggaatgtggattacttttgtgattaggaaaatcacatttagaaaaaaaacaagacccgtgacactgctaacaccacccaagctcttgtgcttttgactcactcctgtggactgagcttcctgccaagagcaagcaggaatttttttatccttgcatccctgctgcccagccaaggacctgccatagtgtttgtggaattaattgttgaatgattaatatgttaccattctctgtttactggaatggcattattaagtcatcgctcagccttttcttctccaaattaaatagcccatattattttaatttatcccaaagcattttaagcagacaccatttgccaagcctcatgtatctttatgtgttaaactgccttttcctccccaggttcaagggcagacggggtttttgaggaggattcgcaaattgacatagccacagtacaggatatgcttagcagccaccattacaagtcattcaaagtcagcatgatccacagactgcgattcacaaccgacgtacagctaggtaagtgtgtgagcaggtgatgagctagcttgtcgtgtcagcagtcggtgtagaaatggggaaagaaacaacatacaacttttatgtgacctgaatgactaaaagtaatttgttttctgagaaaatgtttaaacaatggaatttgaagtacatcctttttcccacttgagtgctctgtcttgtcttcttttttatgaagcagaagattagaaatagaactaacttgagactcttttcaaactgattgacttcg

SEQ ID NO: 48876 - DNA, 1039 bp, Homo sapiens
catttccagcccatctgaggaacatttttactcacagaggttgtgtggtggttaaaggtgcaattttggaattagacctgggttcagttcctagctccagcttgtactgtttgtatgactactgtagcagaatgacattctgagtctcatttttctcacctgtaaaaagaggataatatccaacttaaagaggcattgggaaaaatggaatgagatgacgtctttaaaatgctgagcatcgtgctggcatgcgttaagcacttagtgtgtgttagccaccgtcacagttgttgaggcagaacccctgtccttgacaaacctagtctgttggggagtctgaatggaaaacgaggaaaggtatgttaggtgctgttagccaaggtaaatacaaggggtggtgtacaaacctcaggtgctgttaatggttaacctgtgttgcatcacacttcacttgttccatcagcagcatttattgaacatctactgtgtgaccatgtgctttgtagaatgggatgttcctgccctcaggctccttgtctggaggggagtgcaaatacttaccatgtaagatacttaccagaagaaccttcaataaagggctataatgctttaggagagagacaggggaggttccatttggactagaccttgaagcatataaattttagagcataaaggacattctgaccaaatggtagaacctgagcagagtccagtttagctgaagcagggcttctgcgtggggagtagcaataagacttcaagatagagtggagcagagaagggtttatgtacttctcattgtcagtcacttgtactattttacttaattgtgtgccaggtgctgagctagatactgctccacttttgaagaactactcccacccccaccattttcttttccaccattccgcttcacacactgtgccaaaggcaaacacttggtgttccctgtgtaggtcctcatgctttgtggactttatgttttttcctatattcctccatggattgcctgtcctcctttcatcatctgggaaca

SEQ ID NO: 48877 - DNA, 1015 bp, Homo sapiens
gctgaggcagggggatcgcttgaacctgggaggtggaggttgcagtgagctgagatcatgccactacactccagcctgggcaacagagtgagactctgtctcaaacagaaaaaaaaaaaagaagaagaaaggctgaatagtaatgagctaagcattcagctcaagaaattgaaaaatagaaaaacctgaaacgaataaaagaagcaataaagagaagaatagaaattaatgaaatagaaattcagaaacatcagaatcaagagttggttctttgaaaaggccaacaaaatcgatacacttccaatgaaatggacaaaaacaaggaagagaaacacagatagtagtaggaatgaaaaggaggtacactgtagatcctgtcattaaacattaagatcctgtcttgtaaataaatacaagattattttgaaaaaaattataccaaaaatattaaaattatagatgaacaaatttatagaaaaagacaacaaaattgacacaggaagaaatagaaaacctgaatattctcataactattttgaaaagctaattagtaattaggaaccttcctacaaagaaaatccaaacccacatgacttcactggctagtttctaccaaaaacttaagaaaaaaataactccaatcctatatccactgttgcagagaatagaaaaaggttataacctccaatttgttttaagaggctatcataatcttggtaccaaactcagtaaagaccatacaagacagaaaattttcaggccagtttgaaaaatatagatgcaaaaatcctaaacaaaatattaataaagtgaatctaacattatgttgaaagaacaatataacattacgaagttgggtttattctagcagtgcacatttggtttaactgtgatgtaatgttaagggaaaaaatgtcaagacaaatagatgaatcccaactatgtaaaaacaaacaaaaagtaaaactggaaagaaaatgttaatagtggttgtctctggttgacaagattctgg

SEQ ID NO: 48878 - DNA, 1029 bp, Homo sapiens
aggatggatagaaagccttgagagtggggtaaggaatttgcatctaaactagtagcctgcaaggaagttgtgaagggattgtatgaaagtgataccttgaatctaccagaatttggctctggagagcactctaacaatagggtgaagagtggttggctggaggccagaagaaggttgggaaaccattactgcggcctgagtgagaaggaatgcaagggagatgtattaagtgggtagagtctgcagaacttgggagccgatttaatgtcatcaacaagggggaaggctaagaagtattccaaacttgagagtgccgtgttcactatgccaagtccttagaggccagatgcagagtcttgttcatcttcatatctacagtgactagctcatgacatggcacatggtaggagtttagtacagtttgatgaaccaactgatttaattcattgggtgaatcgtagtgtcgtcattggaagcacagttacaaggaaaaaaagctggtttgagaatggaaggatgataagtttatagttgattgtcctgtaaaattagaagcaaaaaagagcttagagtctctttcttcctgcaaaggctggtccaaccattcactggcagtggtgcttccctgaagagttggtagaagtccctaaagaggccctgtagccttttgtcccaccctgggctagagccccttccaccagggccactggcatcaagctagccaaagaataatcctggtgcctcactgaatctgctcaaaatcctgtcaagtacatacaactactgtattatccgcatttaacagaggaagagactgaagttcagagaggaagtggtttaccgaagcctctgacataagcagatttgaatgaaagtcttcagattccaatatatcataacagagtctgctgactgaaaacaattggctctaagcttgctctccactgactcaggttggagtcaccactttcatgtagctcagagaaggttgaagataaatgaagtctcatttttgtttcttctgttttt

SEQ ID NO: 48879 - DNA, 1029 bp, Homo sapiens
aaattgtagtaaaattgaccctttaagggagataaagcaggttccctgcacagtaagtggcaccatcatctacccattcacctgagccacatatccagctgtcagtcttgaatttttcctgcactgcctccccacatcttatccattagcaagtcttatcagttttacctctagaatatatcctgaatccatttagttgtcttcgtctctgttggatgggtccaagtcaccatgactctccacctagactgctgaaatagcaccctggctggtttttctgcttgtgctcttggcctctctccagtctgttgtttacacagcaaccaaagagagattttaaaatatgagtcagagcatatctgctccgaactcttcaatgactttcagttctgtatagaattaaatccaaatttttaaccactgtgaaatacactgaggcccaaagaggataagagacatacagagagtatgaacacaaagaaataaaagaacttgaaagaaatggagaaaaaaatacagagttgatgattgccttatgacagagggatacagatcaggaagagaccctgggcactcaaggccatggggaggtgcggaatttagagcctgtgacccactgtggacctgctgtactagactggctgcagcagggtcagtctccataataccacacacagtaggccttactttcatgccagatagactgagaaagttgtatacagatgaatttattatttattaagtgtattttagtcaggcacagtagctcacacctgtaattccaacacttgggaggccaaggcaggaggattgcttgaacccagcagtttgagaccacactggacaacatagtgaaaccctgtctccacaaaaaatttaaaaaattagccaggcatggtggcacatgcgtgtagtcccagtgactggggaggctgatgtgggaggattggttaaacccaggaggtcaaggctacagtgaggcatgatcacactactgcacttcagcctgggtgacagagcaagactctg

SEQ ID NO: 48880 - DNA, 1027 bp, Homo sapiens
cctggttctttactcttgttttggtcccaaatattttatataaaagtatatttgtgatataatgcattatattctaagaaggccttattctgaagtgtccaaggagaaggtgaaacttttttaagcttcttagtagaaattccactgtcacagatttttcagaccatgaaactcctatgaacttacttagatacagctgagcaagtatctttccttctgtctcccgtcgtctctgtccaattgcatacccgtttttctatgtccattcccagcgtttatcatacacacatttatttatgttcacctttgtgtacacattactgccttttccatcagagtctttgccatatccttggcaaagagttaggactcgttatctgaaaaacagtgatctgcgttatttattccttttcatacaagagaagccaattgagattgatacatttacataaattactgtccgttttcttaatccaaaaagctttttaacaaaagaagctctttctgtagctttaataagtctggtctcataaaacagaaggatctccagtttggtaaagatatttgtttaaggttaggttggtaaaggcagggtacatcttgtgtttttgaactttttagacttttttttggagagtgattaatgaaaagaggaaaatcctcttgtcatagaaagtaacacatagaaagtacttaaaaaattgttggtgttcacagttggctatgaaatacctgttagttacccattatgacgcatgaacttagtcatgaacttggtggaaagagatgccaggttagaggcagtcatcctgcacttcctgagcctctgtcacaatgaccagcttagtgtttgcaaaaatgtgcctaccatgccccatgtctgggaacagaattagagtgatcatccctgtcgtcaaaccccttttacctgattgagtacagaacagcacttgtctctttgctacccttactgaacgtcagtgaagaaggggggaaataccagttcaaatcaaaatacacatgccat

SEQ ID NO: 48881 - DNA, 1045 bp, Homo sapiens
tcctgctgttgatagactgtccattttttcttgttaattgtgactattttttctttgtatattgtgatgttatgcttttatgttcacacaatttcagaattgctattttttcctggtgaattgaaccatttgtcatttgtgattaactctagtgaagttttcctccctttcaaatagttacacctgctccatttggttgatatttgtctggtatagatgcaatttcattttgatgttttaagatacagatcttctttcctatttttcttcttttgcattcattgggctttctgaatctgcatattagtgtctttcatcattctggaaaattctcagccactgtcttttcagacattgcctccgaaccagttattcttttctcttcttctgaaactctagctacacctatcagaatgtgttattttatccttctcatctcttaatttctctttcttatttcctatctctgtgtctctttgggttgcattctaggtaatttcttcaactcatatcttcctaacagattctctcctcagctgtggaacccatatgttgcatttccaattttagttgttgtatttttaatttctagaagtctgattttgatcttgtaaaaatctgcttggtaatttaaaaaactattacgaaaagtgtagtaattttattagtaaaagttcagtgagcacccttatgtgtagcacctgtattcagtaattgttaacattttgtcatatttgctttatttatgctttatttaatctttaaaagttgacattcactcctagcgacattctcctactcaaccataatatatcacaccttggataatcttttatagtctcttgcacttactccacatttttgcttacacatttattttatattttgcttctgatcatactgttaactccagtctttctgggcctatttcatgatgccttctatgttttgtgatttggagatagaacaaattatttcttgcaaatttttctgttggaattatttgagtcatttaggtttttcccaataggatctgcgtttgctt

SEQ ID NO: 48882 - DNA, 1074 bp, Homo sapiens
ataattgaaattgaacatctttttgtgtgtttattggttattcatgtttcctcttctgtgtgaactacttgttctaatcttttttctattttaatcaatttcttcctgatttgaagaagaaatttgaatgtatgtttggatactaaccatttttatgtattgggtagcaactgttgtagattctcctggtttgtgacttgtcttcattctctttttggtgctttttaatgaacagaaattcttgtttttaatgtattgaattatcagtcttttgcttcattattgctttttgtgttctaagaaatctttaccctcaagattataaagttattttcccaaattgtatttaaagtttttatagttaaataattaatccatctggaactgattttttgcatgtgtggtagtgaggtagaggtctgatttctgtttttttctgtgtggttaatcagttgttgtggcattatttattgagtcccacctttccccattggtttgtcatgctcgcttggtcatatatcaaatttccctatgtttgtgctgctcttcctggacttttctgtttcaattgtttatttggtttttcctgtgctaatatcacactattttaattactttaaatgtaaagcaatttctggtaactgataaatcatgctccttcaacctccttttctcttttcttttcttttttttttttttctgagacggagtcccactctgttgcccaggctggagtgcagcagcgtgatcttggctcactgcaacatccgcctctgcaacatcaagtgattctcgtgcctcagcctcctgagtagctgggattacaggcatgcaccactacacctggctaatttttgtatttttagtagagatggggtttcgccatgttggccaggctgatcttgaactcctgacctcaagttatccactcaccttggcctcccagagtgctgggattacagacatgaaccactgtgccaggcctcaacctcctttttgttatttgtgagtgtcttgtatattcttaacctattgccctgctacacaatggctgattttttttttttttttttt

SEQ ID NO: 48883 - DNA, 1038 bp, Homo sapiens
caggtgtaaaagtgacatttagagtgtatcctttatgtggctcttgatgatctgcatagtgaagcattttatttaaagtgccccttttcccaccttgtcacctgccctgtcttcttgcccattccatcttgcccattccattttctgtcatatcttgtgggttgtgtgtggtgttcttctgcctgaaatgtcttcctctatagtgaattgctgtttatcctttaagattcagctcacacatggcctcctctgcctcctacaagttcactaccacaagcagtccttatgacactccattgtagttatatatttatatgtcctttgctctcatagaatgtaagctgtgtgtggacagggcaatgtccagtttatctttctaacaccagcaactccacagaccctaacattcagtagtcactttgcacaattaaatgaagtggccgcctttgtcgtagagaattataaaatggtacaaggcaggatgcttcagtttgtatgtaactaaccaagcttctgtctcctcatttctaaaattaggaagtgaattagttctctgaggtctcttctggctccaacagcctatgaaaacagtgggaattcttacctgaatgctttcagagcttcgttcccacatatcccacaagatctaccgtaaagtaggataaaatcgtaactttttggagggtgagatggggtggggtttaaggaattatgccattcaagagtcagatgaaaagctgggcacagtggcacacacctgtagtcccagctactcgagaggttgaggcaacatagtgagatactgtctcttaaaaaaaataaaaaagagttaggtgaagtgtgctggcagggccttcctaatgtgttccggttccagtggttccctttctcagtgcaggccaggtgttcccatcccactctctctgccttcactattcccatctctaaaactggaaagattagagagggtcttcactttatatggttcactatatgtgtgtttaagggggcaatgaatgtatttttaaaaaatatttt

SEQ ID NO: 48884 - DNA, 1048 bp, Homo sapiens
ttttgtatttattgccatgatgtttgctgtctggcagtggtgtggggtgctgagtgatagctctttgcctggaggtattgtgtataatttgtcttacttcagcgccattgcagttaataaacatacagctttttgcttatgcttgatttttttttttcatgagctggttctgtcacttgtcctctttgagcagaggtgttttctcttcgaaagacttttacttcctacaattcagcaggtttccgtaggtttcagtaagcatgtatggccactggcacatgaggttattgatgtttctgagggataagagcaaaaactagaaacaaaatgcataagtaatataaaggtcctaatatgctctggaagtttcctccaaagaacttctgacagcacttttagtaagttatagactgtattgatgtaaagcttctctttcgtctgcccttgctgctttctcctgttttgtggaatgtagcatggagaaggaagttcccccaggggacaggaatgtcagcctctggaaaatggcgagttggactacataggatttaaaaaaaaatactacaatgattcatttagacatgtgagaagttattcttgggattagggtaagcagttggaatttatttgcttccattgcctgataccatctcattgtttgaggatgtaatttctggaatagttgatgtgtgataatgtgtttatatcaaaaaatagcacagatcttttaaaatactctataattctctttataccatagactttattgttaattacttaggttcagatttgtcacaaggttgtgaactctgcttggtgtgtatatatctaacttctgaagtaccagcgggaaaataaaaagtaaaccatctccttagtcacaaaggaattattctcgctagatgtgtgtttacactgaaggctctcaatgcttttgtcatagcaagtctatttgtaatccacgaaggatgtgagtgcagagcagtcaccattatgcattgattaagaaagatttagatattgataagtctatcttatgtgatgctat

SEQ ID NO: 48885 - DNA, 1053 bp, Homo sapiens
ctacttctgtccaaagcattctgtatattatcagaatgaaaaatgacagcactttgtcatctgttcaaattgatattgcactctttgcaatgacagctgaaaaggcccacaggtgccatataaagaggtgaccatgttgtcatatttcatttcggcatccctctgcaaagccataattacctaattaggttgttaattaggagattagcatttcactatattgatagaatgctctttaccggcgtggggtgagatacagatttgtctgctctaatttataatctctgcctgttttgtacttatttatttgcttaagatgctggtatggggcaattcagtttacctgagaaacagtttacaagcgaatgaagctttgatcactggattaaagttgctgagttaaaatacggacacatccccaaaattaaaataaaaattccaagttggtataacttgtattattgttaacacagtcaacaaacacaataagaattcacattgttggtataaaaaattcaaaatacaaaaacttaagtctgaactatgacagagatttatctatcctaaactaggcaaaataaattattttaattatcttcaatgacagacctctgtcatttatacttgggacttataagaatatgctaaatgttttgaatgtatttaagaaactgaagcttggttaataacttcagaacaaatatattgagtcttcagtttagacttccttagatagtcatgcatcagggcttatttcatttgtaccttctgtccattagtctgtgcttggaacattcccttcccacagtctttgcagtactgaggggcttatggaatttgaagtatttcacagtaaccttcacttggtgagctatttggagtaagcacggtttctataaagtgtgtctaacattcttttgggagagggggcggggaaaacgatttccatacattttctctgtagtgtttgtaatttgcattatgcatacttttctgcctttttttagttaaggaaattaggagtttcagaacaatgttaagagcaccattccc

SEQ ID NO: 48886 - DNA, 1031 bp, Homo sapiens
taagtgaaaaaaggatatgacactctataaagtatggtcccaattatgtcaaacatgtatgcaaagaaaagaaataggtggtgagattataagacttgatatttttctcagttttagaaatgttctttgataaacaaattatttaaaaataaatcatagtttaaaattgatattaacaaatatgagtagagtcagtgaccatcattttaaccaatagttttcactaatgcaggtgattgtgaagttgtaaatggattgtattttcaagttagttttcacctcttttattttgcacttagaacatggtttcatatgtcctgacataaatgatgttactattcccaggaaagccttcttttcccccaaaagtcctatttaagacagtattctggaagaagagttgtattcgtattggtggtatcattatcccggtgctaccatcacctcttcagtggccacagggacaacgagtaggcctgtgacagctccgtctttactttcagagggagtccactcctatctctgtggagttgaggttggcctttggtagatagagatagtgagttgaatgcttacgtatttgggaagtgattttttggtatggaaaattatgtgtgttaaggtaaactgaggcataagattttagagtttatttgcacaaacagcgattcatgaattgggcagcttcaaatcagaagtgattctggggctccattgagggaaagtaagcgggggaagcttttgtaggaagactgtggaagtaaaacaaaagatttgattgattagttatacagttgatcactaccattggaaagtcctcagttacataagtttgttggctgcttctgactagataagcttaaggttttttgttttttttttcatatatgcatttataagacatatctcaagttttgcctatgtttgcaaatcaaacaaggttaaggtcatttataaggcctaactagttttgtctgcttgaatttttcagaccaggtctgatttttttgttttgttgttgttgttgtttt

SEQ ID NO: 48887 - DNA, 1050 bp, Homo sapiens
cttatcctccaatttcccatagaggctgtgtttccagattcagggtttcatgttacacagagttattctttctggaatgtgtcccccaagcaaccccgctggaccctctgtggaaggaggggctcttctgaatgcaagattcgcatgtatgcaaaaaagcaaacatgccagccctgcgccttgctagtgtctgtccctgaaacagaaccagcaaccagcggacaaagcagtgcccaggagttgggccaggctgcaaacatcatcaacaacagtaatagtaataataataacctttattaataaagcctctgacctagaatgatctcatggaatcctagagtaaggctgggacgtagctgtcattacaattgtatgaataaagagacttgtgggtaggggggccttgtccaaggtcgctgagtggcagaaccaggcgggtggccgcagccctgacactgtcacctgtgggctgggcagcctcagaggggtggtgagtcaggcatattgttgagctctgtgggatctagacagccctgcaactgtccccagtgtgcagaaaagccagaaaattccatcttggcgtcctgacctccacctccgctccagctcacacaatctgcccagttgagttattctccctggaagagcttggtaatttgggcttttccaaactcaggaaaagcctccaagtctagaatcctccccgtggcctctccctggcctcatctcttcctccctccccttggctctccatgctacgctgagtgccgagcacattggcctgatttctgtttctcaagcagctcatactctgtcctgcctccaggctttgaatgggtcgttcccttcacctggaaagccctcttcactccctcttcctagcttattcctgttcatcctttctgtctcaatgtaaaggtcacctcctcctggaagccttcctttacctcccaggctagcttagagctacctcttacatgttctcagcaacccgtgattgtgattctccttcatggtgagatggggttgcatgtctttttcattcctcat

SEQ ID NO: 48888 - DNA, 1551 bp, Homo sapiens
ggctcacacctgtaatcccagcactgggaggctgaggcgggtggatcagttgagatcaggagttcgagaccagcctggccaacatggtgaaaccccatctccaccaaaaaatacaaaattagcctggtggtgctcgcctgtagacctggctactcagacggctgaggcaggagaatcactcgaacccaggaggtggaggttgtagcagtgagccaagattgtgccactgcactccagcctgggtaacagtgagactccgtctcaaaaaaaaaaaaaaaagtgccatgtagtccctgtgtggggcaggccccaatcagtgcatgtgggaggaagatgtcagcaataatgacctataatcaggagaccacatacaggtggcaggtactgggcagtttaactccctggcaatttaagcttgtcatttctctaaaacagtttctgccatgtcagatttgtgaaggcttggttttgccctcagccacccgccactgcacctgaccaggtctctgttggctggtgcaatccagtggtgagctgatagtaaaccccagcttaggaaacagggttgttcttcatgtggatgactctgtgccgaaagcatgggaacagcctagaaatgaaatgaaggacacatgatctgctttggcttcagactttaaaagagcttttgctgtttcctcttctgcagttaaacacagtgggaatatcacttttgatgagattgtcaacattgctcgacagatgcggcaccgatccttagccagagaactctctggtaagagcaggacaacatgtaaccgccataactgtagttgtgtttttcactgagtgataacattcttcttacttgaagggtgctcagtgagacccaagatggggtgcagttttctgggactgaaaggatggatcgtaaattggatgtgtttaatctgggcatcaaggacccatggaagctttgcattccgggttatggaactagatggaactctatattctatattaggggagcaggaacctcattccttccattgcctgctatgaaccccttcagtattccccagtatctgcagattgtgagggactgagccagcacctccaatgccaccatttctttacttaaaggaaccattaaagagatcctggggactgcccagtcagtgggctgtaatgttgatggccgccatcctcatgacatcatcgatgacatcaacagtggtgctgtggaatgcccagccgtaagtgacattttcattgttacagtaggggtgaaaggggggccacccagtgtattcacagagataagctgggaagttttggaaatggttactggtggggtgggataatccttttaaactttttactgattttttttttctttcccacagagttaagcacaaaggaaaacatttcaataaaggatcatttgacaactggtggattttctggtgtggcgtcttccttgagggagctagctcctttgtggggtggtcagtggggtcagggtggcagaacctgtggagaagtaacaagcaccttgtggtgggtaacaaa

SEQ ID NO: 48889 - DNA, 1044 bp, Homo sapiens
tccgggcgtttcgccccattggcctgggttagcgggcgacggggctctctccacgcctccccggtgtgagtttcggagctgcccacacccgagggaggagcgggtggcccgcctcgcgctctgtgctgtttcgagaagaggcagagggtggcgtgtccaaccccggaaagacgctgagagggctgtggctcggggctccctctgcacagacactaactcttcttttcccccagtatacctgaggtgcaccggaggtgaagtcggtgccacttctgccctggcccccaagatcggccccctgggtctggtacgttatcccctccaaggggcatttttttcacatttgtttcactttaagcgccggctcgtggagtcacgcctgtgccagaggtgccctcgtggcttggactgtcaccctcagtaggcctgagccactgaacaagtactaggtaccttaggaaggtcgtgtgtgaaaaatcgaacctggtgcctttaaattgtaattagctccatgtgtctccactgctgctttagtgtacctgaggggtgggcccaagggggagttttgaagttaggactggcttagagacattgggcagccaacatctgtatttcctcgtcaggaagtgggcatggcgttgttgggagattaaacggggtgtgggtgaagatccagtgagcgtttccagctgtgttgtagatgtaaacctagcagttaatgtggcaggctgtgtctcatgcctgctgagcaactgctggcttccccgtcattctgtcctcttggatttctctgaatttcattaggcctttatttaatccttgcacagtgctcccctgccccaaatgctcttccccattggtcttttttaacctgtatcttaactattcttccttggccgttagctggcacttaagggacacttagcctcctgttgaggctaaggattactagaggaggagaacttcagagtagcaaataatcagacctccatccaggaagatggacgtgggtggtctgacatgggagcctagtattttgaaagc

SEQ ID NO: 48890 - DNA, 1045 bp, Homo sapiens
tccaacccctgtgagttgttttgtggctattatttctataagcccagaacttgaagagaaaaatttttgttctggaggttcaagccttcttttcatctctgactcgtcacagatttttaccatgtgtcattttaaagtacatttacgttcagcaagtatagctttcccaggtcagtttattctgtcacccaggctggaatgtagtggtgcgatctcagctcaccacaacctccgcctcccggattcaaacaattctcctgcctcagcctcctgagtagctgggactacaggcacacgcgcgccaccatgcccggctaacttttgtgtatttagtagtgatggggtttcaccatgttggccaggctgatcttgaactcctgacctcgtgatccgctcaccttggcctcccaaagtcctgggattacaggcatgagccactgtgcccagactgtacgcctttctcttcccagccagatgggatcctttcaccagcttggtccccataacacatctgcagagctcagttttagcaattgtcagttgcccatgggacgttctttttattttattttatttcattttattttatttgagacagggtttcactctgtcgcccaggctgcagtgcaatggcacgaccttggctcactgcagtctctaccatcctcccacttcaaccccccaagtagctgggactacaggcatgtgccaccacgcccagcacatttttgtattttttgtagagacagggttttgccatgttgcccaggctggtctcaaatgcctgagctcaagcaatccacccaccttggcttcccaaagtgctaggattacagatgtgagcgactgtgcccagccattattattattattattttgagatggagtcttgatctgttgcccaggctggagtgcagtggcacaatctgggctcactgcaaccttgcctctcgggttcaagcaattctcctgcctcagcccctcaagtagctgggattacaggcacctgctaccatgcccagctaatttttgtatttttagtaga

SEQ ID NO: 48891 - DNA, 1065 bp, Homo sapiens
ttttaaatttttttattatatggagtctcgctctgtcgcccaggctggagtgcagtggtgcaatctcgactcactgaaacctccgccttccaccaaacttccaggttcaagtgattctcctgcctcagtctcctgagtagctggccttacaggcgcctgccaccatgccctgctgatttttgtatttttagtagagacaggatttcgccatgttggccacattgggcttgaactcctgacctcaggtgatccacctaccttggccttgaaaagttctgggagccaccatgcctggcccccctccatctttttactttttactgacctgggtgaatgaaccaatgtataccgatcatccctagagatcacattcagctgctccccgctatggcctcagtgcacattcgcctttgtgtcctgcgaatcgttctatgggggtagattcctagaggtgggagcatccaaggacaggacacccaccctccgaaatggctgtccccattcctggcgcccccagctctgagtgacatggcctgtttttgcatgtccccaccagtgtgacgacaggaaatggagtcttggttctgtttgcatttgtttgattctctgtctatggccattacccgctttcccatctggaggttcaccttttccaaggcagttggttttcacaggaaacgcggggctctggccagaaatgcagcgcagatgagcgcgaggagcctgtgcaaacaattccacatgcaggaatttggggctttgcagccactcctgcctaggggaaggatcgtgatgcatcagcatccctgaggacctcaagctcctgcttgtccttctcttccagaaaaaaccgggaagatcctgacggagttcctccagttctatgaagaccagtatggcgtggctctcttcaacagcatgcgccatgagattgagggcacggggctgccgcaggcccagctgctctggcgcaaggtgagaggtgctgggagggctcgggtatgttctgctacttctcgccatgtggcctcgggggagtgaccttacttttctgggcctcagttt

SEQ ID NO: 48892 - DNA, 1015 bp, Homo sapiens
ccttggcctcccaaagtgctgggattacaggcgtgagccaccgtgcccggtggtgctgttttttgttgttgttgttgttgttgtgttttttgagatggagtctcgctctgtagcccaggctggagtgcagtggcgcgatctcagctcactgcaacctccacttcctaggttcaagcgattctcctgcctcaaccttccgagcagttgggattataggcatgcgccaccatgcctagctaatttttgtatttttagtagagacggtgtttcaccatgttggccaggctggtctcaaactcctgaccttaggtgacctcccaaagtgctgggattataggcgtgagccaccgcacctggccaggttgctgttactcccatgttacagctgaggaaacagaggttcagagagaattgagccatgtgttgctgaaagtcctatagccagcaaagggtggagttaggatttgaactgagatctggttccaggaccttgacactgcactgttgaagggtccttcttgacctaggacgtgctgataaatctttgtggaatggattaactctttcatgcctgtccgaatcttggcctttctcgggtcttctgcttggcacacactcccttcccggtgtcctccctcccctagcagggactctttgtgtctcagctgctacctccctctgggaggcttccgtgaccctgcaggcttggtcagtcaccttcctgggctcctgtgacctcctgtgcttctcccagttggggctcctagtaattgtagtttttgttgacaatctgcctccctcattagggtactctctcctgagtacccagtggccaggattgctgaatgaatgagtgagagcaacataaaccctttcttggccatcgtgatgaagcctcagagcctcgcctgaacttggtgactcgcctgacatctgccattttggcttggcccgcgctggctgatggaggacatgggatctgggctgggtcctgtcctcagccctgccccagtgg

SEQ ID NO: 48893 - DNA, 1042 bp, Homo sapiens
cttaaaatacaaaaattagccaggcgtggtggtggtggacacctgtaatctcagctacttgggaggctgatgcaggagaattgcttgaacccaggaggcagaggttgcagtgagctgagatcacaccactatactccagcctgggtgacagagcaagactctgtctcaaaaaaaaaaaaaaaaaaaaaacgaatattccattacgcctcaatagtctatattttaacttactcagtcaaagccctattgccaggcagttaggctttttctatttttcttttttgtttgtttgtttttgagatggcatcttgctctgttgcccaggcttgagggcagtgtcaccatcatggccaattgcagcctcaatctcctgggctcaagcaatcctcccacctcaacctcccaagtagctgggactacaggcttgtgccaccatgcctggctaattttttaaaaaaattttcgtagagatggattctcactttgtcatccagactggtctgaaactcctggccttaagtgatcctcctgcctcagcctcccaaagtgctgcgattacaggcatgagccatggtgtccggctctattttttgttgttgtaaacagtgctgtgttggaaagcttaaatcaattaatgggattgagccattgattccgcatggtttgagagccatctctgctcagtgtcaggctgtgtgctgggactgggggtgctgggtggggaggcggccatggtcctcaacctcttggggacccctgtctggggaagacaggcccagcatggcacgccagcagaggtgggggtttagggcatctttgggagccagggagcagccataacccagacctggagagtcatgggaggcccagctgaggacacctgcagctggtgacctgagggtggggcaagccctgcacctgctgctggctgagctcatgggaggggacctctcaggtgagccacaaaggatacaggaggagagagtttcaggcagagggcaggtctgcagaggcccagagtagacagagcatgggcattgag

SEQ ID NO: 48894 - DNA, 1050 bp, Homo sapiens
cacttcgccgatatgcaaagaagaggaggcggttcctgctcgtctccgacgaggtgggcccgagcaggcctggggactacgactcccggcgtgctccgcagtccaaagccggaagagcgtggacccggaaccggatgtggcttgcggctcgggtggctgagcgcgcggggaaatggtgagattggcaccgtgtgccggagataggggcgtctgggggtggggtcccgggtctgctcaggagctggggcatgggcacttggaacggggattgctctcccgcccccactattgtacggacgacaacgcggaggcctagcattctctcccagcctagaaactgatccctagtcagccctctaccatctgttgaatgggaagcttagaccgtgatcgggccgcgacgccccgcttccattagtgcgccgaaatagagggtcacttcgtcagctgagacctcccttttctccaggccacggggacagaccaggtggtgggactcggcctcgtcgccgttagcctgatcatcttcacctactacaccgcctgggtgattctcttggtatgtcattctccccgtccgctgctcaccttccccgagccctggcaccgccagagcaactactatataggctctaggcacggcgctggcttcattgcctgcctcatctcttgaactctccagaacaactctatgaggaagatgccagtggtaccgcattttatagatgagatagctgaggctaggggagaaggatctggcccaagattgcatccttagccgctacacttataactctgtttccggcttgctttgacttttgggggagttctgttccttctgggttagcctgctgactcttaggcatggcaaacgccagtgatatttgtgaaggcctttaggatatttttttcttgtgggaaaacttgttggttattgcttaagaagtgcagtgtgtctggaagtgcagaacttggtatcctttagagaaaaaatattagtgaagaagccctggaggcccaggttgggagtcagtcgaggattcctcaagt

SEQ ID NO: 48895 - DNA, 1028 bp, Homo sapiens
caacccctgtgggggtgtcccatcactttccccagcacccacttcccacaggccttccctcctcccctgcctgctgacccggcagctcccgacagcacggccttgtttcccagggaacaatgcatctgtgtcacggacaacaatgtcctttcatgtcaggcgcactggccccggtgcacgccgggacgtggcacaaagggtgctttgtgcagctcagggatgtgagttcctggctttgccatgttggtgctgccgacccggggcctctgtccttgggtcccagttatgcaacagtcagtcgaggctgtggggctggcccaggggctttatctgtctccctctccaacttttgccaagttacccttctgggcttccgccagccaggagcccacactccctcagccctcccacacgctcctctcacctcctagctgggcttcgctgacttgaacctggccgagtttgcgggctcgggctccacggtgcgctgctgcctgctcgagggatatgacacgaagaacactcgccaggacaactccatccttaaggtaccagggatcctgccacctctgccaccctgaccacgggatggggacaaaccaggctgctcatcagaatcctctggaggagggttgttaaaaatacaggccttacctgaataggtagacatcgggaaggggcgagccctggaatcaggaaaccactatcagagggaggcctggctccgctgttggcctcagtttccccatcaagttcagagagggggccctgacagtctccagggtttggcaagcacctgcagtgggttcacgtcatgctgattgcatgccctctcttctcttgtggtcccctgacagcagccccacgagctgtggtatctttgattagtcccagcttcaaatgggagggagttaaggcacagacgttaagtcatttgcctgaagtcacagacagagctggcacctgaccaccagccagttgacttcttggcccagctcctaactcttccccaagtgacacgtggtagc

SEQ ID NO: 48896 - DNA, 1034 bp, Homo sapiens
aggcacccagcacatggcaggcactgccaggccccttcccttctgttctgtaattgaactcccactgcaggctttactcccattatacagaggaggaaactgaggccctgagaagtggctggacgtggtgctgatcaggcctagtttcagtcctgtctctgttgggttagctgtttggccctgggcaagcttcttcccctccctgaacttagttttcttttcttttctttttttttttttttttgagatggagtctcgctgtcgcccaggctggagtgcagtggcgcgatctcggctcactacaagctccgcctcccgggttcacgccattctcctgcctcagcctcctgagtagctgggactacaggtgcccgccacctcgcccggctaattttttttgtatttttagtagagacggggtttcaccgtgttcgccaggatggtctcgatctcctgacctcgtgatccgcctgccttggcctcccaaagtgctgggattacaggcgtgccaccgcgcccggcctctgtgaacttagttttctcatctataaaatggggatcactctgagtccatggcggggctaggatctgaatccaattccctgattctggagtgtgtgccctgaacactgcagtagagacttgcaggcagcagttacttgacactcatccctgattggttcggttgggttcaaacattggttcaaacatttcattatctatctcttctgagcctgttgtatctggagcagagctgggcaggaggtggtaagcagaggctctggggcctcctagaccctttgcagagggaaccggagatgtcttccaagtccccaagtctggcaccacctcgtctcaatctcactttcccctccaggtctagcagacttggcctccatccacagggccttcttagcgcatgccctcttcgcacttactcccacttccctccccatccctcgatcctctgtccagaggtcccaagggcctgttcagaccctgaactctgcccagcagcccctcactctgtcctc

SEQ ID NO: 48897 - DNA, 1044 bp, Homo sapiens
ccggggctgtccgcggagacgcctatgcggtggaggctccgggcttcagctagggcgggggagcccagcagaaggaccgagcagcctggcaccccactttgccatcctctccctggaaatctcggggtcggcgggccggccgcttcgcgtgggcgaaatcagagacacgtggtttccaaggccccttcgggttcgggaaaattttatggttcgggtcacagtaggaagcggacaatgaggcgggagggcagagagaaccgcaacacctggtgccgggtcgggtcgtttccggggctttcagtggccggaagtcgcggcgcctgtactgactctaggaagggctggagttgttttgaatgggcgcccgtaagagaggtgggcaagtacgtgttacagacggccacgccgccctttaggcggtcaaggtggggcgaggagacgttcgcccccctgcagtcggccgggtcactacccaagagcctttggaggcggaagcatggaacggtctgcaaacgttcccgagcgggcctctgcggctctggcgggcgtttcgaacttgggcgccgggcacacgcccagtcccgagagcgctgagggttcccttagcgtcgccctcaccccggccaacccgcggggcgccagagtcctggccctttaaacgccgcgcgtgcctcggcgtcttcgtttcgcgcgcccgcccgcggcgccggcggagcgaacatggacccggctgcgcgggtggtgcgggcgctgtggcctggtgggtgcgccttggcctggaggctgggaggccgcccccagccgctgctacccacgcagagccgggctggcttcgcgggggcggcgggcggcccgagccccgtggctgcagctcgtaaggggagcccgcggctgctgggagctgcggcgctggccctggggggagccctggggctgtaccacacggcgcggtggcacctgcgcgcccaggacctccacgcagagcgctcagccgcgcaggtaaggcctggcccggccggggatggggatgctgatcagcgccga

SEQ ID NO: 48898 - DNA, 1060 bp, Homo sapiens
caggtgcagccaaagctgcagaagcaggcgcaaacacagacctctccagagcacttagtgctgcaacagaagcaggtgcagccacagctgcagcaggaggcagagccacagaagcaggtgcagccacaggtacagccacaggcacattcacagggcccaaggcaggtgcagctgcagcaggaggcagagccgctgaagcaggtgcagccacaggtgcagccccaggcacattcacagcccccaaggcaggtgcagctgcagctgcagaagcaggtccagacacagacatatccacaggtccacacacaggcacagccaagcgtccagccacaggagcatcctccagcgcaggtgtcagtacagccaccagagcagacccatgagcagcctcacacccagccgcaggtgtcgttgctggctccagagcaaacaccagttgtggttcatgtctgcgggctggagatgccacctgatgcagtagaagctggtggaggtaagtgagcactggctcccagctggtctggtgatgggacagctctgcccagacccttcattcctcccctgactgggtgctgcctgggactgagggctaggcctggaacccaggtccagggccatccatgctgggggcctcaaggttctggctgcggacggagaaggcagctcttgggcctggggactctgggaaatacagcacatctgtcatttcaggcatggaaaagaccttgccagagcctgtgggcacccaagtcagcatggaagagattcagaatgagtcggcctgtggcctagatgtgggagaatgtgaaaacagagcgagagagatgccaggggtgggtagaggccctgatgtggcagtgtgagggccacagagcccagcagggtgggatggcctctttctgccccaggccacctcagggcctccttgtgtttcccccaccgtgaaatgggatgacagccctctgcctaggatgggtggccagaccaggctgggcttgatagtggtgtgcatgggaccctcttgctgttgtgctgtcttcacatccgtcccttccagcct

SEQ ID NO: 48899 - DNA, 1065 bp, Homo sapiens
ctgcgaaatgggaggagcacagccagaggtggtcatgggtctgggctttgtggcggtgggggcagagggagatggtagcctgtccagccaccagcccctctccagggccctttcttgctgtgctttgggcaggtgcacacattgagagaggagaaggaatgtagcatgagtcgggtacaggagctggagacgagcttggctgaactgaggaaccagatgggtaagctggggctggggtgacctgggagcaggaatggtgtcagagggttgtgggggtggtttagaatgccccagggagttgggtggatggaatggctttgaggcagagggaaagaggtctgtgccaggagatggcaagtctcgtcatctccatgagcctcagtgccccatcagcaaagacgaaggagtgcccgttgtcagccacccacagttgtcgctatcggaaagtggtttggaagattggctaacatccgggtgcgaggaatcatcagcagggaggccaagtttggggagcttgagaggaggtatggaccaagaggagggtttttttgagaatccagaggcttttattgtctgcgtcctttctcagctgaacccccgcccccagagcccccagcagggccctccgaggtggagcagcagctacaagcggaggctgagcacctgcggaaggagctggagggtctggcaggacagcttcaagcccaggtgcaagacaatgagggcttgagtcgcctgaaccgggagcaggaggagaggctgctggagctggagcgggcggccgagctctggggggagcaggcggaggcgcgcaggcaaatcctggagaccatgcagaacgaccgcactaccatcagccgcgcactctcccagaaccgggagctcaaggagcagctggctgagctgcagagcggatttgtaaagctggtgcgctgccccacctggagagcccgccctcctccctagccctccagacctttgttttcccacctgtaaagtggggcagtgtagccctcacttgaaatggtacttctggaggcatctgtgagccagagccctgctccg

SEQ ID NO: 48900 - DNA, 1049 bp, Homo sapiens
aaaatgtaccaaatgtgtaagcatcatgaggtgtttaagctgagcttttaaattaaaattctgctgggtgtggcggctcatgcctgtaatcccagcactttgcgatccccacacaggaggattgcttgagcccagaagtttgagaccagcctgggcaacacaaggagaccctgtctctacaaaaaacaaacaaacaaacaaaaaagccgggggtgttggtgtgtgcctgtagtcccagctactagggaggctgagatgggaggatcgcttgaacctagcaagtcaaggcggcagtaaatggagatctgtactccagcctgggcaacagagcgagaccctatgtcagaaaaaaagaaaaagccacccagcaggctgagcgtggtggctcacgcctgtaatccctgcactttgggaagccaaagcaggtgaatcacttgaggtcaggagttcgagaccagcctggccaatatggtgaaaccctgtctctaccaaaaatacaaaaattagccgggcatggtggcgcttgtctgtagtccagctacagctactccagatctgggctgaggtgggagaatcatttgaacccaggaggtggaggttgcagtgagctgaaatcacacgactgtactctagcctgggtgacagggtgagaccctatctcaaaacaaacaaacaaaaaccccaccagcaaccttgctgacaaatccacaggcccccacgtctgccaattgcctgcctgtatgaactgggcacctgggggaggggcgtggcccccaggctactcatcttggctttcacagccaaagggcctgggtggaacctcagcttactgtgtttactgactgggtaatgtggcctctgaagctgtcacctatctataaaatggggattaaaacgacactcacttgctcattgtctttcatcccacccacgtgtgttaatcgcgtgctcctgtaggccagccactgctctgggtgctgggacttggtactcaaggacagatgaggctctaggtctcacagagattatgacgtagggggatcaggcaa

SEQ ID NO: 48901 - DNA, 1044 bp, Homo sapiens
acagattcagaggagggggagtttttacaagcagggatgagcaagggcctgatctgggccatggaatctcattctatttagaggcgtggagagaagcctacagggcatgctagaaggggctcggggtgataaattgccgagttaggttggagaggagaaacatggaggcctggggtggccacagggtggctgtcagcggtcagtacctttggaggctgccagtgctggttgtcatggaaaccagccagcagtcttgtaggaagcctgctgactgggagccaggtaccatgtcctgctgaatccaggcagcagtactgtgagactggccctgttactgtccccaggtgacaggagagcttgaatacaaagagagcaagagctgctgaaggccacatgacagagctggtgcccttcctcctggggctgtggagcagctgggcaggggctgggcacatgagcttcctgagggagacctgaggaccccccacccccagcttctggggcaggggctactagggcttagaatggggtcactgacggatctttacctccctgtccttgaaggattacacagtgcgtggcctcctgggcaaagctacagatgacttccgtgaggacgggaggctggtagagaagacaacctatggtgagaaccggaagtggctgccgctgcctccctccgcatttgctttccctgagtcctctccccgccctaggccacgctggccccttctcagttccactgcacacactaggcttgggctgaggctttggccacgggatctgtgctccaggagcatcctctactcccctgcttgcctagctcaaatgtaacgtcacttccaaagactctagtttctctccatctcgtcagtctttgaccttttccttttcttttctttttttttttttttttttgagacggagtctcgctctgtcgcccaggctggagtgcagtggcacgatctcagctcgctgcaagcaccacctcccgggttcacgccattctcctgcctcagcctccctagtagctgggactacagg

SEQ ID NO: 48902 - DNA, 1049 bp, Homo sapiens
tgagcagctagtgagttgacacacccaggttctgccttaaggagctcacagcctccattttcctccagggactcttcctcagtagagctgggcagggaaccccgcactcttgaccttcagtgttacgccagtcttcttagagcctctcactgggagactgatgataggcagagtaagaggcatcttgggctgccctttggatcccagggcactgaggatacagttcagggtcccagattccatgacggggaagcctgagagtctggcctgatgctagtttgggctccatgaggcccattctgagaacgaggtcaacatgcagcccaaagccatcctggggtggcatttagttgagaaaatggaccttgtttgtttctttccagtatgtggaccagcattcgcccatctcaaggttggcgtgggacatcggttggatgcccaggcttctggagtacttggtaggtgatgtgagaagcctgggggtacagtgataaggcttgagaaaagatcctgaagctaccaggagcccagcccacttcttacctggcacccacgtcccaccactcctctcctgccctgattcctgccccaaggctgatcagctggggagtggataggtgggacggaggtaatcacaggttaataccacagtcacccacctttattcagtgattcccacacatgacatagttcgaggccctttatgcacatttatttaccacaacaactttattaggtagatactatatgattttatggaagaagaaagtaggatttaggtgacttgttctgggtcccatggccagtgaatacccctggtccggagaaggaaaaccatcattgcatcatggggcagccaggcgcgtgactctggacctaatggccagggcctgcatgtggctgggtctggacacacaaagccctagtcatgagccatctgtgtccccagggtcaggtggtgcccacatcctccagccgcgacagtcacagtccccttgtcttgcttcctgaggcacaggcaggcagacatgatctcatgccccctctcc

SEQ ID NO: 48903 - DNA, 1034 bp, Homo sapiens
agaggcctggctgcagcctgtctcagctttcaacatgccctcctcactaagcttaatcatgtctagcttttgaattaagagacctgcaactcttcctttcccttgaacatttagaggcccctgtagggatattaattggcttacctttttttttttttttttttttttttttgagatggagtctcactttgttgcccaggccagagtgcagtggtacgatctcggctcattgcaacctctgctttttgggttcaagtgattctcctgcctcagcctcccaagtagttgggactacaggcgcccgccaccatgcctgggtaattttttttttttttttgagacagagtttcactcttgttgcccaggcttggttcaagtgattctcctgcctcagcctcctgagtagctggggttacaggtgcacaccaccatgcccagctaatttatgtatttttagtagagatggagttttgctgtgttggccaggctggtctcgaactcctgacctcaggcgatccgcccgccttggcctcccaaagtggtgggattactggcatgagccactatgcccggccaatttttgtatttttttttttttttagtagagatggggtttcaccacattggtcaggctggtcttgaactcctgagctcaggtgatctgcccgcctcggcctcccaaagtgctgggattacaggcatgagccactgcgcctggcctaattggcttactttcaatattgtcttgtctcggaatagggaggcccaaggagagagagagagacaggcaacagctggtcagtggagccgtcaaatcacacgcaacatttatcgatgaagttcaccatctcatgtaggcacaatttgtggtgctgcaaaacaattactgtagtaacgtaaaagatcactgatcacaaatcagtgtagcagatataataagaatgaataaatttgaaatagtgtgagaattgccaaaatgtggcagaggcatcaactaagcgcatgctgtagggaaaatggcccgataggcttgt

SEQ ID NO: 48904 - DNA, 1052 bp, Homo sapiens
tgcagatcaactgaggtcgactgggagttgaagaccagcctgaccgacatggagaaaccctgtctctactaaaaatacaaaattagccgggcgtggtggcatatatatatatatatatatatggtctttggcctgacttgacttttcttgccacgtccctatctgtttagagggacagtgtcctggaccttaattttcgatctgagtttgagggtgcagatcctttttatcagtggcttggccctggactagtaacgcagtctctcttctgtgaagtgcgattgttaggatacttcttatggggttgaatgggactgttgaccagaaagccaagtgaaagccagtgctgttcacgtggagtttctgagtgtcagtgactggccctgctgtctcagctgaggggggcctcctcattcctcttctcaaaggtagtcaacactggaatgccctggaaagtgttgaaaaatgtggactcctgggttctacttgcagttactgtggcttactttggatgtggtatgacctggggatctggtttcataatatctccctaaatgattctaatgcttagcaaagtttgagaaccactagaaccactagtttaatccagctgctttccagtagttttttaaaaaatttttcatttatttatttatattttagagtctcgctctgccacccaggctggagtgcaatggcgcgatctcagctcactgcaacctctgtctcccgggttcaagcgattctcctgcctcagcctccttagtagctgagactacaggcacgcaccaccatgcccagctaatttttgtatttttagtagagatggggtttcaccatgttggttaggctggtcttgaactcctgacctcatgatccgcccacctcagcctcccaaagtgctgggattacaggtgtgagccactgcacctggcccagtttttttttttttttttttttgagatggagtctcactgtcttgcccaggctggagtgcagtggtgcagtcttggctcactgcaatctctgccccctgagttccagcagttctc

SEQ ID NO: 48905 - DNA, 1034 bp, Homo sapiens
cctttccgctctttgcggggacccactcctgtccgcaaatgcccccctcccaaccactcgctccggaacaggacaccacctctccctcctcaggagcagatagacatggcctcggtcctccgggcccacgcgcacctactgccagctctggcaggaaacccagccccctccgcattctagaacccgctatgtacccaaaggttcccgccctggggcgggggaggccgctcccctctcatctacgctcccctcgtgcctcctgtgctccgggaaggactcctgccactgccaagcgcgcacagactgcgccccccgctgcgcgcacattctaacccccccaggcccctgtgccccgcctttctatcccggctaattcccgtcggccttggagccccaccgaggagaaccgacttaaggacactctggggaccaccctggtggcgcacactgcggactcagccgtcctcgctcacgggctggttggggttcagtctccgggtcagccgcggactgatttggagactgtgcaaggtccaggaaccaccgaacccggagatcaggtctgctctgcgagggcgtcgcggggccggggccagggcaggggcagggaaggggcgcgggtgaggggaggatcgggggaagcggccgcggttcggggctccggggcgatgacagaggctttctcgcaccccccgggcccgcgcgcccctcccacgccgttcacctgccgcggcgccccctcctccatggcgccgctccggccgcttggggcccttctctcagccactccggtcccggaagccgcagaccctccgccaggactttcaaacttgaaacttcccgggaagcggcgccggagacgcgggatcgggcgccccctcccgagacccgctggcccgcgggaccagcgccgcctcccgtccgcgccgatccagcgcccgggaccccacgcccgaggtcccgcgccccagcgcctccctcggatccaaaattccgcgggattctgggcccagtacccgggcttcggcgcctgc

SEQ ID NO: 48906 - DNA, 1049 bp, Homo sapiens
aacctggaaggcagaggttgcagtgagccaagaactcgccactgcactccagcctgggcaacagagtgatactccatctcaaaaaaaaaagaagaagaagaaaacaagaatcgttcataatctcactccctgaaagagaactcctgttgacattttggtgtgtctccttccagcagtgtttctatgcacagatttcattactttaagtcaagctggcatcaattcctactgttttgtgactgactggccaatcaccaggcatggatctccctcgtcattttaggacggagtcactttctttgtgccatcctgtacagatggacatttcagttgaaaacccatactgggaggaacaggctgacattggtagcgttgccagtgtgccaagtactatagttcttggggagaaaggaagcggaatcgctggcccaggagttttgcacacacgtgtttcaggcttttggaccatgactccaggctggcccacagaaggccctcgtcagaagagcagtcacaggccggatgcggtggctcacacctagaatcccagccactttgggaggccaaggcaggaagatcacttgagctcaggagtttgaaaccagcctgggcaatatagtgagccctcacctctacaaaaaaaaaaattttttttttgagacggagtctcgcactgtcacccaggctggagtgcaatggtgtgatcttggctcactgcaacccccgtctcccaggttcaagcgattctcctgtctcagcctcccgagtagctgggattacaggtgcacgttaccatgctcaactaattttttgtactttagtggagacggggtttcactgtgttgcccaggttggtctcaaactcctgagctcaggcaatccacccccctcagcctcccaaagtgctaggattacaggtgtgagccattgcacctggccaaaaaaaatttttttttaattagccaggcatggtggctcacacctatagtcccagctcctcaggaggctgaggtgggaggaacacttgcatggcctggaaggtcaaggct

SEQ ID NO: 48907 - DNA, 1128 bp, Homo sapiens
ttaatagagacaagatttcaccatgttggccaggctggtctggaactcctcctagcctcaagtgacctgcccacctgccccttctctacaaaaaaatttttttaggccggcgcagtggctcatgcctataatcccagcactttgggaggccaaggtgggtggatcacctgaggtcaggaattcaagaccagcctggccaacatggtgaaacccggtctctacttaaaatacaaaaattagctgagtgtgccggtgggcacctgtaatcccagctactcaggaggctgaggcaggagaatctcttgaacccaggaggcagaggttgcagtgagccgagatggtaccattgcactccaacctgggtgacgagagtgaaactctgtctcaaaaaaaaaaaatttttttttaattagctgggtgtggtgctatgcgtctgtagccccagctactcggaggccgaggtgggatgattgcttgagcctgggaagtggaggctgcagtcagtgaactaagattctaccactgcactctagcctgggcaacagaggagaccctgtcttaaaaaaaaaaaaaaaaaaaaggaaaagaagagagaaaaagaagactagttggagactcccaaatgaattaataaatctgtcacagaaatggaaatcaaaataagaggaagtcacatttcatctcaagagcttggtgatacccagtgttgcaaagatagggaagagcaccctcacaccctgtctactggtaagggatgaatcgtgcaacctttgtgaagggcaaccagcagaacctgccaaaattctaaatgcatctatcttttgacctagccattctgcaattagaactgttcttagaggaaaaagatatatcctcacttgtaaaatttttttgaaaaaggccgggcacagtggctcatgcctgtaatcctcacactttgggaggctgaggcagatggatcacttgaggcaaggagttctggaccatcctggccaacatggcgaaactccatctctaccaaaaatacaaaaattagccgggcgtggtggtgtgtgcctgtaatcccagctactagggaggctgaggcaggaggattgcttgaacccagaaggtagaggttgcagtgaa

SEQ ID NO: 48908 - DNA, 1037 bp, Homo sapiens
ggctcacatctgtaatcccagcactttgggaggcagagatgggcggatcacctgaggtaaggagttcgagaccagcctgagcaacatgatgaaaccccatctctaccaaaaaaaaaaaaaaaaaaattagctgggtgtggtggcaggcacctgtaatcccagttactccagaggctgaggcaggagaaccgcttgaacctgagaggcggaggttgcagtgagctgagatcgtgccactgcaccccagcctagatgacagggttagactccgtctcaaaagaaaaaaaaaaacaatattcactggctgggcgcggtggcccatgcctgtaatcccagctactcgggaggctgaggcaggagaatgacttgaacccgggaggtggaggttgcagtgagccgagatcgcgccactgcactccagcctggtgacagagcaagactcagtctaaaaaaaaaaaaaaaaattcacttgaaaaagtacacacatcatgatacacaggtcggtgaagattcacacagtaagcgagcctggatacccagtactctgatcaaggagactagaagctcctcagcacccagaaactcccttccaatcacctccccgggtaaccacagtcctcacttctcccaccacagatgagattcccctgattttgaacttagtggagtgacacagtgtagatccttttgtgtctgactcctctcattaaatgcagtaagggttggccaggtgcagcggctcatgcctgtaatcccagcactttgggaggcgggggtaagcagattgcttgagcacaagagtttgagaccagcctgaataacatagcaagatcttgtctctacaaaacaaaaaacaaaaaacaaagaaaccagaaagattagccgggtgtggtgatgcatgcctgtagtctcaggtactcaggaggctaaggtgggaggatcgcttgagcctgggaaatagagggtgcagtgagccaagatcacaccactgcactccagcccaggtaatgagattctatctcaaaaattaaaaatta

SEQ ID NO: 48909 - DNA, 1031 bp, Homo sapiens
gccacctcttccaggcagccttccctgatctgtcctctaacttctgtcaacctgcaggaccacgccctcactgtgagacttctgtagcctgcctggctcctccttgaggctggaactctctccagggtggttaactctttccctctgttttccttatgcccaacactgggtcaggcagagtgggcgacaataaacgctgctaggagaatcgagccttctgaatattcacattcgtctgaggggagacttaacgactgtccatctctccccacagaggtgagcaacaagtgggcaaggaccatgacaggtgatatcccagcaccagcacaggtgccaggacaccggacgggggctccccctcagcagagtctcctcccttccaccaggccctaggaggcacctgctaatgaaatttgatcagtgccccaaccaccgccttggccagcctatgccgagcccttaccatggaccaggccctggggaagcatgtgacatcaaccaagaggtcacaggttttgcagagggggacacaggtcatttgcccacagcaccaaggaactaggtgatgaggcctggactccatcccgagcctgtggattccagagtgagctgctcagcctggacctgttgcctctcagccccagccctctgcaggccagaaaaaccacggagcacacccagaggtgctcagttgcttccacctgagaggcagggctgcacaggagcaagagtggaggccctgggtcaggcagatctagattcaaactcccgagaagggtggagggaagtgctccaagcagagcagagactgaaggcgggagagcctggtgcaccgcggacctgcagggggaaggcatgagagctcggtgcactggggacctgcatggggaaggcgggagagctcggtgcactggggacctgcatggggaaggcgtgagagctcggtgcactggggacctgcatggggaaggcgggagagctcggtgcacctcggacctgcagagggaaggtgggagagcttggtgcaccgc

SEQ ID NO: 48910 - DNA, 1033 bp, Homo sapiens
cttgacctctccaggatcaagtgattctcccactttagcttccccagtagctgggactacaggtgtgcaccatcacacctggtcaatttttgtatttttgtagagacggtgtttcagtatgttgcccaggctggtctcaaactcctgggctcaagagatcctcctgctttggcctcccaaagtgctgagtttacaggtgtgagacacattgccctgcttgaatttgttgattgcatctccatggtgttatttaacatgttcttctgtccctgtattttagtcattcaacagtgtgatctaatttagggccacttttacagcaggaataatttgcaggtggtgtatgtgtttccagagtcagaacatgtttggtttatgctcttggtgatattcagggctatcagtgatcctctcctggatcattttttaattagaggtgatttgtgttttgaaagggtcacttgggttgctggggggtgtattgtatatgagtaacagggttcttataaggacggagtcggataatcatgcaacagagcacttggtgctattcctggcacgcaatgaccatattgttgttgttgttgttgttgttgttgttgttattgttagagctgtgtgtgggggacccaagtcctgagctcggaggcattttctggccagggctgtttcctcccttctcccctgcctctggaaaagtctgcagtgccccaaggctctgggaggcatgttcaggactgcagcagccatctctgtgcacctggtggggccccttcagggaaggaaggctggagccccactcacttggttcttgcaccagactgtaagtgccctaaccccaatactctgccacctgcatggcctggggcttctggggtctggctcgttcctggcttcaaagctgtgcatgagccttctctttcagggagccctctttaactgcagcctgtatgtgggcttctcccttgcccctgcttctctagtctagaacttgtagctctgcatctgaatagtcagcttgggcgctgtaggg

SEQ ID NO: 48911 - DNA, 1022 bp, Homo sapiens
ttgcccaggctggtctcgaactcctgggctcaagggatcctcctgccttggcctctcttgcaggcataagccactgtacctgaccacttagcctcttgaaggaatctttcttataggattaaaagtgatgggaagccaggagcagtgactcacacctctaatcccagcactttgggaggcctaggcaggcggatcacttgaggtcaggagttctagaccagcctggtcaacatggtgaaaccctgtctctactaaaaatacaaagattagctggacatggtggtgcacaactgtagtcccagctactcgggaggctgaggcacaagaatcacttgaacatgggaggcggaggttgcagagagctgagatcgcgctgctgcacttcagcctgggcgacagagcacgactttgtcccccaaaaaataagtaaataaataataaaagtgatgggacctgatttcaagtagtcaaaatcgcagagacagcaaatgggctgggctatgggccagagggtaaagggatgtaattgtttaatgggtacagagttgtcagttttacaagatgaaaacagttcccaaaactgtatacctgtacatagttaagatggtaaagtttatgatatgtgtattttaccaaaattttttaaatgaaaaactttttttttttttttttttttgagacagagtctcgctctgtcgcccaggctggagtgcaatggcgcaatctcggctcactacaatcttcgcctcccgggttcacaacattctcctgcctcagccttccaagcagctgggactataggcacccgccaccatgcctggctaatttttttttcgtatttttagtagagacggggtttcactgtgttagccaggacagtctcgatctcctgacattgtgatccacctgcctcggcctcccaaagtgctgggattacaggtgtgagccaccgcgcccggcctgaaaaacatttttaagtggtgggacgtgtagggctccacggggcacctagcacaggaaag

SEQ ID NO: 48912 - DNA, 1607 bp, Homo sapiens
ggctatctgcctatctgttgtgtgttcctttaatgtatgggagtgagattgtggtttttgaatctgggtcctgtgccaggaggaataagtggtgagatacctactgtttgtgtcactcaggtcttccaccaacccctccagcctgtaaacctgccgtctggactccagaagtcatttctctctcctctgccaattcctaagcccagggggactgtgtctgagtgacgcaattgttagatctcctcagacaggctgttctctccaggaaaacattggctcaacaaattgtcaccaaacatttgtcttcagggaattctgttttttttctatcaaaaaaaatttggattcattatataataagagatttttcattttgcttggttactaattttatggaaagcctggtaggtttaaatgttaatagcttgttgactgggtgtggtggttcatgcctataatcccagtaatttggaaggctgaggtgggactatcgcttgagctcaggagttcgagaccaacctgggcaacgtggtaaaaccccatctctatcaaaaatacaaaaattagctgggtgtggtggcacgtgcctgtggtcccagctactctggaggctgaggtacaagaatcgcttgaaactgggaggcagaggttgcagtgagccgagattgtgccactgcactccagcctgggcgatagagcaagactgtctcaaaaaaaaaaaaaagttaatagcttgttgtcattgacaagtggctgtgagccaggacccacagtatattctctgtggattcttgtcaccttcattgtacagatgaggaagctgagcccccaagaggctgcggcctggcatgaccaaggtcccatagctagtttatggtggagctgggactatttgatccaagtccaaggtttggtcttctgtggttattcatgcactagactggtcttcctgggcatggtatccccagttctgtaccctttctctagaggtgccacgatgtgtgttgtctcagtaactgggagtctcctggcattttaagcccagggatgctaaacatccttcaaggctccagatagctctccccagtgaagaactgactcatctcaaattctaagtgtgcccctattgagaagctccaaaaccgaatgtcataattgacttgagtgatgtgacgtggggccaccctgggaaggcatggtcacctcgcctgcccttgtaagcagccatgcaaggtgaagttggacaagacatggctcctgtccccaaggggctggtggtctcctgtcagccctagcacccgcctgagaggagatttcacgggacagaatttggactttggaaataggcaaaccagggtttgaatcacagctggagctctctaggctgagtgagttttccttgttctccttttgagcaaaatagagtaaataataccatcctaatcagctgtgatgaggattagagaatttagcatggggttgggggagagggtcaggcacaggtaggtgctttctgagttcagcaaagggcctgggtggacacagaagcttcagagaggaggtacaggtggggctaggccctgctagggattttggattggagggta

SEQ ID NO: 48913 - DNA, 1062 bp, Homo sapiens
agccattaagacgaacaatgtttaatatgcactaatgtagggtgacttctaagataccttaggttaaaaaaggaaacaacagtaaaaacagcgttgggccggttgcggtggctcacgtctgtaatcccagcactttgggaggccgaggcgggcggatcacgaggtcaggagatcgagaccatcctggctaacttggtgaaacctcatctctactaaaaatacaaaaaaatcagccgggcgtggtggtgggcgcctgtagtcccagctactctggaggctgaggcaggagaatggcatgaactcgggaggtggagcttgcagtgagccgagatcgcgccgctgcactccagcctgggcgacagagcgagactccgtctaaaaaaagaaaaaacagcgttgatgggtgctatccatctttgcgtagaaggacgcctgagggtgggcgtatctgcgggtgtgcgcgccagctgtctgataagatgcacaagaagttgttaattgcggttgtctccgacagaattggggtcttgggtacctgggccagggcgagaaatttactaccatgtgcacagatagataattaaaaataagatgatgaagatagtcgtggctcccatccatcacgtgttaagccaatgcctagtttcacttctgttgggaggtcttatttttcccttttaatagaagagaaaagaaccttagagaggttaggaaacttagcaatatcatagccagggccgggcgcggtggttcacacctgtaatcccagcactttgggaggctgaggcgggcggatcacgaggtcagtagatcgagaccatcctggctaacacggtgaaaccccgtctctactaaaaatacaaaaaaattagccgggtgtggtggcgagcgcctgtggtcccagctactcgggaggctgaggcaggagaatggcatgaacctgggaggcagagcttgcagtgagctgagattgggccactgcacttcagcctgggcaacagagcaagactccgtctaaaaaaaaaaaaaaatcatagccaggaagtggagaagctggaattt

SEQ ID NO: 48914 - DNA, 1050 bp, Homo sapiens
gggagatgtgagtatacctgtcccacgcgctgtgctgcttccggtctgcccatcttgcccgtggacccacggtgccatggccagcccacgtccttggggcattttgcaagcagctggtctccccgccagagcctctactgtgcagggcctctggtttagggggggatgccaggcgttggggcctgtgagtcagctttttgcaaatgttggacgcctgtcactctgtctgcccatgcatccatctgtccaccttcattgtcgggaggggcctggcccttgatgcaggagcaagagatgtggtgtgcggattctgggatggaaaaagccatcccagttgggggtgggctgtgtttgcgggaccctggggcatctgagtgccactggtctggggaggagggggctgtggcccctggcaggggagagcccagcctgtgacttgctcaggcagcctcggccatctcctcaccgcatttgctctcctgagctccagtgcctgcagccacttgatctttgtctggactctccaagtccctaggcccctcatctccaggtggttggagtcgggagaagggggtttgtgttgtgtttgtatccccgtccctggggtcaggcctcttggcatctccttgtgcaagactctggggtagcctcctgacctcgaccctggccctggcccagggtgaccccctccccacatgaactctgttccccgccagacggtgcctgactttcaggagactagacctcgtaattacattctctcggccagcgcctccgcggtaagcgcaccccacccccaccccacccctcgtcctcctctctccccacgtcccacaccactgcctctgactgcacaggagctagaagccagcttgggtaaggcgggggcactgccatgtgatcaggtcagtcctgagacactggggaggggcagcagcccccacctctgtccacggcctggccccggtgccctgtggccatggagctggacttgtttccctctgcaaaacgctggagctggcggcagggccagccacactgagtagtgtg

SEQ ID NO: 48915 - DNA, 1045 bp, Homo sapiens
gcagaagccaaagccacggtaggtgtccccgctccccgctggcctcctggcccaggctctggctggagccaaggggtggtggcatgaagggacctggtatttggcatgacctctctcccctctccctggctggagatgcctggctgggggctgctgggctgagcctctctgtccctgccctcaagggagccttggtggcccccgagctctggttcccagggagatatctacggtgtgggcggaccagcagtgcccccagctgggtgcaccaccccgccaggcagctggagtctcctgcatgccctgccctgccctcctagatgctcggctctgtccccggctctgcccgggcatggcaccttcttactaactctactacttgctgcttgaacgtcaggccgagggtccctgtgctcaggcgcccccacgatggtgtggaaaacctgggagctggaccgcccgcttgctcagggccgtgtccgaggggtcccatgagattggatagggcctgggccatctggcgcccccttcactcccagctcactgaggcctgttcagcctggctgggtcaatgggacgcagcctgggacagtgtgcccagggcgaggccaggattggaggagctgggcccaagggtgaacaccctcctggcacaagaggttgctcagggctgccaggcctaaaggctgcctcataccttgcagagggaactcccaggcccaggcctactagggagatggctacctgtggctgccagctgattagccgagggaggccaggcctagcctgggctcacagctgcccatgcaccttgcgttcccctcccatagtgtggccccagagccagcactgcccctggcgagaaccgtctcaggtcactcaagtgtgtggggtctagatcagaggcaggggtgtagttgtttcaatcttggggttggctagggtgacctgtgcctattgggatgacctcttctaaggcacctgaacaggacagtctcccccgtcacttcgggccagacaccgtctctggagtaactcagccaga

SEQ ID NO: 48916 - DNA, 1033 bp, Homo sapiens
caccaacggggagctgctggctcagtacatggcagacgcggccagtgagctggggccgaccaccccctatggtgagcaggcctcacagccagggactaggggtcatggtctttagctctgattctccctccctcccttccttttttttacttaaaaaaataattatacaaataatacctgaattcattctaaatgtaaaaactctacgcagaaaaaaagagtaaaaaatggaatcttctcttaaccagttttggtttgtgtgtgtgtgtgtgttttgtttttgtttttttttgagatggagtctcgctctgtcgcccaggctagagtgcagtggcgtgatctcggctcactgcaagctccacctcctgggttcccgccgttctcctgcctcagcctcccaagtagctgggactacaggcgcccgtgaccacgcctggctaattttttttgtattttttagtagagacgaggtttcaccatgttagccaggatggtctcgatctcctgacctcgtgatctgcccgcctatgcctcgaaaactgctgggattacaggcgtgagccaccgcgcccggcctatttttttttttttgagacacagtttcactccatcacccaggctggagtgcggtggtgcgatctcagctcactgcaacgcccctgcctcccaggttcaagtgattctcctgcctcagcctcccgagtagctgggactacaggagcccgccaccacacccagctaatttttgtgtttttagtagaggcagggtttcaccatgttgaccaggctgttctcaaactcctgacctcaagtgatccgcctgcctcagcctcccaaagtgctgggattacaggtgtgagccaccgcacctggcctatttgtgtgtattttttaatggaatcatattgtgtgctatctgggaacctgacttttttttttttttttttttttttttggagatggagttttgctctgttgtccgggctggagtgcagtggcgcaatctcagctcactgcaacctccgcctcctgg

SEQ ID NO: 48917 - DNA, 1028 bp, Homo sapiens
tggtcccagcggatgctgccaggggcagtgaagtgtttaggtgaaggacaagtaggtaagaggacgccttcaggcaccacagataagcctgaaacagcctctccaagggttttcaccttagcaacaatgggagctgtgggagtgattttggccacactgtcaacatttgttagaaccagtcttttgaaagaaaagtatttccaacttgtcacttgccagtcactccgttttgcaaaaggtggcccttcactgtccattccaaatagcccacacgtgctctctgctggattctaaattatgtgaattttgccatattaaatcttcctcatttatactattatttgttacgttcaatcagaatccccgaaacctcctataaagcttagctgccccttctgaggatgctgagaacggtgtctttctttataaatgcaaatggctaccgttttacaataaaattttgcatgtgccattggtgagtacgtttttgaagagggagaagcgcccctccactgtagaccttatgaggtaaggctgcgagtgaagacctagcagaacaatccaggttggaaagaaacgaagtctcacacagggatctgaggatcctaggatggctctgtcccctcgcccagtggtctgggaagtcgccctccattgtggggttcttggagctcctgacacccagccacggagttcaagtacagctgagatgccagcaggaacagtgccgtagactaaggtaagcacaccttattttatccaacatgcctgtgtcccagcacgtgggcagtgctcccatgggtgcggctgctgcagagagcactgcaggggccacttctagtaggcacagaagacgagtttgtggcctcgactgcaggtctaacgcaggaaccctctgccttatggcttcccagcctgcatggggtccccctagggcagcccagggcacctaaagatggctccaagcgttagaaagttcttggtattgagctgcagccagcctgctatgtccctgggagtcacagatt

SEQ ID NO: 48918 - DNA, 1129 bp, Homo sapiens
agttcctccctttctctgcattgcccaagagcaacagccaaatagcggttcggcccttattttgtactgggcaccgtgtgaaacagcctgcctgcggatttcactcagtcttcaccatacctcgcagggtagagactgagactcagagatgtggcagcttgcccagggccatgcagcctgttcggtatctctgattctaaaacctgagcttttaagttttagctcactacttctccaaatgtcatgagacctttgaccttgaacctggggaggtggaaagccagcctgatggaggctgactcactggctaagacctgtgagttgtgcagggctggctgttcaagtctttgcgcttcaggttctggagatgacaaaacagaagggctcatttgaaacagacttgccaagaaattaatcctacagttagtgaacagcatggggtacagtatgtcagtgtgtgcaagtggaatactactgaggaaagacaagtattttgtaacatgttggatagtttcttgccttgccaaaaaacatgagcacatgcagtggaaactttagcctaatgctgaggcagatgagccccgtggcctagaatccacgctgtggaggttacacggtgcttaggagtgccaacctgggagtcgggcagccctggcccacagactgactgtgacctcaggcagatggctgaacattgattcagcacatgtatatggagcatctggtaagtgccaggcatcatacctaggacgggggacacagcagtgaacaaacacagaaattcttgcccttatcaatcctacatcctagtgataataaagaaagaaaatgtatcagatgatgggggatagatatgttgatgtgtgtgatgtgtttgtgtgtatacatgcagtacatatgcacacatcgcacatgtacacatgtggacatatagatatctttccccccggggccagtaggggaaaaaaatcaagaaaggctttggggttcagggtaaggatgggctctgctttaatagagtggacagggaaggctccctgtgagggtggcatttgggctgacccgggggagtgagccatgtggatgtctgagggaaaagcattccccagtgcggacagcacgtccaggg

SEQ ID NO: 48919 - DNA, 1026 bp, Homo sapiens
gtgccagacttaagtcggagacctgaggagccaggctgcaggttggcctactttgcgctaagctgggggtggaccagtggtaacctccctccgaagtgggttctgcctcctttctagcctagcgggagacaggaaggatggtgaggactcttccgcagccgaccaggagggaccaaactgtttcctttcccggctctgccttggggtgggaggagcagcacaggggttaggggtgcaaactggtggcagtggcagtggcaccaaggggcttttcgggaaggagtcgggccagggctttagaataggcaggaccagcaaagggagggctccctggaccgccgtcccctctgggccaggagcttacagaccgcagtacttgaggtttcgcaaggtgcttggagggcgtctagacggctttgctggctttcttatgggctgtaaatgtggctacattttgccgctgtttcttccccactcctgattggctttgtctttcccagcactgcagaaggatctggacgacaacctctttggacagcatcttgcaaagaaaatcatcttaaatgccgtgtttggtttcataaacaacccaaagcccaagaaacctctcacgctctccctgcacgggtggacaggcaccggcaaaaatttcgtcagcaagatcatcgcagagaatatttacgagggtggtctgaacagtgactatgtccacctgtttgtggccacattgcactttccacatgcttcaaacatcaccttgtacaaggcaaggatggaagtttggaatcccttcctggatgtcatcgggtttggggtctctttgttgtgggatgagatttgggagttctatgttgaaatgagtgagcccggaaaacggttcatgtctcagttccccttggaaaggtgtagaagttaagagtttgagatgcgtggagcagttaataccatcaaagctttgtggtgggttctgaaaatcggtccagtgagtatgtagggtcatgggattttagaggtggacatgatcaa

SEQ ID NO: 48920 - DNA, 1025 bp, Homo sapiens
gagacgtggtttcaccatgttggtcaggctggtctcgaactcctgacctcaggtgatccgcccgcctcagcctcccaaagggctgggattacaggcaggagccaccatgcctggcaaaaataacgtccataaacaaaaacacgtggccaacaggggcggagcagaaccgagtttccggaagcaaaacagggctttgtaccgaacaaagatggcggccgccggcgtcgggaggagggctgccctgaagaaagatggcctccgcgagaggaggaaccggaagcgtgggtctggcggctgcaccggttcgcggtcggcgcgagaacaagcagggtggcgcgggtccgggcatgaagctgggccgggccgtgctgggcctgctgctgctggcgccgtccgtggtgcaggcggtggagcccatcagcctgggactggccctggccggcgtcctcaccggctacatctacccgcgtctctactgcctcttcgccgagtgctgcgggcagaagcggagccttagccgggagggtaggctggggcgggggctggaggctggggctggggctggggctgggcgatggcactagggctgaactaggaccagggcatggagaatggaggatggaggccgggggatggcaccagggccgggctaggactagggctggagcggggcctgggggctggggctgggcgatggcactagggccgggttggggctggggctggggctgggggatggagcggggcccgggggctgggggtggggctgggggatcgcactagggctgggttaagaccagggcggttggctggggctaggggattgaggatggtggatggaggctgggggatggcagtagggccgggctaggactggggctggagcggagtttgggggctggggctcaggagcgggggctggggctggggctggggctgggggatggcactagggccaggccggggtaggggtcacatcccaggagggccgggcctgggcagagctgagtccgcgggggccggac

SEQ ID NO: 48921 - DNA, 1050 bp, Homo sapiens
tcaacctttttgtgtgtgtgtgtgtgtgtgtgtgtgtgtgtgtgtgtgtgtgtgtgtgtgtctacgatgtgcttatttaataattgccaaaatatttagactagagtaacttccggtgggtcaattggattgtgactttcttttgtggttttttggttcttcgattgctctctgttaaatattttcataattccccccacagaatacgtgtgtatatactgcaacttaaaaactaaaagcagtactcgaatgagttgttttaatgttgtacttttatctgtttgttttatgggttctcctgctgcctaatgacctttctgtttttataactgccggaaagccgcgaagcctctcgcatggggagctaggtccccgctgcggctccgcacttgagtttattataaactctggggttctgagtaagttttgtttgaatacagcaacatgattgtctctttctattcttatcctaaaagactctgtctggcatcttttagttgtaccctcgtatctgcttctctaataaatgttatattttttctcagtattgtgtattttaagtgacttttcatgtttccaagaaaattattctgtgtaatatgaatatttaactctttcatctccagtaataggggattttctagcccaatgcttttttaaaaattctgcctcccacccctacctcctcctttaaatgatggcacctcccctgtttctgatcttgcgtgcactcagggcctgagaagtctgtgtttcttttgtttcttttctctctccttgagatgaagagcttttcacggtttattgcggaatgaatacagaacaacaggttttccttttcaccaaagattttacattgtactgctgaagagccaagagtttccttctgagagaattggaccttcatgttccttgtaccattctaggaaattgatgcatttcttttcttttcttttttttctggagttgaattctcactctgttgcccaagctgaagtgcagtggtgtgatcctggctcgctgcagcctcgacctccctgggctcaagcc

SEQ ID NO: 48922 - DNA, 1026 bp, Homo sapiens
cagctacttaggaggctgaggcaggagaatcgcttgaacctgggtggcagaggttgcagtgagctgagatcgcaccactgcactccagcctgggcaacagagtgagactctgtctcaaggaaaaaaaaaaagtaactagacttttagaggcagcagagggaggtgtgcatggggtaaggagaagagattttttttttttaatgttctttttcacccacattctctgaggaatgtgatgtcccatctgtcactttacaggggtggagacttttggcctcagcctgtgtgaagagactggcaggaatactcacgctagggaaaaggcagcagctaggcgtgcagtggttgatggggtttgtattaaggaaacataaatttcattaacacttcagtgttgccactgacattgatggtaacacttggtaggaaaaggaagaagactgtctcaaaatgtgtttttcatggattctccctagagtcagaagtatctcttactctcctttactgtagcgttgctcactgctttttctggggcattctggccagcatccatggaactgggaatggtttatgggacttatgcagtttgcatgcattgatttttgcatctcggctgggtgtagtgggaaagagcttaatctatttcatgaagccacatgcagatgtctgcaccccccatggctgcaggctttgctttcagccttctttcaaggaaagcctggggctttctggtttctcatttatatttgtgtctgcagggtgcaacaccggaggatttcagcaacctcccacctgaacaaagaaggaaaaagctgcagcagaaagtcgatgagttaaataaagaaattcagaaggagatggatcaaaggtatagtgcatcaatatgacttattaagaaattcaaggccaggcgcagtggctcacaacctgtaatcccagcactttgggaggctgcggtgggtggatcacctgaggtcaagagatcaagaccatcctggcctacatggtgaaaccccgtctctacta

SEQ ID NO: 48923 - DNA, 1090 bp, Homo sapiens
tcatagagataatggaattgatgcagccatccaatgtagataccagtttcgtttacagagaaagattggcataaagcaatgtgtagattcccaaatcattctcaatggccagtctagtctaagccttcccaaaatatcttttataatgaatataatgagtaaacagatctttagactgggcccagtggcccacgcctgtaatcccagcagcgttaacatatccagtaaggttttctccttttttttttttttaaatcctaccctgtgggagttgcaatacagttgtagtggaatgctttcttgtacaaacataagttttacttttcccttctcctggactctccagtcaactgacggttgggttacttctttccaaatagtacctggtagtgccccaaagccagaggtggatgccatcctttcttgagtgtcaactgacacattggcctgggaaaagattctaaactacaactaattaactagaggagagatgtccttcttagacttggaatcaacagctggttactagtaaaagaataacagtagtcattgttaacctgacaatcgtatttccacaaaaacaactctgtgtaaaaaagaggcctggcacagtggctcatgcccgtaatcccagcactttgggaggccgaggagggcggatcacctgaggtcaggagttcgagaccagcctgaccaacatggtgaaaccccgtctgtactaaaaatacaaaaattagccgggcatggttaatgtccggctaattacaggcgggtgcctgtaatcccagctactcgggaaactgaggcaggagaatcgcttggacctgggaagtggaggttgcagtgagccaagatcacgctattgcactccagcctggacgacagagcaagactctgtctcaaaaaagaaaaaaaaaaaacccatgaaaaaatagccaggcatggtggcatgtgcctgtagtcctagcggaggctgggatgagaggattgctggagcccagccagggcaacagagtgagaccctttctccaaaaaaaaaaaaagtaaagaatgtaaattcataattgataacaagtttattatcaatgct

SEQ ID NO: 48924 - DNA, 1071 bp, Homo sapiens
atccacccgcctctgcctcccagagtgctgggattacaggcatgagccaccgcacctggccaattcattgtttaaaaagtgtttgcatgcttctgaatgtatttatatgcttgtgggtataatttcaggattcacagctggtaatagaagcttataaatcagggtttgagcctcctggagacattgaatttgaggattacactcagccaatgaagcgcactgtgtcagataacagcctttcaaattccagaggagaaggcaaaccagacctcaaatttggtggcaaatccaaaggaaagttatggccgttcatcaaaaaaaataaggtactgatggttggcgtgaaatgagttttctaaggtgtggagattttgacttgatcttttagtcttagaaaaactaagatcctaaacctgtagtttcagaatgcaaaagaagaagctagtgtgctaccttatgttgagacagtatttctttttggtggtggtatctttgccatggccctgtgtcttatttcagatgcattatcctcgtaccgtgactcccacactaacagagtactgacctctccaccgtttcgcctcatgcctttccctccttcctctcctagactgctggttaccttggctgggagagaggatgtagtgggacattcctgtaacactttatccgcacatctactggaaatcgttaccatgttaataacttggttttgaattcatgttaacatgtgtacccatgaacatttttcattttcttttcatagtgcgatacataggtgcatgacagcattaacctggggacgtagaatatgatcaaggcagcattactgctttaactttagaatgacttactatttattaatttaaacagactgctgtttccacaaccttagcattgaaggtctttcattttctcccatcaagctatgttagtttaggtaatgtagaaatatttaccctctggcttaagctggtttagagtaactaactagagctatagtttgcatgggaaagtctgcacgagcttcttgtcagatatttcttgctcttctgtcgcattacttactaa

SEQ ID NO: 48925 - DNA, 1031 bp, Homo sapiens
tttttttgttttgtttgtttgtttgtttttactttttgtggtgatcgaggttttgctatgttgcccaggcaggtctcagactcttgggctcaagctatcctcacacctctgcttccctaagtctggcaatgcaggtgtgagccaatgtgcctggccagcactgtgttcaaatcacctccattcatccacatccatgctcagacttcggtacgctttggcattgtgttagatgccagcgtgtgaccagatgtttagtagttcccttataagacagtatatgtcatccttaaggcacccagtttaattaaaagtaagtttacagtataaagtagatataagaaaaagctagcagtttttatctctgggcaagagtgcagatttggatgccatgaggatgccatgttccttagaggaaaaatgaagagaggaaatcagcttaattgaacaatttttattggcagggaaaactcaaggaaccatgcagtctctttttcttctttgacattttgcagctgtcatagagttttgaacttgaaggctttgaatgagctcgagtgatttggaattagttaatctgggtttgtacaagaagcagtacatgttgggataggtcatcctgcagctcatgacccctgtgtttcagctgaaggtgaaacaggctcccctgctgccctttcaacgaggtggactagacatccttactctctgttttgggatattgagagggaaactgcaaaggaacatgggaaaattataccatgtccgcatcttactcttgtaaaaaaaaattaattaaaacaccgagataaagtattctttgccattcttctcagaggtagttactcttaaccccttgaggtatgtccttctgaacccttttaaaacagctgttttgggccaggcatagtgactcacgcctgtaatcccagcactttgagaggctgaggctggcggatcacttgaggtcaggagttcaagaccagctggccaaatggtgaaactctgtctctactaaaaatacaaaaattagc

SEQ ID NO: 48926 - DNA, 1462 bp, Homo sapiens
ctcaagtgtgggccgggcacggtggctcacgcctgtaatcccagcactttgggaggctgaggtgagcggatcacctgaggccaggagttcgagaccagcctggccaagatggtgaaaccccatctctacgaaaaacacaaaaattagctgagtgcagtggcaggcacctataatcccaactactagggaggctgaggcaggagaatcgcttgagcccaggaggcgttggctgcagtgagccaagatcacgccactgcactccagcctgggtaacaagagcgaaactatcgccaaaaaaaaaaaaagacaaaagaaagctcaagtgtgtctttcatttcccctgtgagtgttcatcaccgaccacccatccccaagttctcatttctaatgtagccacaaaaggcgctacatggggaatcattttcattttgtgtcaaccattgtggggaccagaagctcaagtgtggggaatcttcggtgttagaatttgagacgttttatctgttgagtcaccagggtgataaagtggagacttagactatgaacagtctgggaacaacgttccagaaggttgtggctcttaatggcttttcaaagagaaagtcaatttcttgagagccggaggagacaggacagggccatctggaagagcttggctgcttataatggttcctttagagcaatagtctcactgcttgcctgacttctaattgattcctcctggttgataacagtgaggttgtagttgaagccttgcatatttcagtcctctcaaaagcttttctctaaatggacttgtattgccaactagaaatattataaagtgtatactgtttctcattgtggctcaatatgcgttttttccctagaagctgaattttatttttattaaagtcatcaatacaatgtaaacaaaattaggcttttacataacaaggactcattcatgatgcccatggttgtttgggcattcatagcttcatgctgtatgtgggtgaaagcactgagtttttatagatttgttgagcttttgacagatcagttagagttgagtttagttgggaaatggtgtgaactattatttgccaaattctgccaaattccttgcttaaagactaggtatacgttaatattagtatgcctttctctaaaattattaaatatattaaaatacatattcttgccaggtgctgtggcacatacccctagactcagctacttaggagactgaagcaagaggattgcttgagcccaggagtccagactgggcaacataacgagaccccatctcaggagcaggggagtgttctcaatatctgtatttgatctcaaaatggagatacttactttaccaaaagacattaatttgctgctaaagttaaatatttaaaatgttattcaattaaaataagttagattagcccaaagtttcaaaagatattttatgttgaatgaggcaaat

SEQ ID NO: 48927 - DNA, 1029 bp, Homo sapiens
ttcagtcagcaattaaggcatcttaacacagaccactcaaatattacatctctaatgtatatctaaatatcctttacattagtacatatagcatgtatatgaattttggattatatcttgactaagtatcaatgaagccaaatattacattatgcggagcggttcagttttgcaaaatgaaaagtgtttcaattgtaattaattctgagccattttgttgagaacacttgatgtgtaatgaatactcaggatcctatgggaggtggatgccaattaacctgattttaattaatattttcttggtgtaaagcagaatatgaatgaatgtggccttgtgtgaaacagagtggcgtgtgttctgttccataggtatacgtcatgtaaagctttcatttccaacctgaacgaaatgaatgattacgcagggcagcatgaagttatctccgagaacatggcatcacagatcattgtggacttggcacgctatgttcaggaactgaaacaggagaggaaatcagtaagcaaaactttattctttttcttcctaaaagatggaccaaacacagtgggaatatccctagaagattaaaattaaataaaaccatataagactatgggtcttaaactcatacctttgagaatcatataaaagttatggaccccagctgggcacggtggctcatgcctgtaatcccaggactttgggaggccgaggcaggcggatcacaaagtgaggagtttgagaccagcctgaccaacatggcgaaaccccatctctactaaaaatacaaaaattagccaggcgtggtggcatgtggctgtaatcccagctactcaggaggctgaggcaggagaaacgcttgaacctgggaggcggaggttgcagtgagccgagattttgcacctgtgctccaacctgggcgacagagcaagactccgtctcaaaaagaaaaaaaaaaagaaaaaaagttacagaccctgttcctagaaagtgtttctaggtctctacgtaaaatgtcaagggtcctt

SEQ ID NO: 48928 - DNA, 1020 bp, Homo sapiens
ctcctggtgacctcaactgtctcatggctttaggtataatccatatggcaatgactcacagatatggatctctaagccagacctctctcctgaattccagaaacagcttgctcaaagtctccacttagaaatgtctaaaaacttggctgggcgcggtggcttatgcctgtaatcccagcactttgggaggctgaggcgggcggatcacgaagtcaggagatcgagaccatcctggctaacacggtgaaaccccatctgtactaaaaatacaaaaaattagctggaaatggtggcgggcgcctgtagtcccagctacttgggaggctgaggcaggagaatggcatgaacccagaaggcagagcttgccgtgagccaagatcacaccactgcactccagcctgggcgacagagtgagacgccatctcaaagaaaaaaaaaaaaaaggaaatgtctaaaaaccatctgaaatgatctgaaatgtaacatgtctgaaactgaactccggatctccccaacttaaaaatccacatgtctaggccaagtgaagtggctcacacctaaaatcttagcacttcaggaggccgaggtgggtacttgagcccaggagttggaggccagcctgagcaacatagcgagaccctgcctctaaaaagaattttaaaaaattagccaggcatggtggcgcacacctgtagtcccagctacttgagaggctgaggagggcggatgcttgagcccaagacgctggggctgcagtgagccatgattgcactactgcactccagcctgggcaacagagcaagaccctatctcaaaaaaaaaaaaaatctgcatttccacgacctagattttcctccactcacctgagggtagctgcatccttcctggtttaggtcaaaaaccctagcatcacccaggtgcagggggatcactggaggtcaagagttcaagaccagctgactaacatggtgaaaccctgtctctactaaaaatacaaaaacattagccaggcgtggtggt

SEQ ID NO: 48929 - DNA, 1054 bp, Homo sapiens
agattgaactcagctatgcaaagcaactcaggtaagttgatattgaaaaaggttatttgttaactgcaaaatgatgtaaggataacgtatattctcattttacagtataaatgtatattttaaatatttttccttttatgtaaggtaatatttcaatagaagtgattgtttttcatacagaaaattaattttcatagaacattaaaaataaaaactaaattactgctttaaggcccagttttttttttcaacaagatatttgctgagttttggagcagcttgtttctcagtaaactttttattgaaatatattaataacatatgtacagagaagtacacaaatcataagtgtgcagctccatgaattttgacagtgtgaacacactcatgtaaccgggcacccaggtcaagaaacagaaagaccagcctggcaggccccctggccccctccagctccccactctccccccagcggtaaccactctcctgacttctaaccgcgtggattagtagtgcccacttttgaactttacatgagtgtaatcatttggtatgcattcttgtgtatctggcttcttttgttctatattacgtttgtgagattgaccatgtggtagcatgtggtgggatctgcttattttcattgctgttgagtgttttggtctgtgaatgcaccagaactcatccgttctgactaggtgattggttgtttctaatttaagctataatgagtagcgctccaacgagcattattgtacaaggctttttgtgtgtatctgaacacatttcctaggatctacgtaggcatctaattgcaaggtcacaggctactcatatgcttagctttggtggatagggttcagccatttccagtgtgcttgtactaattcacactcccttctgtaatgtgttgaggggtcatgtggaatagtattttaaaagtacttcgggccgggcgcagtggctcacgcctgtaatcccagcactttgggaggcaaaggtgggcggattgcctgaggtcaggagttcgagacccgcctggccaacatggtga

SEQ ID NO: 48930 - DNA, 2078 bp, Homo sapiens
cacgtccttgtttacacttggtgctctctgactttaaatttttaccagactgatggatatgaaatggtatttcattgtggttttaatatgcatttccctgattactaattaagctaaatatatttattgcttaaaattcttatttatttatttttgccccttttcctgttaagttatttgactctttttagaacagttggagccaggcacagtagctcatgcctgtaatcccagcactttgggaggccgaggcagggggattgcttgagcccaggtattcaagaccagcctgggcaacatagtgatatcctgtctcttaaaaacataaaaaatagaacaattgaaggagtgctatctatattctagataccaattctctgttgatcatatgtgttacaaatatcttctcccagtttgtattttttatgttcactttcctcaatgctatcttttcgtgaacggaattttttagttttttagttttattgacttttttcattatggtgtacactttttgatgtcttgtttaaaaatcatttctggctgggcgtggtggctcacgcctctactcccagcactttgggaggctgaggtgggcagatcacgaggtcagaagatcaagaccatcctggctaacatggtgaaaccctgtctccactaaaaatacaaaaaattagcctggtgtggtggcacgcgcctgtattctcagctacttgggaggctgaggtaggagaatcgcttgaacccaggagatggaggttgcagtgagccgagatcgcaccactgcactccagcctgggcgacagagcgagactccatctcaattaaaaaacaaaacaaaacaaaacaaaacaaatttcctacctcaggatccaaaagatattatcctatattgtctcctaaaagttttatagcctagccttttacatttaggttcttaattcttaatccacctggaataagtttttgtatatttttaaaagtagaggttttatctcatttttcccgatagatatgcaattatccccgtacctcttattgaacagcttgttctttccccactggttgatgacaatgatgatgatgatgatgaaaatgatagcattaacacttactgagggcttaccatgtgccaggcatatgctaagcatgaggtaatttactaatccttttagtaactcagtgagtaggtcctgcttctatcctcttttgagttgagaaacagcaacacagaagttaaatacttgcttcatgtggcatacctagtagtcaaagagccagcattcaaaccaatttattctagttccagaatccagattcttagccattaggctctgcatcttttctacatggctacatctatcctaaatcaaaagtcatttttgcatggacctgttcctggcctttcaattctttgtatttgtctatgtctttgtccctggccaatagcacaaagcctcttaattaactttagaataagtcagtatctggtgtggctactattcctaccttgttgttcttcaagagtgttttggctattaattgacctttgcatcttgatttaaatcttagaattttgttctccagaaaacttgttggggttttaattgaactgcattgaatctgtagataatctaggggaggattgatatatctataatatatggccttccaatccatgaacatggtatatttctatatttattctgtttttctttaatgttgtcttagtccatttgtgctgctataacaaaatacctgagagtggataatttataaacaacagaaatttatttctcacagttttggaggctgggaagttcaagatcaaggtgccagcaggttcagtgactggtgaaggcccattcctcagatggtgctatctaggtgttggtgttgccacatggggaagggatggaagagcaacagcagctctctgaagcatctttcatatgggcattaatcccatccatgagggtggagccttcatagcctaatcagttcccataggcaccagctcttagtactgtcaccttggaggttaagttccagcatgacttttggaggatacattcatt

SEQ ID NO: 48931 - DNA, 1024 bp, Homo sapiens
gattctcttgccttagcctcctgagtagctgggactacaggtgtgcattatcacacctggctaattttttctatttttagtagagatggggtttcaccatgttggccaggctggtctcgaactcctgacctcaagtgatctgcccgcctcggcctcccaaagtgctgggattacaggcgcgagctacctcgcccaggcttacatggccattttgaagtgattgggttctaataaaatagtttacaactcttcataacatagctcttcataacattgccttttaatcaattttcaaaatttttattgaacaactatggtgtgcacaagacaccagtctgaatctgttgtaagttacattatatacattgaaagatatctacgtggaagcatagaaagtaggttttacctctagcttgtaacatcagagtcaaaagaaaaatgtttgtatgtaaaattaaccaaaatacatttactcaagacttgttaaaaaggcagtgttagtaaggtaaatatgttcactgacttgttgaagttgtggctggttgttggagaaatggcaaagcaagagttgcttacatttgaatgttttttttttcttgcctacttactgagggaagtgacaggttactgaagtgttagttcagctttttattagcttgcttattagtgtgaagtatgaataaatccattggaaaattaagccttcctcgtaattattctctttgcagctaacaaattattcagtgacagaacctggttttgctgcctcctagtatcctctctgtctttatttatttgctctggtgctaatgagaaatgaagtatgtacaagaaagagaacagagaaacctgaataatgcatattggttagcatagtaagaagccacatgtgggctgggcgcggtgggtggctgacgcctgtaatcccagaactttgggaggccaaggcgggcagatcacgacatcaggagtttgagaccagccggaccaagatggtgaaaccccatctctactaaaaatacaa

SEQ ID NO: 48932 - DNA, 1059 bp, Homo sapiens
gtgccgctcccgccttcgcagccagcgcgggcttacctagtgttaagtctctcttcttgggtggcccacgcctaagcgacctatgcttcttgttcttctgaaatcttacagttccccttagatgtaggttggctattggtagcttccgattcagataagtttggaacttgacagatgttttcggggggctgctttagagagaggctttggactatgcaaggggaggaagggaggttcagaaaaacggggtcggggggtcggcagggacgactcttaaagtgtggaaggtggaaggctgggaggggagattaaagggcaccgaagaccagctttgtttgctcctatcaaggtgatcctttccagagcaagagccatatccatgtctagtcgcacgagtttgtgccaagtcctttgcaaaaaccttcagatgtgggatctcatgtaatcttgaagacatcttagtcgtcctaggggttatttatttaattgatgagacgcgggtggctcatgcctataatcccagcacttgggaggcggagacaggaggattgcttgagaccaggagtttgagaccagcctcggcaacatggcgagaccccgtctctataaaaaacaaaacaaaaccacaaaaattagccagcagtgatggcatgcgtatgtagtctcagctactcgggaggctgaggtgggagaattgcctgagcccaggaggttgaggctacagggagctgtgattgcaccattgcactccagcctgggtgacagagccaggccctgtctcaaaaagtaaataaaaggccgggcgcggtggctcacgcctgtaatcccagcactttgcgaggccgaggcgggcggatcacgaggtcaggagatggagaccatcctggctaacacggtgaaaccccgactctactaaaaatacaaaaaattagccgggcgcggtggcgggcacctgtagtcccagctactcgggaggctgaggcaggagaatggcgtgaacccgggaggcggaggttgcagtgagcagagacagcgccactgcagtctggcctgggcgaa

SEQ ID NO: 48933 - DNA, 1051 bp, Homo sapiens
cttgtgccttaaaggcagagaagcgaggcggatgccctggaagcacccagcatcacacccaggcttgtgcggggccaggctgggagcccatgcagtagggcagaaggcagcggaggccaggtctgtcccggctggagaacagcgtccacgcagtcctgcctggggtcaggccctcactgaccctcaggggagcccccaaggtgctgtctgtctagacaggctgtcccaccccagggtggctagtggccatatgcagggaatggtgcttctggctgtggcacgcactggatcacccaggtcccagcagacatggccgcccaaagtcagcaagcctcctttgtgctatgtggagctcacagcctcacatgtgaacacccgtgtctgggttgcctggggtgatcctccctcctgcgtggtggctgtctctggaaagcatcccttgccgctgccatgggcagccccagcccccgtccgtccaggctcacccacagtagtgatgcagacgtgacgtgggggaagggggctgagccctgtggctgggttctgacaactgtaacggttttgtcgagcttaggcccctttggagggagaatcaataaataacaaacaccaactacaaacgccagttggttccttttttaattacatttaaaaaagacaaaggcatggagctgtatggatgacacaccttgaccactgacgaggaagatttcactcagccacgtctcagtggagtctcagaggggagggtttccacacagcacggtgccaagggccagtcttgacgctgtcatagacaatgacatgcaagccccagccctggctcgtggttcaggtggccctccaacactgagctgtcccaggacgcctgccgggctcgctgagggcagggccgggacttgctcaggttgctgggtgttcatgaaggaggatcgggtctgccagatcaaactccaccctgcagcagttagcaaggaccaggccctggtctgctgaggctccactgctggccctgggttctcggctttttgttgtcaatgactcctacgct

SEQ ID NO: 48934 - DNA, 1045 bp, Homo sapiens
catatcacctagaactgtttttccactcagtgtattacagcatctttccacgatacagtgcatattcttgttgtgactttgtctttaataacaacgtaatggtcagcccattgtctggttctatcatgacttatgtaattgatacatattatcaaatatttaattgtgggatgttgaactattcaaaattaccacattaatgatacgtaatcttatgtatattctgtgataaccatcttttgtggtttaatttttgcacacattcatgacatttttcttggacaggattctttttttaagagacagagtcttggccgggcgcggtggctcacgcctgtaatcccagcactttgggaggccgaggcgggcggatcacgaggtcaggagatcgagaccacggtgaaaccccgtctctactaaaaatacaaaaaaaaaaaaaaaaattagccgggtgcagtggcaggtgcctgtagtcccagctactcgggaggctgaggcagaagaatggcatgaacccaggaggcggagcttgcagtgagctgagatcgcaccactgcactccagcctgggcgacagagcgagactctgtctcaaaaaaaaaaaaagagagagtctcaatctctcacctctctcacctgggctggagtgtgattacagttcagtgctcctcgaacccctgggctcaagccgtccttctgcctcagccttccagagtgctaggattataggcatgagccactgcacctggtgcaaaattctcataatgcaaatatttaaggcttttgatatatactgataagtcatccctctggagaggctgtctgaagtggtgctcccacctaccatgtctggaagtttctattttattaccatccaaggtggtgaatgtcttatgattattgaccattggtatctgtaaatttcttgtttgatatttttttcggcgtgttcaccttctagtttttttgttttcgaaagaacccttgcgctggaaaggatggtaactgactctttgccttatttgcagcatacgctgccttttttg

SEQ ID NO: 48935 - DNA, 1071 bp, Homo sapiens
ccttctggattcaagcaatcctccagcctcagcctccggagtagctgggaccacaggtgcatgccaccacgtccaactaatttttgtagaggcagatttttaccatgttgcccaggctggttttgaactcctgggctcaagtgattcacttgcctcggcctcacaaagtgctaggattacaggcatgagcaaccacgtctggcctttttcagtcttttctaactcgtgcctcaggacaattaaaaagtctgacatccctctcaaaaaattctaccttcagtaggaggtgttgggctcatgccaaattataaatggtcaactttcaatgagattagggtgttagcacagtagccagatatgtgcacattttaaggtttctcctctgtgatagttaaggcaagtcaagactaaagaccttctgtctaggcagggagataggtggtaaatttaaaaagcagcccgccccttttatagtcttttcaagcctaggccacgcgagctagtgtagggagcgtcattgggatcatgacgtcatctttgaatttgggcacatgtctgcacatgtgtgcctgtcattccaggattgttttgccattgttcattagttgagttcacagctgcctctccagaaagatgacgatctaattataattgctcatgaatcaatgaagaaccaggaatgttttcctgtatcaacagatgcaaacaacacagacttctctctgttccttttgccctgcttgtaaagaagagtgaatctgaaagtggggcatccagggcactgtgttctggcgctctttaactccctctaaggccgtgatgctcctctttggggcctggcgttgtgcttttaggaagagctgcttctcccaccgtcctccctcctccaggcggtagggtgcaagggagctgcctcttttctaactgctctcttcactgattgtgtagtctctcctcctccatcttgtcctgtttgtaatcaccagctagatggctgtcccttaaatattaacttctaaattgtgctaacatgcaagtattaaggttctcctttcttgctagtacttggct

SEQ ID NO: 48936 - DNA, 1927 bp, Homo sapiens
ccttaagtaactcttttatgaaataggtataataatagcatcgtgcatctcagggttatagggaagattacactagtcaatacacataatgcttctagaacagcacctggcacatacggagcagtcaggccttagctgctatttattattaattatgtggtgctagatgcatgctttgtaaacagatctcttggcttgaaaaacctgtgtccctctcctttctggacccctcaatccaaaattatagctgaggtgtttaccccaggtcaaaaaaaattccttcccactcaacgaggctaacaaattcctgaaaactgcctccttggcttaacattccccagcagctctggagagtagaataaggacccccaaaggacttaaattatagagagaggctgagaaagcattgctcagcattgcaaattgctccagaatgaaatatgtgtttgccaggacatctgggtggccctccaaccccagcagcatttaaggggaggctgacgtgtctgctggggccatagagttcatgtaaaaggggcttgcctagatgacatcaatattttcctctgaattctcccatgttctccttttttttttttttctctgagacggaatgtcactctgtcacccaggctggagtgcagtggtgcgatctcggctcactgcaacctctgcctcctgggttcaagtgattttcctgcctcagcctcccgagatgctgggattacaggtgtgagccaccacacccagctaattttatatttttagtagagatggggtttcaccatgttggccaggctggtctcgaactcctgacctcaggtgatctgcccgcctcgacctcccaaaatgttgggattacaggtgtgagccactgcgcccagcctccccatgttcccttcattccaaaaagttactagtatctgcttagggcagcgagactcaaggatgtagcccagggtggctgttgtgatcagagctgatggccctttccaggatttggaggacaggcacgtacattatcatatctggtcctcacagtagcacactgggttcagcagagcagagtggaacgtggcctggggctttatcagcagccctgagtcactctggcccacccacccctgctgttcctgtctaggcttctgaaaatgctattattgaaaattgttattcttcaggtaacattgttaaggtttccttctatcgaattgattctgatgagatgttcacaagttagagcagccaaaacagaggagaatgagtttccactcataaagctctgtggcagtcccaagtacatttcctctatggagtcattacagcaccacttcattagtagaaaggcatgtctgaaagaaaaatttccttgatttttcaaagtgactggggaaaaaaaaaggagagagaaacctataggttatgaacttgtcaatgtcagagcaaataacttttccacaattgctttaaaaatattttagccagaacaaagattctctaggtgagaagctttacaaattcagttttgtttcatttattcaagaagcatttagtgagaaccttctatatgccaggcaatgagagataataggaaatatgagcaaagctggcacagaccctgccctatggcacttacagtctaaggggggcaggaccgtaaacacaaaggcacacccatgtggtatagcgctgccaaggaagatggcacagggtgtgatgaaagggtatgatgaccttcctttctcagggtggtcagagacgcttccccaaggaagagacaggccagcatctggaggatggacaggagctgcctgtggctgggagcttttcatgctggagtcattacagacagtgagagtgatcgagacactgtgacgctggcatttgttgttattgtctaatagtaataacagctaacatttatggg

SEQ ID NO: 48937 - DNA, 1068 bp, Homo sapiens
aatagatttgattctaattgctaacaatcagtatacactgcttggacctggtctagtgattagcagctagaaggaggggaagatggggcactccttgagagatgtgatcagaatcttgtagaaggatgtgaagtttgaaaaagcatcttaactatcgtggtggaatttttgtaatgttacatttgggaaatgaaaaaaattttgaaacacagattagaatataaagctccacaaaatctttgttggatgtatggaaaaagtctcatgggagaagtttgcttattaaaaggcagtatggattttgcacaaagaaagttggagaaacacacccttgtcaccgagaagctggctctgtgctaagtgatggtcatgctttagattttctttttttccattcttctcttccctgtagctcagccctctcttcctgctatagccgagtgtaccaaagcctcgccaacctcattcgctggtctgaccaagtgatgctggaaggcgtgaactcagaagacaaggagatggtgacgactgtgaagggggtcatcaaggctgtgctggatggagtgaaggtaccggtgcaggttccagacagtcccagtcagggacttagagcagcctgcctgctggtgcttgtcacataagagcttgctcctgaccttcaaacattagaatgtctttctgcgtctctggtgttggtgcgctctatcccataactacttacttctctcaggactggtgcgaatggctcttagggaaaagctgtctagagcagtcagcccttactgagcactgcattaaatcttagtgagtcttcgtagcatcgtgctggctgagcatgcttgccagctagacaaaatgcaatggagatcgttttcacaatgactttaagcaaagctcccagcatgtcatatcagcactaccttttcatgttctgggagcttctaggattcttggtagaaaagcaggagtgagatgagtaagaaatggaactttctgtatttacttgatatccgtgatgtggtctgtgtatttgctatccagagaagtcagaaacagcataagaaattg

SEQ ID NO: 48938 - DNA, 1032 bp, Homo sapiens
ttctcatctctcttccttcaccatgaagctgatggacaaattccactcacccaaaatcaagagaacgccatcaaagaagggaaaaccagctgaggtgtccgtaaagattccagagaagcctgtgaacaaagtaagctgactctggatgtttctcctggcctcacctgcttccagcaatatgagtttgtgcgatttgtatgttccctccctggggattgagctttcagtgcatcatacctacttcgtagcattccatgggcgggacctttggtgtccttgtaaaataagaaccattaggatggtgagtgtttgccacgttagccaagctcagttggctaagacagttctccttttccagctgtgtcatcctctgggcatttaaaacagctcagcacatcatgtccacaccccaggctgctgcctccctgccctgcagttccctacgttgccttggcgcacactcaaacacagggaactctgtgatgtccagaacatccatcatttggctttagggcctgtgctctgaaacatgcaaaccccttgagacacagccaaagatgtcctcaagagttagtggcctcagcagggccagtcaagccagatatgttgaaacagctattgactttcatcaacccctcccttcggcctcaaacagccatttcaaactctgtaggaatccaggtttcctctcttccaggaggcaacagacagatttctaccagagggctaccctctccccttggatctggagcagcaggcagtagaatttatgtccaccagtgctgtggcttccaggtctcaaaggcagaaggtcagtgtaacattaagaacaattgggtttgccttgccttctactgcagaatcctggtccatggttttggggatggaaaaaactctattgcactattattatgttcaactgggtggtgaccgtgggctgaattgttcaggaaagagtccaggggaccttggataaaagtgagagtttatgcaaggtcccatgatctttggagagagctttgtggcaaaagc

SEQ ID NO: 48939 - DNA, 1049 bp, Homo sapiens
agtcccccttctcttcatccacaacaccgatagtgttccctgttttttctttttatctattcaggcatgtttgtggtggtagctcagtggttttaatgtactgcttcctgatgacaaattgagcaccttgttatatgtttattggccatttgaatgttgccttttgtgattctgaatctctttgtaatgcttaccagttatgcaagtaaaatgaaaagggtggttctgtcagatcttaacccaaatccaaggtgaagcctggtttcctgcataggcgagaaggccccagggcccagaatccctcctcaccccttctgcctccatccagggccccactctggggcaggcagtgctggctgcattcagctcagtggggggcagtttgactatgtcgcatccagcttcccatgccgtccatccctaggagtctgtctcaccatacaagggcgcagacaggccagcttgagggtgttcatcaacgcagcattgtttgaagagcagaagttagaatctattcattcgggggcctgactgcataaatacactgtggttgccgtccagcagagcatcatgcagccattaactgcactcacatgggaaaatgcccacaatggcttgttgtttaaaaaaaaaaaaagtgaaaaaatatttctgctgtgtgtggaattatgagaaatgtttaccgtctacgttatatatttttacagtgcttggatttttataatgagattgtttgaaaattttttaaaagataggcttaatattcccattagcagtgtcatagttatccagtagacttcctgaacaattgggtagtaggaatggattttcataacaaaagagtctttggaattgcaaaacttcaaatattgttttccctctgttttaacaggaatagttgtatattaagtaagacagaggatctttccatgttaaagttgttagaaaaatataactccaggccgggtgcagtgcctcatgcctgtaatcccagcactttgcgaggccgaggcgggcggatcacggagtcaggagatcgagaccatcct

SEQ ID NO: 48940 - DNA, 1664 bp, Homo sapiens
cctcgcccagcccctggctcttgccctccctgagtcaggtcacctgttcagctgaccctgctgggctggggccttccagatgtgctcatccctctgctgggagcattttcccctcggtccgtgcctcatccccacgagaaatacagcgcaaatccagccaagtgcagcaaatctagccaagtgcagcaaatctcaccagcttctttttaagccagtttcctcttggtggcaagcacagttgctaccaccccccaccaccctctgtggaaagggctatgacgctcgccttctctctgctccctccctcccagctgctcctccagaaccccccagtgtccctgcacatcccaggagtctgcttctggggaaccggaccaaggtttaagcattcaccttggggaggccacccccacccctctctccagacttggttaggggtctttggcctcacttgtgtagcacttgtcccctgacctcggtagcgatgcttcaggtctgccctccccgcgcctccacagggtttcttgttctctgaggagtaggggacaggacagaggcttttcctcagcaggcagccagctcagattggactttccttctagggatccctcttcaggttgggttggtgggaaggccgtctgaactggagcaggtgggctgtgtcagggaggcggtcaccggactggactctagccagcggttcccacctccacgcgcccaccgcccaagcagccagagctccagccctagccgcccaaaacaatgcagggcaacggttttctcctgagccaagtgtggagacctagatttccttgcacctgagggagagggaccacagtggtggcttctcacgccttggggaaccggaccagggcctgttcataacacagagatctgagctccttctcaagtcaggctgactgctttgggtaagagggcagaattttaaagcaaaaccgtgctctgcagggcgcctatttcagcattttcagactggtcttaacgtagttggttcattgccctcagaaatgaatgttgaaagcggtaagccccatttgaagcacccccgattttaacaagcttcaggacacatagttctgtgctaatatttttgttttgatgaaaaatttaaaaacactgctctcaacccccaccacaaagaacacgaaaatattattataaagaaactagatatatcccaatccctgctctgcagtggtggttcaatttgtaaagcaaaagttagaaccaaaaatgctttcaaaggtggcttcgaacaatgttcataactctctgctcgcatcattctgctttttacagagtttagagacccatttatagattcagtccacggattgtcatgcatttgcaaaaacgtctactagctctccgagttccatatttttattatcaagggacccttagatctgaggacatggggactggcagacaccagctgcagaacggaaccgtcttttaggaaacagaggccacgatgagtacatgatgggccccatctacctagtggaaaatgaagcggcatgtttttcttcacggtcactggtggctcttggcaatttctgactcagcaccattggactttctcctggcccctcctttcctctctgttgggtggggcggccgggggggtgcttttgtagccc

SEQ ID NO: 48941 - DNA, 1079 bp, Homo sapiens
aagaggcttagagaaattatgttttgcctaattgacaaaaccaattagtggctgaaacaacacagaaggccaggtttgtcctctcacttcctaacttgaggacagagaaatatattctgatgtccctaactggcagtctgctatgatagtgaccacatgcccatttctttcttgggatttcgtcccagcctgacaaccttggaacagaacaagaggacaggaggtgtcgttccaggtatgtgttagctgcaccagccactctttgtggcatctgctacccatcaaaggacgtggttgggctgggagccaagttaagttttctcattgtttggcagttgtgtccccagattttcttgcccatcttggagatcttagcacagccggggtgcttggggctcagctgccttgaaggggactcagtcccccacacaggtgattcccatgtcccatggtgggcactgagattggggtgaggggagcacacttgagggacccttcacttcctcacagcccttgcccctttcctcagggtgcgctgggaagaacccccagcggctgcccatgcccacctcagaagctgttcagtttgggcagaaggaggttattgtggccaccttctgtccacggttttcttttacatcctttccattgcactgttggtgcccacctccccattctaaaagacatggccactggctccacttaaggaaggcactttattgtcatgattaagactgtgaggccagcctataatcccagcactttgagaggccaaggtggaaggatcacttgagcccaggagttcaaggctgtagtgagctacgaccatgccactacactccagcctgggccacagggcgagattaaaaaaaaaaaaaagactgagtttttgtcaaactgagcagttcgagttcaggctgtttcccaatcatgctgtgactttgcacctagttcttttctctgagctttagtttcttcatctgcaaaatggcaattaatgtctgcctgtcagggctggcgtatagtaagtgctcagtaaattacaggctatcttttgaggagcaagaagtagactagct

SEQ ID NO: 48942 - DNA, 1058 bp, Homo sapiens
tcccacagtcatttgctttgggcttgactcaatctcattcaagtgctgagtttcatagaaaggagacatgaggctttatttaagcgtacccaattaccatcacaactttttgtcttctgccttccagagagcaatgattattaaatacttgagtttcttcacatgaaagagacagagtgagcccagaagtgttgttaacattgttaatgtaatgcttactgttaggcagcgtgactaatgacccagcaatccctcttcgctgcttctgtagagagctaaccatttccctaactgcatatggatgacaagagcatcaattcaattgttaggaaaatagatacattaaacagtttgctgggagggtagtttgaatcaactagtgtagaacgtcagggcgttggagtgaatagaacggacaaggccattggttcatcagtgaggttagaggccatattgggatgtagtcataaactggttcagggtaggagagaaaggtaaacaaaagattatttaacatgactttggaatcacagacatcttgagctagaagagaagagtaaaaatctcaaattattccctaattttgccaatgaagaaattgaggcttctagaagtgaagtaacttgtctgaagccctgcagctagagtgtggctttgtgtctcctaagttaggatagcaatataacagtgatataataacgcatgtaataatataaaaccatacaacatactgtatatgttatgattttatatttacatgttacagaatattcaatacattgtatatgcaatccattatgtattgtatcatatataacatatgatgcaataatatatgtaacaatgatacaataataacatattgggatacagtattacaataatgccagtggcttcctatttgccaggcatggcactgaaaggtctgtgtatattaggagcttccatttgggagcagttgacatgtaactaaagtgtcctggaaatcggttttttcttaagtgaaagatcagatgttggaaagggaaaccctaagtgtgacagaatttttctcatga

SEQ ID NO: 48943 - DNA, 1035 bp, Homo sapiens
tttaatagtgtctcagtgcaggacagtctgttgacgcactcagcggccttttatcacagttattgacccaggagaccggccggctggcaggcatgccagagatgacatatgcgagacttcaccaggtctttgcctcctcttgccagaagaagttgcggtagcatttgatcagtagcaagacagttttttcacaactgcatatatgggtgtgtttatgaaaagaaaacaaataactggaagaaaatgcatggaaatattaagagcagttgctgtttgtcaaatcatagatcattttctcttaaaaagaaagtaggtgggatgctaatttactgtcaggttccagcccttctgactttctgtgagtcattcttttgtctaacatgttactttggaaagggtactccttagcaatccttgattggatccaagtttgaacaaaacggctattaaagacattgggggacagttcgggaaatttgaatatgaactccatggtggattataatgaggaactgttgctcatgtgattatgtgtgaaacggtgctgagtcatgtaggagtgtgtgcttttttgaatagtcatgctgaagtatttaagggtgaagagttatgctatctataatttactctctaaaatcataatcactctgtgattttccctgtatacacgttaataaatttgtatgccttttctccaattaaaaacaatactgtaatcccagcactttggaaggccgaggcaggcagatcacatgaggccaggagttcaagaccagcctggccaacatgataaaaccccatctctactaaaaatacaaaaattagccaggcgtgctggtgcacatctgtaatcccagctactcgggaggctgaggcacaagaactgcttgagcccaggaggcggaggttgtagtgagctgaggtcatgccactgcactccagcctgggcaacagagagagcctctgtttcaaaaaagaaaaaatcaaaataaaaaaacaggttcagcaaaatatactgtataaataaatggggac

SEQ ID NO: 48944 - DNA, 1049 bp, Homo sapiens
agctgtgctatgtgtatttaatcctctcaaaagcactggaaggaggtgacagtggcctcattttacagatgagaaaactgaggcccaaggctgggcacggtggctcacgcctgtaatcccagcactttgggaggccaaggtgggcggatcacctgaggtcaggagtttgagaccagcctggccaacatgatgaaaccctgtctctactaaaaatacaaaaattagctgggtgtggtggcccatgcctgtagtcccagctaatcgggaggctcaggcaggagaatcgcttgaacccagaagggggaggttgcagtgagctgagatcgtgccactgtacttcagcctgggtgacagagtgagactcttgtctcaaaaaaaaaaaaaaaagaaagaaagaaaagaagaaaatatagctgtgtgggcaatagtcagatgaactattcccctaactttgccccaattcggtgtatgactatgtacaaatcttaactctttcagatctcaaagaaaagctctgtgtcttagtttcctcctctgtagaatgagaacagtaacagtatccttctcttatcgtgaggatctaatgcaaccacgagagtaaaatacacagaaaggagcctggtactgcatgggctaagtgcctaatgaacatcagcttactactatctctccgggtgacagagtgagactgtctcaaaaaaaaaaaaaaaaaaaaaaaaagccctgaagggtttatgtgacttgtccagctgggttgaagagctaggttgaagccgctgcccagtattgaaacaaacccttataaaatagagaagtagcttaataatagccccaaaaagacatcacagactgaagacttttctagtagtataagtacacgtgaacaagaaaatggtgacacttctgcttccagttcatgcttcttgtcagcagtattgcgagggaaaaacaacagtgatctaatgagccctgacaagagatggccagaagctgagcagttgggaagaaaactctttggtgaatctcactctgaatgtatattgtgcctt

SEQ ID NO: 48945 - DNA, 1023 bp, Homo sapiens
cctctatgactcacatgcagtgattgccaggatatattgttaatagaaaaaaagcaaaatgcaagagtatccttaatacgcttactttttctggaaaaagggagatataaaatacccttatctgctcatttctactggggaaacaacacaggaaagagaaacctgaagcagagaaattggttatgggtgggtagatgggaaaggcatgtcacaggtgaggagcggggaatagaggaaagcaggtgtgtgttggggaggcctgactctgagcataccttcttatgtagttctgactgttagaacatgtgaatgtttcacatacttgaaaaagtaaataaactggacaagattttaaaaaagaagaatgcaaaacaagtaaattgaaatgtatttcaattgaataatgtgaccatgccttaggggataggagagggatagagaactaacactagtaacctttgaacttgacattttgaccctaaacccttaagctagggattataataactgtgaactaatattaaacttcagttggttggctggtttttcacagtggtttggattagtgattctgaaactatgtgtattctaggtttgagcaaatacggaaataaattgtggataatgggagccaagtttcatccctttggagagagaagttataaagatggaaagtagaatgccaaaagtcaaccctcagtgtgttggactgcgattggaagtatcagtatcaatggattgtttttaatgtatggatgtagaaatagatatagatgtgtctgtacacaggagtgcacgtttcccaattctgtctgctgagaaggtctagaagcagtgagaccccagcaacagtgagcacaactatcatccacatattagtttctaaatatcattctcactaataggaactccttggagaagtggctgattccagaacaggagcaggaaaagatgagcctagagcatcttgctgtgccggaaagtaaggaagtgcccaaagaatgatagggacacatcaaagga

SEQ ID NO: 48946 - DNA, 1094 bp, Homo sapiens
tatttgtttaaattcattggcaaggcctatttgtaatgggagattggattagtaataacatttgctcttcacatttggttacaggacctgcactcagggtcctgggaataatcctatcactcatctcagtaataagataacctactaataatacacccactgcccagtgactgtttttattgttattttcttggcctttgattttaagagcataacttatcagctgattaggataatggagaggataattgaatctccagcattgcagcattttgctggggtatgctttgatgcctggattgagtaagagaccagagtctgggttcattctgggctttcttgatttagccaggtgaccttgggctcacctgactttagttcaccgccattttttcccttataattaccaggagttggattaagcaagtcccgaggtgtctttgaactcctctgtatgatacagctctggtccacacacaaccttctctttcctggagatgacacttgttgcctctgtcagtccttctctctgtgcccttacagcccttcgtggaaaactgcctacctcacaccccatggcctttgatcacagaccctgctaaatggaggacaggaaagggaatgagtatgtcctagagaatcaaacaaagctgacagagaaggacagagagatgctgcttagatttctgacagtccctcagtttgtagttcctctcccttggagagctggcagaattcctgatgtttgaatctgtgaggacatttgggtgtcctgccagtgaaaccccacatccttttttactcaacttagttttagtgggttcctgttctttgcagccagttgatcctgatgacatcttctgtatcctcataatgcattgtgtttctccatcgttcctttctcatcagttattacatatttgcgttactctgcttctctaagccgttaactctttgagggcagggattgtgtcttcttcatctttgctcccccagcgctaatggcagtataggaatgtggtcaatggtggtcaaaagaatgaatgactggaccactgctgcttaaaacaaaattaaaacaaggaaactaaccc

SEQ ID NO: 48947 - DNA, 1033 bp, Homo sapiens
agggacacaccacatcgcatgagacttctgacccttctcatctccacatctacagatactctggaggctttatgttagatggcagagttaccccagattctgaaatcttcctgttcatacacttagtaaaagaaacaaaaaagaagttaaaactagtaaaagatgcaccagcattagtcagtcacaggaagggacttaacctctttgagaacgtgcagcaagggaagttatcacagaagattacagttccacagctgtcatttaataccaggaggcagtggagcagtgcaaaatttgggggaaagtttgacccaataattttatactgaaccaagttatgtagaaagatagtagtattctaaaaaaaaaaaaaaaaaaaaaaaaaaaaaaatccatgaactcaaggaaaggcccatgagtctttctttaaaaaactactcagtgacaaaatgcagtgagtcaagggatcaacgaagtcagttcattcattcagcaaatatttattgactgcctgttacgtgccaaaccctgtttgagacactggggatgtaacgattcattagcttacattctgatgagaaatggtgaagtgagtggtctgtttaaataaacagccaaggccaagtaattgtcaggaataatatttcagaaggtaaatacagtcatgcatcattaggctcttccatcattgtgcaaacatatatttacaaaaacctaaatggtagaacccacggcacacctaggctataaggtgtagcctgttactcctaggctacaaacctctacagcatggtaccatagtgagtactaaaggcagtgtaagacaatggtaagtatttatgtatctaaacatacctaagcatagtaaatgtatagtaaaaatactgtatgaaaggtaaaaaaaaatggagctgtgtgcagtggctcatgcctgtaatcccagtacttgggaggctgaggtgggaagattacctgaggccaggaattcaaaaccagcctgggcgacatagcaagaccctgcctctataacaaa

SEQ ID NO: 48948 - DNA, 1056 bp, Homo sapiens
taagggttcctcctcattgctctctgtctatacctgtgctgccctccttcccaagtttaacaccattctgacttctttaaacagttaatattgcctgtctttgaacttcatttaaacggaatcatgcagtgtcatttttttgtatgagcttcttttcactcaacatcatatgtgttagattcatcctgttgtcctttttctgttgcagtgtagtcttcctttgaatatgccacatttgattcatccacttggttcgttcaacctgttgggttcttttgtattagaagccctagtaggtgagtgcaaaggctcactcagtgatgtggaatgagaaatgtgggcacatcagtccatttcctgtcagtgtgcacactcctctgggagggccagatgcccgagaagcgttccttcgcctgtcctgctcaccccttgtaccttcttctgattacatcctcagttacaaacagcattcttttctagtccaagggagtgttggcatatatgagttgattgtttacctttgctcaaggtctcatttgctgtttggttagcaaatatttattgtacctactctgtgtcaggcatgtttctaggccccaaggatataaacatgggcaggacagacattgtcccatctttgttaagcttttcatttcgggggtgggaggagaccaaacaagcacccctcaacaaattaataaattaacgccataatttgtagttatgcttagtgctaggaagggactacagagtggggtaaggtatgggagtgggggatactgttaaatagggtgatcaaagagggcttctctgaggagccaatatgaggcagagacttgacgaatgaggaggagaaagaccagtgaagagccggggggatcccaaggggtgactgctctggggatcctttctctagctggtggacgttcttatgccaccacttccatgattttcaggctttcttcacagttcacacttgcttccaggataggaggaatgtaaccagccagcctcgacaagtagcttgtgtctgttgcttgcatgcacaggggccat

SEQ ID NO: 48949 - DNA, 1035 bp, Homo sapiens
tgcttactgggaagtagcctttgtttatttcagtgatatttctcgagtgcttagaaggatgcctggcggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaagaaggatgcctggcacattttagcgattggcccataaatatttgctgaatgaatgaatgaatgaatgagagtgtagccttggtgaagctgctttctctttggggccttaaaaaaaaaaagtagaatagcagcttgtactgctgtagatgacatacaccctcccaattgtaacttctgttgattccttgcatattggttgcgtcaatgcatcacaaatccaccctcacgcaccctaggatgtgagattcgtggggcaggcagaattcagctggtgttggggaggcagatgacatatcctgcattgctagatctagagatctaggtgcagctcctgtctggggtcgggacatgttgtgtgtcagccaaagctcatgtgtcagaaacacagcacttttcccagtctacagctgcccggtgaaagcctgactgttttgcccactttcatttggtgatgtttccagagcctctttgcaatgccattgtcatttcccatcaccagcagggtagctccggttttctgtcattgccaccgaagccagcccaagcccattgttgctgtggatttgtttgcatattgcacagccatctgttctctttaccatccaagctttagattttgaaatatgaattaccaaccgctccaaggatttcaatggcttactgtt

SEQ ID NO: 48950 - DNA, 1028 bp, Homo sapiens
gtgggcggcctggctgccggtagagcacccacccagggaagaggtgaagtcggcctcgtcttcaccttctgttcgtgttgccccttaggacagagcatctcatggttactctctccatctctgtctccttctccctctccctctgggagtttctgatgcaagatcactgaaaaagcgctgggagtgagaagtaagaagcgtaagagaaagaaagtttatcatgcatttataaatgagcaaacactgtgcaaggtgcttgacacaattgctgaacctagaagcaactccatgacgtatgcattattgttcctcctttaatgaggagaaaacagtctagagagttaggtggcccatgtcaggtccctcagccaccaggcagtggagccaggcttgtgtctgcccccaaacttcagagtacttctcccttccctcctcccctccctatttctttcccatctaccctttgtccctctgtgactttttttctcttttcctttgttatctcatgagggactttaaaaaacatctcaaattatcaaagtaacacatttattatataaattttggagaatatagcaaagatcagcaagaagacatccctgccagttgacacagttgactacggtgtatgagtctcatttcccttcacggtttgtcagcactgggtatggagatgagaagacagtctttgccagttgccctgaaggaaggtgggacctgcatgtcatcttttgcacattgtaagttcatgccattgccctttctgcattgcttggtgtggcatttttttcttattgatatccacgctccttccacctctactatactgtagagctttggttcttttgccctaagaacctttttcctggatcataaattccattaccattaggaattccttattaaatcagttaatgtgagttttaattgaaaattatttttttcagtttactcttttctgaagcatatattttcattttatctctgtaatagtggaattagaagggttttttcttttttaaattaca

SEQ ID NO: 48951 - DNA, 1080 bp, Homo sapiens
ctcctgaactgttcttattagaatccagttgcttaatgactaagttactgcaaagttcacctctcacatctatctctgaaggtgctcttttctgtttttgcatcatggaactaacagggttggaatcgttttacattgcaacgcagagcctttcctttagggactctgtcctctattaagggtaaactataaggctcaggggagaggcaccatgtccatcttgttccttgctgggagtccccagcaactagcaaggcgcctggtacactgtaatcattcagtgaagattcactgagagaatgaaagaataaatgaatcgaagcgttttctgttgaatttttaatttacaacccctttcgtggtttgcttgcttgtatttttgatgaagtacagtgagggcatttccattttcagccattactgagaaagccagttgtggtgcttggatgggaggcaatttggagaccttatgatggaggccagggctgggggtcatttggaaggccaaggtgaggtcattgggtgaaccaatgataagctctttgaaggctgattgtagcagttttatccacatcatctgtcacctggtgtgcccttctaatgggacttggtggaagttttttggagttgcctgagtcaggctaatttgagctgctgcacctgatgtcaggtgttctgtggcggctgtcattttggcagcagtgtgaaaactgtctgggaagaggagagtcaattccaccagcctcttagggttatcctactttgtgagttacgtataaccgatttctacttgtgttttccttcccaccaggcccacccctgactcattcttctctccatatagctgctacatgttcagggaatacagattccttcagaatataataggagagaaaatcacttaaatgcccctcacaatttaatcatcatgactttaggattgagcacccttctgaattgtccttttattggcaaaggtgttctttcacctaaatctaaccttcgtagcaccccatcactcaaaatgaacttgctagcgtagtgagtttggctgtagtatagactgccctggttagcctt

SEQ ID NO: 48952 - DNA, 1046 bp, Homo sapiens
cttttgaaacttcactcgttccagttggtacaagtatttgccaaagccatttcctatgttcaccgtggcccctcctgatgtggctgtcagcgcagcgttgttgaacagggctattctttttacaaggtgtgaagtgtggctcttcgcttcgtctttgccatggcattaaaagaaagttccctgtcttctttcaatattagttatttcaaatgaatatgtgctacttaaaagcttgttttgtttctttgtatataatttgccttggatttattgtgcacagtttgttgagttgtatgtttttgtgaattatcaggagtaaatttgacaagtacatgtgaataacctcctgtaaatgaattttataacaaaaatgtactgaactattttttaaagttgtgcagattagcaattttttgctatagctttgacttttctatgctgtgaattaatagctgcgatttggcaaacagccctgttgtctttgttaaaccctaaattttaagaggaaatggcagaattaaaagcagaaacaagaagatggacatggattagaggttatgtattatgaagtaaactacaaggtactaacatcatttcgtctgccatttggtttgctttatgctgaaattacttggtggggatttgtgcaattcagatataaaaagtttcattatccagcccggccctccttcctagctccttttggaatcttctctgtacagtaatgaggtgcattgaggccagctgtgctgtttagttacagactgaagtttggtccaacagaaatatgtgctgatcattaggctggaattggggtggaggtgagataggaggaacagatgaacagtgacccgtgaaaggagctgccagaagcactggtggagggacagggtagaattgcccttgccaggggtaattgctgatggttatggaagtggaacacactttataaaacaataaacttcaggaaatgtagtcagcttccccacacttgtgcctgttaaaaggcacttgacctccgcctctgtgtctccttctgtacccag

SEQ ID NO: 48953 - DNA, 1417 bp, Homo sapiens
attggagtattttggatttttggattagggatggtcaacacataagtcgagtctgtttccttcactggaaattaagtcctgtgagacttcatcttattcactctagtggtcttagcacttcaaattatagatgcttagtacatattagatggatgaatgaagaattttgtcttcaaaaggcttgtttacagtggcattcaatatgtctgtctgtgagggtgtacccccagaaataattgttaaaatctgtgttacatttcctttattactggtttttttgggtggcgtcttgtagcatcaaaatagcatcagttgtctttcacaagatcatatctctttcattagcagtatatgagtagaaaagacctccacatatattcaagattcatggcattttggccaggtgtggtggctcattcctgttatcccagctactcaggaggccagagacatgagaatcgcttgaacctgggaggtgaaggatgcagtgagctgagatcacgccactgcactccagcctgggtgacagagcgagactgtgtctccaaaaaaaaaaaaaaaaaaaaaaaaaaaaaaaaaagattcatggcattttgaggctcagagtcagaaacaccttttttctctgaagctgtggttggtaatcttatgctacctgaacgttgccatatacgtattagatctcagtaattgtgtttataatagtgggaaagatataaatgaattcttggaaactgttgctttattttgcccctcacagaaagcacaggagtatggctacgaccagtcaatgatggctcgcttctgcagactgctggaagagaatgtagaacacaacatgatcagcaggctgcccattctacagctcactgttcagtacaggatgcatccagacatatgcctcttcccttctaattatgtttataacagaaacttaaaaacaaataggtgagttccccttattgtttgtgaccttattttgttgtagtttagctacttatgaagaatagacattttactgtcgtcttaggtcttgtcataaaaagcataaatcatgaagggttaataattttgtcctgttataatagccatcatgttgaatacagcaaagcacataaaaaagaaaaggggaaaaagtcacctatatttatactacccagaaataatcactggtaacattttggtatatccactttcagcagtcctttttttttttttttttttttttgaagacagggtctcattctgtcactcacacaggatgagtgcagtggcacacagtcctggctcactgcagcttcgacctcccaggctcaatcaatccacctgcctcagcctcctgagtagctgggactacactcagtcaccaccatgcctggctaatttttgtatttttctttttgtagaaacggggttt

SEQ ID NO: 48954 - DNA, 1034 bp, Homo sapiens
tccaagctatgatctccacactatttattgaaataaatagtgaaatggtgaaaggagagccgtgtgtcatacacctaatgtataggaatggcggtttaggtaaattttctttgtgctgaagcagtataaacttaactactgatttattttttaacttatcagagagcagctgtggggagtgggcctaactaggagctggcatatctggccacattccagtgcttcaaaggagtatctttctccttgagcacagtgtttatagataggagagcaggtcacattctggtcatgggaacatgatggcaattagaaggctttactcctcagaggcctcttgtggctttctacaacttactgttccatatttttatggctggtttatgcaggcaccccacaagccctttccccaacatgagagaactgcttcgtttattttatctcatcatttttcttgaaactattttgctatggaatgtcctactgaacatagtttgaaaatgttactgtaatagaatctcaactctgtagtgtactgtttagatggccttgctaacctttattaggtagaaatgataactacttgccttataggattgttaggaacaatatctgaaataatgtataagaagtttgtggtgtagtccctggtgtctggttaattggaagttcatgtttgctcccttctctgattattaacatatttacttagaaatatagatactatgtatagagacaggattgatcagcagtgtccttattagtccttaactgtgattcttatcaacaggaaactgtggagatataaatttagtacgactgggtccagaaaagtctattaatagtgaggttctaaagttcagtttggacagccaagtaaaccacagaatgagtaagtactgaatgtggtatatactagtgttttctctgttttgtttggtggaaaatgacttgggcactaaaggtaatttgaagcctccagaattagtctggctttgggaactaattttccttctcattgtgttgtatatgtgtgt

SEQ ID NO: 48955 - DNA, 1040 bp, Homo sapiens
aagggtggcagagggagggaaggttatgggaaataaaaagaggaaaaaaccactatcttatgtgaaacaaatcgtaaggactagaatgatggtcttcaggcttcacggtaggtcacgtagaatgctgtgaatgctgggctgcattttggttggattgtggttttttgttttttttttttgagacagtgtctcgctgtcatccaggttagggtacagtggcacgatcttgactcacagcaacctctgcctcccaggtcaagtgattctcctgcctcagcctcccgagtacctccctagtggctgggattacaggcgtacaccaccacccacagctaatttttgtatttttagtagagatggggtttcgccatgttggccaggctggtctcgagctcctgacctcaagtgatccgcccgcctcggcctcccgaagtgctgggattacaggcgtgagccactgtgcctggcttggattgagtattcattaaagtaagtggatgataaagtaaggctcagagcagttatgacaaatttttttgctggagtaattttaaatatcagtgttagatgtagatgcttttatttatttttaactttattacgagaactttcaaaaatacatggaagtaaagacaaactttaaagctatgtaatagagctcacccatattttttgtgtgtttgtttggtatgtatatgtggcaaattgtagaaccagaggaaggggcattcagacgaaaactccaatgccaaaatcaaacaaaaccgtgtcctcgtgtgtgcaccttccaatgcagctgttgatgaactcatgaaaaaaattatccttgaattcaaagaaaaatgtaaagacaagaagaatcctttaggtatgatacttttgtggattttaaatttgtttttgttttcagtgttaagtgtaggcaactttgaatgacaaaggaaagagcaggccagtcctggtaatagcttctacttgaatctgtggcttgtgagttcatttagcaagtatttcattgaacatttaccctgtgccagggc

SEQ ID NO: 48956 - DNA, 1056 bp, Homo sapiens
cacaattacaagttcagtgacacccttttctgcaagtgtagtgaagtccagagtttgttccacttttgagggtcttgcaggaccctaaattttctccccttttggttctacctacagtatgcagttataaaagggtacttctcccttcttctcttgtccctcagaagctttgagtttcaagtactgccagttcaaaccccatggaccattaataccctgtgctgtatgctgtattctgatttttgtcagggtgctgcattagtgttttcacacttgagctcgtcttacccttctcctggtagatttggagctggctgaggctcctgagctctctttttttgagacggagtcttgctctgttgccccagcctggagtgcagtggctgcaacctccgcctcccgggttcaagcaattctcctgcctcagcctcccaagtagctgggtttacaggcgccccaccatgcctgactaatttttgtatttttagtagaaacagggtttcaccatgttgggcaggctggtctcgaacttctgatctcaggtgaaccacccgcctcggcctcccaaagtgctgggattacagacgtgagctactgcgcccatgtggtgtttttaattttggtgattcagacgggtgtgtagtagtatgtcattgtggttttaatttacttttctagaatggctaacaatgttgagcatcttttcacagacttactggcaatgtacatatccccttcatgtatcttccatttttagttggattgtttgtcctcttatttttccttatttttcagttctttatatattctggagacaagttatttattatatttatatattgaaaatatttactcctaatctgtggaatgccttttaattttcctaacagtatcttttgaagagcaaaagttttgattttgatggcatcccatcaaaatgctttttgtatcctaagaagcatttacctaacccacggtcacagttttctcctatttttttttttctaaattttatggtttaatttttgtgtttatgttgatgaccatttcaatttt

SEQ ID NO: 48957 - DNA, 1050 bp, Homo sapiens
agtgaaacagctgttgttttaataatgtaatattttggccaggcacagtggctcacgcctgtaatcccaacacttgggaaggccacagtaggcggatcatcacttgaggtcaggagtttgagaccagcctggccaactttggtgaaaccctgtctctactaaaaatacaaaaattagccgggcgtggtggcacgtgcctgtaatcccagctactcaggaggctgaggcaggagaattgcttgaacccgggaggtggcggttgcagtgagctgagatcgtgccactgtactccagcctgggcaacagagcaagaccctgtctccaaaaaaaaaaaaaaaaaaaaaaacacaataaaataataataataataataattttttttaaagagaattttcttggggtcacacacacaaaaaagaaacctcattataaccaaacagtgtatttagtctatgtggaagtatttttatcaaaacataatattcaactatttgatctgaaaaatgttaaattactaaattattaggaacctccagttttgtagaataatctattcttagttactgggaaaaaagagaactcagacctcctttgaagatgaggcctaactggatatctgtcgttcatgtctggagtgggaagaaaaggaacatagtttgcttctttgaagtgatagtgctttatgagattgttacattattaccactgacctttaatacttggaaagctagccgggcttggtggctcacatctgtaatcccagcactttgggaggccgaggtgggtagatcacctcaggtcaggagtttgagaccagctggccagcatggtgaaacgctgtctctactaaaaatacaaaatgtgggccgggcacggtggctcatgcctgtaatcccagcactttgggaggctgaggcaggtggatcacctgaggtcaggagttcaagaccagcctgaccatggagaaactctgtctctactaaaaatacaaaattagccaggcgtggtggtgggcgcctgtaatcccagctacttgggaggctgaggcag

SEQ ID NO: 48958 - DNA, 1055 bp, Homo sapiens
ttttaaaggtgataaaggaagatgtttagtcttgttcaaaatggagagcgctatgttcatggatgtgatagcttcacattgtaaagatgtgacttctttctgaattcatttataaatttgatgtagttcaagttaaaatcccagcaggattgttttgaggtgattgataggcttattttataatttgtaaggaaaagcaaaatctattataataaagtcactttgaaaagaacagcataactagggcatggggggaatgatagttgctttatctgctacgaagctgtttcaaagccatagtaatagacacatacgagagtggcacggggcaggcggatacccggagaaacagtgggagaccctttggctcctaagaaggaactccttcttgcatatgtgtcaatcttagataaaacgagataaataggacatcacaaatcagtggggaaaggatggatcgttagaggaaactggcctgcttcattggggaaaaagcaaattaggctaagattcgtactttatagcacataaactttggttaaatcacatatgtttggaaagtaaaactaaacgaagaaaatatcaaaatgtcagtttaggtgatgaaggtaatcataaaaacataaaaagcattagccacattaatggattaatgaatattaatggattttattctgtcaaagttaatgtctttttagtgaaggactctatatttggagttaacagatgtgaagaagagagttttaaaacattcctaaactggcaagagattagtagctaaaacccacaaagcacttttgtaaatcgacagcaaaaaacagggaaatcagtagaagatggacaacaaatagtttgcagaaaacttggtggtaataagtatatgaagtgttactgaaaggaggaaaggaagttaaaataacaggtgagcaaaagtttgtgatcctttatgatctagcagtcttattcctgcgtagcctcgtcagaagaacatatacacgcctgtctatgagggttctatgtcttaggatgtcatttataggatatagagttggagc

SEQ ID NO: 48959 - DNA, 2411 bp, Homo sapiens
aacttgcttatgtgcagctgattagaagtctccttaaagaaggttatcagcttgggcagcagtctctttgcaagcgattctgggataagctcaacttattccttagaggaaatttatctctaggttggcagttgactagtcaggaaacccatgagctacaaagttgcttaaagcaaattattagaaacataaaattcaaagcacctccatgtaacacttttgtggatctgacttctgcatgtaaaatctctcctgcatcttataataaagaagaaagtgaacaaatggggaagacgtctagaaaagatatgcattgtttggaagcttccagcccaacattttctaaagaaccaatgaaagtgcaagacagtgtattgatcaaagcagataacactatagaaggtgacaataatgagcaaaattatataaaggatgtgaaactagaggaccatctcttagctgggtcatgcttaaagcagagtagtaaaaacatttttactgaaagagctgaagatcaaattaaaataagtacaaggaagcagaagtctgtaaaagagatctcttcatatacaccaaaggactgtacttcaagaaatggtccagaaaggggatgtgacagaggaataatagtatcaacacgtttgttgactgattctagcactgatgctttggaaaaagtgtccacatcgaatgaagatttctctttaaaggatgatgctcttgctaaaacctcaaaacgaaaaactaaggtacagaaagatgaaatctgtgcaaagttatcacatgtaataaagaagcaacacaggaagagtactttggtcgataatactatcaatttagatgaaaatttgactgtatctaacattgagagtttctattcaaggaaagatacaggagttcagaaaggagatggtttcatacacaatctttctttagaccctagtggtgttctggatgataagaatggagaacaaaaatctcaaaacaatgtattgccaaaagagaaacaattaaagaatgaagaattagttattttctctttccatgaaaacaattgtaaaatacaggaatttcatgttgatggtaaagaattgatcccttttacagaaatgaccaatgcttcagagaagaaatcatctccctttaaagatcttatgactgtacctgaatcaagagatgaggagatgagtaatagtaccagtgtgatttattctaacttgacaagagaacaggcccctgacatcagtcctaaatctgacaccttaacggattctcagatagacagagaccttcacaaattatctttactagctcaagccagtgttattacgttcccatccgattcacctcagaactcatcgcagctgcaaaggaaagtaaaagaagataaaagatgtttcacagctaaccaaaataatgttggagatacctcccgtggacaggttattattatttcagattctgatgatgatgatgatgaaagaatcctgagtcttgagaaactcactaaacaggacaaaatatgccttgagagggaacatccagagcagcacgtttcaacagttaatagtaaggaggaaaagaatccagtaaaggaagaaaagacagagactctttttcagtttgaggaatctgattctcagtgttttgagtttgaaagttcatctgaagtgttttcagtttggcaagatcatccagacgataataattcagttcaagatggtgagaaaaaatgtttggctcctatagccaatactacaaatggtcagggttgtacagattatgtatctgaagttgttaaaaaaggagcagagggcattgaagaacacacaagaccacggagtatttctgttgaagaattttgtgaaattgaagtaaaaaagcctaagagaaaacgatctgaaaaaccaatggctgaagatcctgtgaggccttcatcttctgtcagaaatgagggccagtctgatactaataagagagatcttgtgggaaatgattttaaaagtattgatagaaggacttcaactcccaattcacgtattcagagagccactacggtttcacaaaagaagtcttcaaagctttgtacttgtacagaacccatcaggaaagttccagtttctaagacccctaagaaaactcattcagatgccaaaaaaggacagaatagaagttcaaattacctaagttgtagaacaactcctgctatagtgccgccaaagaaatttcgtcagtgtcctgagccaacttcaacagctgagaaacttggcctgaaaaagggtcctcgtaaggcatatgagttgtcccagcggtctttggattatgtagctcaattacgtgatcatggcaaaactgttggagtagttgatacccgaaaaaagactaaattaatttctcctcagaacctgtct

SEQ ID NO: 48960 - DNA, 1029 bp, Homo sapiens
gtatgattataggaatatgaaaaataaaaatggaaataaacagtagatcaatatcttttaagttcttgactgaggattttgaattttcttggaagacattaagtatccattgaaggtctttgagtagggcggtatcttgctactgcatatttgatagagaagcaggaggttggatgaaaagtagagaacagcaaagccatgttgagatacagatggatgaagagtgtatctttgccttattccttagctaaagaatttagtcatttacactagatgcgtgacacaaaattcaggatgatgctgaaagagaatttcttgtattatgggcttcatgtagatctgtaaataccaagtttctttctctttcctttatttttttcctcttcttttctgttagttattggaggatgggactacaaagttttggcaggggttgaggagctgaattagaaaaggttgtttctggtatggcaaacagggtgtgaaaagattgtgcttacctagactgttttcttgcccattaagtaatttgtttgccactaaatttttttttttttttacagacgtatcatagtattgcttgcaaaaaatcttgaaaatgtggctgcttttgaaaccctctgtgtgtctgaggactggtggcggcactgctttaaattatttgctccttggcttttagttgggttgctactcaccagataaagaatatgcttaattctcaatatattgtagtatgtttttctaactgtttagtaattcaacgattgtgccattgtatttcagatgatagtgtggatcctttctggccagcgttacactgttttatggtgattctggatcgccttggatctaaggtctggggtcaacttatggatcctattgtggcatttcaaaccattatcaacaacgcaagctacaatagagagatccgacatatacggaacagctctgtaaggttagttcagctaatgtcaggatttaaacatcatctctataagaaagtgtgttccagctagattacttaacaag

SEQ ID NO: 48961 - DNA, 1032 bp, Homo sapiens
gtagctgggactacaggcgtgcaccaccacgcccagctaatttttttgtatttttagtagagacggggtttcaccacgttggtcaggctggtcttgaactcttgatctcaggtgatctgcctgccttggcctcccaaagtgctgggattacaggcatgagacttttaaatcagaaaggacctttataatttaattcaataccttcctttcatagaagaagggaagttaatctactttttcatgatgaaaaagttggtggtaggatgaacatcagaacctctgggagacccatttgtaatgacattgtggttaacattgtggggtaagccttctctgtcccatggcctccctttgcctgcctctttgtttctctgtggttctctaatacagtaactgccagccacatgtgattattaaaataaatttaagtcaattaaaattaaaaatgcagttatttggtcccactagtcatatttcaaggctcaatggccacacgtgcctgtactctatcctgtactgtattgaacaatgcagagacagaagatttccatcatcacagaacattctcttggatatgctgctccagatagtctagataatgaggcctaaaacttgtagtcatgtttattattagatcctgacctccttttgctgatgcttgtatcatgctaatcatgaaggatctgtaattaaataagtgcttctaatctttaggaagtaatgaattaataaagaccaagtataccagatcctatgagaaaacataatgagtataattttttcccctcattctcttcatgcaacttgaatgttgtatataaactcatttgtgggagattctaatataaatatattaatgttattcttttgttgatagggcgtgtgtgtgtgtgtgtgtgtgtgtgtgtgtgtgtgtgtgtgtatatatatttttttttttcttttttttttttttctttttgagaccaagtctttctctctcacccaggctggagtgcagtggtgcgatcttggctaactgcagcctctgcc

SEQ ID NO: 48962 - DNA, 1032 bp, Homo sapiens
gcagttcgtgcccgtcaggcggggacttttctcagaaccagtgttggtgacctcctgtctgtgtctcctctttcctaaaaggtttcctttcagaagacagtcctgaccgggttttctgtttagcacaggggctcacacactccggccacacagctagtgccttgcagccagttcttcaagtttccaagaactagaggaaaatcttaaattgtttttttttttaattttgtgaactctagctatctttttttcttttttggaaatctcttgatttttaaatattcatccaaattgttattgaggggaaaatgtaacattctgtggccagaccaaaagcacagccaaacagctgccagtgtgacgctccttacttagcgtgaccgtgaatgtctctagtgaagaagggtgaaccgttgatactttggggcatccgccacagataactggcttcagaaattctcaggtgccttcatcaagtactgtgttggtatcagtgtagctatttatattgttacactatgaactcttggccaagagacatgtacataacataaaagccatttggctggcttttcttcccccattaaatgtttgggaacctcacagtttgatgcgggagacgttctcagaaacaggatgaacaactgttttgaaataaataaataaaacattgctttaagaaaggacttattgaataatttcaggctttagttcttaaaaagaatccatgaccgtgttagtaatttcattttaatatgcacataattgtgtttgttttatgtctatataattgagatgcacattattttctgaaaagtacccgatttatcatttcatttttaatattgtgtttgaaagcaaatagactagctactataagaccatctttttatatctacagaaagaaatcgtggtgcttggagtaagtctgaaacccggaaactaatcaaggctgtcgaagaagtgattctgaagaagatgtctccccaggagttaaaagaggtggattccaaactccaagaaaatcctgaa

SEQ ID NO: 48963 - DNA, 1049 bp, Homo sapiens
atcacagactgagtcaactccaagatctcatcttgctttaatattctagtagcctaagtgagagccattttaagaaaagtttaaggccaggcgtggtggctcatgcctgtaatcccagcactttgggaggccaaggtgggtgagtcacttgaggccaggagttcgagaccagcctagccaacatggcgaaaccctgtctctactaaaaatacaaaagttagccgggcgtggtggcgcgtacctgtagtcccagctactctggaggctgaggcaggagaatcgcttgaaccgggaggcagaagttgcagtgagctgagatcgcaccattgcactccagcctggcgacagagcaagcctctgtctcacgaaaaaaaagaaggaaaaattttaaagttatgaggtcaagtgatgtgttaatgttagtcaacccaattttctaaccccttaggttagaacctgcaaatgaagaacacaatgtggaaacagctgaagattccgaaataagatacttatctgcagattcaggagatgccgatgattcagatgcggatttgggttctgccgtgaaacagcttcaggagttcattcctaacatcaaggacagggccaccagcacaatcaagcggatgtaccgggacgacttggaacggtttaaggaatttaaagcacaaggtgagcttgtggggccttagtgtttgttgaacttcctgtatgcagagctagcacctaactttcttttatggatgattcagatttatagatcgacaagaagcattctttctcctccttcacctctatctcctaccagaattgtccaagctgtaaaattagcaaaataaagtgcacttgcttttcctcttcttgcccagtttctggtaaaggtggccaggaagaatggggctaaagagaccagataattaattcccactaagaagagaagggacgagaggttaattggttgagacactggaaatgatacaacagttatataaaattaaaatgctgtcaaattaaaatcaactttaatgaggtatcgtttctttctccaa

SEQ ID NO: 48964 - DNA, 1063 bp, Homo sapiens
ccttcacatctgattacccttgacagctgattaagttcctcacctgcacccctgatatctgatgaccttggcctgcctttagcaaggatcttcctgccttgatgtctcctcttagtaattttccatccactgaccccgcccctcccttggctcctcagctaaacatccccacttctgttgtatctggaactgaactcagttctatactgaagcctctccccttttgcaatagtattgaataaaatgtctttaccacctttaatcagtgtctggctctggttccctttgacaacgatttccagccaaggagcacttaccctaggcattttgtatgctccaccccttcccaacaggaaaatggatactagtattattcccatcttacagatgagaagggtaaaatcccagagcagcacgggaagcaccgcaaggcagacccgctcagccacaagcctctgtagcagcgaatggccaactgctcccaggtgggacctaatctctaaacaggttgagagacggaatatccaaatggacaatggccaaaccacatataaaagtagaactatgggctgggtgcagtggctcacacctgtaatcccagcactttgggaggccgaggcaggtggatcacctgaggtcaggagtttgccaccagcctggccaacatggtgaagccctgtctctactaaaaatacaaacattagctgggtgtggtggcgtgtgcctgtaatcccaactagtagggaggctgagacaggagaattgcttgaacctgggagatgaatgttgcagtgagccaagatcacgtcactgcactccagcctgggcaacatagcaagactctgtctccaaaaaaaaaaaaaaaaaaagaactatgagccacaatctgcagcagctaggccaggaaaccagcccattttgtacagtaaccagcccaggaagccacctgctatgccagacttgtaggaagtcagactgtggtctctaccaacaggccaggaagccaaagaataaccttgaaacagccaacccagaatgtccaggacttggttaataactccca

SEQ ID NO: 48965 - DNA, 1060 bp, Homo sapiens
tgggaggggccgtagatctggcatctgtccttcctgggttcggatacacctttgtgggggtcggcccatcttcattttaactggacaagccttgtggagaggcagaggcggcagggtggacaggctagaagcccgcttggggggtgtagcagagagttaactttccagccagctatgatttgtaagagagcttaaaggtgggaaagaaaatccttttcttagattcagcagctttcactaatcagctgcatctctgggtgtcactgcttggctggctgctgagatatatttttttccctccatctcctgttctattagggagccaggggcccaggagacccgaagcagggttagtcttccacgaacagaggagtctgatcccagcgttcagagcacaaaagcttgtaaatcaaactgttagcttaatagcttgggccattattctaaagcagtggggctgaaaccaaaagccaaatgaaaatatagtcaatttgttcatactttagtgactgaacgactatgtaatgttggtgggtattggaagtgtacagagacaaggactgtggggggaggggcggatgttccgagggtgggggcgggaggggaatgtggagacccccccgccagccaacagatgcttgggcaagcccccttctaaaatggatgttgggtctctaattataacatagattttataataaagatccaggctccggaagtcagcaggcctcgctgctggggcacagccctgaccttcatgcctgagggaagctgaatatgcaaaaccggacttggccagcagcgtgcgagcgtttggtgagacatcaggaagaactgagctcaaagctggaggtcgaacactgggatgaacacctggggaagaactcaggatctccatcttttaaaaacatttaaaaaaatagccttactggttttggaaaagctgcatctactcattgaaaaaaatgcaaaccatatagaaaagagcatcagagaaaggaaaatcagcttcaccccccacccccccgccccaaagatcaccactgctaccatttgtggg

SEQ ID NO: 48966 - DNA, 1023 bp, Homo sapiens
tttggccttttgcttccaccatggtttttttctatgtgacaccatgcaattaccagctttctgcttcctcgtggaacaaacgcaccctcctccccaccctgctaatgaggcgattagaggatttcacagtgaccctgagcttcctccacacctgggtcacctgcagacagcgggaaccacagggcgtgctttcagtcatgcagtcagggctgacaacaaagaacaggaacccagccagcctctcccgggacgatgctggagacgggcacattcactgctggagctgcccaagcactggaattagtagatgtggctggcctagcacaaaccgctaggtccagatgcggccgtgtgcaacaggagagtaccagctcttcattagctcgtccttgctcagagctcttctagttcatatcatttgagagatcaagaaagaacatgacagtcccccaggtctccccttctgcacgcaggatagttttagtcatcccaaacccctcctgtattacagccgactacctcctctcctcttctaatctaactctactttcattaagttgctttctgcaacaggaaggtgtgtatcccggacccctccacactcttcttcatgatgtcagagcctttccatcttgttataacctgtacgaaatgacttcaagtctttttcagatatctccacgttggtcccaatgttatagctacggtccaaaatgcagagtaatttgttaactacttaatagtcaaaatgagggatacagttgagaaccagcatcccagagcgacagcatgtgacactttgtgcatgtcagttttaagtgctcgtggcggtggcagcagcatctcttttgagggcttacgtgtgttctctgctgagctgagtcctccatgcacattatctcactgaggcctcatccagtccctgtgaccaaggcaggatccgcagtggccagtgtagaactcggagcccggtcatgtgattctgagtcttagagatcctgaagcccaaactctcagccaagg

SEQ ID NO: 48967 - DNA, 1915 bp, Homo sapiens
gagtttgaatccttgcttcccagctgttagctctgcaatctcaggcagattatcttctccccagtctcagttttcccatctgtaaaacatacaattgctgtgagatttaaataaaacgaggtataaagtgccctgtagagttccagacctcatagattcttaggtctagaaactctgtctcatgatctcagccccagctcctaccttgatagacagtagtgaatgcttggatatttttaaggtttggtgattttttttttttttttttttaagaaaagctgagtaagtttgggctttcatgatataactggttaacttagaaagctaaattaaccatcctacgttgtaggtgtcatgttggtgaagacctggcttgctgagccaagtttaacttgaattcagaggaaaaagaaaaactaaactaaattgactgtgttactaattatcacatagatatacacaacccgagagagtattttatgtgtgattcatgtcagtagtaagaagaataaagtagatgctggatacaacttttaaatctgttatgcgtaagaaataacgtgtgtcttaattgctgtcctcaatttgagcagttctctagcatgtgaactaatgccaggcatgtaaatgtgggttcagtagctaggcctttcgttcagatagccagacacctcattacagtgcccctctccttcacccagcgtgattgaagcccatggtaaatgtccctttggcacatacatttttgggcttctgtgaacagaaagaaagcgagtgaagcatctgtaaaatgtatatttcatatttaggtatataaaacatatatagctatgtctgggtgtgtgaatgttcacctacctacaaagagaataaatttgatctttcaactttactgggaagcactcagaaggttctagggaccatgggggtaaaactcagcttggcaataaagtgattaaaacaaaacccttccattttgcttaaaaataccttggaagttggcaatatcaaggtgcaggctttcacaaaaacctcccacctttgctattactttttataataaaaatagtccagcctatttatcttagactcatctgttgcttcttgataggtgtgaaatcttcatcatcaaagtatacacacacccaaccatgtttttcctacaagcgtttttgtcctgtgaaatatacctgtaaacttatcccaacaaaggagccgttgctggcattgcgagatcttaaaataagttcagagccccctgctcatcctttctgatggcctgtgttttccaagatcagtaggatgttagagacaaaggtgcattgcgtgcggatggatggttggaaatgtgtttttctaaactacccatggtccactagttgaagttagcttcattaaccagtactgactctgtgtcttggagggtgggagagccagccctgccaggtatccatgtgccctcaggggtttgacccgctctcattataggagcattttacctgtcgggggctgagatggtgctgcataactctgcccccctctgtcttcagtttaaatttagactgtcctccccagaagacaactgaaaaatacctcattcattctcaagaggggcaattttaaaataaggtatttctggaagcaggggttagggaggagtaagattttttttttcctaagtattgtatatatttttttctgccattaactttttcttatattttactaaaactgaccttatcatttcaaacctgtgaacctagttctatcctgttttttttttccctacgtatttcgcttgtatacacactcacattatatatatgtaattttttttttttttggttgggaagaaaagatgcctcattttgaaacctaaaggggggaataagaaaagccctttgtaatatattgc

SEQ ID NO: 48968 - DNA, 1142 bp, Homo sapiens
gtgttgacctgtgaccagacagatcttcattggtcttggcacacttccgttcttttggaactatcataaattctagttaaggggcttttttggtttcttctttttttttttttttttttttttttttgagacggagtctcgctctgtcgcccatgctggagtgcaatggcgcgatcttggctcactgcaacccctgcctcccaggttcgagtgattcttctgcctcagcctcttgagcagctgggactacaggcacatgccaccacgcccagctaattttttcgtatttttagtagagacagggtttcaccatgttggtcaggctggtctcgaactcctgaccccatgattcacccgccttggtctcccaaagtgctgggattacaggtgtgagccaccgtagccggccttttggtttcttttttaatgttcccccagatacttcattatggctccagggcagctctgtgggatcagcagggagcagatgtggatctgttggaggaggcagtgtagcagagtggctaagagcatggccttagggtcatgttcctcatctgtcaccagtgtgtgaccttgggcagggactggacctctctaagccttagtttcttttcggagaggcagtgtagcagagtggctaagagcacgcctcagggtcacgttcctcatctgtcaccagcctgtgatcggacctttcttttttcttttttcttttttttttctttttttttttttttttgagatggagtctcgctctatcgccaggctggagtacagtggcacgatcttggctcactacaacctctgcctcccaggttcaagcagttctgcctcagcctcccaagtagctgggaatacaggcgcatgccaccatgcccacctaattttcgtatttttagtagagacggggtttcactatgttggccaggatggtctcaatctcttgactttgtgatccgcccgcctcagcctcccaaagtgctgggattacaggcatgagccactgcacccggcctggactggacctttctaagcctcagtttcttcgcacgtaaagttgagataaaatagtgttcttttaaggacgtcagaggattgtgtgggaaatagtcctggagtcccaagtataaaacatagga

SEQ ID NO: 48969 - DNA, 1024 bp, Homo sapiens
tggctcttgcctgtaatcccaacgctttgggaggctgggatggggggatcgcttgagcccaggagtttaagaccagcctgggcagaaagagtctagattagctgggtgtggcggaacttacctctggtcgtccagctactcaggaggtcgaggccagagcatcacttgaacccaggaggttgaggctgcagtgagcagtgattgtgccactgcactccagcctgggcagcagaatgagaccccatctttaaaaaaaaaaaaaaaaaaaaaaaacatcttaggtacagttggagaatttgaatatggactgtttattagaaaatgctattcagcattaaatttctgaggtgtgataatggtggtgtggttatgtagatcagtgtccttttacttaggaggtatgtgttaaagtatttagggttaaattgtcatgatgtttgcaacctactttcagatggttcagaaaaatgtgcttgcatatgtgtgtgtgtgcgtgggcatgcgtagatagaacacagatgggccaaagactggtggtggcagaatctaggtaaaggagttacatctgtatctccttcatctagattgtactagtcttttaacttttctgtaggtttaaatttttctaaataaaaattgtaggggaaatgataagaattcattgttaaagccaaacacaaagagaaaagtaaaaatccccctagatccctctgtccagagataaccacagttggtggttttgtgagcctctatcatggtattggttctccatctgcctatttaatgtgttttgggtgtcgttactcctcctttatttaacttttttgttgaagaaaccagatcatttgtcttttagaataccctacattcaggatttggctaattgtgtcctcacggtgttcaacatgttcctctttcccatacttcctgtaaactagtagttggatctagagacttgattagatttaggttctaggtttcaggttttattttgtttggcgagaatatgtcataagtgatactc

SEQ ID NO: 48970 - DNA, 1048 bp, Homo sapiens
attatgttgacgagttgataagaagtaccaccgaatggccggaaaatggagtttctaagccacctgattttaaggctgacattaggttttctgttggtctccggtggctgtccttgattgtccctggatggagtgcagtcacctttttcccagaaaggaaagatacctgcagcccgccctgggcgccaactgtcccttggcatcctccttggctgtccggcgcgtgcatttctttttcagaagatgcacctaaatcacctgtgctgctttcctccaccttctccgtatttttttccgcttgaagcatactgttctgtctgtgcagttcttaatttcctctcctcctggggaatttccaccgtgccaggaggctaggagacaaaggagatacggctgtgaagagtcacaatgtcagttctgtgtcccaaataaatgtagactttcgtgcttttctctggggtatgctttttaggtaaagtgtatctttttcgttttattttgtttcgttaatggaaagatcatttggagattgtttgctgtttactcagttacgctaactcatgttgccagttttttggcggctccagccaagatctctcgcctctgacagcttctgcactctctccttcctcctctgattacgcagcccaatctgtcacccggacaacgggggcctggaccctgctgatggctttccacacacggcagtaatgacttttggcaggccgggaaggcgtcagaggcgagtgtgctgcgtcccttctcagagagacggcaggccccctctccctgttagtaaaagcactttgtgaggttcttgggtaaataaatgagtcattttaatccaactgacaggctggcacctgagcaagctgccttccatctgtactcctaggtctcatggaggcagccaattgtcaggcccagggccttcaaggcctcaccgttgagtgtctttcagaactgactttagcaattcttttgctcgaattagcttaaaggaataaaatgaagctacatctaagttctaagagcagacagaacagaa

SEQ ID NO: 48971 - DNA, 1035 bp, Homo sapiens
gtgcctggagtgttaatgggaggagagaagagaaaatcagaaaaggccaggtaggaagaggtttgttggttgttgtttccttcttgaatgtgtcctgccttcctattcagtaaggctgggtccttctaaacctgctgagagctttgtctcaggctctgcttcctagtcccggtgcacagggacagattgagtcagtggggagcggtcacctctagacggtgctgttttttaaaatattaaacctacaaacaggtttccttctgatgttgctagtaacagtgctgtcaacttcttaactcccacctacccaatgctctatagcatccctggtttagtatacatccacctgcatgccactcatttttgtggacattaagagtttggggttttgttgtttgcttttacaaaaacaagatcattcacttatataatgctttgtaacttgctttttacaaccgaatatgtttgttcctttattaggatttgtaatgggtgtcagttgaaaatcgttgcaacaagtaaatctcaaattgtcttcattcttttgaaaacatttttattgtattatagcttaataatcagtactcaataatgatgcatgtagtctataactgaggagtaaatatgaaacctgaaacctcaaagcattggttaggattagactcagctgtgaataacaacaataataacaaataacagtggcacaaacaatatacaagttttatttttctttcacatttaagaaatctgacagagccagtccaaggctggcctggtgctccagtgtcggggaccaagctctttctgtctttttgtgccactatgggaggattccatttttaagattacctcatagtcttagatagttgcaggcactccaaccattgcatctaatttcttgccagcgggtacagagatgctcatacctgctccctctgaaggtgcttgtgtgattggcgtgttccctttaccttttatcccattgctaaaacaaacatgactatacttaactgcaagggaagcttgaaaatatat

SEQ ID NO: 48972 - DNA, 1904 bp, Homo sapiens
gtagttaggtttggtttggttttggacatgataaacctgccaagagtcaacaggtcacttgatcatgctgcagtgggtagttctaaggatggaaaggtgacagtattactctcgagaggcaattcagtcctgggcaaaggtattagtacaataagcgttaagggcagagtctaccttgaaaccaattaagcagcttggtattcataaatattgggattggatggcctccatccagaaatcactatgggtgagcatacctgtctcagctgtttggccaatgtgcataacctactcggatccccacctgacactaaccagagtcagcacaggccccgaggagcccgaagtctgctgctgtgcagcatggaattcctttaaaaaggtgcactacagttttagcggggagggggataggaagacgcagagcaaatgagctccggagtccctgcaggtgaataaacacacagatctgcatctgatagaactttgatggattttcaaaaagccgttgacaaggctctgctatacagtctataaaaattgttattatgggattggaagaaacacgtggtcatgaatagaaaaaaaacaaacccaaaggtaggaaggtcaaggtcatttcttagatggagaagttgtgaaagatgtccttggagatgagttttaggaccagcattactaaggcaggtgggcagacagtgacctctctaggtgtgtccacagagtttttcaggagagaaaactgcctgacctttgggactaagctgcggaatcttcttactaagcttgaagagtggagaggcgagaggtgagctactttgtgagccaaagcttatgtgacatggttggggaaacagtccaaactgttctgagaaggtgaactgttacgacccaggacaattagaaaaattcacccaccatgccgcacattactgggtaaaagcagggcagcagggaacaaaactccagactcttgggccgtccccatttgcaacagcacacatagtttctggtatatttgttgggaaagataaaactctagcagttgttgaggggaggatgtataaaatggtcatggggatgaaaggatctctgagaccacagaggctcagactcactgttaagaatagaaaactgggtatgcgtttcatgtagccagcagaactgaagtgtgctgtgacaagccaatgtgaatttctaccaaatagtagagcataccacttgaagaaggaaagaaccgaagagcaaacaaaagttctgcgtaatgagactcaccttttctcgctgaaagcactaagaggtgggaggaggcctgcacaggctggaggagggtttgggcagagcgaagacccggccaggaccttggtgagatggggtgccgcccacctcctgcggatactcttggagagttgttcccccagggggctctgccccacctggagaaggaagctgcctggtgtggagtgactcaaatcagtatacctatctgctgcaccttcactctccagggtacatgctttaaaaccgacccgcaacaagtattggaaaaatgtatccagtctgaagatgtttgtgtatctgtttacatccagagttctgtgacacatgccccccagattgctgcaaagatcccaaggcattgattgcacttgattaagcttttgtctgtaggtgaaagaacaagtttaggtcgaggactggcccctaggctgctgctgtgacccttgtcccatgtggcttgtttgcctgtccgggactcttcgatgtgcccaggggagcgtgttcctgtctcttccatgccgtcctgcagtccttatctgctcgcctgagggaagagtagctgtagctacaagggaagcctgcctggaagagccgagcacctgtgcccatggcttctggtcatg

SEQ ID NO: 48973 - DNA, 1013 bp, Homo sapiens
aagtggttctgctgcccccatagtccctgacatttggcaatgtctggagacattttaggttcatgtttttggtgctgctggtatccagtgggtaggagccagggtgctgccaaatatcctacaatgcacaggcagccccctgcaacaaagaagtatccatcctaaaccctgctctatgtgtatcccatggaactctttcttcataccttgtttacataaatgtcaaaagtttgttcaggtttttgagcgtgattcctccttctttgggaatcactgcacttcatacatcattttgtcaagaacggtgagttttccctagggctttatgccactgggccttggtggtatacctgtccaccttctccaggtgttctgtgggtggtcagtttgatggactgcatttgtgctgtcccctttgcaaagcacagttctgaagtgtgtttctgtctatttttgttgtccttgggtaccatcctccccacctgccattatgtcagggactgtgaacccatgggactggtttattttgccttaacattgaaatagtgtgctcctagctgattccctgtttaatgacgtctatgtgctagttttatgtcgtcggatttttcactttgctcatgttttttggttagctctcaaacagtgagtcggtccagcagcagatggagttcttgaacaggcagctgttggttcttggggaggtcaacgagctctatttggaacaactgcagaacaagcactcagataccacaaaggtatgccagggctcgggagccagaccttagtggggaaagcgtttcagacccagacagtatgtctcccgcatggcatagagaatggcttgatgacttatttcctaaaagacggagcggcagtcccactactccgtggtccagctatacaagcactttccagccaccatgtgagcttgtttctcctattgggttgctttgaagttaactcacactgaaagcacctaatggtagttggtagagagtaggtgtaaagtg

SEQ ID NO: 48974 - DNA, 2391 bp, Homo sapiens
ctatttctttatgtactagaattgtttcagacttgggctggcatggtcccgcttgttctttgctatcagagttccgtggctggcactgagttgacactctgaagtatttaattcagttgattacagtttgcatttcttgactttcattgcattttacaggtggaagagattagaaactcatgatgttgtgatcgagtgtgccaaaatctctctggatcccacagaagcctcatatgaagatggctattctgtgtctcaccaaatctcagcccgctttcctcatcgttcagccgatgtcaccaccagcccttatgctgacacacagaatagctatggtaaaaagtgtctttggtacttatctgttttgcaactttgtctctggaaaacattatttgtctttgttgattttcttttctggagtaagacttagttcagttcctagggatttttcccaaaatatcttaaatttgcatgtccctccattttcttctaattaatttctccttcaagtttaatttagatgtccttggtctgctacctgattgtatgccaacagagttggtgacgtgtctccaacacttaagaaagaaaatgggtttaagtatttgacttccagactctacctcataagggaatctttctgattttcagacatttagagtgaggctcttgtgtctgtagcactgacacagtttgaatgagtcggaacaatttagaattggattcatataaaaatctaggctttatttgtgggttgcagccactgaagttgtcatctgtattgtgcttttttaagttatcttgaggcttaatgagacatcaaaccttattgaactttatttcaaaggagcatttagagaaactctgaagtgttactttgtccccaaggatgtcagttaagtccctcagattttttaggtacagagaattgaatattatcaaatggtctagaggaccatctttttttttttttttttttttttttttttttaaccagaataacctaaaaccacacactaaccccctgtgttcttctcttccattttagggtgtgctacttctaccccttactccacgtctcggctgatgttgttaaatatgccagggcagctacctcagactctgagttccccatcgacacggctgataactgaaccaccacaagtatggtgtcaactagtgtgcctgctctctcctctgctttctggtgaagctgaccctttgggtcagatttagtatgtggttgggaaaatttcacactgctcatttcaggagtcacttttaaggatccatgatattagcaaagaaagttactgttgcctcttagattcatcttgaagtcttgatttacaaaatgcaacttgtttcttgatacgcttttaataagatgcctttttctagatgaaaaagctaaatttaagctgaacactggccatggatataaacctcgtggatgacttagcattcctttgccactgctgatgtactttattaacttcccaggctactctttggagcccatctatggtttgtggtatgaccactcctccaacttctcctggaaatgtcccacctgatctgtcacacccttacagtaaagtctttggtacaactggtatgtatgtcttaggttggatttgattagttggttttggcctgcctttaatggcaggaggagctctcttttagatctaagggaccacttgctgttgtaaacttgtttttgacacttattgcaaatccctggggctttcagaatgtgtaaagtgaacctaaaaacaaaaaagagagagactgatctagatccccagaaagttaactctagcagctttatttatagtaatagttataggctgaaaaaaaatcggcagtttttctaatagttgggctcagtgttcatatatgttctgcccttgtctctaagcaggtggaaaaggaactcctctgggaaccccagcaacctctcctcctccagccccactctgtcattcggatgactacgtgcacatttcactcccccaggccacagtcacaccccccaggaaggtgcgatccagctcgtctgctatccctctgcccaggcacagtgactcacttgcaagcctcactttgagaagcctaattatgccagatagaattctgacctaaaatgcaatgggtttgaatcagaataattgaaaatggactaacaagctgctctcaaggtgtgatctgccgacccctgggtggttccaaaactctgctttggcagaactcttgtggggaacccagcaggtcaaacctactctcttgattttttttttttttttttttttggagacagggtcttgctctgtcgcccagggtggagtgcagtggcacgatcatggctcactgcagccttgacctccc

SEQ ID NO: 48975 - DNA, 1404 bp, Homo sapiens
aataagaaaatgtggttaatattaactgcctgtacctcacagagacatgaaaatatccaatagtatttgttccaggatggcagtaccattggattcatctgctacagcaccatgcaaattgatttttgtgtctgccaagaagggtaactcttttattatccctagaggtgggtcccaaggagtcacattggcagggtattataaaaacatgcatttaattcagaaaaaataggaacagttttaacaacttaatgttttttaaacaaatggattgatgagaatataatctaattaatggattggtgagaatataatctaaatggattgatgagaatataatctaaatggattggtgagaatataatctaaatggattgatgagaatataatctaattttgaggcacatcatttagttcagattgcaaaacacttatcttttccaaaagagtacgttttgttaatcatggataagtcttcagttagactgttaggaaaatgaaatcagggctagttctttctgctgagaatcattatatagtctcatatattctcaattctcctaccaatatattattcttactggatatcttccgtaatgaaaggcttgatgcttgatgtaaaaatcaaaatatatttaaaactttattcccagactcatagattcctattctaataggaataatggatgtcttaacctacatagtagtcttttgattaatatcttgtttcataaatctgaatttcatctacctggcaaacattcatgatttaattatgggtcaggtgagctgctgtagctagctagtcagagctgattgagtatccattgggtgttaagtgtcttcagttagcctgaagttatttatttgacttaatatttaaactgtaggcgtgctgaaaggtttccatatatatatattttaatttactggtctctaaatactgctttgaagtgagcctttaagttgacttgttagtgctatatgaatttctccttcaattatacttctgttgtagttctttaaaaaatagtaagttacttgtcaatgtgcagttttttttttttttaattaacaaaaagtaagtatcttaggatttggttgaatgaatgaaacagagcagtgctcctgtgttttgttgaaaagcagctccttttgttttcatccaactgctatcaatagggcatcctaaggctgcaggacttgggtgtccccaagtcaagtttgaactcgtctcccggatgcctttgcataggtgtgttgtaaatggtcctcactgactcattacagtagagttggggctcagtgttctgttgagtctgtttgaatgttatcccttcagtaatccttagggatagggaaatgagtacgtgagtcaacttgtgatttgtgattctctcagtg

SEQ ID NO: 48976 - DNA, 1032 bp, Homo sapiens
gcagtaatagtgccaagcgcaacagagctgtgtataggaagggtgtagggaagacgggaggtgcttggtctgctgtctttgtacatggacagctctgtgactcatgccgaggctcagtggttgctgtttagtgtattctgtcactgtctgcctcacctctgtcgtaggaattgtaaaataaggtagggatttttgtcttacagctctacattggttcataagtagggtcttgatacaaattgtagactgtcgaaagttaagtattgttctcaagtagggaaagttttctgagtttgatttttcattttcagtgtttttgtgtatacttcatactgttccttttttagaagtccactgtatatgaatttgaacccaaagtcaaatggttaagtgttcagatcattgaggtccccaagctaaatatcaccatcataaaatgtaaattctgggatacaaaagtaaatctcaaattttattaaacatttttcacgatagtaattgtattgcattttagtagtcagattttagaagtttggaattttaatataggaaaaatactttgtgggcactaccggctgctaggttactcctgtggtcactatgtcacatgtgtagtatcatctcaactggcacacagcgtcattggtaacatttttggacaaagcagaattcaggaaagtttctggtagatggttttctggaaggaaccttgtacctgggattcatagcttggcaagcctcaaagatccttactcttcaattactaaaaattgttggccgcctttagcaattattcttattttgaaacaaaaaaaaccccagcttttaatagcatttttcttttttcatggggtactcttgtttatacttttgtcctcatttttaagacatttttggccaggtgtggtggctcacacccgtaatcccagcactttgggaggccaaggtgggaggatcacatgaggtcaggagttcgagaccagcctggccaacatggtaaaaccccatctctacgaaaaatacaaaaattag

SEQ ID NO: 48977 - DNA, 1044 bp, Homo sapiens
caggccggcaaagtggagctgtaaatttcaggaagcattataaaacctaatctttggggagcctttgatttaccgagcaaccacctgtgattcttaaattgaacattcctgagtaaatctggaatatgcaaatgtgaaaactgatttagggttgtgtagggaaatgcacctttaacagtcatgcatcaggcaaatgaggctcctcagaaacagtgaaacattctttgctattgccctagggagctgcagaatcttcctctaaccacctggtgtaaacttaaggggtatttatagaagatgtaaacggaaaatatcctcttactaaagttaatatcttatccaaaacactcttatatcacgtgcctagaagggcagatgatgtaaactttctctgctgcatgcatttcctggtgtcataaacacttggtacgttcctaaattcctggttagaaagcaggtggctaccagccttcttgtttccataaaattagagtgcttcaggtcctgtgactcagttgtcctcttcctcactgggttaagagtaaaaactgatactgctactgttgtggtgtaatatgatgccttctgtgcatgcctggtttcattcgtgagatgaaacttaacagtcttactagggcaaatctaatatatacctctatatgtaatgtttgcagaataatgaacttggtggaaacgagatctgaaaccctagtgctcatgagaaccttgatgtacagatatttggcactatactaggtagacctacatattcggacaccttgtatatatattttggaagaagactgattcttatgtgcaccggaggttgaggaccactggcttcaagtatcattctggctattttcatttattatttatcacagaggtatttcttaaaatagcttgtagccttttatttgtgtagtggtgggtgaattttgggctctgaattagagctgacttgttcttatagctctgtcttcatttgaagtttgtttggctacaggtatgtttatttctgggttccagggccatagtgaacta

SEQ ID NO: 48978 - DNA, 1047 bp, Homo sapiens
caacttaaaaagtgagtgagctttgagccaagaggaagggaccctgtccccaccgaacagtgggagagtacatggggctggggccggagccggggctggctgggcagaaccctggctcccacacctcttgtggttcctgctagagggctggggtctgggggcttcgcctgcaggaagaaagacgaccgagagctgtggaggggtcctggggtggctggggctcggggcagcccccggcgggaactcatcccaccatagcctcatcccagctggccttggctcagtgggccctgatctaggggcccctggcaagaggtggggtgagcctctgctctcacattgcctcacccctcaatagtgagtgctcagtgggcaggctgcaccccaccctctgggagaacaggattagtgggaagatgagacccacacacagctctgagagagtaaggcagctcaccagcactgagctacaagttgaggagccgccagggacctgcagatgcccggcaggaggaccgatccctcatggagtttacattccagcgaggagggggtgctgggagacatgcagagctgtgggcggggcttccttggaggaggggagaggtgttcgccactgaccaggggcctccttggttcttttagctggacagccaagggggcttgggccggggcaggtggccttcagatggacaggggccggctcaggagcccagcctggctcaggggagcccaggcctctgactctgctgccacccacctgtccccagtgccatctcctccatcctgggcacctggctggaccagtactcggaggatttctgtcaacctccggactttccctgcctcaagcagctggtggcctacgtgcagctcaacatgccaggctcagacctggagcgccgtgcccaccttctcctggcccagctggagcactcggaacccattgaggcagagcctgagggtgaggaggactggggtgggtgccagagggtgaatgaggaggggtcggtgctgggccacacgaagaggaggctccagggtctg

SEQ ID NO: 48979 - DNA, 1035 bp, Homo sapiens
tcacctggcaccttcagcatggcacttccctggcctggtgtcttgtaggccttttgcccagggcacgtccacaaacctctcggagatgcaggtgctagaaagctggccctgccaccctcccctgcgaatttgctgtgtgacctgaggaaatccttcctgtctctggcccctcctccacatctgtgccacaaggggctggactctgctccaagcctgagaccatggcagaggcagcgccaggcctgggtgggtcccaacaggccagggttcaaatccctgttctggctgccacgtcctggctcctgacctgggcgagttcctctcaggctgtttccttgtccatcaggcagggcgttaggaggattaaacgtgatgggtgtccaaagggccttgcacccaggaagtgcccgcatgtgctgggcactgtagctggttaaagttggggctgccctgcacccccttgggaccagcccaccttcctcctcagctgccaccagccacgcccctcccgggcctggccctgtgttcacctgactgtcaggggctgggcgtggacagggaccctggatgcccaaggcttgcggctgacctggaggtctggttctccctcctcctgcttgaggcacgattttcccatcagtgagtagcagggcacaggccggcagggagggtttctggagagatgggccggcctttgcggggctcagcactggttggttcccagcctccactttctgaggccagggagcatcctggtgggcaggcaccgcgtgtcgtcccggtctgaggccgcctctgtgggctgccatgcccaggatcaggagtgtggcccacccacaccccgggctggcctcctgtcatcttgatgctttgtctgtgcgctggggatcagggttgggtccacccacctggagctggagggcaggcccgagggcaggagggtcacggacacggacacgaggcccttgcgttccacctcccttgatggggctcatggtccgagctcatgacttgagaagtcctgggctctcacct

SEQ ID NO: 48980 - DNA, 1043 bp, Homo sapiens
ttgcacccttgtggtgtgttgaacatgtttctctgtcccctgtaatcccacaaatggcagttatatgcagaggcctgccttgatttaggtttgggttttgaggagaacactgtgagtggtgctgcgttcctccactggtgacacacgctgtcccaggatggccttgcccttggttagggtgtccccacagcttacaggaggcctcaggagagggtcttgcatgcaggaggcgtcccatgaatgccaaccccagttgctaacagtgtgaggcagagtcaggcccgcccgatctgagggcattgggcaacacatcctgtgcagggaactttatctgtgccttcattaggggggcatgtgtatctgtgtttctgtctctatgtgtgtgtatctgtgtctatgtctctatatctgtgtgtgtgtgtctgtgtctatctcaaacttgttttttccctttttgtggagaatggggtcttgctatgttgcccaggctggtctccaatttctgggctcaagaaatcctgcctctgcctccctaagctctgggttacaggcatgagccaccacacccagcctctgtgtctgtctctatgtctctgagtaggtatgtctctgtctgtgtgtctctatctctgcgtgtgtgtctctgttccaatgtctctgtgtgtgtgtctccgtctctaaatgtgtgtgcctgtgtctgtctctgtgcgtctgtgtctctgtgtctgtctctatgtgtgtgtgtgtgtgcctgtgtctctgtctctatgtgtctctgtgggtctgtgtgtgtgtctgtgtctctgtctctatgtatgtgtctctgtgtgtgtgtgtctgtgtctctgtctctatgtgtgtgtctgtgtgtgcatctctgtgtatctttgtgtctgtgtgtgtgtgtgtctgtgtctctgtctctctgtgtgtctctgtgtgtgcatctctgtgtatctttgtgtctctgtgtgtgtgtgtgtgtctgtgtctctgtctctatgtgtgtgtctctgtgtgtgcatctctgtgtatctttgtgt

SEQ ID NO: 48981 - DNA, 1051 bp, Homo sapiens
catcctcaaactcacctgcaaaacctgcgtcacatatcatgatggtgaaatgatacccgcattggcatggcagtgcgtagtagaaattatcagagggttgttgactctggtttaggcgccaggttggaggcagcagtgatcagcagaaatggaagtcagagtccccagcctaggcctcctacaggggacagaccacccaccccagggacagggtcccagcagcgtcaagtctgtgtgctgcctggaacaaatctacttgtgatccttaatttggaacagagtagaggaaagcaagcagccttgggggccggacttacaccctgccttggcactgacacgctgtgtgacatcaggcaagttgttcgccctctctgggcctcagttttctcagttttacaacagagatgatgactgtggcctcatctttctggcagaggctgtctggaaaagtgctttgtccccattgaggtgtgctaaaggcggcgccagactaggctctagggtacgaaggggtgtcaggagttgatcctgcctgccaggcttctgaacgtggcaagaatttgcctctgggctgcacagtgacaggtgtcagtgatgcccccgtccctgggagtctcctagtcagagccaaagagggaggggatgccaggcataggtgcagcctccaggggcaggatctgtctcctgcacgaccacagcatcactacctagcagagccggctgggcctgaatgtgtgttgagcgacttgacggggcctcaggttcccagaagccagggggaggggagctggagtgtccccccagctggacaccgagtctggccagcagctccctgagtcaagttagcagcaggaaagaggagcaaaagccaggcctcggcctctgctatctgcttcctggacaggatgtggtgccgagtaaacagcttcgcgaggagtcactgctctggctctgagtcacagctcctagcgacagctgcacagtgtttgtaaacaatgggcctcacacccagccagggcctgcccctacctagaaaggtgcctgtgggttg

SEQ ID NO: 48982 - DNA, 1621 bp, Homo sapiens
gactgagggcatcagttcttctgtgactgttggtgggggccctcccttggttcactgccatgtgggtctctctgtagggcaggcagctcacggcatcagaactcacttccccagagtgaggggtgaaggtggggaggaaaacaagagcaaacaagcaagacagaagtcatagttttttgtaaatcttggaagtgacctcacatcacctgtgctgtgttctgttggtgagaagccagtcactaaatccaatcaccctcggaggaaggggatcactcagcaacttatgtaccaggaggcagggatctctggggccagtgtggaggctgcctgggacagtgtctgagaggaggcagtcaggcctgattctaaacataacggaggctgggcgcggtggctcacacctgtaatctcagcattttgggaggccgaggcgggtggatcacctgaggtcaggagttcaacaccagcctggccaacgtggtgaaaccccgtctctacaaaaaagaaatacaaaaattagctgggtgtctcggcaggtgcctataatcccagctactccggaggctgaggcaggaaaatcacttgaacctgggaggtgatgagtgcagtgagccaagatcatgccactgcactccagcctgggcgacggagccagaccctgtctcaataaacaaacgaacaaacaaacaaacaaacatcatgggagccattggaaggtgttcccattggaagatgctcccatatgccacagggggccgatatctgatttttgcttcattttcaacccgttcatggtgcaaatgaggaaaccagaccaagaagggagtgactttccccagatcacagcaccagtgcccagcctgtccgacttgtattccgggctgtgtctcgcccctgtgagaagtttctttcctcacagttgtaaaggccagaggtccaaaatccaggggtcagcaggaccctgcagtctctgaaggcccttttccttcctaatccttccatctctaagtctgtgaggcagctaacaggttttgtagtattgtctcacattagcgtggtgatgtccccaggaagtagacgttagaaccatccccattgtgcaggtcaggagactggggaggccctgaaaggcacaatggctagtttggggtcacagaactggcaagaggcaggagcttggtgacccagatggcttcccctctctgagcctcaggggctgggagcatgagaacacactggttggctgtcccagctcccagggtggctgtgagtacctggaagtgccccttgtctcccctcacacatctgccatcactctccccatttccttaacccccagcactgctgccacttgatttttacgaacatctgaatatgacgaacatacagatttttacgaacatctgaatatgacgaagtagcaaaggtggatattcactcattcatttcgtatctgtctcctgggcccaggccatgccggggcggggggtgggggtaacaagaatccggggagttgccaggggaaggggaagtgctcatctggggagtgcgtgggcacagagagattccagaaggaggtgtcctgtggtcgtggttgattcgtggaggggaggtgtggtga

SEQ ID NO: 48983 - DNA, 1647 bp, Homo sapiens
agccgggcgcacccctgcgccgcgcgcgggcccaggcgagcggcctctgcgagccccgggtcccgccctggggccggcgatgtgccaccgaggctgaggatgatggtagattgccaggtgagtgcgcgccgtccccagcctcgcgtcgcgggtggagggaggaccgtatgccccagcccacacccaccggggggagggagcccggcgccgcgtccacgctgagcgtgcgcttacgcagctccgcgtccaaccccgcccgggacagtagggaaactgaggacaggagaggggcagggactcgcccggggcacacgaagttggcggagtccagagatgaagggagggttccggcctcttaggccaggaagggctcggctcacccttcccgtggggtttgctttgggaatgacagcctctaagatcctggggacccctgcccatctcccatgtgggctcatttgcctgggcttctccgcgcacgtacaggcgcaggcctgcgcatacatgctcacacacacgcagacacacacaccacacacttcctggggctcagagtaggacgggacgctggggaagtgactgggggaaagaagaaagagggcgggggctactctgccacgggcaggggcatccagtacccagcaacatgcctggggccatggcacggggtggggggcaaggggaggacacgccagcttgatgggcggggattctccaaggttcccaggatctgtctgggctggggcagcctggagaggacagattgtggggttctgtgttcaccgctgtgatcacctggaagcaggaaaagaccccttcagtgtggacggggctgtaggaaaggaagcctcaaattcctgctctataaattggaatgtttggcctgggtgactccaagggtcccacaggctcgtagacgtgtctgtcggccttaggtctccactggggatgcccccactacccaccgaggtctgtggaaaatgccttcttcttggaggttcttctgagcaagagaagccgggggggctgaagggctgagggcctggggtggtgcagagcgtggccaagcactggacaactcttgtgggacaagactgtccttgttggagcctcagggttcttatttggaagtggggccagagccgttgccctggttggagtgaggaggcctcacgagtgaactggacaccccaggaccagcagagggaaagaggggagcaaatgaagcttctgaggcgccttgaattacccctggagcctgcaggttctgctcctttgaccccctgggactcaggagagctgctaccttgacaacacccaaacaaaggtgtgtgttttgttttctgggttttctgcctgaggctgctgctgctgtgctagtgccggccaccagggggaggcagtgcccactgtactcattggagcaactggagtcagggagagcccggcagggtccctctgggggaccccggcctctacccaatgcacaccccccattactagcatccctctccacaatgttagctgctcagaggcgggagggggctccaagagcttcctctttcccttcagcaggtgtgcccaagcactcaccctgggttgtgggggggcagcgttgggcttgggtgtggctctgaaagtgaccca

SEQ ID NO: 48984 - DNA, 1018 bp, Homo sapiens
aatgagtgcaggttgaaagaaaacaggtgaattttagtggcatatggatgataaagctgtaaataaaattcttttgatgaaactctccggttacgagacaaagactgtaactgaacaggagctggtgtgactgttaccagacagaggcaactgatgaaaaagccctgtgaaagataggatgtgaggtgagcatgagcttgagctgagagacagacacaacagtatctgaaaagaatacatactctttccatgcatatatggaacatggatggaaactgaccacctactttgtccagaaaagaagtcttaagatatttcaaggaatcagtgtcgttatctgaccgtatcccaatgtcattaaaaaaaatttgagctatttttttttgttttttagatagagtcttgctctgtcactcaggctggagtgcagtggcatttcatatttggaatttttaaaacacacttataaattacctatgagttaaagaattccgaatggctattagaaatatttgggactaaaggataatgaaaatgctacgtattaaaatttgtggaacagggcctggcatggtggctcatgctgtcaatcccagctctttgggaggcgggtggatcacttgagatcaggagttcaaggccagcctggccaacatgataaaaccccatctctattaaaaataaaaaattagctgggtgtggtggtgcaaacctgtagtcccagctgcttgggaggctgaggcgggagaatcacttgaacccaggaggtagaggctgcagtgagccaagatcgagccgctgcactccagcctgggtgacagagcaagactgtctcaaaaagaaaaaatttaagatttgtggaacagagctaaagcagcacaaaaaaacatagcccctaaatgtatgtgcatctacagataaatagtgccatttatacacacatacactgtatgtctgtatttttaaagctaaagaaaaataagcatgcagcttaagttggaacaactcaaagtaaatg

SEQ ID NO: 48985 - DNA, 2782 bp, Homo sapiens
acagctgcgggcatgggaagggctagctgagctcttcacctgcatcctggctgccgtgaggattccccgtgttagaggtggggacgcctgctggaggccgcctggctgatgtagggctatcgggaagtgccagggcctgtgttcccaactgtcgcccccttcaggctaagtctcaggcagggacagacccagaaagaacacagtctgccctcagagagctctttgcagtgtagtgacactggggtttctgcagtcagggaggagggagggtggccaggctgacagctttttgcaagaggagggggaccagcaccagctgggaggcataggctaggacaggcccacgtggaggctgggcaggaagggcctgctgaggtcacacagctgttggtggttgggccagggcggcttcctcctttcagaatgctagggtggctctcaccactggccgcctctccttgccaggcctgccaactcaggggacagatggagcaggagtggagaaagggaaaggcaggtctggggtgtggtcgtgttttcttaactctgcttctgtcttgctctcccctcccctggctttcctctctgcctgctcctgtctctccctggggtttctggtggtggaaaagctcaagcctttgcgaagctaatgacctgcctctgtgcgaagcttacgggaggctggacctcgacacagactctgctgatggcctctcggcccctctgctggcgtccccggagcccagtgctggccccctacaggtggcagcccctgcccactcccatgctggtggccctggccccactgagcacgcctgagcctccggggccacgcttcgttctcaggaacaaaacctgaggcagccctttggatgccctcacagccttgcttctctcagcctaggttcccatttggggacttcaggaccccagagccactaggacttccttgggaagcccgttagcccagggtgggtcccaccaggacagtagggaaacagttgtttccctagccatttccgaatagcccatcattccgagtcatcatctctgtttgctgccttcctggccagccaggtggaagaaagtttccaagctaggtctggcccgttggggatctcagcagtggggcaggagggtgcctgatttcggggagtcctgacccgagcctgttgtcagagttgggaggggctctgagcagtgttgggcaggccgggtctcccatcccgaggccagcgttcctgtgcagagccccatccactggttcttgccctgagccacatatgtctgtgccatgggctgagtgccacgacaggcccgtgtgacagctgctgcccacgcatgtggaagctaggtgggactcattcctaattctgccgttgtaatgagacttgattaaaacaccgccacttttttgcattgctgctctttcttcctcattccttgtcagtccaggaccatccttggtctcccagcagttgtccgagcagcagctcctcagctctgcctggacagcctggcccaaggtcactctctcctcattggcacctggtaggtccccagtattcagtgaatggacctgctgccatcattgcacatccaggcacctgtgcctctgctggcatctcatcctcactgctaccagagccggtgctcctagtgccggtattttagagaggagaggatgtggacttagaaggggtgaggtgtaccacggccacagagctaggaagtgaagtggcaggaatcagaacttgaacctgatggaagtctagacccagtgtcttttggtgccaggctcaccttagaaatgcagaagtcacaacactgggcaggaagtgtggggggagcacagttcgtccacaggaagtatgggggagcactgtgggggagcaccccaccccagttcctccagcaccatccatgtgcttcatcttctcatgggggaggccatcgtctttcccgatgtatgaatgaggtgacagcccaggatccagccttggggacaggtaagaacacagctgacccatcaccacctgaaccagagaaccccacagccaagcagaaggcaccagacagacaggagcttgaggcccagtcctggctctggacctggcttctggggtggcctagggaagttgcttcccctctgagggagaatttccccattgatacgtgtggtgatctgttcccgcactattttagctgtggaaatgccttgtacttaaccactgaggaagaaaaagattacaaccagatggaagcatatatgaagcgagagcccggaaggaactggccagactttgtggtgggatcccacttaccctgttcctaaaatcctgagcgataagacctgccatcagcttcattttctgcttggccaggaccatcattcccatgtgaaaatcaagttatttctccttcttaaagccaagccgctctgctgaccttttttcctctccagctcatggccttggcagcagagctccacggggaagcagctgataaccatttgcagttctctcttgggcctacgtcagacaggttttgtctccatgactctagcaaaactacacctattaaggtcaccagtggcctccacattgctaagccccggcccattctcagtccatgtaactcttttatcccaagctttttattttgagggcagtggaactcatggaagtacttgtcagtttgcctctctgagcacattctccttcgtccatcaccacaaccagaatggatgatgattgcatatcctctggtatctagctgtatt

SEQ ID NO: 48986 - DNA, 1004 bp, Homo sapiens
ccctgtgactgcctttggcttggggacatggcaggtaaagaccggcatctggtgtgcgtaactctgggcccttgaccttgctgccatctgcttggccttatgctctgtcactgtaggtccagcgtcggaagtggaagctgaacctgattgcagagttggagtccagagttctggctgagcctgtccctctgccagccgagtgagtgcatggctgcccccctagggcctgttttacttgagttcaacagcagagccctggcttctgctggccagcttgccccttttggtgggacttttagtcactgccttgacctcaggtgggagctctcattatcagtcatctgttgggcttgctgttgacacctgactgcccttgtgaagctacctgagaccgcctcctgacatatggaggaaagtcttattttgagtcctgggtgtcacccttttttcaggtatagtaaacttatcctccacagggcccaaggccctgtggctgagggcagataatgtaggtctcaccgtgagggtggtcgtttgaaaaagtgccctgaatgatttgtctgctctctccctagaatatgccctacagagataggtatattcagccacattttccattcagggtagcaaacagtatgccagatttggcttgcagatggggttttggcccacatattttttaaaatttcacataaaatattcattgaggagtccagatttttagcctctcttgtaaagttggactctggcagtgcagatccacattcccacatggcatcaaagttcccctttgaagagcacgccctttgcctttctccttcacttgtctggccctggtgggctgtgtagtctgccaccctcaggggattcgttttccagccaaaccttgctcggccactgttcttatctccatgcagcccaatggaactgaaaaatctggagtataggccagtgaaggtcagggggtgctttgaccattccaaggagctgtatatgatgccccg

SEQ ID NO: 48987 - DNA, 1068 bp, Homo sapiens
cccgcgctgcgaaccttgcgggcgtccgtctggagccgcaggctcgggtgctcccgcagaaacgcccgcacgtcgcccggcaactcgctcatggccgacgcgcccgcggagcagcccggcggaagccgctcgcagaacctggagccgggggcggggctctgggcgggactcagcggcgccccggatgcagatgcctcctgcgtcccggaagcgcccgcggggccgggtgcgatggcggcggtggctgcgttgcagctggggctgcgggcggcggggctgggacgggtgagcgccgggtgcggggtgcggggtgcggggtgcggggtgcggggtgcggggcgcggggaggggtcccggagctcagcccgcccgtccgtgtccgcaggccccggccagcgccgcctggaggagcgtcctcagggtctccccgcgcccaggtgagggctgcaggccgggctgtgatccaggcgcctgggcagagccacctgctgtctgccctgcactttgaagggttgtcgtggggattgaaatgaaccaactgccggctgagcggaggctccctgggagtgacaagttccgtattaaaatgctttcagtggaattgtggtcgtgtgccgggcatgtagcgagcgctttgtcctcacaacgcgagaggtagctccttggtcgttcccctgttacagagaaggctcgagagttacttccgaacgtcccatccagctaatgggtggccagcccaggctgaaagcccagggctctgaaagtaaagcgtatctaaccaccgcggcttacgtgttcctctcagtgtgcagcacagggctgttttgccgtgtgtagagtgctgtgcaagcctgccccaggcctgcctttttataaaaaaaaaaaaaaaaatagtatccgcaaggcccctggtgcttttcagcggatggaactcatcctctgagagcttaaaggcactttctgtgtacattcttccctctttacatttacgatgagttgtaaaaatggaaagctgttaagagagctctgtgagccattactgaattgatatatttttctacataacac

SEQ ID NO: 48988 - DNA, 1020 bp, Homo sapiens
agtgaaaacatttagggacacccaaagaatgatgcagtattaaaggggtggtagaagctgctgtttatgataaaagtcatcggtcagaaaatcagcttggattggtgccaagtgttttattgggtaacaccctgggagttttagtagcttgaggcaaggtggaggggcaagaagtccttggggaagctgctggtctgggtgctgctggcctccaagctggcagtgggaagggctagtgagaccacacaggggtagccccagcagcagcaccctgcaagccagcctggccagctgctcagaccagcttgcagagccgcagccgctgtgggcagggggtgtggcaggagctcccagcactggagacccacggactcaacccagttacctcacatggggccttttctgagcaaggtctcgaaagcgcaggccgccctggctgagcagcaccgccctttcccagctgcactcgccctgtggacagccccgacacaccactttcctgaggctgtcgctcactcagattgtccgtttgctatgccgaatgcagccaaaattcctttttacaatttgtgatgccttaccgatttgatcttaatcctgtatttaaagttttctaacactgccttatactgtgtttctctttttgggggagcttaactgcttgttgctccctgtcgtctgcaccatagtaaatgccacaagggtagtcgaacacctctctggcccctagacctatctggggacaggctggctcagcctgtctccagggctgctgcggcccagccccgagcctgcctccctcttggcctctcatccattggctctgcagggcaggggtgaggcaggtttctgctcataagtgcttttggaagtcacctacctttttaacacagccgaactagtcccaacgcgtttgcaaatattcccctggtagcctacttccttacccccgaatattggtaagatcgagcaatggcttcaggacatgggttctcttctcctgtgatcattcaagtgctc

SEQ ID NO: 48989 - DNA, 1050 bp, Homo sapiens
tctttcctcactgttcgtatctttctcaagtaattcctgtgtgtcaggtgtcaggggcaggcctccaggagcttccagagcacacctccggagctgactgagagccctggccgggtagtgtccaggaagagctcctggcgccatggagagaggagagaggatgtttctggcctggatggctgggtgggccaagaagcacttgggaatttagttatggattagagattcatcttggtaaatcacagcctgttactagttgggaacttcagtcttccccaaaccttccacatttcaaagctggtgctttattgcctcctgcctccctttggcttttatctccctacttgcaccagcagccgtctcagcagtagctacatcagcctgatggatagagacttcatgacgtgcagcagctggaacttttgtttataaagcatctcttttcctcacatttattttgaatttcttacgtttcaacctatgcagattgtccagaacatcgtgggcacagctctgatgattttagtggccattggttttaaaaccaagctggctgctttgactcttgttgtgtggctctttgccatcaacgtatatttcaacgccttctggaccattccagtctacaagcccatgcatgacttcctgaaatacgacttcttccagaccatgtcggtgattgggggcttgctcctggtggtggccctgggccctgggggtgtctccatggatgagaagaagaaggagtggtaacagtcacagatccctacctgcctggctaagacccgtggccgtcaaggactggttcggggtggattcaacaaaactgccagcttttatgtatcctcttcccttcccctcccttggtaaaggcacagatgttttgagaactttatttgcagagacacctgagaatcgatggctcagtctgctctggagccacagtctggcgtctgacccttcagtgcaggccagcctggcagctggaagcctcccccacgccgaggctttggagtgaacagcccgcttggctgtggcatctcagtccta

SEQ ID NO: 48990 - DNA, 2008 bp, Homo sapiens
ctcccccttcagccccctgcatgtctctgactgcctggagctcctttctcttctggggaagtcgtgagcccaagcagggctgtagaggcaggtcattcggtactgggccatcttttgtcccatttctatgattaccgtgacaagggaagtctcgagcttggctgcagccaggatgctgtcttgttatcacgttgcttcataaagaagaatacttggttattcagaatgaaatgctgggaacagaatatctgaatccacatcagtggtctcagaatcactttgttctctggaacatcatagcacatttcttgagaaatacagaaccacatttttgagcttagatctgtcctcggtctcctacaatggttttgtgtgttttagactccagctgacattggagagacggcctaatgtattatgaagtctgtggaaatgcctttggaaaggctgagactcaagtatctctctcttctttcccctcagacgattgcctacagcattttatgggacttgaagtttttgatgaggtatgtgcattctggttggttttagtatacgctccttctacaggttgagcattgcaaatccaaagtctgaaatgctccaaaatgggaaaaatcttgggcaccaacatgacgctcaaaggaagtgctcattggagcatttcaggttttggattttcagatttgggatgctcagccaataagtatataatgcaaatataccaaaatctgaaacactttgggtcctaagcatttcaggttagggatactcaatctgtatttctaaactcagttaactattggtttgagtagacttctctgggtctaaaccaagcttgtccagcctgtggtccacggggtgaacatggcccaacacaaactcaaaaactttcttaaaacattgagagttttttttgtgatttttaagttttattttttagctcatcacctatcattagcattagtgtattttatgtgtggccaagacagttcttccagggtagcccagggaagccaaaagattggacccccctgtctaaattgtgcctcttagaaacaggttctgaagaggatgttgcagagcccctagaatagtagagactgaagccgtctcttctgacccttatttcacgggtgtggggactccgggtctgagtggaggacagacctgaccacggggacccagctggtcaacactgaagctgtgactaggactcggttgtgtgtgtgttcaggtagcctgtcactgtcgagttgtaaagatacctctgtctcctgagctatgtaaggttttacatgggtgtaactcgagtctgaggtcctgtgcgcatgcctgcctggtcctgcttggcagatcactgggtttggagaaagggaagtaagggccttcttatactggcagcaaggtctccctgcacctggtctcacagacaggccagatcctggtgaggcttagcttccagcccacatatctgttcctcaggaacctggccctgggaggaggcctgttgctgctcctagcagaatcccgttctgaagggaagagcatgtttgcgggcgtccccaccatgcgtgagagctcccccaaacagtacatgcagctcggaggcagggtcttgctggttctgatgttcatgaccctccttcactttgacgccagcttcttttctgtaagtattcctacttgcctgaaccggtctggtttcctgtgaatgctgtccctcccccaccccctccctgctcacccctccctggttgggtattaaccacagcctgggggagctgctgaaatggagcaaacttttttttttttttttttgagacggagtctcgctctgtcccccaggctggagtgcagtgcgtgatctcggctcaccgcaagttccgcctcccgggttcacgccattctcctgcctcagcctcccgagcagctgggactacaggcgcctgccaacacgcctggctaattttttgtatttttagtagagacagggtttcaccgtgtt

SEQ ID NO: 48991 - DNA, 1311 bp, Homo sapiens
gcccctggtgttgctcttctggcacaagtcaagggaagagcactagcgggtgaaggggctgctcacatacaaaacccaagtgggttaggaccatatctgtaaggcaccatatctgtaaggcagcgcaggctgccgccgtcagatgatctccttaagagtccgtctaggtggtggcagagcatggctgtgggagcttccatgcccttttgtgggcagcttgggagggcagctacttgtactcgcccaaaccccaatcagacagatgcaggcaagtaaacagggttcgaagtcaaaatatggcttcttgtggacagaatctgaccaagcccaggtggggctttgtttctctttattcacatagtacttaaagctgccagaccaggcttttacatgaaaatgacctaatttgaagccgatagaggattaccatggaagtcactgatcagataaagtgacacatccattttttcacatcttcagaaaacaagagcaaaactgaagtgacaagatttgaccagaaagtgtgggctgctgaaagcaagacctaagtaagcttagtttcccaggcccagtgtcttccagtattatgacaatgacattaagtctttcactgggccgggtccatgatagacattccttttgtgaacttcttgactgtaggaggttggccagagcgtcaccatcttcagatgggcagagggaggttggctggccgcactggcttgtggtggcctggagactgagtccgcatcctgttaccccaaaggctgggttcctcactgcttggttgactgatctttccttctggcctgcagaggctggtccacggggacgagcagtctggttagtttctgctggcaggctccccacagttgcatctcttgtctctctgcctctggcatcaagctgcttgctctggcagccagggacagtgtcctcttgctcccaggagccatgctctgtagaaactgctgagacgtgctctatgcaggagcttggcatttggaagccatgggaagggtccagaaactaatgaactcagcaatccaaactaatgtccatgcctgcagctgctcctcattgcctattagacactctgtaaaatgtagcttctaagcagtttatacccataaacagcaatattagcacttaatgggttctgcctggtggctcatcaccaaggtgacagaaaagctgcatggggccttcctctccagtgtgacctttggtgtttttaacctgtcctcaagagtggcagagctagtcctgggccctaggagctggcctcggccctagttgaagtgctgggga

SEQ ID NO: 48992 - DNA, 1014 bp, Homo sapiens
agtctccttccagaagtgtccaggtggcattctgagcaacagggaagcctttgaaacaggcggttgggtaactgttgagagcattcgggaactgggtggacaggatccgatcctacaaagtgaagggacacaactcccttccctctttcttgattaagcttgacagaacaaaaaaacaaaaacaaaaggtggtggtggttacgcagatttatgccttttacttctaaaagaatcccgttatgtcgacaaattaacagccttatccccgcagggagagccttgtgtggcccacttgccgttttttcctcggtttacttaatgtgttcgtgtggctttgctagagttttaagtagtgatggttaaatttttaaatttttctggaggtggtagtgagtcatcaaactctgaggcctagacttatcggaaggcttgtatatgtgtggtttaaaaaaaaaagaaaagagtaagtgaccgttttctgatcagctattgagctcttccgttcctcctggggggtgatctctttctagtgtgacctcaccatcggttctcattgcaacactttctgtgagccaatattttaaatttggagggaaaaagtaatcaacttgacgaagcattttttccctaagattctgattttgtgcttaaagacacaattttatttgtttatttatttttatttatttattttttctttgagatggtgttttgaccttgttgcccaggctggagtgcaatggtgtgatctcagcacaccacaacctccaactcctgggttcaagcgattctcctgcctcagcctcccgagtagctgggattacaggcatgcaccgtcacacccagccaattttgtattttttttttttttagtagaaacagggtttctccatgttggtcaggctggtctcgaactcccgacctcaggtggtctgcccacctcggcctcccaaagtgctgggattacaggcgtgagccacggcacccagcctttaaagacacaattttaaaaac

SEQ ID NO: 48993 - DNA, 1071 bp, Homo sapiens
aataattacaaagggtccccccacccccgcagccctccagccctgccctgcccggccccactgagcagctggctctgcctctgtggagcagtcaccccctgccaacgtggcctcagtgctttgggccctttttgcccatctgcttggtccttgtgcccctgtgcccagcacccaacctgccatcaccctgcactcagagacctaaaaaggcagcgtgtttgttgcttctcctctttgggtttccctttcttctcctgggaggggtgtctgagtcacagaagtgtggggaccatcaggtcgttgctccctctgcttctcttgtgtcctccctccccgtcctggtgacatctcgtggccaggtccatgtctcactcagtacatctgtagcagagtggctagtgggagggctcagtcattgtggggttgactgtgggctgcggctatgcctcgtcacctgctgggatgtttcatgtcgtctagattcaggatgcccaggcagcaatgaggctgtacgtcatggtgaagaaggagtgggagagcatggcccgagacaggcgccccctgctgactgctccagaccactgcagtgacgacgcctagcagtcctgccctgctgctgctgccgccccgctacagaggcaatgtgaccagtcacagggacagatcacatctccccagagtggcaactctggtgaaaccttttcagaatcatggcagaggggcgtggcgtggtgctactgagaaggtcctccttcctcttgactttgtggtctgaaacctggtcttactgtccatgtgtgtttgggcccggatggtcagggtggggagcagggacggccatgggcacgcctggccacgctttaccgactgctgaccccctgggccaggtgaggttggggcctgtgggccgccagtccatacggtgctgtcactgcccatcttcggtgacaccctggggtgaggtgctcagcaccttcctctcgaggagccacattttcctcctttgtgttaggggacataacaagctctgctgggcttgagggacccagaccaggtgtctgcagtcagctc

SEQ ID NO: 48994 - DNA, 1074 bp, Homo sapiens
aggtgttcatgcttgtttacagagggtgaaactgaggtgagaaccccccgggcagtgtcctcacagaaaggtcttctgtgtgctcctgctgtaccccctcagagactgctgccgtggggactcgtccttccctcctgactctgactccatccctggcaccttgcgcagcacatgttcaagtctttcttgaagatgatgctaaggaccagacacagtggcttatgcctgtaatcgcagctttttgggaggctgaggctggaggattgcttgaggccgggagttagagaccagcctgagtaacataggggagaccccatctctataaaaaattttaaaattagccaggtgtggtggcgtgtgcctgttgtcccagctactcaggagactggggtaggaggatcagttgagcccaggaggttaaggctgcagtgagccatgattaccctatagcactgcagcccaggtgacagagtgagatcctatcaaaaaacaaaacaaaacaaaaaattgcatgctaagattgcaagatgagctgttaaaatgtgttatttgcaacttcctgatgtgtagaaccaactcaaaatacaagtataatataggaataagttggttgctggttaactgttgactgtttttctcctacttccttgatttcaagattttgtttttattgtctctgactgttgggcatcagcttaagtcagtgcaataaatttccttctggagttgaaattcatatcagtgccttgtttccatgtgtgtgtgacacacttggattccctacaagatgttacttgcagggcagccgcgttggctcacacctgtaatcccagcactttgggaggccgaggcgggtggatcacctgaggtcaggagttcgagaccagcctggccaacatggcaaaaccctgtctctactaaaaaatacaaaaattagccaggcatggtggcgggcacttgtaatcccagctactcgggaggctgaggcaggagaatcacttgaaacctggggtcggaggttgcagtcagcaaagattgagccactgcattccagcctgggtgacagagcaagac

SEQ ID NO: 48995 - DNA, 1041 bp, Homo sapiens
gtggtgagcccagcagaggagacaaaactcactgggaggcatggactcacctgctcagccctgaagcctgggagccctcgggcctccttcccagcgtcatgctgcccatttccgagctgcgtacttccacccacgtcacagttagggaaactgaggacagagagagatcaggcaggccgcccaaggtcttgcagtgagtcatgaccaggactcagccccaccagaaagcctccacttcccactttccggggttcacaggggctgactctcccatctcggccgggcctaggaaccagtattttcagcaaaacctggtgcggcggctgtgtcttgcaggtgtacgtgtctgagattgctcccccaggcgttcgtggggctctgggggccacaccccagctcatggcagtgttcggatccctgtccctctacgcccttggcaagtatggccccgcactcctgtgtgcaggctggtgggaggggtgggtgccgccaaggtagacgtgggtggaaagggaatgatttgtcccagaacagatcctgggctgagaggcaagagatctggcatcccggccccactcagtcagcaccttgctgggcacctccaggcagggcctgcccctctagccacaggcccagtctctagctggggcagccagggcttctcctggacccacagtcgccagactatcttttaacggcagaaagcttccatcaaatgccatctcagatgggaagtccagatagaaaagaaatcacagtgcgtgcagctgctcagttgagggggcgtggaggtcttgggtggaggcctagggccttgcctgcccaacctaccccttcctcatcctgccctggccctaagactttccaaggacttcccactatgtgccaggggctgagcaatccctgcagccccaccctgcctggggcaatcagggtaggcttcctgtaggagatggcccttggactagaccttgaagggcagatgaggttattcagaggctccagagggaaggggctgtaccaggcctggacctggcccct

SEQ ID NO: 48996 - DNA, 1050 bp, Homo sapiens
cagggctagaggccaggagaggcggggagctgagcagccaggggttccgggccccaaacgagcaaggagggcaggcaggcaggtggcaggagctgtctggggctggtggcccgaagggctggggtaggacagggctgacagggagtggccctgggggccagggacgaggggctttgctgcagcaaacacagaatgagcctggctgccaagggggccggggccgtgtggccctcacgcggtgaccgccggggccgtgtgtttgctcaggttcaatgatgaggtgaagcacatcaaggtggtggagaaggacaactggatccacatcacagaggccaagaaattcgacagcctcctggtaggtgacttctggctccggccggctcccaccccagccacaggggacaggtgcttcctcccggccctgagcgagtggccatgttttctgtgaggattgattcttcccagtgtggccaagatttagggaattggtttttaaggcactaggacagctagagctatgtcccagcctcctgaattgggacttctgacccccaaagcctgagcaaggtggttgaccctggtaaacagtgcaggggtggggtaggggcagcccaggccaccagcagccccagattcctctcatgcccatcctcctgcgagagcagaaactgacgcccagtggggcttccagctggggcctggccgggtagccccattacacatgtatggcttcaaacagcttcttctccgactcacccccaccctctgtcccagccagaatgcagttagaggcatagtccttgaaatgattttaaagttatgcctacattttcttttcttaattacaaaagttgtatatattgagaactcctgattagagcccccaggctcttagcttccccgctatggccacagaaaagcacaaggtcaagcagaaatccataatctcgggctgagcgtagtggctcatgcctgtaatcccagcactctgggaggccgaggtgggtgaatcacttgaggtcaggagttcgagaccagcctggccaacat

SEQ ID NO: 48997 - DNA, 1051 bp, Homo sapiens
gagggaagaggtagtctctgaggctgtgcccagcctgtggcccagtgaggccagggtggggggctgtagccagggagggagccctacctgctcactggagcggcagcacctgcctgagtgtggccaccaccagacccccaccccggggtttccagacctctggagcagggagcttggctgtgggtgtctcacatccactggctgaaaacttcccgcaccttcggtccttgctgtcccaggggatcaagtcagtgttagctggtggctatgccgacatctgttccatcagacccacggggcatctactcagagatgaggttgtcctggccacgacccttgggcacctcccaggccaggggcgctggggctaagtccacagacagtcccctccagggcagccaatgtggggacagggcagtcactgacaatgaccccctctgagccctgctctgtgagtggccctggggggccgttaacactcttgtgctctgccaccagccgcccatcagccggccgccatcccgggagatcgactacactgcatacccctggtgagtggatcgtgggctgcagacatgggcatctggtggcctctttgttatgggggcatgcccgccgggtctgggtggtgcctgtgagcggcccagcagggtggaggccccaggctgcctgttgccatctccagggcactgagcccagtggctcccaaatgccttctccctcctggcctataactctccaggagcctgggggagtccttctcctgtaggcagctgttaaccctctctaaaacagctcaactggctcagatatttcagggaattaaaccctttttgaattttatctgcactatataaaagtggtatatttgaggtcacaggtgtaatccacttactgacaatacagttgcttggtgggaacagtgaggctgtttgaaatcacagaagtcccaactgtcctgacagtgtggcagcagattttgggagagagcttgccttgccctctcagggtgggcttcattgcagtacaggtggcaggaagagcttcgttt

SEQ ID NO: 48998 - DNA, 1057 bp, Homo sapiens
gtttgcacccaggctctgtgggggaggcctggggcatcttctcttcggccactcgctttccatggcctgtaattttctccccaacatcctattgtgcaaaagttcaagcgttcatggaagctgaagcgacgtgatggtgaatagccgtcttctcaccacgctgccgccatccgcgtcaccccaccccaccccagccatccaacagcgggtctgtgtcaaagtgaattgcacaccagtgcagcccccctgagtacctcagggggcccaatatttgtttagcttctgaaatttcaagcttatatccaatgaggcaaacaaatcttaagtatatgttttctgagttttaacaaatacccacacctgcccacatccaagcccagtcaggaccttagaccaccgtccccacctggaaggttctctcaggccagtgcagcagtgttaaagcttcttctctgacctgccttctacgagcagggagtctgggccctgagtctgccccatgttgcgggcagagccaggcttggagtccaggccctctcggattctgcacagcctgggtccggagcccagctggttcccaggatggccacatggtggggctcggggaatccagtgggtgtagcatctgctctctttccctcctgccaggtcaaacatcaagccagacaaagccaatgccaaccaccacagtttccagatgtacacgtttgacaagaccaccaactgcaaagcctgcaaaatgttcctcaggtgtgggaaaccccctgctacagccctcacctcgctccacgcccagcccaggcccctgagagagcttagtgttctatctgtcccatgttccctgtgggaggccctgaggggttaagggagtataccccacaagagtcaggcccgtgccaggcatggtggctcaagtctcagcactttgggaggctgaggcaggcgaatcgcttgagcccagtagttcaggaccagcctggcaacgtggcaaaactctgtctgtacaaaaaataccaaagtcagccaggcgtgttggcctgctcctgtggccccagct

SEQ ID NO: 48999 - DNA, 1062 bp, Homo sapiens
agcggaagggctacagctacgagctcaaggagatcatcgagctgctgttccacaagatgaccgacgaccccatgaacaacaaggacgtcaagaaggtggggccttccgggtcccccctgctacccaggaacgtgggggtggcctggagagaggcactgggttccagaccccaggggaaggggactcgaagtcagccgctgatgctggccgggtgggttggggtgggcgtctccgctctgcaggaaggctcctctctgagtcactgcctcgccgtcgtgaccactgctcatagcaggcctgctcctcgccgggcccagcgccccccagaaaggtgggcaagaccagaatcccactccccagtgaggcgactgaggcagaggggagaggccaccccaaggcctctagtgagggtgggactttcaaccttggctttccatctggccagcctgactctagcccatgttgtcccttgtagcaagcaggctttcctctcccgtcccaccctgcggtgcttggaggagggctgtgggtaggtctggctgtggcttgtccgagactctacatgtagctggctggggcctgtggctgctggggtggggccagggctgcaggggtggggcctgtggctgctggggcggggccaggactgcagaggtgggcctgtggctgccagcgggtggggccagggctacagggacggggccgaagctgctgtggggcaggaccatggctatagggctattgctggctggctgtctggttcagtcctgcttcagctgaggcttctgcccatggcacttgagcagctaccgtgtgcagccctggtggggtggggggcgggggtcaggagcccttgttctgaaagtccagtccctggcctccagggctggcagtgtagccctcgtccagacccagcaagtgcagactggatgagctgttgagggtgaccctccctgccctcatgcccaaaacaagtaactggggcccatgaggcagtcctgccaccagcacccaacactctgggaagaaattcctttccccactgatcaccccacccccagc

SEQ ID NO: 49000 - DNA, 1097 bp, Homo sapiens
cacggaaaagcacctgcgatacgtcggcgatgaaagaaaaaaaaaataagcttctgaagggcattatgatactgcccccttcatctttcattttagaaagaaattaaaatgtgtgggtgcagaggaggccaaggacggccgcaccctgcaccatcagcacctggcgggtccgtgctgccgtgagctcctgcgcgaggcggtcacaaatgcgtacagtgagcaggacgtgaggagaaaagttcgttttgttttgttttttaagtttttacatagaagtaatacttgttcattaaacagcaagaacaggctgggcgcggtggtcatgcctgtaatcccagcactctgggaggctgaggtggaaggatcacttgaggtcaggagttcgagaccaacctggcaaatgtggtaaaaccctgtctctactaaaaatacaaaaattagccaggcgtgctggcgggtgcctataatcgcagctacttgggaggctgaggcaggagaatctcttgaacccgggaggcagaggttgcagtgagccacgattgcgccactgcactccagcctgggtgacgtagtgagactatctcaaaaacgacaacaacaagaataaaacagcatggccagcaggcgtcgagcatccccatgagccaggccctgtacccagtcctggctctgaatcccattgccacagggaaggtggtgagagctgagatcagaggcctggagcaagttgactgggactatgtgacaccaaagctgtccttgcagcctctggggctgagaccttggaaggagacactgagcctgtgcctcgagcacctcccaggcagggccctgttcgtgtcttgaagcattttcctccaccttttcctgtctgtgtggacactttgaaagccacgcagggaacatgtcaagagaagctctctctgaatcagaagagtcacagagacaaaaccagacagacaacgaaaatgaacctcagcgaaccacacaggggtctgagtcgaagcctcacccttggcaggaccccggccccacccgccctgcagcagataggcgctgtttgttctctcctgaacgtggggcttgggcttctggct

SEQ ID NO: 49001 - DNA, 1140 bp, Homo sapiens
ggctagagaagggccaaacgtctgggcctgagttctgggcttaggtctcccctctctgtgggcgggggtacaggtgggtgggttcaggctttcctcggggagggctctcccatcgccctgtcgccctcccaggagtgcacactgaaggtccaggatggaaaatttaagctgcaagacctgctggtggtccccatgcagagggtgctcaaataccacctgctcttgaaggtgaggctctgggccccgggtgcctgcggggtcatcactgctggagtcagatgagggctggcagcttccagggggtataggttgcagcccacagacagattaagttgaatatagacaagtcagttcatgcttagctcataatcaccgctcaatgcatgtgatggccgattatcacagtaaatacacagaggaaaatgatgagtccaatcactaaagaggtcagaaaactgaaagagacagaaaagcgtcctcacaccaggaataagaaagctactgtggttggtctctgagcttcctggtggccatggcagaaatggacatggaagggcttcaggaaagccagacctgggagggaaggcggtggtttctgcccggcaccttgcgaggcccttttcccgtggaatgctggcacagcgccttgctttttgctgccttcatggcccttctcacggtcactcccttcccttatccacaaggtttgggagcgcccctgccaagaagtggggtatcccctgtggaggagtcactctctgtcctttggtgtcgggcagccaaacccagcctggctggcgggtgggggtggctttcttctgaggacttggttctgtgcacacctcctgccccaggtaggggccagggcagaggccagaacccccgagtggtaacacatgacactcttctcacccttccaggagcttctgagccattctgcggaacggcctgagaggcagcagctcaaagaagcactggaagccatgcaggtgtgtgggtaaactgaggcaggggagaagccaccgtctggcttagcccgtgttcttggactggaattgggctcattaacgagcctcagttttgactgtggacagtttcctgggacagcaggagttggggcagggcagggcagggcagtgg

SEQ ID NO: 49002 - DNA, 1298 bp, Homo sapiens
tggcacagcatgagggtgagccctgagccagtgcaggcctcggtgctcagggcctgggggcaagattctgagccctcctggggtcttctttcctggggggatgtcaggggcttctctttcctccagtgttggccctttttgggggtgggatgggaggttgagagctccagcctgcatcccagccgggacctgacctagaaccacctgggactcaggaagagcaggggcaccccctctcccagcacgccggcagccctcctgcggcccggtagcttcgggaaggggagagcagcctcctggccgttgaatgtgtccacgtgcagggagctgtcaggggaggggcctgttggttgcgcacctacagcctgctgggaaaaatggacgggctcactgcagccccgagctgctcattaaatctgtgtgcgtgtgtgcgtgtgtgtgcaccgtccaggcttctgatctacggggagtactgcagccacatggagcacgcccagaacacactgaaccagctcctggccagccgggaggacttcaggcagaaagtcgaggtaagtcctgccaggcgttggccctggccctggctccaaggttgcagcttgcaggccagagctcgttaggtaccagcctctctcttgcccatttgttgggaaggtggtgatgggggtgatgacgtaatggttttttgtagatttttcttttttgcattgtgttgggttggggagtgggttgggtggaggtcaccatcccaggccaggacacagtgagactccccatggagaaacgtccttgggactgaatctgactcagctgggggctctggctgacccctgatcctggcctctgctgactccagggagccccaggtgccatttgctgggaactgtgggaccacccacccctcatccatcctcaccccaggcccagggcgagtctctatcaactgggggctctgactgacccctgatcctggcctccgctgaccccagggagtcccgggtaacatttgctgggaactgtggggccacccacccctcatccatcctcaccccaggcccagggcaagtctctgtcaacatctagtgtttctcacgtgagcccctcccagcccctcctgttcccagctggagtttccaggctccatctggttagtacaccctggtttctgcgtggagcctggtgaagagccccctggctctagcagtggtggaggcagcgtggccccccagtagagatgcacgatgccccccaagtccagtcaatgaatgggggaatgccctggttcctgggagtggccc

SEQ ID NO: 49003 - DNA, 1087 bp, Homo sapiens
agaggcaggggaggtgatttgtgtcatcgctggtggcagtttctaaggcagtcgccggacctggctggggatggacctttgagatgggttagtaagaaaacctgtgagctcacaaacacccttcctgccttcatgtctgttcccaggggagcctctgtcaccagaatgtgggcccaacccgtctgacggctgcctttaccccggcttcagttctcccgcacggctgagcgacacccagatggacctctcatggtggagggcgggtggggagagaggagaggatagtgagcgagggccacagccctgccccttgctggctgtttaacctcagtttgtttgttttaatctgcacaatggccacagtgctgttaccgccaaggattctgtgaggcccaagagaataactgtttttctacaggcgctggcacacagaggggcttgcccatgggtcggtggctctttgaatgctggttggagggttcgatcagtctggtctgtcccagggccatctgccctctgccaactttgctcctctgaccggctttcatccacctcactcacgactgtagtggtgcagaaaatgaagtacccggagcaacagcttcctccgcctcctttgcccgcctgcctgcgggaggctccacaaggcaggagctgggctcacccccggcttcccctctagagaggcacagatgctttgcccacagacggacgccgtgtggcttgtgcattgcagcgtgtcctccagggaaggtgctgagggccttcctcgaatgcacacgggccctccctctctcaagtagaccttgaatggtcctccccaacccaagccttaaaaggcgacagctgatattcaaaggcgaggtttgggatgaggccgtggcacacagcgtggctggggaacccgttcctgagtaccgcagggattgctcctgccccggcttctgtccctgcctcgcctccctgcgtgctggccatggaagggggtgctctgcatttatttccgtccttctagcagtgaactttgccacccactttgagcccgggatgtgagatgtgtccttgtgcaggggtgagggcttgcagg

SEQ ID NO: 49004 - DNA, 1208 bp, Homo sapiens
catctgagcaggagcatccttgaagggagagctgcccctgagtgcgagcggggagggagattctggggccagggctctgggcgagggcttggatgtgaggctgcagctgctggctgctttagtgtggcgggtcaccagggcccaaggtctagctggcctttcctttcctttcaaggggctgcttctctgggcaagttaaatgccacacagggcctcagtttcccagtctctgaaacgaaagcatctgcccagatggtctgtgaatcccactgagcttgaggaatccacaattttatgatttaggagcctgctttgcataacactggtttcactttcctgggagttgaagtgattttcaggcttaaacaaatgtgatcgtgacacggcagggaatgtaatgtatccgcgaatgtagagctgcatgctttattgcatcataaaatgactgtgcagctttaaatgtgtcatgttagcatcattgggataattttttagggtgcataaaatgtagaaggagtttctggtgtcgaggaggtttggacgtcttctttctacatggggagtgagtgggagctgcctgctggcggcgacctgggaggggagaggccgtgcttctcccattggatcctgccctggggccttggccactctgtgctgtgccctttgtctgcaggggtacaaggagtgaggaacaaaccgctgtcctctatggcccaccctccccgccgttgtcctcaccctgcccacctctcccagaggaagtttgtttagataccatctcctgagctcatgtatgttcatcttcactctgggaggtccgcgttgtggaggacgcctgagtgtggagcccgagttgagctgggagaggctgggtttgggacaccttatgttcaccccagaggattgtttttccaaaggggacaagtttgaaagcagactccacgaaaacggccccacgagaaacaagcaaatgaatccagccctgttagacagcccccggccccaggcacatgcaaagcctgccctggtctgaaggaggccggaatgaagcccccttccccagaggaggtgttgacaggcatccccccgtccctccctggtggcccgaggctcgtgtggggatggaggggagactggagagacggaagacggggcgtttcttaaggcgggtgatggccgggacagaaaggcctttgtcccccgccccc

SEQ ID NO: 49005 - DNA, 1094 bp, Homo sapiens
atcatgagggtgccctgactttgggaaggggccttaccctgatgtgatccgtgggggatgctgtgtatgactacaggctgaggggtcccaggacgatggtactggagcttttgggtggcgcagttgccccttggtgggggccatttgctcaggttcacagaggcactgggcaggggtaaatgttcctaaacccacggggacttccgttgttggattctcagaggacacagaaattcctttgaattgaggtttttaaaaaatgtgaaatataggatagacttttttttttttttgagctggagtctcactctgtcactcaggctggagtgcagtggcgcgatctcggctcactgcaacctccgtctcccgggttcacaccattctcctgcctcagcctcctgagtagctgggattacaggcacgcaccaccacgcccggctaattttttgtattttcagtagagaaagggtttcaccatgttagccaggatggtctcgatctcctgagctggtgatctgcccacctcagcctcccaaagtgctgggattacaggtgtgagccacctcgcccggccatggatagactcttaaaattaaatattaagcacatacaaaagaatatttagaacacatttggggcataaagaatagcagtcaaaaccccggtgcccagcaccctgagtactttctagaggataactaatgcctctgaggccccaccagtccctccgccaggtgcataggctattttccagctggtgcaaagtctgtaataggcaccgtttaaaacatgtttaattgtttttaaaagtatcatttctggatacaaagactatgtgttttttgtttgtttttgtttccagaaatgatggttccttctcctttccaccagcccatgacaatacagtactgtcagtggcgtggttatactccccagcctgttttttttttgttttgttttgttttgttttttttacatattaggcaggaaagagattcatgcaacaaaaaatcagtcattttaattgctcctgcacaaaatactagacttttgatctcttctccaaatccattagacattcttccaaactggag

SEQ ID NO: 49006 - DNA, 1040 bp, Homo sapiens
tgcattccccttcagagtcgctgctagttgcctggctcgagtgagtggcatttttcattttgccgctcagctgtcttggggcctgggggcggctcccacctctcttcctgcactctgccggccccctagaagaaacttctgatattgatgttgggccccacagccctgccattgcccaatgcactggctgagaagtgcctttcctgctcgcttttgtttttccagcctcctcctggtggcaaaacctgaatgtgaagctgtgattgcacatgttttgtaattatcactactcgatggtcgcttgtcattctgaaggcaagtaccccaaatttttctgtccgtgctttccacaagaaaaaagaaaaaaaaatgaaggataacacaggctgagttagagaaagtaatttataatgatttgcttctgaatatgcagcaatagtagctgtagatttccaaggcagataggtgagtttccggggcaacatattcaaatgagtttgataatcttgccatttggctccgttgggctgcgtgtgcgtgtgtgtttccagatgtgtggtaatggctgataaggaaggtctgcggctggggccaggtctgtgcagttcctgcttactgattgctaatgacagtcggagggtcggggccagaaagctcttctgatcggcagagcctctgagagcaggctgggtcggcggatggctcatcacatggtcgccagtgtggctcagggctccaatttctttttaatttttacttatttttgagatagggtttcactgtgtcgcccaggctggagtgcagtggcatgattctagctcactgcagcttcgacctcctgggcttaagtgatcctcccacctcagcctcccgagtagccaggaccacaggtgcatgccaccacatctggttattttttttttttattttttgtagagatagagttttgttgtattgctcaggctggcctcagactcctggcttccagcaatcctcccgtctcagcctcccagagtgctgagattgcatgtgtgagccac

SEQ ID NO: 49007 - DNA, 1033 bp, Homo sapiens
gactgcccagtgcagcagtgctggtgctgtggccctgtatggtggacgagggccaaaaacaccatcatttactcaggcgaaagagtattttgtgcctagaggcccagagagggcttctgttcacaccccggtactctggggccttcttggggaggtgagcttcacggggccctcagcactgactcagcagcttggacagtagtggtgcattgagaagcttgcggggaggacggagccctggctgcacacctggcacccgacggccccgtggccggttgctgtgtcctgggagcagcgggcatgtcgtccgactccactgggagagggtgtgctgcatgcctgcatgcctgtgcccacgtgcctggtgcccacgtttgggctcggctggacacgtgctttgttgcaggggctgctttcctgcaagtgcatttgccgtcctgagcctgctcactcatcgaattccacgtggtcgtctgggagtgattccgggtgcttcctggtttgaatttcacgggaccctggaggacatgaactcagaaagtgaggcgttgatggtcgcttttattggtatattagatgcattgaggttttgaaagggaggacttgggattcttctgtgtctttttaatgtcttagagcgtctagaaatagcatttgctcttcagttctctagaggggtctcccagaagaacaaagctgtgtgtggcagagtggttccctttagaatgcggagctctgggggagagcctggcgcttgggctggagccggcccaccaggacacgggctggagccccattcgctcatctgtgatttggggcacagaatttacccggataggaagcagctcaaaatacaagctggttccacccctttcccagtaagaggattttaagtttcttggtcaacatgattttataagcttttagggatagatgaagtagttcaacatttacttaaatatttaatttgctcaatcgtttacatctttaaaaacatgaaaataacatgttcttgtaagttgcccttttttac

SEQ ID NO: 49008 - DNA, 1049 bp, Homo sapiens
gcgtggggtgggaggggcgccttcagaccctccctccactctctgggggaaggcagagaaggaaggggggtggggtgggaggggcgccttcagaccctccactctctgggggagggtggtgaaggaaggggggcatggtgggaggggtgccccaggccctccctccactctctgggggagggcggtaaaggaaagggggtggggtgggaggggcgcccccggctctccccactgtgccgtctgtgccactgcagttggactgccaatgactggcattctctttgttactttcagcctggttgtttcaaaactcattaggcttggcatttctttacaaaggctggcatggcccgagccgagcggagagtgggaattgatttacgaggatggcggtggatctaggaaatgtcagcgtcccctccagagtccataaatcagttttgattccagcgaggccttctcccatcccctaaaacatctcccagggggctttccaacgtggtggagcttaaagttagtcagccgaggagctagtctcctgggtttgctgaaccagctggattaaagagctttctcctgattctgtctccaggccaccaaggtcagctggggcgtggctgtgaggttccttctgtcttttgtatgagggacaagtgccagccaggatcggcctgggcttgaaccgtgatgggatggagtgaccggcatccgggaggggccttggggagcagtggccttcctctggtgtggcctgagggctctgagctggcctggtgggcttgttggcctgggcagggcagggcttgctgggttcgatggtctgtagggagcgaggatgaatttgaggtgctggggccgcatgtgtctgtgtgcccagcgtgggctggcaccggcagccatctccctgtcgtcactgctcttggcaacatgtttggggccttggctgaaggaggtatggacaagagagtgtggacaccagagggccacaccaggtccttgtccctccccccgccgccggccagccaggctgaggcaggcctgagggggcc

SEQ ID NO: 49009 - DNA, 1041 bp, Homo sapiens
taaaggggaggatggcactctctcaggcaggctaggacagggagtgaggcccagagggggtaggcaaagtcccaactgcatggcctctgtgggatgggcagggcccctctgtgctgtgttgacattttcagtggcataagttttccctttggaggttatgcgtctttgtgacttactagaaacgataaacaaataaaacccttctagccaaaaaaaaaaaaaaagaaagagttttctgtttttctcatgatgggttcccagctctctgttaagtcaaaaaatattcagcttgacattccaccattagagaatcattcctttgacttgagagtttgtccctgtcggcgtaggtaatccattgggctccaccattgccttttgagtgctgagtttgtcacctcctctcctgaaaatgggttcacatcaggaacaggtaaagaacttggcccctggaagaggaggacggggatagggcccctcagggaagggagatgatttagtgagctctagggctaggctgtcataggcctctgggtggggagcaggtctggggcctgctgggtgggcttttgtgcaaagagatttgcagtagagaaagaggaaaacccagggtgggatgtacaggggacaggaccccgtgagagtggcaacctcgtccttattagtccttgctgagtgttcccaaagctccgggtttctttgtatgtgtctcatttaatcctcacatttgatggacggggacgctgaggcttagagggggttgggtgagtggccatgggtcacacagacaatggcagagccgggacattctcttcaactctgccatgccagcatcttccttcacaccccttgacctaaacagtcccaacatctgcattcagaaggtacttaattaatgctttttgcatggctggaggcatccggggtgtcctttgcaggggaaccgacaaagttgtgctggtcctggaggcccagccgtgagcctctagccaactctttcttccagctcagcttctgggatcaatacacaggcactcccgg

SEQ ID NO: 49010 - DNA, 1035 bp, Homo sapiens
tgggcttcccagatccccagcagcaagggcagtggcgaaacatgcagattccttggccactctgcccctggggactttggggctggagccctgggtgatccttttgattctcaatctttaaaaaacattactgtgaccaggtacagtggctcatgcctgtaatcccagcactttgggaagccgaggcaggtggattgcctgagctcaggagtttaagaccagcttggacaacgtggtgaaaccccgtctgtactaaaaatacaaaaaattagcaggatgtagtggcacccacctgtaatcccagctacttgggaagctgaggcagaagaattgcttgagcccgggaggcggaggttgcagtgtcccaagattgtgccactgcactccagtctgggcaacagagcgagaccctgtctccggtggggggaagaaaaaattattgtgataaaataacataagagttaccattttaaagtgtgcatttcagcagcatcgaacagattcccagtgttgtacaaccatcccctctgtcttgttctggaattttttcatcaccctgaaacaaaatcccatttcctcttgccccatccaccagttcctggtaactactaatgcattttctgtttctgtggatttgcctgttctggacatttcatataagtggaatcctacaatatgtggcctttagcgtcggcttcttgcactgagcgtgaagtttcaggtttcacctgcgctgtggaagccgccagtgggtcattcctttttgtgactgaatcatattttactgtttggatcgaccacagcttgtccatctatgcacctgttggtggacactgggctgttttcaccttcggctcctgtgaatattcatggtcatttagtcctgagccctctggcccataggccccctcccttccagggctcaggagaccatcaccatgaggatcccaggagctgacattgccccttggaccctgaaggctgttcctcttgagggaagagctggtggtgactggcctcctagtggacgtgttc

SEQ ID NO: 49011 - DNA, 1103 bp, Homo sapiens
gtgtgtggccaagacctcaagagcagtgtttcagtgaatgccaggccccacgggccacctagcacatggatatccagttttcccagccctatttgttgaaaagactgccccgtggaatcgggacaagagcctctgggctgagcctctgctgtgttctctgaccgtgggtggcctcccatctcttccctgtgcctactacatcagtggaggtaggagcctaattgaagacttggttaatcctgatcgattggtagtggctgactggagggctcagctgagaagggtcccgaggctcagccattgattagcgttgtctgccgtgggtgtggtatgagagcatgggtacatgtgccaggggtttcccactcctgggctagctggtctcaggtttcgtgtccccagaaagaggagagagcacaatagctgaggggtgctttccagaagcctgccttgttcttgccaccactggtaaggtaggtcctgataagagcatgtgtagggggggactcagcctgagtaaagcaaggactggatgctgggtgggcacctgcagaagtgctgcgggtgtctgtgacaggctgcccggtgtttgcagaattgcattgatttttctgagatggctgaggtttggggagttgctatagttgtggccagggctggtgctgggcctccccatccctccacagtggggctgttgccaggagggtggtcctctctgcttctgtgtgctctgcttagctcagctggtgccaggacatgcagcctcagatgatcggagcctgggaagacagggagccaggggccactgcctactgtgcagagtgacagggactttggtgggcagaggtgtgttagacagttgagctagtcaaggagggcttcctggaggaggtgctggggttcgagatgtgagctgcagttcaccaggtgaaggtggtggtatgggaggtctcaggggcagcatgtgcaaaggtccagaggctggtggcggtggcctggcctgctcaggtttagaagggaggtctgcttggagtaggagactgggaggggcaggagctagggcagtgccagagagccctaccagagagatttggggtgctatc

SEQ ID NO: 49012 - DNA, 1078 bp, Homo sapiens
cctgccaggtggtccactgcacctgccttctggtgcctcctctcatccaggctcggtggagccaggcgggccctggaggaggcaggcgggtgagagcaaagcttccgtcagacctggacgcgagttggactctgtagatacttggtctcgttgagcctttgtttctgcagggatcaaatgaagcttgagactgtccccttggaggtgttgctgtaaaggactcggtgaaaaaatgaacggcaggtcctagtcatttttattagcattttcttcctcttcactcaccccgcaagttccagtaggaactaaaggatccagaaggtttattccggaagtgtttctcttctggctgctttcctggtatttttttcaaagggttgcattaaagagattaggttttggctcaaataagttgtgtccggcttcctgtgctgcccggggtgggcgtgctggggccgagttatggccgagcgtgaagggtgagtccgcagcccttgctgatgggagccgttggccctgctccccgccacggcctgtagatcctttcctgttttcctctgtgccctgtgtctgggcggtttgtccagttgcccagctgggaaggagtgtggagaagcccatgggtcgccagctctggcggcttcttccaggggctggtttgccccagcttggaatccggtcgggcatttggagggaggattctggtgaggctgcggggtttctgtggcttgcttctgagattctggtccctggactctgcagatcatgatagttccgaccgtagggactctgatctcattgcgagctgggactgagcacaggtctgcgggagggaaggaaggcaccccggcagcgcactgactgtttaccatgtgccgtggtgtcgcctgtgttatccccacctaagcaactggtgcacggtaacatggctgtgagtttcttgggtcctcaaaccctcgctgtcctccctccccaggtgcctggtcatggcattgtcattgggatccgtccagctccttcgcggggccctgggcaggtggctttccctgagcctgatgtcctctcctgtgacgtgagg

SEQ ID NO: 49013 - DNA, 1062 bp, Homo sapiens
ctaaagtgctgggattacaggcgtgagctgctgcgcccagccggactagccacatttgagtgtttggtgggcacaggtgtctagtggctgccctattggacggtagatggatagaacgttcctgtcattccagaaagttctgttggaggactgtaccagattaatggagactgaagaggcatggcagcagaaactgtgtgtgatcccatattggaacctgggccagtttttttttttttttcttttagctataaggacattttggttgtcctttatatattagggaaatgcaagtaaggtctatagataagataaccgtgtggtgtccatgttaatttcctggttttgctgtaggtactgtgattatggaagaggatgtccttgttcttaggaattacacactcaggtatttagggataaaggagtgtcattactgtagttaatctcgagtgttcagaaacacacacacacacacacacacacacacacacacacgcacgtggacagagagggactctaggataaaacagatgagtctgttgtctatgaacagcagccgacccctgccaggatgggaggagtggcctgaggcagaaggggctggggtgagcactgcctgctgtgaggcagggtgaggggtcagcaggggcgtatgtcctggctgggggaccctccgctcccagggcgttctcagtgctgcttggtttacgctcttaggctctgattctgacgtgcactatgtctaagtctgtccatttgtctaaatttccagtgagcagggacaggctctctgaactgctcttggagctgggcagtttgtccataggggacggttattgatgaggatgacaatcctgggctcttattgggctgtgtgtgccacaccctcccctcgcgaatccccgtgctgagctggattggggggctgatggctcccacaccccagtgcccactctggtcatcagggcacatgattaatcccgtgaggcaggtggcggtagaaaaccaggcctggcataaccactcaccctggtctccctgctggagtcagcagacaggatt

SEQ ID NO: 49014 - DNA, 1050 bp, Homo sapiens
gagctcttagcccagtgcctggccttctggaaaacctggcggccgtggagcgcctataatcactgtgagtcagcgcaccgagacgcgtagccagtcttggccggaagggcctggagctctgtgccagagcctcactgtgcacatgaggagacttgcccgagctctcctgggaggagggagcagcgagggtcacctcccataaaggtcagcccggccccacgctcctcctgcatggtccagctggggcccaggagtcagcccctgagacagtgtggcacctgccttgacgacgcaggccttgtgctgccgtccttggcgagacaggactttcttgcatccccttaggcgggggcctgctgcccttttgcatcccggccactccatttgcccctgaatcctgggcctacccatgagctcactgcttggagcttggttgtctgtctgtgcagtgggccagtgcacacctcacaggctctgcaggtggtgagtgagttggctgttgtgcacgtcagcatcctccctgcctgtggtcattgtcaggctctgctattactccatcaccattgcccaggggtcgatggccaagccacctgtgttcaaactgcagctccccagctgaggcctgctggctatgtgactcaggcaagtggatttgcctcccccggcttagtttccccttttgtacccctctcaggtcatgccggctagatgccagctctggagggcgaggcaggcctgtcctgtttcccactccagcactgccggtgacccgttgccagtaaggggcagtggaagggcccacataggctgaagggcgcccctgctctcggtgggctgccgtgggttctgcagggcagagaggcctgtccctgccattgtgtccccatcacaatagattgtttcagagaccctaaagagacgtgactgtcctgtgagcatgtgagcttggccggtgaagcttgccatccaggatgccctcgggcctcacctgtggctcagacctgggctcctggctctggggtcttggctctccggccctgcgccgcctct

SEQ ID NO: 49015 - DNA, 1033 bp, Homo sapiens
tggctggcccagctgttggcctggcagcagggaatccccctcccgctccctcgccccctggtgctctgcccaccagccgaggggcctggtgctggttcgcctggaatttccagaaagtacagcttctcagttgatcttcgcattttctgacttctcaggaactaactggctgcgtgctttttatacattcccaggactccctcctccctaacccaacccaaagctgagataactttttaagaaattctaaaagtaatgtctactcgttggaaaaaaaacaaaacgaaacaaaacaaagcaaaagaagaaacaactcagaaaggtagaaagacagagtaccctagacaccctttccccaccaggcccccagacccgctgggcccaaccccacagctgagaaccagagaccctccccaggggcttgggctgagggtcacagggtagggaggggctgcagggcccaggggaggctgggtagacgaggggatcatggcacctctggagatcatcgagttcctgacttgcagacctgtttttaattgtcagaacccccttccctccctctctccctgtgaaccagtgaggaagctccctccttctcaggaatccagggaattcattcagagccactgggttggggaaactgaggctccaggagggtcagcgacttgtccagcgtcacctgggaagctgtgctttgtgcctcctggccccgtgggctccaggtcttgactctgcgagtaagcagggaaggagcagatgggcagtgaggtgctggctgcccgtctgagagctccccggagcgggggcctccagcaggggccgtgcctttgtgctgagcggaagcggcaggaactgagcttcacggagcagcctgagctggagggtttagagggctcccctcgggctgggggaggccagagctgtggggaggagtggggaggagtaggagtgggagtggagtgcaagtgggggggtggggaggaacgtggggggggcgttggggggagtgggaagcagcgtggggggagtg

SEQ ID NO: 49016 - DNA, 1027 bp, Homo sapiens
tgagtagctggtactacaggtgcacaccaccacatccggctaatttttgtatttttagtaggagatggggtttcaccacgttgggcgggctggtctcaaactcctggcctcaagtgatccaccagcctaggcctcctaaagtgctgggattataggtgtgagccactgcacccggcccatatgatatttagctttctgtgtctggcttttttcacttaacaatgacctctagttccatccacattgctgcaatgacaggattttattctttttcatggctgaatagtattctattgtgtatatatgtcacattttctttatccattcattcactgatatttaggttgattgtgaatagtgctacggtaaaggtgggagtgcagatatatctcaaacactgatttcctttcttttgtttacatgcctggtggtaggattgctggatcaggcagatctctttttagttttttgaggaccctctgtactgtttcctatagtggctgtattagtctacgttctgaccagcagtgtactagtgttcccctttctccacatccttgccagcatctgttgatttcttgttgataatagctattataactggggtgagatggtatctcgttgtggttttggcttgcattcctgtgatgattagtgatgttgagcattttttcacatgcccgttggccatttgtatgtcttttgagaaatgtcttaataacagattatttacccgtttaaaaatcagattattattattatcattactatttgctttttttttttttttttgagacaaagtcttgctcagtcacctaggctggagtgcagtggtgcaatcttggcttactgccacctctgcctcctgggttcaagcaattctcctgcctcagcctcccaagtagctgggattgcaggcgcccgccaccaagcccaactgattttttgtatttttagtagagacagggtttacggtgttggccaggctggtctcaaactcttgacctcaagtgatctgcccgccacg

SEQ ID NO: 49017 - DNA, 1151 bp, Homo sapiens
cagcgaactcccctgccctgaccccctcagctctgatgagcccccttcttcaccggggccagccccaggctcaggtgcccggtttttggtcccctgaagcttcgtgttctgaaggactctttgcctggagctggggacgctgtttggcttctgaatccaaaagataaacaagaatgacaaatacaggaccgtggaggggacaggactgggcagtgggagcttgaactttgggccagactgagcggctgcgcccctgagttaggtctcctgctgcctggcagctgcaggttttgcaatcctgatgctgctggaaacagtgtttctgttttgtggggttcatctgtcagtctttacagagtttgtgtaaggatgaagacaaatcattctcacagacctactccttgtcccctaggccagcttggccctgaagtcatcagtatttctgttggtttgttttgtacttttgggttcaaaggcagcgcgaacacgcggtatctttccgtgacccgccaggtgcttgcgggctgtggccttcccaggattggggagcccgtctccaagtttcctcaaggcctcccagccctgtgttctttgaaatctgcataggggtggggagggggtgcctgcctgtcttctgttgttaaggactttaaaaaatgctgtgttggctgcctccagggtcatccttccacagggggatcctttctgcagtggctggagtaggagagggtcccccagcctgcaatggaggaggtggcagtgagatcctcctagtggaccctgggaccagcatcctctggccggcgggccagggagggcagtttccccagccctgcccagccctgcctgtcctggcctcaccctcgaacaccgtgtgcctccccgctcctggtcttgaatgtgtgtccagttttcagccacatttctgggatcatcacatttgtctcatacacgtaggacatctccagaggcagggggcgtgggagctgcgtgccctagggcaggtggacgcatacacgtaggacatctccagaggcagggggcgtgggagctgcgtgccccagggcaggtggacgccccatcccctttgccagctgaggggcagaggcctgaggtactgagccacctggacttggcgtggccttcctgac

SEQ ID NO: 49018 - DNA, 1026 bp, Homo sapiens
ggcttagcaggagccctcagaggcctccctgggagccagcgcctcttcccgcaggatgtcagtggtcaggtgcaggtggcgggggtggcggtcactgctgcagagggcttccccggatctgttctcagagccccacggggactgggaagtctggactccattttatggctggagaaactgaggagaagggtagctgttggggagcagggctgggcctcgaaccaaggtggctgcctttgatatgagttccaggggctgcccaggctgacttgctcgggcaggattccctgctgcttgcaggctggggctcagggcagaggcagggcagctgggtccgcacagaggaggcttgggaggagcccagccttgcctggtggactcgctgggtccgggggctgcccctccccagctgtggtttgggaagatgggaagaggagggggccgtggctgtggcaggtggcttggctcagctcctgcactggaagttcaagccagagacttcctggggtctctggagccattggccaggcagcaatacgaaccctgacagaggccccttgagccctgctgctggggggtggacgggtgtctaggggtcccgctgctgggccggtagaggggtgtttaggggccctgctgccggactcgtggagggcgtgtaggggcctggatggtaggaggaccagatgggtgtgtgtctgtgtggctctccgctctgattgaatcctggcactgtcccctcccaggtaggcaacgacctccagagcctcagtttccccatctctgtcatgagaacagtcatagcagtcccctcgtagccatgctgtgaggatttgctaagggcaggcacagaaggcacacccttcgcacagtgcccaggaaatgaccgtcacctggactgtggcacgtagtgccctgtgtcgctgaggctgatcttgccatccactcctctgtcccgtggagggtgggccacctttgtacggctgttgcctgcacggggacggctgcagatgctcccttaaccct

SEQ ID NO: 49019 - DNA, 1108 bp, Homo sapiens
tggtttgcccagtgtcgagacagggcccatgaccctgcccgctgaaggggtctgtctcctgtagtcactctttggacgccccaggcagagtaagcgctccagaaacgccagcagctggtgttcctgtcgctgctggtggccatgtgactggtggatgtttttgatgggcagcctttctcgcatccatcatttcctgttagtagtctgcattcatttttttcctgtctcaagtatattcagatagtcttgttgacctgattaatttcaataaatacttattaaacgactgggtcaggaagtgggtgggtcgtggcacccagtgtgatggtgtcacgctggcatggacgacatgccgccaagcgggtcaagaagcgggtgtgcgagcgcatctccctgcccatgtctccacagagaagcccggctcagcaccctcagggggcccgtccaggctcagcagcagcagctcctccgagtctgggagcagcagctccagcgggtccagctctgacagcagtgactcagaatgaactggcttcggacagaacaggacagatggatgtcgcacacgccgagactctgccgtacccctctgtggttcatattactacttctgttccatggtgtgcaggtctgcttcttaattcagtgttatgatatcttccagtttttgctttcataggtcagagatctatcttgtgtgtgcgttagacttgatgagaaggtgtgaactctgcagaaagtctcttcttcatcactgaattcagtcacttggagatgacaacttcaaatgctaacccgatgaccccagaaaaccgtgtgagattcgtaccgaagaaccttgtggaatccctttgcttaggcccaacctggtcgatagctcgagaaagaattttttccaaggaaatgtctcggatatgggtactgtatttgaaagctgttagctttgtcaacacgcattgtccttgtcatttgggccccgagctctgaccctcgtgtctgacgcggccacctctttctggaggggctgaggacagatgtgcctgcttgtggagaccaggctgggcctaagcgaagggtcatcgcagccccagcccggagcgtggagccc

SEQ ID NO: 49020 - DNA, 1059 bp, Homo sapiens
attggtaatttgtgtctttttttcttggtgaatctggatagagacataccaattttattgatctttcaaagaaacataattagatttcattgatgtttttaaaaaaaatttttacttttatttatttctgatctttactgtttcctttgcttagtttagacttggcttctttttactttttaaggtagaagattagattaccgacttgaaacctttttttaattttttattttttaaatttttttgagaaggagtctggctgtgttgcctaggctggagtgcagtggcacgatctcggctcactgcaacctccgcctccagggttcaagtgattctcctgcctcagcatccctagtagctggcattacaggtgcccgccaccgtgcctggctcatttttgtatttttagtagagacagggtttcaccatttggccaggctagtcttgaactcctgacctcaggtgatccacctgccttggcctcccaaagtgctgggattataggcgtgagccaccgcgcccagccctgcgttgtccttttttcctgaacatactcctttttctgaagtttactttgtctgaaattaatatacccacaccagctttcttttgactagtgtttgcatggtatatttttttctcacttttttccttttaacctacttagaacattatatttaaagtggcatttgtgtagacactatgtaagtggggtcttcttgtttttttaatccaacctgagcatctcttccttttagttggtgtgtttagaccatttatatttctttctttttttctttttcttgaggcagagtctcgatctgtcgcccaggctggagtgcagggacaagatcttggctcactgcagcctccgcctccctggttcaagcgattctcctgcctcagcctcccgcatagctgggactacaggtgcccgccaccacgcccggctaattttttgtatttttagtagtagagacgaggtttcaccgtggtagccaggatggtctcgacctactgacctcgtgatccacccgcctcggcctcccaaagtgctgg

SEQ ID NO: 49021 - DNA, 1102 bp, Homo sapiens
tttataaataacagcaccactgttataaatgttaatcaaaggacttgatttttggaggaaaggggagaattatgggtatgtgttctcttccagcatgcttttccttttcacgggacccagaatgtcatgttaagatgttctcagtccttgcatagactgttttgaaatccccgagcagcccatggtattattgtggatgacacaggacccataaaaggggcagagagagaaactcgttccccctgtgggtcctgctgcctttcccaccctctcgcgcacagggcctacccaaggtcctctcccaggcactgctgccattgccaccctctctgtgcactgggtcctgtgggtgatgatggcagggtggtcctggaggtcccactacatccagaggaagccgtcagaaccctggttttatactgagacctcgcttactgtgtcttgaacccaaaagaccttgcaaaggccagtcctctggagcctggtaaatactgggttgagtttaacgagggagctgagcatagaggacggaaacccaggcttgcagaccgagcagggaagctggcagctctgcccctgctcctgaaacaggtgctgttggatagacatggtgctcacgcctgtaattccagcactttgggaggcggaggtgggaggatcacttgaggccaagagtttgagacgagctgtctctacaacagattttaaaaacgagtcaggtgtggtggtgtgtccctgtagtaccagctattcaggaaagtgagatgggaggatcacctgagcccgggcgttggagactgcagtgagctgtggttgcacagcactccagcctgggcaacagaggagaccctgaggctgatggatttccatgactgagcactatttagcaattgtgcaattttatcagttgagctgtggggttagagcccaacagcaaaacgacctgacctgcatggccttcaaggctgtcggccgagcgggggcctggaccgctgctctgtgggttgggttgcctctggggacatctcctgagaggagagcctgggatatgagagcctggggtgggcttctccagagctgggtccagcctgaacagtgaagg

SEQ ID NO: 49022 - DNA, 1247 bp, Homo sapiens
aaattgttacatttataacaaggtaagaagatgcgggcctggcacgccgcttgcagtaaggattggggcgctgtgcaacgcagtgggcctgggcgctttgcagcagctcttgggcaggcccaaagcgcttcacctggctgggtgccgtggctcacacctgtaatcccagcactttgggaggccgaggtcggcggatcacttgagctcaggagttcaagaccagcctgtgcaacatggtgaaaccccgtctctactaaaaatacaaaaaaattagccaggtgtggtggcaggcacctgtaatcccagctactcggaaggctaaggcaggagaatcacttaaacccgggaggtggaggttgcagtgagccgagatcatgccactgcactccagcctgggtgacagagcaagactccatctcaaaaaaaaaaaaaaaaaaacaaaaaaaacaacacacacacacacacacacacacacacacatatattcattttgttctctcctgcgctgccaaatctgttaacaaattttaaatatttttttgagctacaactaataatgtcctttgcaagcacacagctcctttcctgacacgtgacctggactctctgtgtcttcagcccacagatgacatagtgctaatggcccaagctttagagaaaatttttctacaaaaagtggcccagatgccccaagaggaagttgaattattaccccctgctccaaagggcaaaggtcggaagccggctgcgggagcccagagcgcaggtaaagggagctggggcaggcgaggggctgggcctctctgcagaggcccacgggtggatgggctgggacgcgatcctttagccatctgagctgtttcccatctgtcgtgacgagctcgtgggtgccgggtcttggatgagtgtggcctgtgggtgatgttggaggggcagctggcccggggatacggaagacattaacgccatagctggctgcctttgagcccacgctggggaggagctcatggtctaggaggatcacctgtccctgctctccacctcccaaatcctgctcccccttccagctccagccctgaggtcacttcttccacgacgcgtggggcctgttcccctcctggggctttgtctctttagcactcatttgattctctgtgacctgagagtcactatcacctgcctggttccctggtcaagtaagaccgcgtcttgctgtcagggagcatggtggtgattagtgtcgtgag

SEQ ID NO: 49023 - DNA, 1044 bp, Homo sapiens
ggtttgatttgggatgtcatctcagaccctggggtaggggtgtgtgtaggagagacacctctaccccccgggaaaaggcttcccttgctggtttggctttctgaaatccaaaaagttgacagtcactacaggagtagaggcaggtgacacggagtggtcaggctctggcctgggggggacagggatgtaacaggggctggtccctggtgtccagacgtgatccttctgtttactttgtttctgggagctgggagaagcgaaggccatgtttgttttgggcagacatgttctgaatgtccaacactgccagccacactcccaatgttacctctgttcgtccacgtggcaccctggagtgatgcaaggtcctcctccctttgctgcggccccaggggacttgggatctaggggcacctccttttctccccagccaagggggcccatggtcacacccagttctagccactggctaggacgtcccggcccccagaatgtccttgcatgagtgaagctgtggcctgcgggaggcatgactctcatgcctgcgcatgggctgtggtgggaagcactcggtagacgacggccttgctaagctctcagcacaaaccatctcttcacagcgaggtcagctgggggtggagagccgggctgtgaatcctggtgtgccgacaccgcgggcgctccatgcctccctctcgcagggcctctgtgtcgggtgtgcagaccccaggggggccccttaccgcctttctgcatgggcctctgtgtctggtgtgtggaccccgtgggggccctgcaatcagccctttcagagtctccactggaccttgggttctggaggggccttgtggctggcggctggccctgccctgggctgcctttgtgtccttgctggccgttgagggtgggggaagcaggagcgcctcgttctttaacttcccagggtcttcttgctgtgtggccgcctgcaggttgaggagcctgggacaggaagcccagggtcttgatcctgggctgtgcctccactgccgactgctgagtgct

SEQ ID NO: 49024 - DNA, 1025 bp, Homo sapiens
gccatgcgtcactggagccttggcctgacaatcccacaaggagcaaaatgtgcaaaggggcagctgtgtgagcctgcgggtccagggtgccacccgcccccatctgcccacaccacaggacagagccctgggtatgctgaccaggccctcgctggtaccaggggctgggtaggaggcaagggtcaagcacggtggctccgtgggctgtggactcacagacagatgtgctgcatgcccacgctttgctcttagctctgcctccggtctgtcccggcaacaggcctgggggcgtcctgcagtcctcggcatttgtggttgggggtgagcagagaacatagacgaaataaccaaggggatggtctgagagctgcggccctgctggccccttgtcctggctcggcatggctgagtgggacagcagtgaggccaggcctgtctcctggggccggggtgttttgtgagtttggttcttgtcaggccggctgagaggagatggagcagacagatggatgctaggtgggcctgccgcagctttgttttaggaagtgcggagcaccagggcctgaccctgaggctgtgtccctctaagagcacggtgtctccttccctctaaagggccaggtgctgtcctcactcactgcccctctgaagagagtcccctgcctgagtcgtggctctcctgcccttcccagacccgtgggagaccctgactacgtggcggtggcctggggttgggagggcctgaccagtgtctgtggggccaacttcctcgttcccagcatgtgtggagggtcgggcctcctcacgcgcctcatgagggtcccacgggggtagagcgtcctttgagtcctctctattcgaggagtgggtagagaggcgggtagggacggagcttggaagaggtgacgggttgtggccagaaggctgtgggggcgtcatggcaggaagggaaaccttcagagaggccgctcacccagggccgtggggccatggagaagcacaggccctgggttcagaaagcagga

SEQ ID NO: 49025 - DNA, 1035 bp, Homo sapiens
agtatcactctgttgcccaggctggtgtgtaatggcatgatttcccttcactgcaacctccacctcctgggttcaagcaattctccctggctcagcctgccaagtagctgggattacaggtgcccgccaccacgcctggctattttttttaattttttttaattttttagtaaagatggggtttcgccatgttggccgggctggtcttgaactcctgacctcaggtgatccacccatctcagcctcccaaagtgctgagattacaggtgtgagccaccatgcctgaccgagagctcttttaaagagaaagtgtcactttgggccattcacctgttggtggtttaaattgtaagtcttctggccactcctgattgagctcgcagtggagccaggacctgtgcgtgtggctggaggctcggaccctgttgtgtccgtgctgttggctgtctgcgtctcgcaccagtctgtggctgttccctgagagtcagttcgcaggctgcctcctcacagggccttcggagcctggtgttgggaagatggggcgtggaacatgcccccgcccccctccttgccgcaggcccccaaggtactgagttcgtcagaagttaatccggtattgtgggagacaacttttccagccacttggaaaagtgtcccgctgagggtgcagtgatgttcaggagtcgccggctggatctttctgagtgtggcttgataaccagctgcagcattttgcaaagcacccagtggactcgggtgtgatctgcagaggcggctgctggccaggcctggagtctggggcagagggagtgccctcagtgcacctgtgaggacctgggactaagagtcggtacctgggagctgtgggactctggggcgggacggccttagcctccgtgtgagcactgaccgagatgaggcacagatgcatctgtgtgaggtgcccggcccctgcaggagtgctgagtattgtagctataacctgtcatgtggcagaaggaagaatctactataagcggctgagaggatgccctc

SEQ ID NO: 49026 - DNA, 1434 bp, Homo sapiens
gatctttaattttggttgaaagctttctgctcagaaatagatactgggatttctcccccttacattaaacttggtcattgtctgcaaaagttaaccaggaggggagactgtagtgcattggtgggcagagtaattgggctggaactgcaagaggcagcttcgtgtgtcccgtcctcccccgccctaccctgtgagaaggaacagaagaggaaaagagttttctttttaccctgctcttttgtaggcttttccccttactcttttctttaaaatggagggttttttttttttcctgggtccatgtagtatgcctggggagatcctggaatctatgcaaagttgtatggcatttttctggggaaagtagtttgttactggcttccaacggggtctaaggaaggtctgaacccctgcaaggggctggcctcgggggttagggagccctccctccgggttcttccctggcagccctgatgcagcctctcatttgcaaataaaggtctgtgtttgccgttttctctgttgaggccttgatgggtgctggtggttactgatcatgaaagataaggcacacgctgtaacaggacgggctgcaggcgagcgaggggcatttctttctgaccttccgggtagcctcagaggcccggtgcctcagcagggcaccgggtgcctggaaagactgtgggagcagctccagcctgagccctgccgttgggacatccggggaggagggatttcaaaagctttctccgagtgggcagtcactccatttttatttttgttttgtttttagaaagtagagtaattactttcctttgacaacagctcgcgcctgcttcggaagtgagtgagctttgaatgaaggacgggacttgcaaacagtgcctgccctacactccgaagtagtcatacccagaaagtgaaagtgggggtgtgcagagcgaagcagccaggcctgctgcagccggtgctaccttcctctaccctcttcctccaggctctggagatgccagccgcgggagccctgtgcaccaggcggcagtgatggccttgtgcgattcctggtgccaccaggaagtgccaccactttccctgaggcatggtggctcagggtttcccaagtggggtgattggcacaaaaccaacagctatgcccagttgtcgatgggaagagccatgttttgctgtggatacacacggtaccggggcggggtatggggaaccggggcctactcttcccagcgttgctgcctgggaggtgggggcatgcctgaagtcgtgctgcgggtctcttggttttcaaagcagttaacgcagttggtcagaggatcctcctcttgcttccttgaccggtcatcaaagtataactgacctgacggggttcctgtcctaggcaggttcctttttttttttttttctcttctcctcttgaga

SEQ ID NO: 49027 - DNA, 1027 bp, Homo sapiens
aatgatccaaatggaagcacagagaaggagaaagagagataaaccagctaaaccagcctggagctggaaacgtgtggggtgaggcccacaggccgcaggggcctgcggggtgcagagggagtgaagagatgtcagagaggggcctactgcccccacagggcccccttgttccccccgagtgggttccccagtttcccacccccactgccttcccatttcttggttaacattttctttctttttttttttagacagaggctcactagtggcacgatcttggctgattgcatcttccacctcctgggttcaagagattcttgtgccttagcttcctgagtagctaagattacaggtgtgcaccaccacgcccggctaatttttgtatttttagttgagatgaggtttcaccatgttggccaggctggtctcgaactcctgacctcaagtgatctgcccgccccggcctcccaaagtgctgggattacaggcgtgagctactgtggccggccacatttcccttctggtgcgcgtcctcctgtagctgtgggatcaggggaggtagagatgtcttgtaactgactcaagtttggctgcttgccgcaggagaagcgaggtgtggtgaaaggaaagcaacttttattcagatgctagcaggtgggagagtggccaggctcaaggctctaaggaaccatctcagctttttggactgcgtgaagggctttaggaaggagaactcggtgtgggagacatgtgggagtagggcagtggtgcaggtgtcttgagtaattgcccatccggaggtctagttggcatcatcttgaccttggtctggtggtggtggactcattgttcataactcccctagacaggaggattccacagctgggttctatgcctggtttatttaaaaatgagcccctggcatttctaagcaggcacagaatgagataagtgagcactgtggctggtgggaaagggagggaaacaggtttaaagtatgtttcaaggctgcattctgagactagga

SEQ ID NO: 49028 - DNA, 1044 bp, Homo sapiens
tgtcatgtttaaagatagagatattaaataatttgacctaaatgaaagtgtagagaagcacaagggagagaagatcctgtcaggacggtgatgactttgggggctgggagagggctgtggccatgagggtgctgtggagggggcctggagtggctggcaaagctcttggcttgcgtggtggtgacaaaaagtgtctgccctatcaaagtccatgaagcttggctgggcacggttgctcatgcctgtaataccaggctttgggaggccaaagtgggaggatcgcttgagcccaggagtttgagaccagcctgagcaacatagtgagacctcatctctacagaagatttaaaaatcagcagggcatggtgctgtgcacctgtaatctcagctactctggagactgagacaggaggatctcttgagcccaggaggtcaaggctgcagtgagctgtgattgttccactgcactccagcctgggcaatagagcaagacactgtcttaaaaaaaaaaaaaaaaaggccgggcgcagtggttcacacctgtaatcccagcactttgggaggctgaggcgggcggatcacaaggtcaggagatcgagaccatcctggccaacatggtgaaaccctgtctgtactaaaaatacaaaaattagctgggcgtggtggcgcgtgcctgtaatcccagctacttgggaggcttaggcaggagaatcgcttgaaccagggaggcagaggttgcagtgaatggagatcgcgccactgcactctagcctggcgacaaagtgatactctgtctcaaaaaaaaaaaaaagaaaaaaaaaaagatttcattaagctaaaaaaaaaaaaaaaagtctctgatggtttcctagtatggtttgaatggagccggaaacccccatagcccacccacctaccttcaagagctcatccctcacattctccctcttctgcctccccggggggtgggtgcatccactgctttccccactgcaggcgctttgcacggatttgaccttctaaaggcaacgttgcacccacagt

SEQ ID NO: 49029 - DNA, 1034 bp, Homo sapiens
agatggcagagaaagctccattcaaaatgtcctgctccaaacctgagattcttatcctgtcttagtaaaacttgtaaaaatgtgatggatacattacaatctctgtaaccgcccaaagagttcaccttgcctgctgtgtagatagcgccattttatcaagacagaggaattgcagtggagaaagaataattcatgcagagccggctgtgcaggagaccggagttttatcgttactcaaatcagtctccccgagcactgggggatgagagtttttaaggacagcgtggtgggtggggggaagccagtgagccgggagtgctgactggtcggaaatgaaatagggagtcatagctgtcttcttgcgctgagtcagttcctgggtggggcccacaagatcagatgagccagtttatcgatctgggtggtgccggctgatccatcaagtgcaggatctgcaaaatagttcaagcactggtcttaggttttacaatcgtgattttatctccgggagcagtttggggagagtcagaatcttgcagcctccagcgacatgacacctaaccgtaatttctaatcttgtggctaatttgttagtcctacaaaggcagtctagtccccaggcaagaaggggttttgttttgggaaagggctgttattctctttgtatcaaactataaactattaatataaactaaattcctcccaaggggagttcagcctacacccaggaatgcacaaggacagcttggagcttagaagcaagtggagttggttcatctctttcactggctcataattttgcaacggcggtttcatctctaccctgacaataccttttagttttcttacccactggggtcgagacttaattgaagacctcagacggacagcataacacggaacctgagaccttgatttgcggggacaggcttaaagtgtattctggagttggtgcccccaccccaggggccggctcagagggttcactttccagcctaacggcaggggaaccagaggctgccgacctggatctc

SEQ ID NO: 49030 - DNA, 1097 bp, Homo sapiens
ggacgtgcccaggggaaagtgtcggcaaaccagatccgcaacttcaggagaaggatgggctccgcgggctaggcgggtccgaaggagcacagtaggacctgcggcctgcacgatttccaaagagggtttgagaacttccgtattcaaagaggaaagagcagacagtagggaaaaatggaaagaaaaaaacgggagggtggataaaagaggccagcggttgcattcttttgaggcgttgatgagccttccctgaatccccgttttacatgggaaaggtggaagaggaacagtaaactgtgcattcatcctgtgctcagtgaacctgcatctttatggaagaacagtagaggagggagtcaaagatgcgtttgtctcccgtgagcggagggaagacttctagtcctgtctttgtcccatacctgtgcagataagctgttaatttacattttcagggtgaaattcagcagaactctgttttaggacaaagttcttggaaaagaaagaaagaaaaaagatgtgttgcctgtaatcccagcactttgggaggccgaggcaggcagatcacctgtcaggggttcgagaccagcctggccaacatggtgaaaccccatctctactaaaaatacaaaaattagccaggcgtgatggcacgcgcctgtagtcccagctacttgggaggctgaggcaggagaatcacttgaacccgggaggtggaggctgcagtgaacccagaccctgccactgcactccagcctgggcaacaagagcgaaaccccatctcaaaaaaaaaaaaaaaaagatcttggggaccacaatgtatttccttgtgagcaaacagtgaggggggccccctggggaggggagtggccttctgtctttgcatctgtctatttaggaagacactgggaggtagttttgggtgacccagttcccaagcttaactcttctttttggcatagtgagtttggggtcctgagatttttattttccttttacctctttaagctggaggagaaggaaacttctcagggattatcccagcacattatcttatcttcctaggcttgagataagacagaactgcctttgggctgcct

SEQ ID NO: 49031 - DNA, 1026 bp, Homo sapiens
gtctgggcaggtgatggttgtggaaggatgcaggaatgggaggtctcagagctgatgatcagggcagtgggtgggccttctgggccaagtgaccagtgagtcctactgctcttgttccccgagtgccagcaccatcactggaagtctgggccagtgtggtggctaagtggcaacatgatgggctgagcgagaccatgtcagctgccatccgagggaggtggccacgggcaggtggttcaggaatcacggccagcgcctgctgctcactgctctcttattagagtggtggccttcttgggctgggaggtggtggtgggggatgggggaccagactttaaggaaaaatggaggccacactgtgaaggaccctggccacaagctgccatctggcctttgggactttgtattttgagtagaatgaccatgcactcacgtactcctccactcgctcatctgttcattcatttatccatctgctcattcattcactcattcgttctggaatagggctgggtgtgctgttgggtgcggtgcagggctggagacaaggaggcaagggtcccagccaggggtggcttgcattaattcatggcatctggggggtgttgaagttcatgggcagtagagagatgtgaccgaggccgcagtgccatgggggagtggtggagagaggaggtgcggctcacgacttaaggatggaacattggaggcgagacactggagcgtgcgggcccccaggggacaggaggaggcaggagggtgtcctcagggaggaggaggcacagcctcagaagaggttgagaccaggcagccttgtccaccaccctgcagggcccgagcagggcgggtggagggtggtgagaggtgggaacaatgcatggtgcctgggcaggtgcgtaccggagactgcagcgcggagctggtgttttggtgtgtggagctgccaccgtgggctgcttcctccagacctgtcctgcctgccacatgcactgctctacagggctggtttgctgcagcaaagaactc

SEQ ID NO: 49032 - DNA, 1050 bp, Homo sapiens
aaatcagggagtgtgatgtttttgcctttgttgttctttttcaagattactggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaagagaatggcgtgaatccgggaggcggagcttgcagtgagccgagatcgcgccactgcactccagcctgggcgacagagcgagactccgtctcaaaaaaaaaaaaaaaaaaaaagattactgtggctattttgggtcttttgtggttccatacagattttaggtttgtttttctgttttggtggaaaatgccattgggattttgataggcattgcagtgaatttgtaggtcatttttggtagtatggacattttgacaatattatgtcaatccgtgaatatgggatatctttacactaattttgttgtcttcaatttctttcatcagtgttctattgttttcagtgtacagatcttttactcattggttatatttattcctaagtatttgttctttttgatgctattataaattggattgttttcttgatttcttttttagataattaattgttagtgtatagaaatgctacagttttttcatgttgattttgtatcctgcaacttgactgaattcgttgattagttctagcacttattttatggagcctttaggattttctatgtgtaggaccttggatctgcagtgagacagttttatttatttatttattttgactaatttatctgactagaatttccagtactgtgttgaataaaagaggtgagagtgggcatccttgtcttgttccagatcttagaggaaaagctttcagttttcccccactaattatggtactggctgtgggcttttcataaatggtttttattgtgaggaggtaagctccttctatacctgttctgtgtagagt

SEQ ID NO: 49033 - DNA, 1049 bp, Homo sapiens
ttttagattccacatacaagtgtgatcaagcagtatttttctttctgtgtctggcttattcactgtacataatatcttccaggtccatctgtgttgtcacaaatgacaagacttccttcttttttgaggttgagtaatattccattgtatgtctctgtatatcacaatttctttattcatctgttgacaagcagattgattctatatctgggcaattatgaaatgtgccgcagtaaacatgggagtgcacataactcttagcgacgcagatttcatttcctttggatatatacccagaagagggattgctggatcatatggtaattctgttttcagttttttgagtaacctccatactgtttttcagaatggctataccaatttgtgttcccaccaacagtatgcaaaggttcaccttttctccacattctcctcaatactcatctcttgtctttttgataatagccatcctgacaggtgtgtgatgccttattgtggttttgatttgcactccctgatgactggccatgttgagcaactcttcacatacctgttggccacctgtatgtcttctttggaaaaaaatgcctatttaagaccttagcctgctttttatttgggttatttgtatttttgcgattgagttgcgttacttatgtattttggatgttaacctcttatcagccatatagtttgtaaatagtttctcagtctgtaggctgccatctcgttttgtttgtttcctttgctttgcagaacctttttcatttggtgtagttcctgtggtttatttttgtttttgttagttgtgcttttggtgtgataaccaaatcatcaccaaggctaatgtcaaggagcttatttccctagagttttacagtttcaggccttaattaaattaattagtcttagtttaagtcttcagtccattttgagttgatttttgtatatggtgtgaaataagggtccagtttcattcttctacatctggttatccagttttcccaacaacatttattgaaggtactatcctttccccatggtgtatt

SEQ ID NO: 49034 - DNA, 1052 bp, Homo sapiens
gtagaaagtgtgtagcgaagtgtgtctgcagaacgggtagaaagtgtgtgatgatgtgtgtcttgagaatggagtagaaagtgcgtaacaatgtgtgtctatagaacagggtagaaagtgcgtggtgacgtgtgtctgcagaacggatataaagtgtgtggtgatatgtctctgaagaatgggtagaaagtgcgtggtgacgtgtgtctgtagaacagggtagaaggtacgtggcgaacgtgtggctacagaatgggtagaaactgcttgatgacgtgtgtctgtagaacggggtagaaagtgcgtgatgacatgtctgtagaatgggtggaaagtgcgtgatgacgtgtgtctgtagaacaggtggaaagtgcatgatgatgtgtgtctgtagaacgggtggaaagtgcgtgatgacgtgtgtctgtagaacgggtggaaagtgcgtgatgatgtgtgtctgtagaacgggtggaaagtgcgtgatgatgtgtgtctgtagaacgggtagaaagtgcgtgatgatgtgtgtctgtagaaggggtggaaagtgcatgatgatgtgtgtctgtagaatgggtggaaagtgcgtgatgacgtgtgtctgtagaaggggtagaaagtgcatgatgtgtgtctgtagaacaggtggaaagtgcgtgatgatgtgtgtctgtagaacgggtggaaagtgcgtgatgatgtgtgtctgtagaacgggtggaaagtgcgtgatgacatgtgtctgtagaacgggtggaaagtgcgtgatgacgtgtgtctgtagaaggggtagaaagtgcgtgatgatgtgtgtctgtacagtgggtagaaagtgcgtgatgacatgtctgtagaatgggtggaaagtgcgtgatgacgtgtgtctgtagaacgggtggaaagtgtgtgatgacgtgtgtctgtagaacgggtggaaagtgcgtgatgacgtgtgtctgtagaacgggtagaaagtgtgtgatgacgtgtctgtagaatgggtgggaagtgcgtgatgacgtgtgtctgtagaatgggtggaaagtgcg

SEQ ID NO: 49035 - DNA, 1045 bp, Homo sapiens
aacacattcttcgtccagctttgttcccttgctggcaaggagttgtgatcctttggaggagaggaggcattctggtttttggaattttcagcctttttgcactggttattcctcatctttgtggatttatctacctttggtttttgatgttggtgacctttggatggggtttttgtgtggatgtcctttttgttgatgttgatgctattcctttctgttacttttccttctaaaagccaggtccctctgctgcaggtctgctggagtttgctggaggtccactccaaaccctgtttgcctggatatcaccagcagaggttgcagaacagcaaagattgctgcctgttccttcctctggaagctttgtcccagaagggcaccctccggatgtcaaccggagctctcctgtatgaggtgtctgttgacccctgctgggaggtaaacacccagtcaggaggcacgggagtcagggacctacttgaaggcagtctgtcccttagcagagcttgagcgctgtgctgggagagccactgatctcttcagagccagcaggcggtgatgtttaagtctgctgaggctatgcccatagccaccccttcccctaggtgctctgtcccagggagatgggagttttatgtataagcccctgactagggctaatacttttctttcagagatgccctgctcagagaggaggaatctagagaggcagtctggctacagcggctttgcccagctctggagggctccacccagtttaaacttcctggcggctttgtttacactgtgagggaaaaacccacctactcaagcctcagtaatggtggacgtccctcctcccaccaagctcgagcaccccaggtcgacttcagactactgtgctggcagcgagaatttcaagccagtggatcttagcttcctgggctctgtgggggttggatccactgagctagaccacttgcctccctgacttcagcaccctttccaggggaatgaacagttctgcctcgctggcgttccaggcaccactagggtatgaaaaaaa

SEQ ID NO: 49036 - DNA, 1047 bp, Homo sapiens
ttattttattatttttttcgagacagagtctcactctgctgcccaggctggagtgcagtggcacagtctcagctcactgcaagctccacctcccgggttcacaccattctcctgcctcagcctcccaagtagctgggactacaggtgcccaccaccatgcccagctaatttttttgtattttttttttttagtagagacggggtttcaccgtgttagccaggatggtctcgatctcttgacctcatgatccacccgcctcagcctcccaaagtgctgggattacagttgtgagccaccgtgcccggcctatagtaggatgatttataatcctttgggtatatacccagtaatgggattgctgggtcaaatggtatttcagtttatagatccttgaggaatcgccacactgtcttccacaatggttgaactaattaacactcccaccagctgtgtaaaagtgttccatttctccatatcctctctagcatctgttgttgcctgactttaatgatcgccattctaactgtcatgagatggtatctcattgtggttttgattttcatttctctaatgaccagtgatgatgagctttttttcttatgtttgtcggccgcatatatgtcttcttttgagaagtgcgtccattcaaatcctttgcccactttttgatttttttttttttttttttttggtaaatttgttttaagttccttgtagattctggatattagccctttgtcagttggatagattgcaaaaattttcttcccttctgtaggttgcctgttcactctgatgatagtttcttttgctgtgcagaagctctttattttaattagatccatttgtcagttttggcttttgttgccattgcttttgctcttttagtcttgaagtctttgcccatgcctgtgtcctgaatggtactgcctaggttttcttctaggtttttatggttttaggtcttacatttaattaagtctttaatctgtcttgagttaatttttgtataaggtgtaaggaagggatccaaattcagttttccg

SEQ ID NO: 49037 - DNA, 1242 bp, Homo sapiens
cacagcaaaagttgggaaagctaacgttggcacacagatccccagcctggtcctgactcgctcaactacccaggagcacctgcttggcccagcgtcccctcatagtttcccttcatctggagtcgtttccagcctttacctctcttgactcttgatgttttcgaagagtaaggttgtgagtagtggcccttggtgtgtttgtctggagtttccttgcggtgtgtcctcccagcgtgtcacctcaggggcaaggtactgggacatctccgtattggtgactccagcttcaccccttggtgcaggtggcatgtgctggccttccccacttctaagcttgctgtttttgctttagaatgcattagtaatttgtggggagaggctttggactgtgaatacgtttctcatcagactctcacctgctggtctctccacgtgtggatggcttccagcctcagtgcatctttccattttgtcagcgtttgccccacttgcttgcttctttattcatgtgtttgtttatatccggatggcctcatggatcttactttattcaataggtcataattcattactttcattatttattttgttgcttaaattgtcccagattttagctgagtagttttgaagaataagaatgtgcagggtatgtgccctacaaataccaaattttgcttaactttgcattaccaaaaacagtgtggttttggttccggggcagtcacatggaccagatgaataaaccacatgtagaactgagaaaagagatgctttgcagggaatctggtgcctttggggtggcctcaccgagggagccgcgctggctggtcaagaacatggcggcatagacatctctatgggaaagtgccgtaaaacctcaccccacctgagccagaaataccccttcctcggagtaaagatgcaaacctgaaaagtaaaatttaagaattttgagaagataaaggcaaatacttttatgatgttcgtgtagagatggattgccaaaattataaaaagcacaaatagaaaagattgttaaatgtaaccatatcaaaatgtaaaactttcctgtgacaaaagaacatcataaacaaaatgaaatgataaactgtacccattgaaaatatttgcagcacacgtgacctgatgaaggactgtcatccagtcctttcgtaaccacaatccagaaagaattctagaatcggtaagaaaaagatgcacagcccaaggcagatatggaca

SEQ ID NO: 49038 - DNA, 1033 bp, Homo sapiens
tggcggcgtgcatgtgggaagtgcttgcaagaattctgtggaaaatggtgttcaggcctagttcacatttccagaggagcctgagcttcggggacgctcctgtaatgctagtggaagcttcctgtgatcaaaagtcaaattttagcttttctttaatatcttttattgatttttcctcgtattagaaatgacatagttatagaaaatgtagaaactatggatgaacaaaaagaataaaatgtaaattacccgtaatcttatcacctatgaaaatggttaacattttggtaaaaattctgatagtttttcttgatttgtatgtgttatataggcctacaacacagtggggagcctactgtgctttctgtcgtaagccacgtttctgcttggtacggtactgtgcagtgagtttctgctcattggccagatatctgatttcagccgttccagtgactcccctgtggcccttctgtgatctcagtgttgctggaggtcaagttgtctcctctccatctgtgcagtagtctccgtccagccacgatgatttccctcaggccacgttcctgcgaggggaatggttgttcatatttaaggactttgttttttgtttgcttgtttttttttggccaaatctgaacctaaagattgtaacattttcctttctattagtttgtgtaggtgtcttttcccatgtcttcccatatcttgggcattattaaaaattacttgcccatttgaaaggtgaaaaatagtgtctttttctatggtaaagacatagaaaaacttaattctgggtaaaattgcagattctgggtaagagcatctgtcccttactctccttctctggtgaatcacttgtttgttatctttgcccgtatttttttgggcaagagggtatgtttctttttcccctgcttggtcacgtttctcatttgctgtgcatttgtaagtgacttttcaggctgttgctggcctctgtgtttctgtggacttggcagataaatagaaggtggtctccttgtaaccagagaca

SEQ ID NO: 49039 - DNA, 1044 bp, Homo sapiens
gcaagattaagtagcgtggttcatgtcaagagtttgatgctgcctggtccaaaaatggataaaggctgattgctgctgctgctgctgtgtcgtcatggttacagtggcaccacgcctgcctggctccctcttctgtaaagaccatgggtgttcaccctctgttatcacttctgattttcatgtcagaaagaggatgctgggctccctccccgggctgatgccagccctgcccacatgctgtctccgctggtgtccccaggcactacatggtcctagcctgtgctggtttcccctcagccccattaacacactcagggctcccatgtctaccttcttactgctgttaagttaggacagtcatcctttgaggtcacggtggaggtcacgaaatgatttcagttgtctgtgttcacagagtagtctgagatgctacagttagttgcctttgtaagtacagaagacagtagaattattgaaaagcctagagccttttcacgttgttagttgctcatttaatcaatcaatcaattattttttttgacacttggtctccctgtgttgcccaggctggagtacagtggcacagtcatagttcactgcagccttgaactccttcctttgggtcttgtgtgtggcactcacctggtcatcccctccctgtcttagataacatccctgaggacctcagagaccctttctacgttgaccagtatgagcaggagcacattaagccgcctgttatcaagcttctcctgtccagcgagctgtactgccgtgtctgcagcctcatcctgaaaggggaccaggtggccgccttacagggacaccagtctgtcatccaggccctgtcccggaaagggatctatgtgatggagagtgatgacacccccgtgacagagtccgacctcagtcgcgcacccataaaaatggtgagtggtctgcggtggccgcccccaggggccatcctctggagccgtgggctctcgtgtggcgcacctggtgcatggatggtgtgaacacggtgtgcggcgaggtggtggagac

SEQ ID NO: 49040 - DNA, 1074 bp, Homo sapiens
acccttggatcttttgttattctcccgcaggtcttggaggctctgttcttcttttctccattgcagtttctgcctgttgttcagattgggtagattctcttgatctgacctcaaggtcaatgattctgtcttctgtcatctcaactattgctgagcccatccagtgagttttaaaatgtctgttactgtattttccagttcttcatttggctctcattaccagaattttctaattttgtttcaggagaatttgtgattacttgggagtgatttcatgccagttgctttaaaatccttgtcagatagttccaacatttgatttatcatggtgtttgtgccagttcatcatcctctgattaaagtcatttctgatggcttcctgatcattttgtctattttgttaggaaactctgggtactggttttattttagcagtagtcaccttgttcaggtttagcatgcaggcctgtcctacttttgtgactgtggttctggtgatagtctgaccttcctagcctttgtggtgctgttttggtcgcttgacttagcctctcccctggggcttccatgggtccccactgatgttgctcgagggcagcaggagctccttaggctgggcagcgtgctgcctctggatggacatgggagtctctgcgcacaggaccaagagcttcccaggctgggtgtttgttttacacccctgcctctgaggggtggaacatttcagcatcaccgtcaggtgcgtggagtgtggctcctgtgccggtgtccgcccctcccctcggatggcttccctcagtggggagaggagtcccgtgaccagtggggaaggagagtgcctcctaggccaggtgctggtgatggtggtcccacttgctggattcccttggtgcagggtgtgtctagtttgtgggaggggtgtctcaggtccgcctgatggggaaggagagtgcttctgggctgagggatctcttgctgatgtccctacctgctgattgttagtagggcttgggctcgcctggtgtggtaggtggaactcctactcaatccagggcagaataagtgtacctgggt

SEQ ID NO: 49041 - DNA, 1901 bp, Homo sapiens
cttatcccttggggataagaggggactgctgtacttttgagtaatttataaatgacagaaattgattgttcatggttctggaggctaagaagtccaagattaaggtgccaacagatttggtgtctggtgagggcctgttcctcatagatggcaccttctgagtgtccttatatggcagaagaggacaggctccctcaagcctccttagtctcattcatgagggtagggcccttgtgacctattcacccccgaaaggccccacctctcaccactgccacattggggattaggttgccgtgtgaattttgcaggggcagaaaacactcagaccacagcactcctcaatgatttcaaacttttaattttcaagtgttcagagattttcctgttttgtcttatgtatttcccatatgatttcattaagataacctagtttgatttcttttatacttgttaaggtttgtcttgtggcctaggatatgttctcttttagtgaatgtttcatgggcatttggaaaaaaatgagtattctgctgtaacttggtggagtgttctatcagttgtattctgctagttggttgtgttctgatttatatctttgttgattttatgtctagtaattctgtctagggggtgttgaagtccctagctatacttgtagatttgtctgttcctctttttagctgtgtcaacttttttcatgtactttgaggctttatagtttggtgcgtggactttcaggatttttaggtctttctggtagattgatccttttatcattatgtaatgtccctttttgcctctcgtaatttttctactttattaatgtagttctgctttttttaaaaaagtgtttgaatggcgtatcttttttccctccttttagtttttaacctacttaagttgttgaatttgaagtgtatttcttgtaaagagcatgtaatgatgttatgttttttaatctaccctctaccagtctgtcttttgattggtgtatttagagtgtttacatttactaataacattatattgttaacaattactatttataacgttaggacttgagtctgacattttatagtttgttttctgtttgtttcctctgtttcttgttcctgtttctcttctcttgacttcttattggttaattgaccattttttaggattttctctagatttatttatattgtttttgggtgtatctctgtataatttcttagtgactgctctgggtattacggtatacttatgtgacttacaacagtttactgatatccttattttactgttttcagtgaaatgtggaaaccttttttccatttagccgcccttgctctctccacttttaaataccactgtcttgaccatctgacagtgttaaaatttttgtcatcgtatgtaatttaaaaaactcataaggagggtagtctgttgtatttactcattactcatgtctctgcatttttcttcctggtcctccaagattccttattttcttgctctttggacagcttcctttagccattctttaaggtttgacagattattttatttttcttcaccagaaaacatctttatttcctcttcatttttttaaggatagtcttgctggatatggaatttgtggttgattgacagttcttttccttcagcacttgaaaactgtgccacttccctctggcctccatagcttcagatgagaagtctttggagctggtgttcccttgtatgtatcgtaccattcccctttggctgcttgaaaatattttgtttttagttttagaagtttagtcatgatgtgtcctggtgtggatttcgttaggtttatcttttttggagttcactcagtttcttaaaacatttcattcattcctgtcattcaacatgtttgggaagatttt

SEQ ID NO: 49042 - DNA, 1561 bp, Homo sapiens
gatcagttgagcccaggagattgagcctgcagagagccataattgtgacactgcacttcggcttgggtaacagagcaagatcctgtctcaaaaaaggttaaacttacatgagttcagttgggcattacattgtgaactgtggggcccttcgtatccttttcaggcctcctgtagcaatggaagtgtctgcatatacagagacccataatgacgggcttgaggaggctggctctctaaagggcagatgctactggcagaacaggggagtagagggagggagactcccctgagggaatctggaatgttccattagagtgaaaactgagtttgtagtctaggtgtgtgagaatcagatggaggtaagggaacgaattaagagaagcaaagacaatagggggaagtggaggggagtgcgtgatgtgcacaccgtgtgggaaaggctggtggcctcatgggggtagtggctgcagagttggaaggcgaaattagactggaaaaagtgctgaggccagagcgcagaatgctttgagtggctgattcgtagattggggatttgctctgtgggaattggggaaccactgaaggtttctgaggaggggagagatgtatgaaatctgagcttttcagagaagtccctgctaggatacaatggttaatgcccattgtaaggtataaagtgaagacttttgttttggacttttttttttttttttttaatagagacaagttctgtcagggatggtctcgaactcctgggctcaagagatcctcctgtctcggcctcccaaagttctgggattacaggtgtgagccaccgcgcccggccattttggacctttgagagaaccacttttatcgaggtgtgatttacatctggtaaagcacacatgttttaagagtgtagtttgaggaatttaaaccactgtgaccacaaccacaatcaagacagcattctcattacttcccgagtttcctttgtgcccctgcccggcaggacccacccagggcttcactgctctgctctgttattgtagatgagtttcctctgtgcatctaatctgacttctttcacttagcgtagtatttttgaaattcatgttgtgtagatcttttttgcttagtaataatattccatggtatggctagctcacgttttagaactccattcatctgttggtgattatctgggggcatttccagcttttggctattatgaatagagcttctgtgaacattcatctatgtggacagatgttttcatttatcttaaacagctgtgcttgggattactgggtgataataagatacatatgtgtaactttgtaagaaagtgcccagttgttttccaaagtgacatatttatttggccagcagcttatgtgaattccagttgctttgcatccttgccaacacttgatgatgtcagtctttttgattttagttatgtaagtaggtgggttgtatctcaccgtggtttttgtatgcatttccctgatgacttatgatgagcatttttatatgcttattggccattcgagtacctttttctatgaagtatctt

SEQ ID NO: 49043 - DNA, 1053 bp, Homo sapiens
ccctaatgccacttctctttgggtaacaaggccctctggggtaaacctgcggtggctgccgagacagtcttatccacacagtcatcgggacaaacctgaaagggtctgaagttggcctgactgcctcgtgtccacataagcgatgcgtttctacctgtcacaacctgtggctccctgaagacaagcctgggagctgcactgccccccggctctgctaactacagtcatccctgcacttcctcggctttaggatgctgaaaaccaagatctgttttagcagagctgtgaggaaagaacgtggacggacagcgtcctcagtgctgttgggagcaccctccgctagggtgcggggagcgggcccctctgcacgcaggtcactggttcctcggcctcctgccgcccccagcgagctaacggctgtgctgtcctctaggccgtcatttccctgatggagatggggttcgacgagaaagaggtgatagatgccctcagagtgaacaacaaccagcagaatgccgcggtgagtgttgggctgtggtgagtgagtgtgggctgtggtgagtgagtgtgggctgtggtaagtgtgggctgtggtgagtgagtgtgggctgtggtgagtgagtgtgggctgtggtgagtgtgggctgtggtgagtgagtgggggctgtgatgagtgagtgtgggctgagtgagtgtgggctgtggtgagtgagtgtgggctgtgagtgtgggctgtggtgagtgagtgtgtcaggctgggcgagtgctgggagcctcactcgtgagcgccccgggcgtggtggaggccgtgtgtttgcctactttcacatgcagccggctatgtggcttttaaagtgagacaattggatagatggctcaaacagtataaaaatttaaaaatacggaattctaggtttttaaaagggtgccttatatgtacatattttatggatgggtaatttgttcatttttttttttttttaatttttttggagtcagggtctcactctgtcccccaggctggagtgcagcggtgtgatcacactcactgca

SEQ ID NO: 49044 - DNA, 1050 bp, Homo sapiens
ttcttgactttttaataatcatcattctgattggcatgagatggtatctcattgtggttttgatttgcatttctctaatgatcagtgatgttgagccttgctctgtcgcccaggctggattcttcctgcctcagcctcctgagtagctgggactacaggcacacacccaccacgcccagctaatttttgtacttttagtggagacagggtttcaccatgttggccaggctcgtctcaaactcctgacctcaagcgatctgcccgcctcggcctcccaaagtgctgggattacaggtgtgagacactgcgcccggccaactgtcttcttttgagaagagtctgatcatgtcctttgcccactttttaatggggttgtttttttcttgtaaatttgtttattccatgtagattctggatattagacctttgtcaggtgaatagattgcaaaaacgttcccttctgtaggttgtctgttcactctgagggtagtttcttttgctgtgcagaagctctttagttagatcccattgagacaaatgcttttctagtctattttctcatcttttcagggtcctgttttaagtaagggtctcagttcccactccctacctcccatgggcccaaggcgcacgttctgtctgtgtgtagacatcagaccccgccctcccagggcagcccctgcgcacaccctctcccagggctagctttctgtctcttccttcttgggtttctcacttgtggatatccctttcttgtgaggttagctctgcatgtaaaagtttctctttttttttttttttttgagacagtttcactctgtcacccaggctggagtggcggtggcacaatcatggctcactgcagccttgacctcctgggctcaaatgatgctacttcagcctcctgagtagctcttacaggcacgcaccaccacacagggctaattttttattttttaaaattttgtacagatagggatctccctgtgttgcccaggctggtgttgaactcctggcctcaagtgatcctcctgccttggcctcccaaag

SEQ ID NO: 49045 - DNA, 1048 bp, Homo sapiens
gggggcggtgggcctggggaccgtggcccgagtttctgagcacacctgtaagttatcctggcttgaatccaggcgccccagtttcctctgtgttgccacattcgtcaccttttgaaaaacttgatattttacagttccttctgaccactcatccacaagccccccctgttcggcagcctctctgcggggtgggggccctgcccagagaccgggagggtcatttgccgtcgggggtgtccatgagcgaggggccgctcaggctgccagccgcctccatggcacagtctgcagggctgaagggtccctgcgcctgtgtgtgtggaccttcctcgcccgcgcctcatctccccattcttccttctctctcctgttctttgattcgggttttacttcctccttggaggtttctgtctgtctccgacatgctcagatggcagatctgctccatctgcatgctgtcgtctcgtgtggcactgatcgtttccttggggtgtgtgacattgtgctgtggcctcacctgcggagctcgtgttttccatggagttccatgtggccaggctgtagacatccacctggggtgattctgagtttgcttctgctggtgatgagtggggcccctgccccaccatgtcccgcagtgtaacccccggcttcgcagctcaggtcttccctgcacagggttccgtggagacaaatgcttttctttgtttcttttaaaatttaatttaatgttaagttctgggatacatatgcaggatgtgcaggtttgttacataggtaaacatgtgccatggtggtttgctgcacgtgtcagcccatcacctaggtatgaagcccagcatgcactagctatttttcatgatgctctccctcccccagaccccctgatgggccccggtgtgtgatgttcccctcactgtgtccatgtgttctcatttttcagctcccacttataagtgagaacatgaggggcttggttttttgttcctgtgttagtttgctgaggacagtggcttccagcttcatccatgaccctgcaaaggacgtg

SEQ ID NO: 49046 - DNA, 1060 bp, Homo sapiens
tctaggccctgtagccaggagctgttctggagggcatctccggtccatcccacggctcctcctgcctggggaggacagtgatggccgccgcagacgctgtgtggcagccatgcctccactgggggctggcagactcatgggggtggagcctcagatgattctgttttcttcagtgaagccagagagggtcttcagcttgccctgcacctgcgccagctgggccgacggtttcctcacagggcacaggctgagtatcgggccagcactgagtgaccgtcaccaggcgttcctgtccctttccactggcttcagtcccacctgcagggaggctcttggccctgccaatcccctgccttgccctcagctgatcctgctgtcttgcaagaaagcaatgtcatctcaactctcagaatcaagagttctaggacaggggagcaagtcatagatccaagtaggtttggtggacatttagagaattgatctccttttttttcaccacagttccagacagaactccggaagatactggtgtctctcatcgaggtggcgcagaagctgttagcgctgaacccagatgcagtggaattgtttaagaaggcgaatggtatgagtcaaccccgatgctgcattccagggcggttcactgccggccttggggagcgtctgcagctccacgcactgaccactgaccggaacctcagtgctttatggaagcgctgatgagggcctggggcctgcctcaccggcaactcctgttgatgtgcctgagggcgggcaggtggagctcagacagataattgctgcaaatgtttgtgctcagataaggcccctgaacctgaggctggagccctcatggccctgtcgtctccctgcagcaatgctggacgaggacgaggatgagcgtgtggacgaggctgccctgcggcagctcacggagatgggctttccggagaacagagccaccaaggcccttcagctgaaccagtgcgtggggggccacctccttcccttgccggagacacctggggcctggttttgtggggctcccaccgtgggtgac

SEQ ID NO: 49047 - DNA, 1034 bp, Homo sapiens
cgtgcggccgtcctcgagttctgcctgccgcaggaccaggtgtcttgttcttctcgatctgtcccttggtctggtggagcctgacttcctcgggtgccaggaggggaaactgtctggaggcctcgtattccagcgcagcagctgtggagggggtgccagccgtatgcagtacgtgaggcagctctgagccgctcctccctgcaccagccgcctccccttcctctgctccttgtagaaccttctgccatctggtgtgctttagtgttctggaatattccatggtgtctctgctgcaggtctttttctctttgctatgtccggcacattgactctggagattcagatgtttgagttctgggaaatttagtcctggaaaatgttctgaattggttttttgatctccttgttttcttttctctttctgtaactcttatgagttggctggtaggcgtgttttctgagggattccttgattttatcttctaagcattctgtagcctctttgatctggctgtaacatgtttaaattcctaggccagttctcctcctcagatgatgtcttctagtgttctggtgtgttcctccgtgggccgtctgtcctggctcataaacactatcctcttccctgctgactcctcactttgtgctgctttctgttgttcctttttttttttttttgagatggtgtctcactgtcactcacccaggcttgagtgcggtggtgtgatctcagctcacctcccaggttcaagtgattctcctgcctcagcctcccgggtagctgggattacaggtgtgcaccaggacaccgggcttatttttgtctttttagtagagatggggtttcaccatgttggccatgctggtctcgaactcctgaccccaagtaattcacccaccttggcctcccaaagtgctgggattacaggcatgtgtcaccttccagaggccctggatcttgatagcagcgctttgggactgggtggctggctggggcactgcgctttgggtgtggaccctgccattttgccccc

SEQ ID NO: 49048 - DNA, 3109 bp, Homo sapiens
ccctgtcttgggcacaggtggggttggagcccccatggggcccgctgggaacctggaccaagccttcctcggagatgggaggaagccgcggggtggagcaggggcaggtaggtgaggttgagctgcacttgagttccctctggagtttccttcatctgccccacacccaaatttgcactttaatttgaccatccctgggggcctggctgctgacagaagggctctctctgccctccactccaaagtgggtgcccccccacccttggccaggacagggagggagccgctggctgctgccggaggtggtggctgcacagaggacgcctgactgctgttcaggcccgcacaatgtcccgtgccccttcctcactcgtttgtaatcgccgtctgttttgttctgggtaaggaaggcaagagctatagataaaacttaaataataataatttaatgtgaatgggttctgagctctccctgcgccccgggcgggccaggccgagcattttgcactaatgtgtcccacggtgggcgtgagtcgggagtgtctgtggacgtgcgtggctgctgagcggacctgctgtgtgctccctccacgtcctgaatgtaccgtggggcgggggcggcggcccgggctcagaggggccttccagagtgccttagcatcctttgatcatttttcccaaggaaaccaattaagaaagccggacccttccctcctttgtttacaagatgactaattctagaatccggggttgtcctgtcctgtgagtgtgaccctgactcatccagaccctgtagagagagacgagccactcagtatttatgagatgtctgcacctttatccctaagcctgactattagcaatacgcatatcctatatagaatctattacagagctacgttatctccacaccttttgaggaggacagaagggactggaccgtgttggagctgccgcctggcaggtggtgggcctgggatctagccgcctctcctgccctgccttcctcttccccaaggggatgggcccaggaggcagctgggttgcatggagaggtccaggagggaccggaggtgtgacagatactgtgagcccggcgggccgcgcctggctgggtgcctcggtacttgaattctgtcttgttttccgcattgtgtctgtccacccgagttctctgtcgtcacttaactttgcattggatttggttgttgtactttgcccctgaatgtggacaaagctgtgggcaagaggtcagcaggacccgcctgggggtgccggcgttggtgactgcgggtcggggctcctagaacataggagccggctgcctggcctcctttctcctccaggaagagtcattctttggcatttgtgtttagagccaggaggaaggcggaaggtagggagggagggctggtccccctctgagggggctctagtgcctgaccctgacctgtcctcattcgacagctgaaactgttaagcgctggcccagtccccccaccccacccagccgtgtactgcctgggctcccctcaaagggaaatttttatggaaacatcttggcagcaagtggaaaaagatctatggcccatgaaccaactgaaaactccaagaaccctctgtctgcctctgccagcagcgagtcctaagcgcagaatccagagctcgtagctgtcctcagctgtaactactgtttcagaatgttgctgctgcatacttttgtcatgtcagccagccagctccgtgggtgagagtgtgcgtgtgcgcgtgtctgtgtgtgtgtgcgtgtctgtgtgtgcacgtctgtgcgtctgtgtgtgcgcgtctgtgcatgtgtgtgtctgtgcgtgtgtgcgtctgtgtgtgtgcgtctgtgtgcgcgtgtgtgtgcgcgtctgtgtgtatgtgtgcacgcgcgtctgtgtgcacgtgcgtgtctctgcacgcgtgtctgtgtatgtgtgcacgcgtgtgtctgtgtgtgtgcacgcgcgtgcacgtcaccaccggagcatttagggtttggtacaagatggttctaaaatggcaaaggtttttcgtgtttgtttgttttgtttctttggaaaaagaaaaggaaaggaaaatcatgcagaatcgcaagcattcagactggacgaccggctcgtattccgatcagtcgcttccattgttagcatcgtacacgattgtgatttttatgtcaaaagaagccaaaacttgcaatactatttttagcagacaaaaaaaagaactaagtataaaatgtataaatatttttgacttgaagatttggatggcactgggtgcaagtagagcatccatccttcggatggaatgtttggaaaaaagagacttttaaaaaggagacggttgttttaaagagtctgtttaggggttaaagtactgtaactcacgactgttaaaaaataaattttcctgtgctgtaaaggaaggtttcacagtaccactgagttagatttcagccacagatgcttagctttttttttttgtcttttttttaaggaggaagcctttgttttgttttcctgagccctcactctgtttttgtgctgttactcggtagagtcaagactgttactttttagccatggctgacattgtatcaataactaaaactgaaacattcaaaagcgaacagggaaaccgagggcttcaagcgtgctcagagccgtttcagacagtggaaatccatgacaaacaaaaggatgtgatcattaattgtaaagcgctttgtaaaattcacatttacaaaataataaagtcagttcaaacctaagtttcctggacttggcttggccctgtggggtttgggggagacacagagaagccaagcttgggctattgaaggcaggggtggccaatggtcccccaggggcaccctcaggaccccgtccctgttagcggcgtccccaggccagctgtccacacaacagggcagggatctggctgtggggttcaaggtcacctgacccatctcttgctctccccagtgttttacaagggaaggggcaggtgggtaggatgtctgcaggtactagtgtgcctgctagaggggggccctgtccggacccgcaggcaacctgccagg

SEQ ID NO: 49049 - DNA, 1857 bp, Homo sapiens
aaacgtgacctctggtcttctggctgaggccaggagagccccaggtggtcacatgggccccaggagcggccggggaggctcatccagggcatcatggttctgtggccttggggaggggcgggcctcccggcaggcaggtggctgagctcacgccgccccgtcctcacagtgtactgtcagaacttcgcccccagcttcaaggagagcgagatgaacgtgatcgccgcggacatgtgcaccaacgcccgccgcgttcgcaagcgctggctgcccaagatcaagtccatgctgccggagggcgtggagatgtaccgcacggtcatgggctccgccgccgccagcgtgcccctcgaccccgagttcccgcctgccgcggcacaggtgttcgagcaacgcatctacgccgagcggcggggcgacgccgccaccatcgtggctctgagaactgacgccgtgaatgttgacctgagtgccgccgccaaccccgccttcgacgccggcgaggaggtggacggggctggctcggtcatccaggaggtggccgcccccgagccgctgcccgccgatggccagagccccccacagccctttgagcagggcgggggcggccccagcaggccccagacgccggcggccgcggcccggaggccggagggcacctatgcagggaccttgtaagcggagctgggtggctgcgcgagggaccgagtactagagctgcttgcatgcgttactaatacaaacaaatgtgatcaagccacttacctactgaactgctactgttgcctgagaaaaatgtgatttttattctgcttgtatttaaaattgatgaaggaaacaaatgcattcattatactgtaaacaattaggccactggcagcctcctgcgaggaagttcccagggctcccttttgatattcacaaggtcagcctccaagtgtagcttccctcccccttcttggggagggtgggaggccgccaggcccctggtgcccagccctgccccttcctccctgcccttcctgctcctcctgcccggaagacgaagcaggggccggcggtggtctgtggcgagggggctgggctgtgcgtcactgacccttccttccttccccatggaacctctctggggcgacggggcagggctcaggctccagggcctaactcctcgtttttccttctttcggagactcggggccaggcccaccgggccttccacctgtgtggggtgtgtgcacgagtgtgtgtgtgtgcgtgtgtgtgcaggggtgtggtgagggggcagtgatggctgtggcccacccctcggggtggagaaaagggtactttactctgcccccacaccctgtccttgttctgcccgatccgtctcggctctgcagcccctcggtcccctgacccccagggcaccgctgaccccgcctggcctcccactgtcccgcccgggcccactgtgggacgtgcacagctgatgtagcacacgctgccctctgccgcctcagccactttgggattatgcttgtcttgttttttttaggttttgttgtaatttagatctatttcatatatggtttggaaactttcagactcaatagaacaaaaactttgggtgggatgggtgtccctgtccccagcccaccatggcttggggtgggtcatctgtggccgttagggtgcgtccccctgctcccccgcccagggccagggaccactcgtctcccactgggggaaaaagggggtcccgggtgggcgactagtacgtgtgaagctgagctcagggccggacctggggagcgggggactccgctcgggcaggaggcagcggccagggctgggccagggcgagagtcggtcctc

SEQ ID NO: 49050 - DNA, 1034 bp, Homo sapiens
tccagctcctcctccccctccacctccccccctccccctcacccatctgtgcgcctcttcggaccctatggcccgggaaggccacgagccctttttctgtttggtggctgcaggctctggggtctacatcacacgcggccagctgatgaactgccacctgtgtgcaggggtgaagcataaggtcttgctgcggaggctcctggccaccttctttgacaggtaggtcggggcaggagtgctggagggcacaatggagctgcggagggttctggctcctttagctatgagctgtctgatcgtccagggttgtggcattgaaagccctctcgcattcctgacttcagccgtggccggtcggccccaggacggtggagaggctcccagggagggagggaggggctgtctttcgtggcctttctcaaacgggcttgtggatgcaacccccacaacagaaaaatgaagagccacacttattctgttgtgctgatgggccaacagaacccttcccgaggacacagcggcttcctcagacgtccccggagtccctgaggacaaggctcaggtcaccttgcagccccatcacccggtcatcttctcagcccagacgcttttcctttgtcctgtcccttagagggtggctgggccggctcctgccactgggacacacgcagaccagccaagggtgaggccaagtggcctcccagcagggcattcgtgcgggcgggtcgcctccaggtaccctccccatcatcctcaccctgcctgcctttccggtccctccaccaggaacacgctggccaacagctgcgggactggcatccgctcgtccaccagcgaccccagccggaagccgctggacagccgggtcctgaacgctgtgaaatgtaagagcctgggggtctctcgggtgggtggggccggggctgggttcagatcccagcctgaggaggactgggtgggccgcgggggtgctcccggccacctgcagcttccgtccctgggggccgagcatggtctgattgaggggaagatga

SEQ ID NO: 49051 - DNA, 1092 bp, Homo sapiens
agtgtgaccggcaggggcctcttccttgctcacaagcccatcgaggggcctcctgccaccctggaacccagctctggccccgactcacggggcctctgaatggcccttccgggggccacgagggatgagccgtcctgtctctgccatgaacaagtctctctgcgggttctccgttaaagcccagttgtagcctggaccttgaagctcagctcctgcagagggtgagctgggggccggggaggtggaggctgcgtgaagacattgaggcacctttgcggacgagcttccactcggggcggggtgtttttagccagcagcacccggtgcacggcaaggcagaaatagaagaggcttttttggccgctctggtgctgacagtctctggctcttggggagctgggcaggggctggggaggggcgggtgttccaagcacaaacaacttctgctgtttagaaaaacatctcgagacgaggtggttgtggatggggaattatttctgttggtgaactctttatgtaaatgccacgcaccgtgcggcttctccgcgtgtgtaatcacagcaggctgcaccgggggtgggggtgtgtaattatgttttaaaataccacccgggttgttttgctgtgttccctgagcactcgggtaattctgggcttatcctgcgatgctctgccccaccgggaaatgctgcctgacccctgtagtggccgggcaggggctgtgcacccacctttgaggccccctttctggcctctgttctgttgcagcctctgcttgggtgtccctgggccttgggaagctccccttcctgggactgacaggtgcagtgcgtaccacgctcatcctgggccagtgggtccctggggagggagtgtcagggtgactccagggtgggtggtttcagaccccgcatggttctcaggagtggaacacctgctgccttcagtggggcgcccgctgtggattcaggatgtggggtcctcagaaaccaaggtttcagccccccagggctgggtggcctgcccctccctgacaggcgctgggtgcaaaggtgactctgggaccctccctgcctcctgccctcctcaggc

SEQ ID NO: 49052 - DNA, 1045 bp, Homo sapiens
gcctgcgtggtctctgatggtgtcacctgggcgagtccccgatgacacactctgccttggggacaggaacagggctcgccatctgggacatcctgccgtggtgttggcccgtgggcagggatctcggggtgttttgcctggtgaggacgtggagcacctcagaacccaatcagtaacccagggagttgagaaaagtcagggtgaggccaatgagacccggtttccctccagacctgcatggccccctccttctgacgttcgttcatttgttctttctgagcgttgttattgtggtaaagtggacgtgagaggggccgttgcagtgacttttacgtgcgtggttcggtgatgctaagcgcattcccactgttttgtgagcatcactgccatcggctccagaacttcccatcttccccagatgaacctctcatccccatgaaacggtccctccccgttcccccacccagccccggcacccaccctctgtttcccgcctctgtggacctgacgactctgggggccgcctgcgagtggagccccgggatgtgtccttctgtgtctggcagcttcctgagtgtggtgtcctccaggctcagccgccctctcgcaagctcccctggtgtcgcccggctgggagcagaagggcctggaaggtacggcgggggctccttctgggtccctgaaggccccaaccccgcgccccgggcagcatttgtccttgtgtttgcttcgccccgtgtggtccagggaggctgcccacctgcctaccctcagtagctgggccctgctgcccgggaggctgctgctccgggccctctcgtcgtgaccctggtgcaccttccctgtgtgggggcgcggttgttcacctccatgcagttagctcattgctctttatgagctgttcccagatgtcaccatgctgagaggtttggagggcaccgtcctggcacctgagtttcttcacagggctgtcgagggtgaaggtggcagttctgctacagcggccagtcctggggtgacaggaggccacgggtcccccagtacc

SEQ ID NO: 49053 - DNA, 1027 bp, Homo sapiens
ggcaggggccaggtttgatgggactgttgagctggtcgagaagcccagagggtcccactcactcggggatcccacgttctccgagagctgagcaggcccaggtgccctggcgggctgcagggtcatgccggcccctcgcgtcgggagcaagctcctgggggtgccagtgaggattctacttagtggcccccacatcttcccccgcagctgcacccatgagtgtgggcatggggactcgagagaccagcgagcccctttccatccgggtttccaggagacccagagaggccaggatatgcgtacaggtccttcctccctccctcctccccctccctcctccctccctcttccctccttccctccctcctccctccctcttccctccttcctccctccttccctccctccttcctgatgtgaatgtccctctctgccttcatttttcttcctcctggctttccctgctgggcttttctgcatttccccatgtgtcagcatccacgaaacgggctgtgtcttaacaggcacggtgtggcgtggcatggcgtggtaattggtgatggtttgccttcccagttatggcgtggcatgattaaattggtggcacctttgccctgtggcacatgagagaatggcatgccttataattgtggcctctgtgctcccaccaagtacagcgtggaagtcgtttctggtctttctggaggatgacagaggcactgccccagccagcactggtagttgatgggccctgtgtgttaggcgcatgctgtgtgccaggccctggggacactgaccagcagggtgagcccccctcactgccagaagcactggacccagaacaggctcactggccaggaggcagcgagctgggaccatggacccacccccaaagctgggtggaaggggcaacagcagggaaggcaggtctccccgagctgcagtgaccacactaaatgccacgtctgcaccagttggccccacagccggccctgggctctggccatcaggaggcacctgggcgggg

SEQ ID NO: 49054 - DNA, 1314 bp, Homo sapiens
ttgctccatctctgcctgcatgcatggctacttagtagtcagcagatatccaagggacagttccgaaattgcaccctgaggccggctctcaggatcctgggccccgaggctcccggctctgtcagccactgccgcctttaggccctgccgcctcagctgctccaccccagggctggcaggtcccagttctcaggatcgcagcccctcagggttgtagttggtcttttgataattttggtagttgtttttgatgagggagttagtctaatattggctgctccctcatatccacagtgggaatctctggggcgttttaaaagttaaatatatttatttttgcatagctaatgtgtgttcactgtcttaaagactaggaaaaggtcatagagtgaaagccattctcccctgctggtcctcacatgcacactctgtccttacacacacactctgtccttacacacactgtcctcacacacactgtccacacacacacacacacacacacacacacattctgtcctcacacacactgtcctcacacgcaccctctgtcctcacacataccctctgtcctcacacacacacactctgtcctcacacacacacactctgtcctcacacaccctctgtcctcacacacacaccttctgtcctcacacacacacactctgtcctcacacacacacactctgtcctcacacaaaccctctgtcctcacacacacgcaccctctgtcctcacacacaccctctgtcctcacacacaccctctgtcctcacacacaccctctgtcctcacacacacacactctgtcctcacacacacacactccgtcctcacacacacacacacacacacactctgtccccacacacacactgtcctcacacgcaccctctgtcctcacccacacacacacacactctggccctcactcacactctggcctcacacacacacgctgtccccacacactctgtctcccagaggaactcacagctggcacacatcccgggagcttcctccatgtctgacgcatgtgcacgtgtgtgtggggggggttgtgcatttgtgtggttgggggcatgcacgtgtgtatggcggtgggtacacacttgtgtgggtggcatcccgtgcattgcccttcatttgtccttagtgtcctggtcgtccttctcagcacacacagaccctgctagtgtcttcacagtgacccgtgccatgtgctgtgataggtgggattgattcaacctgtgcctatggctggacaagctcttgcaaaggcagggcgggccacctgctgcctcgaggatg

SEQ ID NO: 49055 - DNA, 1071 bp, Homo sapiens
agggcacagctgtttaagtgatttttgttttttttgttttttttttttttgagatggagtctcgctctgtttcccaggctggggtgcaggtggtatgatctcggctcactgcaacctccacctctcgggttcaagtgattctcctacctcagcctcctgagtagctgggataataggcgcccaccaccacacctggctaatttttctatttttagtagagatgggatttcactttgttggccaggctggtctagaactcctggcctcaggtgatccacccgccttggcctcccaagtgctgggattacaggcgtgagccaccgtgctcggcctttttaagagatttcctaatcttgtttgtgcatacccttcccaggtaggaaaaactctatactttatgggagggaaaggctcgtcctggtcctggtgatggacatgcagagaacttgcaggctcggccacaggtcaaacgtaaatctggaaaatggcccctcttcttatctcagagggaggtgtttgcttctgcaatgtacgtgacctctttcctggattgaagaacaaagatgaccaataggcacaggactcgagcccctcattggccctgcaggcatctccacaggatcagcccacagagtcagaccccagcctccagggccccctcgctggtgcgttgctcccaggtgctctgcacagcatggccgagaccagcccaggggtcccgggagctgctcatccctggtccccgccacgtaatgggaatgcggctcaaaccacacgtttgacaggagagagacagatcgacagacctggcccacaaccagacacagaaacagtcccggggtgaaagggctcaacaacaacaacgagaacaaaaattagaagaaaacagtgacggcaaagtcgggcttcttctcttggggagacacaagaagacaggcatggggttgagcacaggccatgtacctcatgtttctgggatgtcctgtgaacgtataattttatttatttacttatttagagacagggtcttgccctgttgcccagactggagtacagtggcacgatcacggc

SEQ ID NO: 49056 - DNA, 1006 bp, Homo sapiens
tcagccttccacgtagctgggactacaggtgcccgccaccacgctcggctaatttttgtattttcagtagagacagggtttcaccatgttggccagatggtctcgatctcttgacctcgtgatctgcccgccttggcttcccaaattgctgggattacaggcgtgagccaccgcgcccggcccatcgagcatcgtttaagtgcattctgtggtgttcacagaacgacaaaatcacctgcggtgttcagagaacaacaaaatcacctaatgatgcatttctcaggatatatccccgtcgttaatcaacacgtctgtattcagagttatgcaaccattaccatcgtgaattttagaacatcttcatcactccaaaaaccacaccctttagtagtcattctcatttccccatccctcccccacccccactgctcccggctctaggcaacaacaatttttttttttttttttttgagacagagtttccctcttgttgcttaggctagctcttggctgtgtgcgatcttggtgcgatcttggctcaccgcaacgtccgcctcccgggttcaagcgattctcctgcctcagcctcccgagtagccgggattacaggcatgaaccaccacgcctggctaattttgtatttttagtagagacggggtttcgacatgttgcttgccgaggctggtctcgaactcccgacctcaggtgatccgcctgccttgacctcccaaagtgctgggattccaggcttgagccactgcgtccagctaaatcttttttttttttttttaatctttttaaatgatctgttctggacattttatataaatggaatctcataatatgtgccctcttgtgaccagcattttttttcacacttagcgtaatgtttcgcttagcgtagcgctcatccgtgctctcccagtacttcattcctatcattgctgaatgacattgtatggatattccacattttacttacccattcagcccgtgatagacattt

SEQ ID NO: 49057 - DNA, 1050 bp, Homo sapiens
cgtatttgattttcttgagacttcttctttgacatatggattacttagatgtatgttatttccatttctagatttccctgttacctttgttacgatttctagtttgattccactgtggttagagaacacactgtgtaattttaagtcttgtaaagttcttgaagttttctttctggcccagaatattgtctgtcttggcatatgttccacaggcacgtgaaaagaacatatgttctgctgttgttgagtggagagttctgtaatgtcagttagatcctgctgatgttatttaactcactctatctctgctgattttctatctagttctatccttgtttagagaaggctgttgaagtctctactagaattgtgggtttgtctttagttctattggtttgtgcttcatgtattttgtagttccgttgtctggtacatggacatttaggattgctgtgtcttagtggattgatgctttaattattatgtcacgtcctactctatctctgataattttatttgctctgaaatatgctttatttgaagtaaaacaacccttgctttcttttatgtttgcataatttatctttttctattctttttattttaacctacctatatcattatatttgaagtgaggtgttttttttgttttgttttgttttgttttgttttgttttttgacagagtttcactctttcacccaggctggaatgcagtggcatagtcttggctcactgcaacctccgccttctggtttcaagcaattctcctgcctcagcctcccgagtagctgagattacaggtgcctgccaccacgcccggctaatttttgtatttttagtagagaaggggtttcaccatgttggccaggctggtctcgacctcctgacctcaggtgagatccacctggctcagcctcccacagtgctgggattacaggtgtgagccaccgcgcccagtcaatagaatacattttaaaatatgactcagctatatgctatctaaaagaaactcacctcaggctgggcacggcagttcacgcctatgatc

SEQ ID NO: 49058 - DNA, 1034 bp, Homo sapiens
tcttgctctgtcacccaggctggagtgcagcggtaagaccacagctcactgcagccttcacctcctaggctcaagcgatcctcccacctcagtctcccaagtagctgggaccacaggtgcgctccaccatgcccagctagtttatttttattttttgtacagacagagtctccctatgttgcctaggctggttttggactcttgggctcaagtgatcctcccaccccagcctcccgtgtagctgagactacaagcacgtgccaccatacccggccaattaattctttatgtagcctagatattagtcctttgttaaatgtgttcctggcatgttttttctaccagcctgtgtcttgtcttttcatcccattacctgtgtcttgtgctgagcaaaagtttttaaattttgataaagtccagtttatcagtttttttcttttatggaagaactctctgcctagccccggattctacaaatattttattctcttgtgtgtttttttctttcccctctagttttatgtttaagtctccaattcattttggggttatttatttatttatttatttgagacggagtttcactcttgttgcccaggctggagtgcaatggcatgatctaggctcaccacagcctccgcctcctgagttcaagtggttctcctgcctcagcctcccaagtagctgggattataggcatgtaccacattcagctaattttttgtatttttagtagaaacagggtttctccatgttggtcaggctggtcttgaactcctgacctcaggtgatccgcccgcctcggcatcccaaagtgctgggattacaggcataagccaccacacccagccttttttttcttttcttttcttttttgagacagagtcttgccctgttgtgcaggctggattgcagtggtgtgatcttggctcactgcaatctctgccttctgggttcaagcaattcttgtgcctcagcctctcaagtagctgggattataggtgtacaccagcacgcccggctaattttgtatt

SEQ ID NO: 49059 - DNA, 1068 bp, Homo sapiens
acccacacctggggctccccacttcctggcctgccgctttgagggagcagaagccgccattgaggacaaggtggaatcggctcatttcacgcagaaccaagagcgtcggcctggaggaggtcacgtcctctactgggcctcacgtcactgtttcgtgaggatccgattgctgttcccccagccccatacgcgacagtgagtgggggacagagctcccgggctcccagaaggaggccgtgcgagaacccattcccgccagcatcccccggccctgccgactccgcctcggctgggaaggccacgcttcctgccgctctgtgtgaggtgtagacgccgaggctgagtgatacatccccgagccccgcaggtgagctgggaacagaatgtgaccaccgacatgggccctctgggagtcacaggggatggtcgttcggaaggtccagcttcatctgtcggtgcagtttagggtgtgacttggtggaggcacggtcagtattgagtcaatgttgaaccagagataggttccttgaggaaggcaggcagccttgctgtgacagaacgaggaatggttttgacctgtccgtctgtgttaattgaagggatgatacataattttaaataacctcagaaattattaacatctttataaagaaccttaatgtttctggaatgaagaactttgttttctttttcttcttttttctttttttttttgagacggagtcttgctctgtcgcccgggctggagtgcagtggcacaacctcggctcactgcaagctccgcctcccgggttcactccattctcctgcctcagcctcccgagtagctgggactacaggcgcccaccaccatgcccggctaatttttttgtattttattagtagagacggggtttcaccgtgttagccaggatggtctggatctcctgacctcgtgatctgccctcctcggcctcccaaagtgctgggattacaggcatgagccaccgcgcctggccatgcctggctaattttttaacaaattatttgtggagactataatcttaccatctctcctggtctctcact

SEQ ID NO: 49060 - DNA, 2028 bp, Homo sapiens
ccagcactttgggaggccgaggcgggtggatcacgaggtcaggagtttgagaccagcctggctaacatggtgaaaccccgtctctactaaaaagaagtacaaaaaaacccaaaacaaaactatgattggactgatattatttacgtggttttcactcccaaaggcacacctttgcgtataaagcacaagtcagtattcatcactgattccttattcacttttcaaactactttcacttaccttttattactttataaataattttaagcacaattttgttgcccccttgcctgctccccggtgtgggggtggccagagtccttggggtcccctcgcatttcccgggtgaccacacagctgccccctgctcaggtgtcaccgcctggggaccttctcctctgtgaagggcctgttctgggctcttgcccctccctcctctgtgcgtttcccttttcttgatggatttgtagaatttgtagaattctttccatactctgaccacacgccctttgctgaagatacatatgttgcaaaggtctgtccttctcggcttgttttttctcttagtgttggtctttatttttcaatattttaatgaagcacgacttatcaacaatgtcctttgtgccctgttagggtttttgttgtttgtttgtttgttttgccaaaggccatgtttctcttctgctttttttgttttgttttgttttttgagacggagtcttgctctgtcgcccaggctggagtgcaatggcgcaatcttggctcactgcaacctccacctccgggttcaagcaattctcctgcctcagcctcccaagtggctgggactacaggcgcccgccaccacgcccagctaatttttgtttgtttttttctctgtcacccaggctggagtgtagtggcgcaatctcggctcactgcaacctccacctccgggttcaagcgattctcctgcctcagcctcccaagtggctgggactacaggcgcccgccaccacacccggctattttatttatttatttatttatttttgagacagagtctcgctctgtcgcccaggctggagtgcagtggcgcgatctcggctcactgcaggccctgcctcctgggttcacgccattctccgcctagtcccaagtagctgggactacaggcgcccgccaccacgcccggctaattttttttgtatttttagtagagaaggggtttcaccgtgttagccaggatggtctcgatctcctgacctcatgatccacccacctcagcctcccaaagtgctgagattacaggcatgagccaccaccaggccaatacattttttaaaaattgtagtcaaatatacacaacatgaaattcaccattttaaccattttttaagcgcacagttcagtggcagtaagaacattcccatggctgtcaaccctcacctctgtttgcagaacgttttcatcatccctgaccgaaactgcacccattgaacaccaactcccctccgcagtcccccagcccctggaaacctccgttctgcttcctgtctctgaactgtcctgctctgtgcccgcgtgtgagtggaaccccgtggcgttgtctgtgtgtgcctggtggctttcactcggcatagtgtctttgaggttcaccgggctggggggtgcatcagaatttcatttcatttttgtcgtggtatgggcaggaaacctggctcagagaacatttgaggaactgggtgtttagagtcactgaggagaggaggctggatagattgttgggttagttacagcacttcttcgagttccgcagggccgggaaacgctgccccttggggttctctttgctactggatggaaatcatttgcttttcttttggttgcatataggagacttaggatgtcacggggtatggggtgtcatcactactgagttgcaaatcaggcagaggccgcgaagggtgcctgtttactttatttccaagttttcgatgactgttctttgcaggatctcttcgtgaccacacgtaaccttcatgc

SEQ ID NO: 49061 - DNA, 1987 bp, Homo sapiens
agcctccgggctctgccagcccctcccattggagctgccctgcacggcgcccggcctctgggctctgccaaccccttgtttccacagtgagttcaggattgtggagggacctaccccacctggctacccagcattggcaggtggggactttgcttcagatgtttaagaaaaaaggtaaaagataaagtaattaaacttacagaaaaatgtcaagtattgtacaaagaacattttcccgaacgatttgaggtaaacctcccctgcatacctgtgtgtcttgttccagtgtgggcagagggctgcccgccacccgcctgtacccaccccctggcagccgcctcccaggcccctcctggccttacaccagcagatccagtgcagacccctcagtacagttacttgttgagtctctttaaatttaattaaaaactttttttttttttgagagtcttgctctgtcgcccaggctggagtgcagtggtgcaatcgcagcctcaaactcgggctcaggtgatctccccgcctcagcctctggagtagctgggactataggtgtggatccccacacatggctgatttaaaaaaaatttttgtgcaccaccacatctggctaattaaaaaaatttttttgggtcgggcacagtggttcacacctgtaatcccagctacacaggaggctgaggcacaagaatcacttgaaccctggaggcggaggttgcagtgagctgagatggcaccactgcactccagcctgggcgacaagagcgaaactcagtctcgccaaaaaaaaaaaaaaaaaaaaaaaaaattgtagaaatggagtcttcctatgttgcccaggctataaattcaaattttaaaaactttctgattaattatacataaaatttaccgttttagctttttcagtggaatgaagcatgcacatttttgcgctgccctcagcaccatctctagaactgtttcatctgcccaaactgaacccctttccccattagacacaaactccccatccttgccccagcccctggcaggcacctttctacttcctgtctctgtaggcctgcttccgggactgcatgtgagtggagtcccacagggggtgtcctcgtgtgactggctcatttgctccgcaccctctccccacggctcctccgggttgcagggagtggcggagcccgtcccttctccaggctgcgtgatgtatgtgtgtgtgtgcgcccgccgccatttcctttgactgtcacccattggcggaccctggggccacttgcctcttggctgtctggtgctgccgctatggacgtggcgtgcgcgtctgtttgagtcttgctgtgtctctgggctcttccagcctggtgtattctgtggcctttccatggccttcgtgaccctgactccggggtctgggccagtttgacagatttgatagatggaccctcgaggtaggtttgtctgtggcctcctggtgattggcgtcttgggcagggacgtcagagataccgccttcttggacgttgccccaccagcggagaccggacattgcgtaggaggtgtctgtgtgatggatgagtctcggaagcagccctccagcaacccgcctttggtgaaggccccaggtgtgcatggggacagggctggacacaggaggggctggggcatgcagtaggggaggggttggctacccaggaccaggtctgggtgtggaggtctttgacctgggagcggggaggctgcaggttggtgagtgggtgttgagggtctcatcggaacccactgctcctggaaagacgggtcccctcctggctggatccatgtccctcagttgtccctggagccactgagtgagggacaccctcagcgagcaccaccttccctacctccccgctcttcctcaggctgtggggctgtagaggaactaggagatggggttgtggccaggtcttgggtctccccacccagtgatgcgggagaagttggggtgagg

SEQ ID NO: 49062 - DNA, 1023 bp, Homo sapiens
taccttctcactcctgggcactgcctagagtcagggggcagctgtgggccttccttggttcttctgcggcggtcttggagggagtcagcgttggccctgcctttggatcggagcagaaggaagttgtcccacatcttcctcctcccagggacccctgaggcatcccctctggccagggcccccacccaggccctgggcatctgcctcgggggctgtgcccatctcccttctaccacccagctggtgtctgtgccaagaaaggggaagtaccatctttgctgaattcttgacttttgtgctgttaaaaaatcagctttaacagagttttgctcatttaatttcatttccattgcacagctaagcgcctttgttaaattttgtatattgatactttttgttgtcagcagtttattctttttttttttggatataaatccattagggtgagagaagattaaaaagatacattacaattaaaatgttaatgaaatccgtatcacacaacttttgaaaccctttaggcattaatcttgcctgtgtcatgtccattaactttggctattcttattccacactgacccctgctgagagatttgtgctataattggatttttttttaataaaaaagaaaaaaaaaaagcttttaagaaaatagaggttgagtggtcggccgtggctcctaaatgaagagggaaagtagaagaacatgactcactctgttggggctggggtcccccattctgaatggggacaggggtcacccagggcctcccccaactgtggatgtgccaagtggtgtagaggtacatgagttgggggagcctcagaggagggagggcaccccgagggtgggttcaccttcttggggagaggcccccagcgctgggggaggggctaacaggagccccccaccaggtggggttgtggggggtgacatggaggctcaggcagagcagaacctgaagggccttgagttctctgaagtctgtaccccctacccttcgcctggaagtcaggccttcg

SEQ ID NO: 49063 - DNA, 1194 bp, Homo sapiens
gtcttccgggcaggatgtccctcgagagctgtgcttgcctctcaccaacttagaactaaccccactcccaggctgggcacggtggctcacacctgtaatcccagcactttgggaggccgaggtgggcggatcacttgaggtccggagttcgagaccagcctggccaacatggtgaaaccccgaatctactaaaaatacaaaaattagctgggcgtggtggcaggcgcctgtaatcccagctactcgggagggtgaggcaggagaatcgcttgaatctgggaggtggaggttgcagtgagccgagatctcaccactgcattccagcccgggggacagagcaagactccatctcaaaaacaaacaaacaaaaaagccaactaccccccggcccccccaatacaccccggaaaagcagccctgctgtttggaatctgaccccttaaagtccttctgtctgtcctatctgggagcctctagatgctgccaaaggctttcccaagcccagctctcacatgtttcctgcaaaggacagtggctgtcccctgagcctgacttggccaaggggctctgccgtgcctcccgggaggaggtgagtcactgcagccgcccgaccctcagccttctctggagcaggaggcagcagctgctttacagctgcataaaacattagagggaaatttaggacaaaagaggaagacgattagagcatccaatttaaaccgagggagggcatacggaacccaaaacggcactgccctaattcaggagcagagggaggcacgggctctgcaaccgctgacaagaaccaaaatactcacccagttttcttctgcaaaagagacccaaagttgcctgacaagatgcccacagatgtcccaggccctgcgggagccgacctcctccccaggggatgatgcagcccgctccgtgcccatgccagctggccaagggcacagcagatgccccaggtcaccatccttccagggacctggctcagagccatgggatgttctgttctttccgccaagactctgtgggcaccgctgtggcaggccagagcaaggctgagaagtggccgggaaggagccacatccaactgtgcaggcagctccccccagctccctccctgctctctgctctccctggaccaactggcccagcctaaggctgtgcagggactggacagcagggtct

SEQ ID NO: 49064 - DNA, 1020 bp, Homo sapiens
cacccagctggcaaatcccggggaagagcggcactccgggcgttctggcacagacggctggaagactggtgggaggtgggaggcgcccctggaagggctcctttgggccctggcggccgagtccgtggctcatcctcctggcaccagggcatctggggagcatgtccgccctctgggctgtccacagtcattgtgtctccagagcctgcagcacccgtgggcgtgttggacatcttggcaggtgctggcttctggtctgtgcccacagcctgaggcccctggggagacatgaggtggcttcccgacatgtcaggagcggtttccccccaggctctctggacaagcgtggggtcaggtgatgcccacgcacctgccgttgtcagcagtgtttcttcccctgcaggctttgaagacgacccccaggctgtgctgcagacaatgaggaggtacgttcacaccttctttgggtgtaaggaatgtggtgagcactttgaggaaatggctaaagaatccatggactcggtgaaaaccccagaccaagccatcctctggctgtggaagaagcataatatggtgaacggccgcctggcaggtgagaagcccctgggcatggggggctcagcacgggcggagggaggccctggtcctgggacagcaaggacggcacggctgccgtggggcttgtccctgagctttgcggcctcgtgccacccactgtgctgacgggatcaggacttgggtggctgagagctgccagagctgcagcctttcccaggctgcttctgtccccggctttctagatgcttctctcactccgggggctcttcgaccccgtggaaatgggtgtggctctttcttcccccatcggtacccactggtagcccgttagactctgaagatgtttttgactctggaaagcttggaacgtaattaatttttgatgaggaattttagtagtatggaaatctgttgtccaaacgtaaaccaaacctctcaaagtgctttgttttgttaaaaaaa

SEQ ID NO: 49065 - DNA, 1105 bp, Homo sapiens
ccaaaaataagatgcatgatagaataatttatagtgagcactttggatagagtttacttacaaagtgatttgtgaaaagtacaggaaatcttgaaggactggaggtgcctcagatgaatgcatgaacattgcccaggcagctttttcccccacggtgccatccagagttcagaaatctctagctggcctcatttcctttaagaaagtgtcctgctaatctgtccatcatattagtggaggacagtgtggctcttagtggtggtggccgccggccagctaattcgctggagtcgcacagctgtcgctaggcagacctgctctcctctcccggcttctccgtcttccccttagtctagttaggcttggagcttttacacttgtgctctgggcaactcctgaggccagggtattaataagttattcttaatatttttctgaagtttacttggatgtctaaaataaatttgattctggtaaattaatcatggtactttttaacctgcacgggagaaaatatattggactgagctgaagatgccggcgtttctggtctggcatcgccacctgtgagcttcagctcgggtttgaggaactcttttggtggctggtgtttctggtctggcattgccacccgtgagatttcagctcgggttttcggagctctttcggcagcctatgttttgcacagtttgtggtgcagcagctgatcagagtttctcctaaaaagacagagccctgggatcttctcagccagacgcctccccaagctgtgttgatgtcggccagcctcacggcccacacaagcccataggcagttagccccggctgccggcgcatgtgcactgccgcgcgcccttcatacagtcagtgacggcagaggggaagcccagcgggcgggcaggcggggtcagcacagctcctcgtgaggaaggcagaataaatcagcaagcccccgccagctccatgatgagtcacacaccgtgaccttgcctgtcacctggccggagcgaggccgtgggcgcaggtgggtgagctgcaggcacgggctggagaaaggcatggccgtgggcacaggctgtcctggggagaggcgcaggctagatgc

SEQ ID NO: 49066 - DNA, 1095 bp, Homo sapiens
agcctctccagtagctgggaccgcaggtgtgcgccaccaacgcccagctaattttttgtattttttttttagagacagggttttaccatgttgcccaggctggtctcaaactcctgggcttaaacgatctgcccacctcggcctcccaaagtgctgggattccaggcatgagccaccatgcccagtggagagccttcatctttcagaggcaaagcctggtgggttttgtgtagaaatgacgtgctgagatttgttgtgggacagttctgaaagtgggtggagactttggcaaaacaggattcaccttgagctgataattattgatccaagaggtagaatgtgtgggatttgttacatttttatctctattttatttgcatgttagaaattttccatagcaaaaactttagagataggaacaaaaaaatttatggttccttttagcctccccaaaatggcataggtgttccagggtttgcgggcagtgtctgggatggtgttggaaaccacttcacatgtgtctgtgcacgcatccttgccttgaaagaccctgctcagatgctgccagtactcgctggagtgagaacacgggaatgtttttgccaaacagcctggaccgtatctgattaatctgcacgtacttgcttgctgtcctgacttaagtgccggccgctgacagccgcgtctgttaccagcgctttcatccatcagggtgtcatttaattaggggcccacagccttgtccctgctccgtgatgtgcaggttcagcacaaatccgcttgttctgtgactatctgtggtaggagaggcatcgtgctgttggtggagttctctctcctagctccacatagacgctctgtgtgatgagggcctaactgatgacctagagggggcaggtgggctggtctcgcaggtggccgcagcctggagtggggactgctgggtcctgggcttcccgggagtccagtgctcaccacactgaaggtcatgctcctgcttttcagactgggccagtgccattcgcgtcgcagctctggactgcatggaagagaagaaccaggccgtgtgccatgactacgacatccacttctacc

SEQ ID NO: 49067 - DNA, 1036 bp, Homo sapiens
ggtgctcaaagtgaacccacaacttagaagtccaaatactctggagacttctctataataccccaaaacaacctataaagcaatttttttaactctacaaagaatttcattggtgggctccttgatcacagatgcacagcctttgagaaatctttcaccaaactgctggtagtgttccgcactttattgtttagtgctttcatctggtcgcacgttgttaaccagtcacgaagttactcgcctgctctacaggttagagttggcgtgggagggggcattcacaacacccttcccttaaaatggtatttaaatcactgaagtaggaggtcctcccgacccagtgaggtttggcaggacttcctgtgttgtgctaacctcaaattacatgtttcagtgggcaagatctgtaacaaattgctactctttcttcctgcacctttgtttttatgccttacacccaatcctgctgtatttttctcatcgcaaacagatttgtaaagaaactttttttcaagtctaagtagggcttttgtatgttactgtaaatggttatctttaaaatgcattctcctcttagagagctggggccttttgattctaatggattcctcctctttgatctcatgttttcttatgtccctgttgacctgactcagaactgaggtcagagactggaagagatggacagaaaaactgttcagtggggtttttagacactgcttttaggaaaacaaacaagtaattcaatcacgtagggaacccttcagttcttgtgtgttattcagtggcagaaacagatatgttcattaaaatgcaggtggccctggcaggacttggtcactttttttgtgggttttggttttgatttttttttttcagttgagtcgctgaagtctaaagatcgtaccagattcaaatattgcaaattctgtaaccgaagcagcacataggcagccttgagaactgtccctggagctcagaaggaaggcccctcctgagagccacacagtaacgtccatacccagtggtgtgatga

SEQ ID NO: 49068 - DNA, 1032 bp, Homo sapiens
gagaagcatttaacccacatccttcctgctggccacccatgcctcgggccttggcaccactgtgcccctgaccataggctcattccctgcctttggggtctgggctcctccctggccgctgtgctctggtggtgccctgttcccgtgcattgctgcgtcgtctcccagcttgtaaaacgatcaccatccccaaccgcagccaccaggctggctcttcactgctggagccctggtgccctggcctggcccttggcgcatgtgggtcaggtttaccaagcagactgggcgtggccggcgctggggtggtcttggttcctgtttgtctgtcccagccctgcttggggtctggctggggtcaagggcaccccccacctggtgttcctgtgttccaggacaagcactttctcagaagcccgtggccctgctgacgagagacagcccacccccagcctgcaagagaggcagccagaggccaggtatctgctggccgctgactgaccaggtccgcagtgaacagaggcgggcctgccgactgactgtgtggcatggagcatggctgttccccaagtgcacacctgaacacttggaggaataaagttctgtttttaattgtggagctggacacaggctgttgtggttttgttgtcctgaggtaccgggcagtgtacagggaccccccacctggctggggtcaggctgctgcctagtggctgagccaccctagtgcaggcagttcgggaacaagcagggtgctgggggcccagagctggggtcctggaaggcctcccgtaccccggctgccctcctgtcagagaagcaggctttctttcgcccatttcctggaaagcatctgtggctttgtccttcaggctagccggcaccctccccagatggctgccagccctcgcgctgccctggctgacccagggggttccctggaacagatgacctggctaccccgacacggcggcagcccccaccctccactgttccttttgcatgggcctttattggcataagactagcccccat

SEQ ID NO: 49069 - DNA, 1039 bp, Homo sapiens
accattaaagaagcttggggcagcagcgggcggcgtctcggcatctaaaacgttctttgcttttcatgtcacgttcaggtatctcaggagattacatttcagcttgaaaaagggtcggtggaatttaaaagaagaggaacagttaattgaattaatagaaaaatatggtgtcggtaagttgctgacagtttgttcttctagtttcttttttttgttttttgtttcttagaaaagagatcaagataaagacagagcaagctctgtcgtccaggctggggtgcggtggtgcgaccatagcccactgcagcctcaaacttttgggctcaagccatcctcccgccccagcctcccaagtagctgggactgcaggtgtgtgccaccacacccgacgagctgagtgttctgtagcgaagtctttgcttatatttgcaatgtccccttagagtaaatcctagctgtggtattgccacgttcaaggacacaccagatactgtggctctgccctgtgagagcagcacccgtgctcctcctgctgccccacactgtgaagagcgggaatcgtgggaggtggctggtgcggaagcctggggggagcagatatgtgagggccgtggtgtgcgcttaggacgatttttccttctcagttacatgtttggcagaactttcctaaggggctgagcatccaatgagaatcagatgctgccaaattgtaggcacccaacatgcttgaccccccagcgtgagagtgcacaggaggctccactctgatggggccacggcgagtctcctggggaacagcaagcctgtcctggggaagaatctttggatgaaggcatttccatggggtttggcttttgcaggtcactgggcaaaaatagcttctgagctgccccatcggtctggctcccagtgtctgagcaagtggaagatcatgatgggggtgagccactcgctccttctttatctgaaaccagacaatggcctggtcaactggggggtccagcaggcaggaggaggggaggggaggggggcgttcggt

SEQ ID NO: 49070 - DNA, 1066 bp, Homo sapiens
cggctgtgttcagcggctgctgtgccccagtggtcccttctctgactgggttcagggtggggaggctgcagccgtacctgcagaggcttcacttgtctgcctgtcccttcctgcagaagttgcttcaagctgttgccaaatacggggagcaggattggtttaaaatccgggaagaggtgccaggtaggagcgatgcccagtgccgagatcggtgagtcgcacagcgctgagcgagggaggggcccgtgtgggtcactgaccaggtgcactctggtgtgggctgtgggcgggctgggggacagcggccagcgctgggcgagggaggggcccgtgtgggtcgctgaccaggtgcactctggtgtgggctgtgggcgcttgcttgccagggttggcccggctgagctgtgttttccaagcctgacttctgtattgctgtctgccggagcaacgcatgggctccacttgagacagctccctgggcggcttttcctgaccctagttgtctcagttctctcagaatgctgataggcaggacctctgggcacacagctgcagctccctccttttcctgcttattttcctttcaaaaacagcttcgttgagataattcacacaccatgcgatgcgttcatttaaagtgtatatttccgaagctgggcgcagtggctcacgcctgtaatcccagtactttgggaggtcaaggcaggcggatcacttgaggccaggtcaaaaccccgtctctacgaaaccccatctctactaaaagcacaaaagttacccgggcatggtgggggtggcgcctgtaatcccagctacttgggaggctgaggcaggagaatcgcttgagcctgggaggtggatgttgcagtaagctgagatcacgccacagcactccagcctgggtgacagagcaagactgtctcaaaaaaatattaattaattaattaaaatgaagtgtagaaggccaggttcagtggctcacgcctataatcccaacactttgggaggccgaggccggcggatcacctgaggttgggagtttgagaccagcctgaccaacatggag

SEQ ID NO: 49071 - DNA, 1033 bp, Homo sapiens
ccgccaggtttctatgtgttgccacctccaggctgtggccctagggaaggagcctgcccagccctctctgccactaggccattgccgcagctcctctgggccttcccagtcctccaggtctccccatgcagcggtgcatgcccagtttaccggagtttgtctcctttcttatttctagtcttcttctgtctccatcagcctcgggagtttattctgttgatgtttctaaagcgctttttcctcgtgtgagttcttgccgcttttctggtttcctgagtaaggactcagttctttactgacttgggtctcttgtcttgataacgaggcttgttaggccaccctgagagtagcttggcgtgaactcttcttctcatagatttccaaagtagctctagtttccatttttattgcctctttggacctaggtgtatctaggagtgtatgtttccgtttttaaatagttggatttctgggagttcttgtggtggttctttatctgaatttgattggaacatgaactaggggcgagatgtataaaatctccatttttcaaatatattttacttttttatggcagagcacctgattatagcagacccagctaaacttgccaaaactgtttttaagaaaaaggtatgttctctgtaagtagggcctactctatatcagctattaaattgagtttgcctttaaagatgcttaattctgccgggcacagtggctcacccctgtaatcccagcactttgggaggccgaggctggcggatcacctgaggtcgggagttcaagaccagcctggccaacatggagaaaccccgtctctactaaaaatacaaaattagccgggcgtggtggcgggcatctgtagtcccagctactcgggaggctgaggcaggagaatggcgtgaacccgggaggcggagcttgcggtgagcggacgtcgcgccactgcactccagcctgggcgacagcaagactccgtctcaaaaaaaaaaaaaataaataaataaatacaaatcggtttttcttctat

SEQ ID NO: 49072 - DNA, 1013 bp, Homo sapiens
cagcgcccaaagtcggggaaactgaggcccggcgtggcccccgtccggccgagcctgggcgcgcggggattctggccctgggagcccctcggctgggagcgggctgcgggctccgaggaggctccggcggggcggccccggctgcagggcgcccgcgtgcgtctcggggactgcgccggcgattccgcggtggccgagcctcggagggggtttccccagttcacgcagcgagcaggaggcggaactgggcctgggccgggtctgtctcccaagccagtgcctaaacgcccatcgtcctggcgcatcctggggttccctgggcccagccgagtctgggtggcgtccccgcagctggggctggagggaccgcctgctgcgctccgtcttggtgggcagccctcatgaccagcccttgggagaggggtgcggggagagggacagcccctgatgtcagtggctcagcacgtgtgactttgacctccttcctgctgatcattgctcacctgagcgacacggggagggggaggcagcagcctcgtgtgaggcttccagaggaaagcgtctccgccggcccggaggcgctgaaccagcctgcggtcgctgccagctctgcctctggccggctgttaactgagtttacaggttcacaagcatttcgggcataaacaaggggctttgtgaaggagtgaggggacctgggctgctgatgcggctaacggtgctcgcgggtggatgctttggttttgttccagttgggcagggccccagtcagcctccagcagggagagccacgccaaggacgggggagggcgtttctctttgttgttgggtgttttgggctcccgggtctgtgctagtgattcctttagattttctctgctaatgtttcattctcccactctctctctagcgtccttctcccttcagacttcctggaccacagttcctaagaaaaaagcttgacaaacatttgttagtgtcaggcactgccacgttccaggcgttgttctgga

SEQ ID NO: 49073 - DNA, 3247 bp, Homo sapiens
aggatccgacaggggctggtgacctcctggatgaggaggaggatgaggacaccggatggagtggggcctacctgccgtccgccatcgagcagactcaccccgagagggtccctgccggcacgtcgccctgcagcacatacctttcctttttctccaccccgtcggagctggcagggcctgagtctctgccctcgtgggcgttgagtgacactgattctcgcgtgtctccggcctctccggcagggagtcctagcgcagactttgcggttcatggagagtctctgggagacaggcacctgcggacgctgcagataagttacgacgcagtaagtgagcctcacggcgccctctggcacagcgcctgtccgagcggcttctcccggggagaacctggagccatcctacctcttgggtggcctggtttgatttccaggacaaggcgatttgcgtgacagcctgctatccactttccctttgactttgcttctggttacacgtgggaatagaaccggctaaagaggactggtgagctagaagctgtgaattggatgcagttgggcacttacagggctgtaccctcagtaaaggcaggctgcagtcgccagcttgctaagtattccaagaggaggaaaatttttaaaaaattataatcacctaaaaggttataagctctgaataaaaaaaaaaattttttagctgggcgccgtggctcacgcctgtaatctcagcactttgggaggccgaggtgggtggatcacctgaggtcagcagtttgagaccagcctggccaacatggtgaaaccctgtctctactgaaaatacaaaaattagctgggcgtggcggcaggcgcctgtagtcccagctacttgggaggctgaggcaggagaatcgcttgaacccgggaggcggaggttgcggtgagccgaggtcacgccactgtactccagcctaggcgacgggcgaaactctgtttcaaaaaaaagaaaaattattttcttcctgagacagtgtctcactctgttgctcatgctggagtggagtggcacgatctcggctcactgcaacctccgcctcccgagttcaagtgattctcctgcttcagccacccgagtagttaggactacaggtgcccgccaccactgctggctaatttttgtatttttagtagagacgggggtttcaccgtgttggccaggctggtctcaaactcctgaccttgtgatccgcccacctcggcctcccaaagtgctgggattacaggcgcgagccactgcccccggcctctgagtaaaattaactggcatctgtgaccacaggtctttgaaaagtgcctgcctccgtctgtggtctccctctgtagtggctgcaggtggatgctgcactgacccagcatctctgcttatcaggaggctctggagccacaccgcagaagcacacgcccttttgagccagacatgctgactttctaataaggatgttctctctccacagctgaaagatgaaaattctaagctgagaagaaagctgaatgaggttcagagcttctctgaagctcaaacagaaatgtatgtaagcttttagttaggaatgcaatccacaacatctaatacacagggaaatccgtttttaaatgataatgaagtaatcagagtcaaaccagatctgggttttattgtatataaatgttcagcatcaaacacatttctgtgttctgcctaaaagtttattttgagacagtcttgccgtgtcacccaggctcgggtgcagtggcgcaatcacggctcactgcagccttgacctccttggctccagcaatcctcccatctcagcctcctgagtagctgggaccacaggcgtttgccactgcacctggctaatttttaaatcttatttttgtagagacagggtctcactatgttgcccaggcttgtctcaaactcctcggctcaaggaatcctcctgcctcaggctcctaaagtgttgggattataggcatgagccacggcgcctggccaaggtttattttaaactttaggcaaaaagccaccaaacaccttgttggagcagcagtgctgtgagagccgctccctgcacgcctgcctggtggctacaggtccaggcctgaggctgccgctgcctcccctctgtgcctgagacccattccatcacaggctcttagcgggttttatctggctcatgaggtatctttttgtagtcctcttaaaagtagccacagaaattaacaactcgggtttttctttaacaagggtgaggacgcttgagcggaagttagaagcaaaaatgatcaaggaggaaagcgactaccacgacctggagtcggtggttcagcaggtggagcagaacctggagctgatgaccgtatgggtttcttctctgaatcggacgagctgggtggggcaggagcgctcctgagaaagtgctgttgtcctcagcagccggtgcagcctgcccttgggagcggggccatgtggctctctgggactggtgttctttgacgtcgctgtctcgctgtgcctggggatagctggcccacgagggcatccgtggggagtggggggccagagcacagacactgcacgatgagcccttcccaggggtggtctgagagtggaggcgggactgggaggggcacaggggctgtgaagggccacagccaggttgggtgccctcctgctccctgggttggggcccgtgtccggtatgaatgtgaggacatcagtgatgctttttgtggtttttcttttttgggtaacagaaacgggctgtaaaggcagaaaaccacgtcgtgaaactaaaacaggaaatcagtttgctccaggtaattaaaggaagggacttcagtgtttttctttgatttgtggagtcacataatgaattcagtaagaaagaggcgaaagactctgctggggtttcccctgagcccaagcagagaaaggacttcaaatgaggacagcagccgcttcctgtcagggcgtgaagcagagggaggccctggagctctgttgggagtttggggtctggcacggggcatccacttgtaggagtccctattgccatagagctaggtgctgagcatatactggagtgaaggggaagccattaggcccccagtcccagaggcgagcccccagttaggccagagcatgcatcttgagtgccaggcccccacgggtaagccctcgcctcgccaggtggtgactttcagccgggttgcctcggagctgc

SEQ ID NO: 49074 - DNA, 1056 bp, Homo sapiens
gaagtgctgctgggtgcccggggtgtgcaggagtgtttgtgtggttatgccaggatctgaggacattcgggggttgtcacaagacaagaggacgcgcttgccccggctgggcttcaaaatctgctgaggagccgctttcagaccacggacaccagggccagtctgcaagtcaggccatctccagggtcacaagtctgggagcttgtgttttttttaaagttttctcggctgaccgggcgcagtggcttacgcctgtaatcccagcactttgggaggccgaggcaggcggatcatgaggtcaggagattgagaccatcctggctaacagggtgaaaacccgtctctacaaaaaatacaaaaaaattagccgggcgtggtggcaggtgcctgtagtcccagctactcgggaggatgaggcaggagaatggcgtgaacccaggaggcggagcttgcagggagccgagatcgcaccactgcactccagcttgggcgacagagcaagactccgtctcaaaaaaaaaaaaaaagttctctagactgtgagaaccactgcagtggagactccatgtgcaaaagaaaaaaaccaaatgtgaggtcataaagacttcctgccagcatggtgggtgacattgtttctttgcagattttggctatggaaaggggaaatgttctaagcagagcccgtcaggagcccacgggacacattttggaggtagagtagttcagcaaccttttcttcttgtctccatccaacacagtgccaggcacgtgtctggtgggactgtcaatgtgactggctatgtggtgtagctggagcccaaaagagcaggtgggggtgggatttcaagggttcagtcttgatcctagagtagcagcgaggtgacatcagggagcggggaagccccacctggggggctggggccacaggagccagctttacatggggctcacagctgggagggtcgagtgtggctgcttaagtccccggagggtgggaaggcggtggcaagagggagaagggaaaagtgggcgttatttaggctacctaggtaggaa

SEQ ID NO: 49075 - DNA, 1059 bp, Homo sapiens
acggaccccagccactctcgggggcagacgtcagaatccgttcctgagcagctcctgtgccctgggggcagtcacagagccccccaacacccccgtgctctgcaccagcctctccctccacacccgaagcaggcgtccatctgtgtcctcctggcagcccctcaaacacacaccaccccatgtcacacgggtatccagagcaaggctggatctgggctaggtgacccctggggcctcagacctctgagtgggccccagagcccagctgaggaagccacacagcctccaggacgtggcacggttcccctccacttggctgcaagtcgcctgccatggggcgaggaggcctgcaccccagtataagggcctccccagctgagtaagaagctgcttcccctcctctcataggccaagcctattgtgtgaaaccatctcatggtcttggtgacgtagaccatttttgaaaccgtctcatggtcttggtgacgtagaccgtttgcttctttaactccagccgcggaatgacattagtggaaccgggctagggaactgctggaagttcaggatgccaccaccttgaacacctaggccagggatccccaccatgtcccgggtttctttcttcgagagtatagaaccgttcattcttgctttgtgtcccattccatctcttgaaaaaatgtagtctttgaatgtgtgaaaatctagggacattcaatctagtcttttaaattatttttccatatttatatttttaaataaatgcatatattgagtcttaaaatctctttctggccaaagactgaaacctggaagcaacaatatacatgcatatcccgttctcacaatgtccttgtttgaaaggctgtaaaatccacaggcaaaaagtttggtctcaaccctcaacagctgactatgatcttgtccggttcatctctgctatctttaaaatcctacattcggctgggtgcggtggctcactcctataatcccagcactttgggaggctgaggcagatggatcatctgagtggtgggcaaatcacaaggtcaggagttc

SEQ ID NO: 49076 - DNA, 1077 bp, Homo sapiens
gcccgggggctgccatctgtgaagctgctgggcgctgatacccggttcgtggccgggcacagatctgcagtgcctgcccgggggctgccgtctctgaagctgctgggcgctgagacccgggtggcggccgggcacgggcagcctccacgcctgggtgggaggcatgggtcagatttttttccagtggcaactcggagagtttaaaatcaatgagatttgattttggtaacaaactgttggcgtgcgagagtagaagggcagccggagcagggccgggccccaaggcctcccgggcccccatgtcatggcgggaacagcaggtggctgccgcccacacaggtgctctgggggaaggagttgaggtgggccccacctccctggcccatgagtccctcaggcgggaggagctctgctcactggggtctcggcgggggtccaggggagccactcaagtggaactggggcctgtggcccccggcaggtcccaactctggcccaccaggccttctggcaattgcttctccgcgcaagacaccaaggccaggtcgtggggtttccctggtagctcctcgaggggctctgggcagcaggtctgggggtggcggagctgggaggccatgtcccccagccggccgtgcttcctcctctgcaggcgggagtgggagactcgtctgcaggagacgctgggcccgcactatgtgctgctgtcctcggcggcccacggcgtgctctacatgtcgctcttcatccgcagggacctcatctggttctgctcaggtgggcgcggctggaggggtgggcgcggctggaaggtggcagcgtcccacaggtgagctgagggctgcccctcccacagaggtggagtgctccacggtgaccacacgcatcgtgtctcagatcaagaccaagggggccttgggcatcagcttcaccttttttggcacttccttcctcttcatcacgtcccacttcacctgtaagttgcttggtgcccgcaccgcaggtgctgtgtgagaacagcttcctctcctgaccgggaccctgtccaaggcaggggtcctgaccgctggcttcatc

SEQ ID NO: 49077 - DNA, 1237 bp, Homo sapiens
ttgcgagggagcaagagtggatgcctgcattggccagctgtctgcaactgaggtccccgcgtcccatgcagtaggccaggcctggccaccacttgtccctggactctggacagccaggctggctctgcagagcagctccaggtctcatggccctgatgaaaccacggcacctcctggccaccctcacagtaaacattgatggttaaggatacagtgctttcaagggagcccaggacttggcactgacttgtcggtttccagaggcttttggaaacaaaaacgaagccttcagcttgtcagcgccaatggcccgtgtggttcattatgtggaccagcccctgccacgctgcagccgagcactgctcaccctgggggcaggcatgcagaggtcatgctgttgatttcattccaggcctgcgccacctccgggagctcaaggctagggaggattggccagaggaagcacctggtgctgaactaggcttgccctgctgtgaacttgcacttggagccctgacgctgctgttctccccgaagaacccgaccgacctccgcgatctccgtcccgcccccagggagacacagcagtgactcagagctggtcgcacactgtgcctccctcctcaccgcccatcgtaatgaattattttgaaaattaattccaccatcctttcagattctggatggaaagactgaatctttgactcagaattgtttgccgaaaagaatgatgtgactttcttagtcatttaggatgatttaaggatatagtattcctggtcatttaagaatgttcattcattgaagccggagctgtctctgccacaggagagccacatggtcggtagtaaccagggcctctccaagcccagctgtgagtcactgcccagtgagtcccgcgcttcctttaaggtgctgggagcaaagagagggtgactgaggcagaccccaacccctgctctgcaccatctgggccctcgccgtgtttgaacctggctgaatgagtggagggcgctgtgttctcaatcagcgcctccgaggagccgtggggttccttcggcattagttcacggtttttgagagaggccttagttactgcagtgaatttctttcctgttgcaaagacgcttccagcctcactttactttctgtggcctgatgaggaccatgggtgattttgtgtacccaaagcgctggggactgcccaccgtgtggcccagtcactgggaaggagccc

SEQ ID NO: 49078 - DNA, 1049 bp, Homo sapiens
aggttttaagctctgcagcgtcactccctggctctgaactcccctcctccaggcctgagggttcccagggaggagaggtaaggagtgccgacgccagggccccccgcagcccaggcctccccagcagctcactgtccaggcgcctcttcctttatggaggggcggtactgggtaggaagaggcagtttagaaacaagagcacctcgaaggtggtgttcctgggggaaaaaaaattgcacttgttttaacaaaactgtttgggagctccaggaggggtgcagggggtttgagttgtcgcctcagtcccggtcctctcccttcaacagcacgggaattgtcttgaattgtgaggtgtcaggaggtgaagctggcttaggccgaggctggacttttcctcccagccctcccctaagctaatggttgtttcgggataacagctttacattaagacaggaatcttaagctaacactggcttttttttcccttttgagttatgttgattctaatggcatcacaaagcttttgaaatggaactgacagcttggattggacagtgacgtgcatgttgactttcgtccgtgttttatgtgtgttcttgctgttttgtagctttcgcgctgtagttcaatgagttcattatcacgtgaagtgagccagcattttaatcaggtacctgcggctggtggtcctcactaacatgagagctggcgtgtgccgcctgtgttcctgagcacgcggtgccggttcgccacgtgcgctttgccactaacctcgcccgttgtctccctcagcgtcacgtgaccaagggtacagggttccttttttttttttttttttttttgagacggagtttcgctcttgttgcccaggctggaatgcaatggtgtgatctcagctcaccgccacctccacctcctgggttcaagccatcctcctgtctcggccttcctgagtagctgggattacaggcatgagccaccacgcccagctaattttgtatttttagtagagacggggtttctccatgttggtcaggctggtcccaacc

SEQ ID NO: 49079 - DNA, 1017 bp, Homo sapiens
cgggacgtccgaagaattgtaatgatttttctgtcactttcagagcagacctgagtaggtgtttcctgaagttttgaagtgtcatcattaatcagatgctaattctgtttaggttcagtctgctgaccttttttctttttaaaatcttggcagattgtttgggatgaaaagaaaaaccagtgggtgaatttaaatgagccagaagaggaggtaaattgtcattctagttcctgttgggtgtgaggtgtgagtggagggaacagcctcatgtggccctgtgatatttgggtggctgttgccccttttggagcctcctgactgtgccatcccagtgggtttctgtgcacacagtgggtgtctgaagctgtgtttccctctgcagaagaaagccccgcccccacctccaacctcgatgcccaagactgtgcaagctgccccgcctgccctcccagggcctcctggagcccccgtgaacatgtactctagaagagcaggtaagggtggccttggagtgggagcttgcttgaacgattaactgtcccagagagagaggccaatgtgtagctgttgtgcgtggggaggaggtggcttcccgcacgtccctgcgtgcttttcctctgacgcagtgagcgcagagcatttggaagctggaggccacctggcgcgttcacctcaatttgcttccctcccctttgcagcaggaaccagagctcgctacgttgacgtcctgaacccaagcgggacccagcggagcgagccggctctcgctcctgcggactttgtcgctccactcgcgccactcccaattccttctaacttgttcgtgccaaccccaggtaggtagcacgagcaccagcccctccaggtcagcccccagtctcctgacctttgatcctctttctatgagtctctcctaaatctcccgttaaaagaatgacctggccagcatgcagagagcctggggttggtttgtggttttttttttgatttgcctgtttctgcatgagtgtgccgcgt

SEQ ID NO: 49080 - DNA, 1092 bp, Homo sapiens
cagcccggccgtctctttttctacagtagaatttcttttctaattttttgatctcacaagaggatgtcctggaattcagtagaatttctaacattgtcactggttttcctgaaagtgagatttatctcattagacatgtttggtataaatacctcctctgtttgctctactcctaaccaggagggatggttgcttttatacagaccgcattctggaaccttctttacagatacccagcccttcacgggcatcccatcagtaggcgattgctatagtttgaacttgcattaggtgttttaccctttaaaatactgtgtccctggaaaagtaaaaatgagggttgagctattaaaaattgggacttgacccaggaataaatatttttaaaaatcattgtatctttgagaacacccatcgcccccctctggccagtcttccctcagtgcatgctcacactccgtttcttccagcccggaatctccatcgaacgccctcatttgcattctgagtgctgagtgctcccagacggagctgcttattaagtgcggctggctcttctctagtcaggccaggtagaggctctgggaggcccagtcagggggctgctctccccagcccccttcctgcctccctctggtcaccagagtcatccggcctctcagtgatgtatttaggaaacacgcctggggaattgcatccccctctctctttcggttcctgtgaggagccccaggagagcctgttctgcatttccttgcgacagaccccctcgaggacggtgccagactcggaggcccccccagggtgggatcgtgccgactcgggtcccacgcagccacctctgtctctctcacccgctcccgaaacaaagagacccggacaggcagccaagaaagaaacgaaggaacctaagaaggtagtacagcctgcccacggtgcgcctggcggccgggagggtttgggcaggaggcacgcttcccagagcgccatcctcttaattcaccacacatgcaaatagcctcctgatacaaacagccgagtgtctacagtgcacacggcatgatgggtgtctgtgtatttgtgccttcagat

SEQ ID NO: 49081 - DNA, 1064 bp, Homo sapiens
atggagccctcccgcagcagtgtcctggcactccgagttccgagatggagcagttggacaggccaggactcagtcagccaggagccctggggatcgccaaccctctgctggcggtgcctgcaccgagccctgagcactcgagcccgagcgtgcggctgctgccctcaggtgagcccaggtgcgcggctgctgccctcagacaagcccctgcttcctgtgggctgagccatggcctgcacccttgcctcctggagaactgctttcagatgtggactgttggaggcagtgtctcacaccacctcggtggttgtggggctcctcggtctcctccctcttcccttcatgcttcctcccctgaggagcccatggaggggaggctcatggctttccatgtccataaatatccatgtgctggcgacactgccctgagcgcccgctgcctgctcagcctccctgcttgtttctccgggagcctcagccgcaccgtgtctgggcggcgccctcggctgtgcccctctgtaacctgcttctcccagtcggccccgtcggtggaagggccagcccagagctccagggagtcaagtccagatgccccctcctctctcgcgcttctcggcttccttcgtcagtgaacctcaccagcgcggcctgcacgcaggtccgcatgcctggatgagcacgggctccttcctgctcgcctcctgcttcttccccagaccctccagactctccatctcacctgaggacaagccagggtcctcacggtggccacaggccctccaagcttggccctgagccctcctgccctcgtgccatgtccactcccacgctgtggaccagccacactcctgatttgggcccactgcccaccctccctgcctgatgtccagtctgcttcgtcctcagacaccgttaccacttcctggttgattgctgtccttagcgctttctcttactcagttcatctgtcccgacccccatgaggacccagcatttcttttgttgttgaagcatccagggcccagcatggtgctggtaggcagcagccctctcaggttttatgt

SEQ ID NO: 49082 - DNA, 1033 bp, Homo sapiens
aatcccttggggaacagggactaggactgtggtcagcgggcgtggtgggtgggagacgatgatgagtgaagtgtccagaagagttcacagctcacagggcgatgctcggatgcaggggagcctcagggcagtacaaggctttgtccatcggcgatgctcggacgcgggggagccgcagggcagcaaggcttctgtcgtttcaggtgtttaagttcatctactcctgccgcctggcggaaatggggctggccacgcaagccttccactactgtgaggccatcgcgaagagcatcctgacgcagccgcacctgtattccccggtgttgatcagccagcttgtgcaggtgctgcccctggcgcctgtcctcgggatgctgtgctgactgcagggaaggagggcttgccagagcccccgggcatgggggtagcgatggttcagacgcgcattgtggtaggcgctcagaacctgcctcttgggcggataaagatctttgaatggcttcgtgttttgcgtcttagcctgggaactctcaggcaccgtgtgccagcacagagccttggcagcgagtttcacaatcagaaggaactacctgtaggatactcttcttttattgagacgcagtctcactctgtcacccaggctggagtgcagtgtggtgcaatctcggctcaatgcaacctccgcctcccagattcaagtgatgctcctgcctcagcctcccaagtagctgggattacaggcgcctgccaccacgcttggccaattttttgtatttttagtagagatggggtttcaccatgttggccaggctggtctcgaactcttgacctcaagtgatgcatgcatctgccttggcctcccaaagtgctgggattacaggcgtgagccaccacgcccggccaggatattcttattttgaggcaatttagtctggtggttgatagcttaagtgtccagagtccagcagcctttgcttgagtcctggctgtactgctgcaggcctcagtttcttcgcctgtaaaacagaggcgg

SEQ ID NO: 49083 - DNA, 1070 bp, Homo sapiens
ccaaatcaaaataattcacttcctctacagtttgccattcttaaagttcgcaaccaacgaagcaatccagaggacggaagcctatgagtacgcccagtccctgggtgccgagacctgccccctgcctagtttccaggtaagcaggtgctgccagcctgcagctgtcatggctgggcaggcactcagtgctaacaagcttttggctacttagattgtttgaattggtatcgaaaaaaatgatgtgagttttttgggggaggatcttgagaagacatttgatctaaaatgctaagaaacaagatcccattgaattgaggctttccgtttgcatttgatttcaattattttcatgagctttttttttaagggagacagggtctcactctgttgcccaggctggagtgcactgttttgatcactcccaggctcaagtgattcacctcagcctccagagtagctgggactacaagcagcactaccatgccacactaattttttttattttttgtagaaaaaaactgtgttgcccagactgatcctaaactcctgggctcaagcagtcatcctctcagcctcccagagtgttgggattacaggcgtgagccaccgcacctagcctgtatgagctttttttttttttttgagaccgagtctcgctctgtcacccagactagagtgcagtggcacgatctccgctcactgcaagctctgctttctgagttcacgccattctccttcctcagcctcccgagtagctgggactacaggcacccacgaccacgcccggctaattttttgtatttttagtagagatggggtttcaccgtgttagccaggatggtcttgatctcctgaccttgtgatctgcccacctcagcctcccaaagtgttgggatgacaggcgtgagccaccgcgcccagccgtacgagctatttttaatatttgagggcggtattctctgatgcagtgtgggggtggtgtctataaaacatacatgagaggctgagcatggcggctcatgcctgtaatcccagcactttaggaggccaaggtgggtggattacctaag

SEQ ID NO: 49084 - DNA, 1274 bp, Homo sapiens
tggctaactttttttttttttttgtagagacggggtttcaccatgttgccaggctggtctcgaattcctgggctcaagcaatccgcccaccttggcctcccaaagtgctgggattataggcatgagccaccgcgcccggcctgatcagtatgagtctattatggatgttttataactgattgaagtcatgtaacctgttagcttttattaacatctttctctactgtaacgtttttgcctcccagccagaagttctaaattatgccctggatgattttggtgaaaggggaggctgccttactggagtcactctccgtgttgacaggatattcgcggaggcctcctgttagaactggggagttgactcgagcgtgtttcccagtggatggggcggcgtggtgggcagcgctgcgtgattagccctgtttgtgattagcgtgcttgtgttttatgctgaaaatggataaaagcagcaaatatctacaaatacccactaccacagggactttgaaactcaggaaaataatgaatcgctacgtgtctttagtctccaaatggtgaataagtgtgtttttgaggcctttgggttgtttgtgtatctgctgctgcgtgaggacacatggcctgtcttgactcatgtcacgtgagcgccgccgataacccaccaaggtccctgaaatgccttttgcaggatgctttggagtctgcaatgaagaatggcctgtggggtcacgctctgctacttgcaagtaagatggacagccggacacacgcccgagtcatgaccaggtacagtcccacagtggcctggtccagtggcgagccctgctggctccctgtagcacgcggcgtccgcaccctgggggcaggcggcaggcggatctcacttgactgtgctgtgctcccacacgaactcgggcttccttggcctcgaggcttccttgggtcgtgttgtggagagcttaaaaagtttttaattaactgcatggtttttagtacttcatgtaaaatctcagtgaattcctcagtcttcatcttttatagctttttttaaattttgagttttgctctgttgcccaggctgaagtgcaggggcgcgatctcagctcaccgcaacccctgcctcccaggttcaagtgatcctcacgccttggcctcccaagtagttgagaccacaggcacccaccaccacacccagctaattttttgtatttttagtagaggtgggttttgccatgttggccaggccggtctcaaaactcctagcctcaagg

SEQ ID NO: 49085 - DNA, 1034 bp, Homo sapiens
atattaaacaattaccgacttttgagttggaagtctgtcgtgataaatctaacctgtgatttaagctgtgtgagcacattgaaaatctaggctcagaagcatcagtgacaagctgattgtttctttttcaatttattttaaatgcagtttcatcaagaccaacttctcctgaaaaattttcagtgcctcatgtctgtgccaggtttggccctggcggtcagcttatcaaagtgattcccaatctgccttcagaaggacagccggccttggtggaggtccacagcatggaggtaatggcacacgcagaagcgtggcgtcactgctctgctgccctggggaactctctgctttgcagtttgtcatcttcaattgtcagaccttgtctctggacatacgtccttggaaaatgtttattcctgtgaattttcaatttgtagggtttttcttctatttgatcatatatttttcctcctagaagtcagtattgtaagcgtctgccttgggtgttcaacgtggtttgattgtatatgcattttctgtcctcgttttggggatgtttgctttattggtgcttttcaatgatagatgcagtgggtgggcccggtgctgcccaggtgaggggggcgggtggggtggacgtgcacggcgctgccgaggtgacgggggctggcatgcgcctcttcctgcagcttctgcaggcttctgtcacatgtattggggttctgcctcagtatttggggagagaaaatggatttcactacttaaaataaagtttgaaatcatggctgtggtccacacaggccatgttccatgtaacagcctcgacagagccttcacctgctgtggggcggggcaggtgggccatgccatcctctcctctcacgggcagcatccgtgcctgggttggccggcctgccagcagggtggctgcgcactggctgccactgacccacggccctctcctcgtaggccttgctgcagcacacgtctgagcaggaggagatgcgggcgttcccgggacccctggccaagta

SEQ ID NO: 49086 - DNA, 1033 bp, Homo sapiens
attcatgatttataaatgccatttatttattgattccttttttcaaaatccaaaaagaaatgatgttggagaagggaagttgaacgagcatagtccaaaaagctcctggggcgtccaggccgcgccctttccccgacgcccacccaaccccaagccagcccggccgctccaccagcatcacctgcctgttaggagaagctgcatccagaggcaaacggaggcaaagctggctcaccttccgcacgcggattaatttgcatctgaaataggaaacaagtgaaagcatatgggttagatgttgccatgtgttttagatggtttcttgcaagcatgcttgtgaaaatgtgttctcggagtgtgtatgccaagagtgcacccatggtaccaatcatgaatctttgtttcaggttcagtattatgtagttgttcgttggttatacaagttcttggtccctccagaaccaccccggccccctgcccgttcttgaaatgtaggcatcatgcatgtcaaacatgagatgtgtggactgtggcacttgcctgggtcacacacggaggcatcctacccttttctggggaaagacactgcctgggctgaccccggtggcggccccagcacctcagcctgcacagtgtcccccaggttccgaagaagatgctccagcaacacagcctgggccccagctcgcgggacccgaccccccgtgggctcccgtgttttgtaggagacttgccagagccgggcacattgagctgtgcaacgccgtgggctgcgtcctttggtcctgtccccgcagccctggcagggggcatgcggtcgggcaggggctggagggaggcgggggctgcccttgggccacccctcctagtttgggaggagcagatttttgcaataccaagtatagcctatggcagaaaaaatgtctgtaaatatgtttttaaaggtggattttgtttaaaaaatcttaatgaatgagtctgttgtgtgtcatgccagtgagggacgtcagacttggctcagctcggggagcct

SEQ ID NO: 49087 - DNA, 1043 bp, Homo sapiens
tcgatctggggcagctggacccaggagccaggttggttgtgcccttcgtgtgcctgaccctggtgggtttgcctgtcagttctgctggcttggagcaatcctggaggtcagaagcatcatctcacaggctggatgggatcctgctcacgggaacccagtcctggggagcagagctcacccccagccagcctcaccacacagcccaccaccgctgcacccacccccacctcacgcctgtgcttcctgcagggcctggggatggctcctgggggaggactgggctcctggcacatactctgtcctgagatgaggaaacgtgtctgtggcaccagcaggagccagagagggtgtcagggcgggccagggagagcgcgttggtgggtatctgggatgagccgtgatcagcactggccggagtcggggggctggcaccagtcccctgcagggtagctgctgtcagacctggcttcccaccaccccaggctgcctcaccatgtcctgactgtggcgtcatgggcctcagtgtcctgcggcagcatccctggccggtgggcgggggaggaggaagcctcgggtcccagcccctctctgattgtccgcccagctccatcgtctacctggagattgacaaccggcagtgtgtgcaggcctcctcgcagtgcttccagagtgccaccgacgtggccgcattcctgggagcgctcgcctcgctgggcagcctcaacatcccctacaagatcgaggccgtgcagagtaagtgtggccccatcccgggaacaggctctgcctgcagggggtgccatccccccgtgccccagacacgctggctgtttgtgccagttgctacccacgggtgtgagcgttgccgtccgagttggggtagggcttttctggaattttctgaatggcactccgcccccacctgcggcggtcacagctgccggtggagccacctgggaacgagtccagccacgggaaagtgggtgcctgcttctctccccaccctttcctcctgaattttctttgttgggtattatttcaaa

SEQ ID NO: 49088 - DNA, 1079 bp, Homo sapiens
gcacagacagggccctggttggtctgtgtgggccgtttgcaacctggctccaggcagcccctgtgcccagtggggtgtcctggcattgagggccttcagcaccccactcaggccacgcttcctgggccagtcacagggatgcctggatgaacagacaggccctgtgttcgggaattaccctctggtggggtgacgggcaaaggtgcaccccgacgcagcagtgtccacagagcacaaagaggaggcaagactccatggtgctgggcctgcagaggaaggagtgatttaggctggcggtgggtggaggagtcagcccaggaaggcttcctggagggggcggcattgccaccctgcgtcttaggggacagggagctcagggagtggcagctgcccggggccgacagctcctgttccctgcaggtcagtactgtaccgaggatgtggacgagtgccagctgatgccaaatgcctgccagaacggcgggacctgccacaacacccacggtggctacaactgcgtgtgtgtcaacggctggactggtgaggactgcagcgagaacattgatgactgtgccagcgccgcctgcttccacggcgccacctgccatgaccgtgtggcctccttctactgcgagtgtccccatggccgcacaggtgagtgccttgaggcccaggtgggcgcagggggctcacatgggccaggcctgagctgtgtgacctcacccagggactgtggccctcctgcacccaggataacctgaaagggcctttctggtcagggaggccggtggtcgctgtgagtcccccggaacgtcccaagtgtcacgggatgcccgacggggtcacggcgggcagctcctcctggggtgtcagtggggttggaccccagccgtgggtggtgtgccatgcctggcccaggggccgtgcccactgaccgccgctgcctgcccaggtctgctgtgccacctcaacgacgcatgcatcagcaacccctgtaacgagggctccaactgcgacaccaaccctgtcaatggcaaggccatctgcacctgcccctcggggtacacgggcccggcctg

SEQ ID NO: 49089 - DNA, 1050 bp, Homo sapiens
cccttgaggctgggggcaggtcctgctggtgagggaggggtcccaggggcaggggcaccctcaggctggccgcctagcgattggctcctgcaggacgtggccacgggctccctgggagcagcagctgttgggggtgtctggggagaagacccccatttattgccctgtgagggaccacactgctgccaggggacccttgggcttctgtggcaggacagtgggccgggattggcagtgaggcccaaggagggcaggtggggctggacctgtggctctgctggggagcaggtgggatgtgttaagatgctgatttcagccgggcagctcctccccttcccttcccagggagccggggtgtgcagggccgttccttcccctctgggaagtgcagctcctgtgcaccggagaggcccccgcactgtccctgcccgtcccaccaactgtccctgcccgtccctccactgtccctgcccatccccctcactgtccctgcccattccccgcactgtccctgctcatccccaacactgtccctgcccatccccccctcaccgtccctgcccatcccccccgcactgtccctgcccatccccccccactgtccctgcccatccttgccttgggaggtgctgtcacctggtggagccatgggaagcacctctcccacccagggtctctggttcctgtggcgggtgcagagccagccacatcactgacaccccagctgggttgggtccagctgaccccacacccccacccctctgctcggcctctgcctgtgcccccatccctggccctgcatgaccataaactccttgagggcaggaagtgagtgagtcctacccgcactgagtccctctcacccctccttctcattttggggcggagggaactgtcttctgtcccctgggggtggcagatggccgcttagcttagaaaggaaaacagcacaatttagaattcgtcctgggtgaaaggtctcggcagcatctgcctcctgctgctttctggagtcgcatttccatggagcggccctggcagggagggtgg

SEQ ID NO: 49090 - DNA, 1018 bp, Homo sapiens
gctcccagcttcctgccctcttccccgtagtggggttacccagcgtgactcatggcccgagccacaggcacccgcccagggagccacggcggggagacctggctttattagagatgcgttcgtgcctcatcaagtccaaaggaggaaactggcgcgtccctcactttccctgaaacaggctcccccacagcccaagcggtcaggttaaggtgcatttgcagacagatgccctagtaggaggctggagcttttggcccagaattttccctgctgtaggcccatggtcaccgagcctgcccgggggctgaggccctgaggaggtgccattgccccacccaagcctcagacaagtgtcctgccctcgaccctgcgggaggcagcagctcaggccctgaccctggccagagagggcagctctctgaggctgctgtggccgtggcaggcaggggctgggcttgccgggccgtcgagtgggcacagagactatctgggaaggaggtgggcggtgagagctgactccccgcagccgggggacagatgagccccgtgccgcacagcagggccgcgtggtggggccccccaagttccgctcggtttcagctgttgacgagcggaaacacacagttactggaaatgagaggtttgggggagccgccaggggttgaacatgtgtggtttccctgacggcttttcagtaagagatgcttgagctcaggctgggcactggctggtgcgcggagggggctgggccagagtcccccccttgggcctccactctccatccttatagagggacctgggttggtcccagctcccggggtgcagcccctgggtggcccctcctacttccccttcagtggtcagaaggaggctggcctcattcctgtctgacggagagccaggtggggaggccgggcggggctgagtgtccagggtccacatggtggcggggctcaggccgtggcgaggtcctgtcctgggcctccagggtctggcccagcacagagctctgcagctc

SEQ ID NO: 49091 - DNA, 1061 bp, Homo sapiens
ctcgtcttgggcgtggccaggggaggaacaggttgattctcctcctcatgctgagctgagcggaaaggcctgtgacaggacctcctgtttatgcagaacctggtcttcaagggcgccagggttagaaaaacatgtttaaaaacatgcagcatccgaggtgggcagatcacctgaggtcaggagttcaagaccagcctggccaacatggcgaaacccccgtctctactaaaaatacaaaaattacccaggcgcagtggcgtgtgcctgtaatcccagctacttgggaagctgaggcaggaggatcctttgaacccaggagacggaggctgcagtgagctgagatcgtgccactgcactccagcctgggtgacaaagtgagactctgtctcaaaaaaacaaaaaacaacaaaaaaaaccccacacagtgtcaaatagaaagtctcacctactcagactggggagacatcaggaacaggaaggcctggggcggagactggggtgggagcctggagtgctctgaaggaagctggctccttggggcaggccctgcctctgaacagcagccaacatgttttccattgaaaagaataataatagaaaaagagagagggagaaagaaaacagcaaccctggcaggaagagggtagggcagggcagacagtgcaccaggggaagtgcttccacagggcagagctgggtgcggggacccccagatgcgggcggcaaactggagaccccacaggagccgggactggcttcattcctcattccctgcacctgtgatgggcagcagcggccaccggtgcccactgggcagttccaggccgggccgagggactgcacccttttgctgtggggaggggacctttcctgtttcatgtctcgtctataaatagtgaaaggatgtggctttgcagaatcgattgggcgtctagcttgccttcctcaataatgcagcgatgacagctccacactcaggacgccgctgttacccagcctcgtaaaagccctggcagacggccgcccaccctccaggtgtgccagtgcagttttcatcccca

SEQ ID NO: 49092 - DNA, 1152 bp, Homo sapiens
gccctgccagactcctcagtgagcctccagggtggggggcaacgctttggagagtagcccactttgtctctgcttttcccccactgcgtccaggcggcacatcaggccaccccaccctgcttcaagcaggacgtgttccctgctgctccccttccccccatttctgactacagaactctgggcagaatgttgacgcccctttggtttcatggaggggcttcctgcggacccgtgccccagcaacccatgatactgagcagagtgcgtccggggtagggggcggacgatgccccttggctgggtgcaggtccccgcccccagggtaaccagggccttcggtggtggtggtgcgggtgagactgacctctcttctcctgcccctgcctaggcccgcgatgctcccagcccggtgagacctgcctgaatggcgggaagtgtgaagcggccaatggcacggaggcctgcgtgtgagtaccacccctgcgggacctgttgctttgtcgagggcagagcccctgccttctgcagccgcgcaggggacagaacactaggccattgtcttctggagatggcccagagtctgggcacggtcacgtgctgacttttattggacaaagtctggcaattacttaatcaccagcaattatgctgcgtgtggagctggtctggctgctgagggcttgggcactcctccgtgggccacctcaggctccggggtcactaagtgggagtcccagtaccccaattcttctttaagtccccaagaaacagttgatctgccaggggaagctctggaccatttactgagaggcccagcccccaccaccctgccaacttggggcgcctcctctgggcgggtgatgcctcctgggcacaggtgatgcctcctctcgggggtgatgcctcctaggtgggtggtgatgcctcttgggctggtagtgatgcctcctctggcacaggtgatgccacctcctgggcgggtgatgcctcctctgggtgcgtgatgcctcctgggctggcggcaatgcctcctctgggcacaggtgatgccacctcctgggcgggtgatgcctcctctgggtgcgtgatgcctcctctgggcacgggtgatgccacctcctgggtgggtgatgcctcctctgggtggtgata

SEQ ID NO: 49093 - DNA, 1022 bp, Homo sapiens
ggggacaaagatgggggggtggggaggtctcgtctgggtccaggctctgtgtattgtctggggggctgtcaagcttggttcctccggccctggggggtcctggtcagtgtccagctgcttctgcccagcatggatccaggccagggccccctcggcagtcagcagcgaggaagccacctccccagggccaggaccttttcagaccacccccagccatccgtgggtcgggaccatgtcccaggagactacggagcctgtacccgggcctgggcctctgctgttgtgaagacctgccccctgccgacgtctcacctcctccagcaggtccaccctggactgcctgcctccccccccgacgcctcatctcctccagcaggtccaccctggactgcctgcccccccgacgcctcacctcctccagcaggtccaccctggactgcctgcccccccgacgcctcacctcctccagcaggtccaccctggactgcctgcctacccccccgatgcctcacctcctccagcaggttcaccctggactgcctgcccctccacacctcacctcctccagcaggtccaccctggactgcctgcccccccccccccccaccaatgcctcacctcctccagcaggtccaccctggactgcagcctctgcacttcttccttcattgcactgtccactcctgcgggcagagccaggcgctgggtcacggccggccggctccccacccacacccccaggctccctcctgtccccagggagaggcagagccagaagactcaggcccaggcctctgccgcccccgctgcctgcctggcgctggccagaggtctcagggctatgccgcctaagtacgtcggggcgggtggctctgcgcagaggctcagggtcccggccacgctgagggaggtcaaggctgaggtctcagcggcgttttcgatgcggtgccgtggacggcgcattattactcacggtacgagtttgaagtgtcacagcgcgtaccaaaagtaataatgtcccg

SEQ ID NO: 49094 - DNA, 1041 bp, Homo sapiens
aggctgctggaacgggcctacagtcatggcttccaacggagccccagaagctccaggaatatgaaggaggaccctgggcctgatggtgagcatggagagtccgagaagggcctgctggctgctcagccagacgtgtgtgaccagtggtgatgtgggccaggtggcccaggccggggtcccggggagcgcacactccagggctggcccaggtggtgactggcgctgacgtccccagtggagcacccttcagcgaggaaggcagtttgcagaaacagggagttcctgggggctgggctctgggcacctgtgctggaatctgtgaaggcctcacctgtggttctggccctgggatcccctgtaggcaggggtctctgtgaggggcccccctcagcccctggggtgcttcagagtaggggcgagggtgcggctttcccagctgaggaggggccagtctgtgggttccttggggtgccccccaccccgaggaaatggcttgtgtggttctgatgcctgcagggcatcctgtgctgggcgtgtcctggggtgtggacaggggacggggtcctgttcttttggcagaaatgatggggcacctgacttaggagaccctggagcagaccccactactgagccaggccacaggccacgggcctcttcatcggcggcctcctcgtgtgagaaagcctggcttgttctgcaggggcctctgcctggacttcctagctgttttccagggaccaaatcacagttcacctgctgccctttctatggacctggcaggctgggttggctggcactggccctgctgccccactgggccctgtccccatctcagcttggagattctggctaacctgggtgtcctcgggacctggggcctctgatggtgcttggatgggaccctcctgccgccctcacctctccagggcagcacccaggctcaggcctgtggagtagtggcttccgggacactggctactaacagcaggtgctttgttcctgctttggtccctgaagagaagggagggccagagggcaggg

SEQ ID NO: 49095 - DNA, 1051 bp, Homo sapiens
ggacacccggttgtccttgttgaagtcagccatgagcaggacctggccaaccagcgccggcagggaaggcaggtctcccaggttcgcctggcgtttgggaccaaaagaaaggaaaagccagctgatttgatgtctgggagcacgacctggcctttacctggtcctcctggcggggtggtctgccggccagaccagcacatctgccaggttaggggtcccagcccacagctacacgggtggaggacgcagccagcaatgtgtcagctcactctgctggcctgtgtggctgctgccagacagacctcccgcctcctggcagccttgggtgcacctggggagctcgggggtgggcacctgggcagagaagcctcagagcttccctgaggatgagaatcggcacagggcagagggcacgcactggctgaagccctgggaagcggcccctttccacaagccctggtctccattcggggcacctgccctgctggacacacggcccttgactgcaggagcctcccctcgacctcagctgccagcccaccggcgcccccaacccttgcccccagccctggagaggctccttccctggcagggctcatgcccaggggctgggggatgggaggtctgcccagggtccacttgggcccatctgtgcctttgcgctgggcatgttggtgccagggccgcctgctgggcatatgaccgtggtgtggactcctgccctgccccctaggagagctgcctgaccttgaggaagctgagggtcatctcccggaattccttgatggaggtgccccgggtgggcttgtcaaacagtaccagctcccgccggggggccgcatccgaccgggccttggagtcgagggtctcctcaatgccacacttgatggttacatccttgtcccgccagagcccgctgtacacctggacagggccacagaggtcctccgtgcagacatccccctcccactgcacgggcagtatcagccccaggcccacccgccctgccagtggctatacctgctggcccggggccaccgagaggcaggtc

SEQ ID NO: 49096 - DNA, 1860 bp, Homo sapiens
tccaacttcccctcccgcaaattaagcgtagagtaaggggagagagtaacatgggtcggatttttctagaacggcccttgtgacagtgagctttttggtggcagggagcttctttggtccgccttcctggagaccagatgcagcaaaacgcagtctttttcttttcgagacagagtctcagttgcccaggctggagtgcagtggcgcgatctcagctcactaccacctctgcctcctgggttcaagcgactttcctgcttcagcctccagagtagctgggattacaggcgccagccactaggccagctaactttttttttttttttttttagagagacgggtttcaccgtgttggccaggctggttttgaactcctgacctcaagtgatctgcccgcctcggcctcccaaaaaacgcagtgtttatgtgatgctcctctgtggtgtttgcaagatttatacaaaattgcggtttctttttttctctaggacgtctgctcactggagatgacacgtgcgtggggtgttgggtaagttggtgcattggagctggaacagggtcaatcctccaatgtaactaagccctcctgtgcaacatcttaagtgactggagggaccagtcggtcttgtgttcacattgaggctagaagctgtctccaggggagtaaaaacggattatttagtcttcaacaggacactgcccctagaggcgttgcagctgtggctgccgtgtcacatctgtgtcattaggtggcagagattagagaggctatgtctacgctcagcgttctgccccgtgaacgtttgaatgtttgatagtctcacactcctgttttgtggacaggcatctgttttccttcgctggtatctgggagagagggtgggccctgtgagtgggctttctaactctcgcgctgggctaggctggcctctaggggtctgaagggatagtgggaaggtggagggtgccttcaccaggagcagccttcatgagtgagttttaagaacctgtgaggatcggtcaggtcaggtgaggtacgcgctggatcatgccgtacaccgtgtcaggatcacgcaggacaggactggggaagggtttgctggcgtctcggttaatagcagtaacggcagccgcttgtgttcttgattctttgccaagcattcttgttatttaacacgggaaggaggtgacttcgcctgtgatggacttccagtgtgagcactggccagagtgaccaggctgaccagcaccagccctgatccaggtaagaggtgaggcggaggcttgccctccttccctgcctgccgggtgcgtgtgagcggctgccctgcggatgctgtcctggacctgttggcaccacagacagttgctctgctgtgcctgtggcctcggggcaaagagaaagtggcgatttctacactcagtgctcgggaaccagtgggcactgagaatggtttatggcctgacattacttgcaaccaaagccaggcagcatttggattttcgcttttggaaaccaccttacctggtttgctccatgagggaggggcagcaacatcgctgggaaccctgaggtgtagatatgtataaatgagctgtgtgtgtatctgaagctcgggcacttgtggggttaccaggagtgtgcgtctcactcccaggcctcgttctggaaacgattctgtaggtctgtctgggaggccttaggcaagtttgattaagaacagtcgagctggataaacaggctgttccttgtccagcactagtcatcccaggggggcgggggcggggctgcaactcctgtgcacaaaggaagggccctgggtaggggtcaggagctgccttgcccagagatgtgtctgg

SEQ ID NO: 49097 - DNA, 1081 bp, Homo sapiens
tcctcccagggctccaggtcagtccttgggcccccagcccagccgcctccgtggactcctggggcctgtgcctctgcagcctccactgccctggccacacgctgctccatgtatcacacccctcccagcccagggccttttcccaagttgtacctcctcctccctagccctggccacacctgacctttgcgggttcaatccctcagcccagctcaagcactgtcttcctggaaagccatctgccaccccacctgtctctgctgagctggctcaggggctgtgtggcatttcttcatggactactggatgagtgccacccacttcaggaggacagggtctgcctgtcccggtccctgctgtatccccagagccttgcagggaccttggcacagactgggtgaataggtgacccccgccctggcccggccagttctctccctctcctctacttcatggctcctgtgctggatgggacctgctctgtccagtgggtgagcagagcaggctggccgggctggccactggatccttctggggattgtaggcagtgtgggcatgggggtctcctgagagaccctggccagaagacacaagagagcccgccctggggggccccagccctgggccctgagctcaccttgaccccatccgaagatccaagagggctggccctggggggcccccagccctgggccctgagctcaccttgaccccatccgaagatccaagagggctggccctggggggccccagccctgggccctgagctcaccttgaccccatccgaagatccaagagggctggccctggggggcccccggccctgggccctgagctcaccttgaccccatccgaagatccaagagggctggccctggggggcccccagccctgggccctgagctcaccttgaccccatccgaagatccaagagggctggccctggggggcccccggccctgggccctgagctcaccttgaccccatccgaagatccaagagggctggccctggggggcccccagccctgggccctgagctcaccttgaccccatccgaagatccaagagggctggccctg

SEQ ID NO: 49098 - DNA, 1024 bp, Homo sapiens
tttctcctcactggcagagcagaggggaggggcagtcagcatgcagggatggctcaggggctctgtgtaaggctgtcagacacctctgtacctgcccagctgctggggcggccacccaagacacaggcatccttcagagatgcctgcccccgccccaacctgctccctcctcagcccagccctgcagggacgccccaggcagccccagagcagaggtggacccggagtgagtggcgcagcactgtgagcactgtgggcccggtggtgcttctcagaggcagcttaggggtcaggatgctcatcctctgcagagtcactggggactgggcccttggtgcagggcccttgggtgctggggccagcatctctgaggccacatttggctacaggctctcagcctctggagggagaggcagggacctgtccttcccttcaccctggcgaccacatgtcacacctggcctcagggtgacttgatccgttggcctgaatcagtgccagcctctccttgggaccctggctgggggcaggtggggagctgagcgcttacatttcagggtctccgtgctcatcaggttcgaggggaagtccaagtccatctggccctgatgggaggtgggggcggggaagggatgagacatccttggcagggagtgggccctgagtggtggccctgagcctgtgtccacccagctgtcatggggatgggcagccagccaggccctggcctggggcttacccggcggtacttctcgctggtctccttcgtgtggatcttgtcgatcagcttcttctgctggttgagccggttctcccttgcccggcgctcctcgatgaaggacgcctccctttgcctcatgttcctctggggacatgcgggtgggcacagggttggggagctgtctcaacaaggcccctaatggcagtaaagccagcgggcggttggccatgctcaccttactagactttggaactgcatccccggccaatggccacacccttttcctaaaccacttgtgcccgt

SEQ ID NO: 49099 - DNA, 1079 bp, Homo sapiens
agcgacaacgaggaggtggtggctggcccggcccccgcccacgccaaggagggcttgcggcactttctggaccgcgtgctggaggggcgggcgcagccacagctgtcggagcgcatgctagagaccaaggtggccgagctgctggcccagggccacaccaagccacccgagcgcagtgccacaggcgccaagagcaagtacctcatcttcaccactggctgcctcacctactccccacaccagatcggtacacccctgccgccatgctgcccgcctcggtcctaggagcttgggggaggccgggcaggggtcctgaggggcagacagcaagcaagtccacaggcaaagctgggatcgttcactcgcccctggggtcacaagcccagacctggggcctgtgggatgagcagtgaaaacaaacgcaggcagggccgctggccagcaagcaaccgacgggcctgattcaggtctggggcccccggagcaggcagtgcccacggacctctgtggtgctcacagccccagagacaccactgaggtaggaagctgccctggagtgatgtccttggggcattggacagggaccctcaccgtagccctccctgcaggcatcaagcagatcctgccacaccagatgaccacggcagggcccgtgctgggtgagggccggggctccgatgccttcttcgacgcgctggaccacgtcatagacatacacggacacatcatcggcatgggcctgtcgcccgacaacaggtgggcctcttgccagtgtcccaggcggggtgcccgcaggcggcccacacctagcacagtgcccctcgcccaggtacctgtacgtgaacagccgcgcctggcccaacggtgcggtggtggccgaccccatgcagccgccaccaatcgcggaggagattgacctgctggtgttcgacctcaagaccatgcgggaggtgaggcgggctctgcgtgcgcaccgcgcctacacgcccaacgacgagtgcttcttcatcttcctggacgtcagcagggacttcgtggccaggtgcagggcgcggcgtggtgcagggcgggtgtgggca

SEQ ID NO: 49100 - DNA, 1048 bp, Homo sapiens
accaggcctgtgccatggagagccggcgctttggtgaggctggcatcagaatggtggctggggtgggcgctgggttcagagtcctgggtggccttggcgccgcccccaccctgctgatccacagccctggtgcagaggagacccgtggcatggaggaggagcccacccacctgcctctggttgtctgcgtggacaaactcaccaaggtctacaaggacgacaagaagctggccctgaacaagctgagcctgaacctctacgagaaccaggtggtctccttcttgggccacaacggggcgggcaagaccaccaccatgtgagtgtcggaggggcagggcggtgggcatctgctgaccagagcaggagtcctagtcagggcagggtggggcccctgcagagggcgtggggtcatgaccccgcccacctacccaggtccatcctgaccggcctgttccctccaacgtcgggttccgccaccatctacgggcacgacatccgcacggagatggatgagatccgcaagaacctgggcatgtgcccgcagcacaatgtgctctttgaccggctcacggtggaggaacacctctggttctactcacggctcaagagcatggctcaggaggagatccgcagagagatggacaagtgggtgggctgggcggggggcggggcaggtgggcggaggccctggggctctgcatagcagcagccccatgccccacctccctgtcccaggatgatcgaggacctggagctctccaacaaacggcactcactggtgcagacattgtcgggtggcatgaagcgcaagctgtccgtggccatcgccttcgtgggcggctctcgcgccatcatcctggacgagcccacggcgggcgtggacccctacgcgcgccgcgccatctgggacctcatcctgaagtacaagccaggtgagtggggtgccgtgtgggcaggggtgcgggcggcgcctcccctgccccctgaccctgggtctggccttgtcctaggccgcaccatccttctgtccacccaccacatggatgag

SEQ ID NO: 49101 - DNA, 1695 bp, Homo sapiens
acagtgggtaccggtggagccctgccaccagccccacccctgacagctgcccccgttctcccaatgacctggggaggggtcccgggtgcttggcttccttcggcttccccccactccttggggagtccctgcccctctacccgagaaggtgcttggaggtggggaagcagaaggggctgtgctggccagccctttatggacatgggttggggcgagagaccccactccttcctccccgtgcccggtctttggacgtttccctagcgcctcctcccttgccctgcctccactttccgggaagcactgcccctcacaggaagcgcccgcgctgtcaccatggcaatctgggagggagagggcctccaggcgtgtacccagtcctcaggctcctgggaggaacctgccagaagcggggaggccgggcctggggctacctcctggacggacccctccacctgatggcccctcaccctccccaggcgggggccggccccagcccagactggaagatgagattgacttcctggcccaggagcttgcccggaaggagtctggacactcaactccgcccctacccaaggaccgacagcggctcccggagcctggtgagacccccgcttcccctgccccacggccctgtccctagcccagtgctctcattctaacctgtcctctctcgcagccaccctgggcttctcggcacgggggcaggggctggagctgggcctcccctccactccaggaacccccacgcccacgccccacacctccctgggctcccctgtgtcatccgacccggtgcacatgtcgcccctggagccccggggagggcaaggcgacggcctcgcccttggtaggtcttggtcgggggtgggcaggggcagcagggcgccctgcagaaggccgccctcacacgccccctcctgcagtgctgatcctggcgttctgtgtggccggtgcagccgccctctccgtagcctccctctgctggtgcaggtgagccagtggccgcgggcagggcagggagggtgccacacgctcagaggtctcaggccccactccccacaggctgcagcgtgagatccgcctgactcagaaggccgactacgccactgcgaaggcccctggctcacctgcagctccccggatctcggtgtgtggcccccttcagccctgaggctcccgcccaactctggccgccaactgaccctcgcctcctccttcccacagcctggggaccagcggctggcacagagcgcggagatgtaccactaccagcaccaacggcaacagatgctgtgcctggagcggtgagtggccgccccggcactgccacccccacccacccaccccccatccccacctccacctccatttccacctcccctggccaactttaccccaggccctgccaccctcacctgcacgctaaccttcacctcccccgccgccctgcaccctcacctcccctggccaacttcaccctgggctgtgctcccctgccaccccagggctgaggtgggctgagtgcccacttccagactgggccactggcacctcgagggcatggggaggacccagcgatccccccccacccaggcataaagagccacccaaggagctggacacggcctcctcggatgaggagaatgaggacggagacttcacggtgtacgagtgcccgggcctggcccc

SEQ ID NO: 49102 - DNA, 1030 bp, Homo sapiens
gcccctgactgcagcccctggtgtggtggctttgggagtgacctgcctgggttctgtgtctgaggccagtgaggtcagcagactccatcttaggtgtcctcggtgcctgggggacaagccagaggctggaggagcagcatcccttccaggctgcacacttgtcagtgccgggttctggggagagccgcacgggaaggagaggtcgctggcggcatcgtttgctgctccccagagacagacctgggcccttccctctgggactcccaatctggacggggttcctggcttgctgtggggcatgttgaggccggaggctgggcttgtggggctgcacggccctgcccaggagaactcagcactgcctggacggcgagactcagcttctgagctgagggctctatcaggcctggaagtggaccctggggaggggtggggcagggtagttctgataagtcctaggactgttcgcttccgggttctgagccctggcgtcagggaggaagggcatgtccagaacaatggccagaaccaggcccggccagctcggggggtgacgggggcgggtggctggggcagcgctgccgtgtgcaggggccgagccctgcggggccgtgagccggccctgccttctgcttccttcccagatgtagccgcctgtcccgggagcctggactgtgccctgaagaggcgggcaaggtgtcctcctggtgcacatgcctgtgggccctgccttcagcccttccaggaggaccagcaagggctctgtgtgcccaggatgcgccggcctccaggtacgagagcaaagggggaagtcgatggggggatgtccctgcatgaacctctccctgtaagaagcggccggctgggcgcggtggctcatgcctgtaatcccagcactgtgggaggcccaggctgttggatctcatgaggtcaggagttcaagaccagcctggccaacatggtgaaaccccgtctctactaaaaatacaaagtagccgggtgtggtggcacacacctgtagtcccagcta

SEQ ID NO: 49103 - DNA, 1051 bp, Homo sapiens
tgagtgcccgccggcttcgctgccggtgcgcgtcccggggtcggggcctcagtgctgctctgcctgtcctcacgccttgggtggcgctgggcaccggccttgtgcgccatggtgggcgctgaagttctgggggcacttatggcgcaggctcggggtgctgttctagcttcaataggagggagactgttgcagcctcagagcctccgcctgcatcccctgccctcgagggcactggcattctgtctttgggactgagggctgcaggtggactccggaggagggtgataagcccagggtcctgggacaccctctcacctgcacagatgggtcctgagggtccagagagcagagctccctgcaggaacccaggatgcaaagctgacgtttttctggggggactgaactgggagactttgcgactgcattcgtacagtactcctggcagccctgcagaagaggtgctgtgagcccgttttacaggcaaggaatccgaggcatggagaagttaagtggattgtggcacagctgaggcgctgtcctgggcagcctggttctgtgtgtgtggcctcaaggggccagagtgaggccggcttcctcctgggctcagtgcccctggatgggaggtgggcatgaacaggagaggcttccgagaatcagagtgtgctcagccaggaaaggcggaggccacctattcaggaaacggggctgcagctgctgtgctgagcccgggtgggtggcaggtgccagtcctcagttcaccggcctctgcagcttcgtgtctgcctcaccgggagacctggcagggccctccctaggcaactcctcccattcccagtgcccagtgcttggaagggagggccctcaggcagcccagacgttggcgggtggaggggggtgtgccagccaccgtccagctgctcttgttcctgcgacctcttttcaggaggaggaagtgggggatggaggctcctgggctggggaaaagggctaggaggggcctggaacccagaccctagagccagctttgtacctcaggcccctgcctttggcg

SEQ ID NO: 49104 - DNA, 1046 bp, Homo sapiens
ggctggggtctgcccaccagggcctccccacgtctgcctttgagggtgcctgccatgccctgggggatcctggcatctttactggactggaagcaggagacagaacagtgtctgtcccggggtgacttcatcaggagaccgcccacatagagctggaccccgcagctgaagcggaaatgtgagacaggctggcacctccggaaaaactgcctttcagccttggtgttccgtgcaaggtgaaaagaaataggtcctcccagtttacagcttgaaatcaggctagtgagtggccctggagaccacgaggggagaatttaaaggccccggctggcagggtctaggtggctggcagaggcacatgcagaccctgcctggagcctgccctaggacgctgggcgggtcagtctccgtgcaggatgtgagcagcgtccctgggctctatccgcgaggtgccagtagcgtgtgcaggtacatacacgtgcgtgcacactgtgatgacacccggaaatgtctcaggatgttgaaatgtgtccttgggggcagaagtgtccccagttgagaatctgccccagaggaacacacccacaccaggcctcaggattttgtgttgatcaagttccaaggaaaaggaacatctcagccgggcgtggtggttcacgcctggaatcccagcacttgaggccaggagttccagagcagcctgggcaacgcagtgagagaccccatctctacaaaaaaaaaaaagaaagaaagaaaatgagagatccaggtttaaaaattcataaacaccacaaggaaacaatacactatgagacccagcagaagcaacagattgactctagacccagatactagaattatcagagagaatataaagtaacagtgttttatatatctaaagaaataaaagagatttctggaaacatgaacaaggagtggtatttatagttccttactccatgaaaagcatgatctcttaatgctataaagaagactaggccgggcgcagtggctcatgcttgtggtcccagcactttgggaggccg

SEQ ID NO: 49105 - DNA, 1073 bp, Homo sapiens
atgtgcgcctgtaatcccagctactcaggaggctgaggcaggagaattgcttgaacccgggaggtggagcttgcagtgagctgagattgcgccattgcactccagcttgggcaacagagcgagactgtctcaaaaaaaaaaaaaaaaaaaaaaaaagcaggcatttcacagccatgttcatcgcatcaatattcacaatggctaaaacaggccgggtgtggtggctcacgcctgtaatcccagcgctttgggaggctgaggctgacagatcatctgaggtcaggagttcaagaccagcctggccaacatgctgaaaacctgtctctactaaaaatgcaaaatttagccaggcgtggtggtgggtgcctgtaatctcagctactccggaggctgagacaggagaatggcctggacccaggaggcggaagttgcagtaagccgagatcgtgtcacttcactccagcctggacaacagagtgagactctgtctcgaaaaaaaaaaaggacaaaatgctgtaggattccactgatatgacgtacctggagtcagcagagccacagagacagatggtagaatggtgagtgccaggggctggggtccattgtttaatggctacagtttctactgggggtgatgagatagtggaaaatagtgatgacggtgcacagcgttgtgaaggcaggaatgtacctaatgccaccaaatttcacacgcggaagtggttaagtggtcaattttatattatgtataattcagcacacagaccagcacggccccaagtgcggatgcagtaggtcacggccagccgcccgccgatagcctttcagtctgagggacagcacagacgtgatgtgtggccgggcatggcccccagtctgtgagccatagagggtgggactgggtgtcccagcaggaatcggggtgtggaggagctgcctagatggtctggagagggcagatggacctcgaggggagggtttgggctcagcagcctctcacccttgctggccaggctcccaggattccctgcccagggacctctcaccccctcagctggtggctctgcagccaa

SEQ ID NO: 49106 - DNA, 1887 bp, Homo sapiens
ggactggaggtctgagatgtttactgtgaaactgctctggctgggtggagacactggagggcaggaggccaggagagctgcctggctgtgggaaaagctgagtgggggaggagggctccgcaggagtgggccttgggaaaaggagggcgggtccctgggtggaggggccagcaaaggctgtgcaggctctggcttggggacactgaggagctccgttttggatctgcccactgtgagatgcctgggaggcgccatggagaccttggtgggcaggtggtgccgggatcagagtctgccaggggagacaggttttaggagtccctaggtatagatggtttttgtcgtccggaaaggttggaagaaggggccaggcctagtcctgagtgccaccagactgagaagattggggtcagggaggagggcaagggcagccagagaaccaggaaaacatctcatcattgaagatacggttcaggaaggagaatggccaaattccagatgctgttgagaagtagatttaaatagattgaaagtaaaaggatggactgggcacagtggctcatgcctgtaatctcagaacttgaggaagctgaggtgggaggatcaagtgagacaggaagttcaaaagcagcctggtcaaaatagtgacatcccgtctctacaaaaaataaaataaattaggacctatagtcctagctactcaggcagctgaggcaggaggattgtgggagtcgaggagtttgaggcagtcatgaactatgattgcaccactgcactccaggctgggcaacagaaaaagaccccgtttcaaaataaaaaaaaattattacatgatataaggacattatatagtaataaaagggtcaattcatgaacacattatagcaattataaagatgtatggccgggcgcagtggctcacgcctgtaatcccagcactttgggaggcccaggtgggtggatcacaaggtcaggagatcgagaccatcctggctaacacggtgaaaccccgtctctactaaaaaatacaaaaaaattagccgggcgtcgtggcaggcacctgtagtcccagctactcgggaggctgaggcaggagaatggcatgagcccgggaggcagagcttgcagtgagccgagatcgcgtcactgccctccagcctgggcaacagagcgagactccgtctcaaaaaaaaaaaaataaataaagatgtatgtaccaagaacagctccccaaaatatatgaagcaaacattggcagatttgaagacagaagtaagttctacaataatagttgtagatgtcactcaacctatttcagtaatggaaaacgtatctaggtggcagatcaacaaggaaatagagggtctggacagtgctaaaatcaactagaaaggacggacacagaacactcacccaacaacagcagaacacacagtttttaagcacacggaacatcctccaggacagaccatgtgttaggccacatattaaaatatattaaaagaagttttaatatatatatatatatatatttttttttttttttttttttttttgctttctttgttgccctggctagagtgcagtggcacgatctcggctcaccgcaacctccacctcctgggttgaagtgattctcctgcctcagcctcctgagtagctgggattataggctcccgccaccatgcctggctaatttttgtatttttagtagagacggggtttcaccatctaggccaggctggtctcaaactcctgacctcaggtgatctgcctgcctcagcctcccaaagtcctgggattacaagcatgagccaccgcacctggccttaagatattttctttttttttttttctttttgagacagagtcttactttgtcaccca

SEQ ID NO: 49107 - DNA, 1043 bp, Homo sapiens
accgtctggggcgtagcgcagggcgttccccgagatctcgcgctcgccgaccagccacacgtacccggagcccgtcatgttcagcatcgcggctgcgcggtatacagtggcagcatcgtcctcgctgtggggcagacggggatgacgggccaggactccagcactcccaccgcggcgctccgcaggcccaggtcctcctcctctggagcagggacctgcccagcccccatcccctcctagagcgaagcctgcagacctcgcagaggcgctgcggcccagaacccaggagcctcccaggcctccgttgctggctcttaccttgggggagcagggatggggttagatgctggcccccttaccttgggggagcagggatggggttagatgctggcccttaccttgggggagcaggggtggggttagatgctggcccttaccttgggggagcagggatggggttagatacctggcttatgggactgacttccttcttgtgacctgcacctgtgctccccagcacgcccttccctccacctcagaaggctctgatggggtcccaggatggtaatggatcaccattgatcacttgctggccagataccaggcactgctcgaagtgttttacggggattatgttgtttaactttcacaatatctctgtgtcccgaggggaagcggaggcacatgggacacacaagagttggtaagtggcagagtcaggacccgagctcctaagacctcctagacaggccacacccctctggtcctctatgttcaaacatgtgaaatgaggggttgagtggctctccaggttggtgagatattggtggatccagcgtcctggggacggccagagatgagaggcggctttccccctggagtctgcataagcagctgccttcgcccagccacccaggcctggggcctgcaggaggacagagcccagacaggcctcaccttgcaggcatgtgtggtcttgagctctgccagtgtgcttgcaggtgggcccctgtggacagtggagcaggggacctggtcctctg

SEQ ID NO: 49108 - DNA, 1058 bp, Homo sapiens
agctggccctcctccctctcaatagcgcgtcgcggcagcactgtgtctttttggttttgcaaagcgccgcgtccacccccggtgctctataaataagaaccaacaatcaatacccgctggccccgccggccgccagggaccccagccctcagcgcccagtgccgccctggcccggaccggccacaggacaggggcaggggatctccgcagccggactgaccccaccctacccaaaggagccccccacccacgcctccctctgaataagctcgcagccccagagaccaggtgggagctgggctgccctcccctgcccagacccccagctggcagtgccccccacagttcagccttgcagggcggggccagccccagatgccacgtgatgccagaactggccccagaggacggtccctggtgcccagagaggctcgggtgagggttccgctgggaacatgtccctgggagggcaccatgagggtctctgagctgcacctggcctcgctccaggcagggccctgggacccagtgtcaccctctgaaagtggcccatcacctgcacgacatttgtgcttgccccccgtggctgcctgccccaaatcgctgtttctcctgtctgcctggacaccccctcttccccagcctgcccagcccacgatccctgcgctattccccctccctgttccctgcgggactcctggctcagactttgcagcatcagctctgcccgctttccgcagcagaggtggctccaggaatggtgcttccacctgctccttgagcctccagtggcccccaggcctacaggctctcactgtccacccatcctgcatgccaagtcccttccccaggaagctgagcagccaggcctcatgggtccctcttggggcaccctggtggcttcatctcgggatttggcttgcttgatgccaagtcctgtctgtgccctggaggtctgccccgcttccagtgcactgaggggcaggtggctgcaaatcgcacttcctcccccgggcgtaagcttctctctggtgatgctgcttatgggctgggggctt

SEQ ID NO: 49109 - DNA, 1085 bp, Homo sapiens
ccgcgaggccctcatcgccctccttgtggtgctggcgggcatcagtgccagctgcttctgtgccctcgtcatcgtggcaattggtgtcttgcgggccaaggggtgcgtgaaccctggggccgggagaggatgggagtgaggccaggctggctgccctgggcccttggtcttgcaagaagggctttaccccctgggtgggctgtcacctggggtaggaatggcgtttcctaggcgtgtgctgggggagctccgggggcccagcactgttccaggactcatgttggccttcgtcccctcagtgaaacatgcccgagacaagtggacaacaggtgagcaccagggaggccctcgagggaggcacgctgtctcaggggaggcccttggcggggggagctatcccaggggagtccctggaggaggaggggtgctgtccctggaggaggaggggtgctgtccctggaagaggaggtgtgctgtcccaagggaggccctttgtgggggtgcactgtcccagacgccagcctgtcctgggggaacaaggactctaccagctcgtgatgacccggcccgtcatgcaggttggtggagaattttggggtccaggaagatctcatggacctgcacccggtttacgtggagtcccagctaatggacgctgacctggaggtctccctggtgccaccactagaggatcagagccttgtggccatccccatggaggcttcttcagaggagccgccaccacccccgcccctaccacctgagtagagggctgagggcagctgggggaggggaattaaagcgtatttagtggctgtgcactgtcctccctgcaggccctcctgagggcagctgggggaggggaattaaagcttgtttagtggttgtgcaccgtcctccctgcaggccctcacacccctcacggctgcatcatggggggtgcacgcgcatatgggtctcatcaaagcagagtgcccaggccccacagcaagttcccctgttcctctgccccctggcagtaagccatacccctaatgtttccaccttctctgccacagctggtcagcccggctccttcctgcacc

SEQ ID NO: 49110 - DNA, 1731 bp, Homo sapiens
cctgcgcatcgaggagctcttcagcatcgtccgaggtggtcctgccccggccctggggtccgctctcccgtctggggagtcttcccagggccttccccgtgtctcctctgtgtctgcatctgggctccctgtgccttcaccgtgtctgctctgtgtctgcgtctggggctcccagggcctttgccgtgtctgctctgtgtctgcgtctgggctccctgtgtctgcgtcttgggctccctgtgccttcgccgtgtctgctctgtgtctgcgtctgggctccctgtgtctgcgtctgggctccctgtgccttcaccgtgtctgctctgtctgcgtctggggctcccagggccttcgccgtgtctgctctgtctgcgtctgggctccctgtgtctgcgtctggggctcccagggccttcgctgtgtctgctctgtgtctgcatctgggctccctgtgccttcgccgtgtctgctctgtgtctgcgtcttgggctccctgtgccttcaccgtgtctgctctgtgtctgcgtctgggctccctgtgtctgcgtctgggctccccgtgccttcaccgtgtctgctctttgtctgcatctggggctcccagggccttcgtcgtgtctgctctgtgtctgtgtctgggctccttgtgtctgcgtctgggctccctgtgccttcgccgtgtctgctctgtgtctgcatctggggctcccagggccttcgccatgtcggctctgtgtctgcatctgggctccctgtgtccacgtctggggctccctgtgccttcgctgtcgctcttgcaggggggtgcaccgggcagtgctgggactgtccccactgcggcgtcccccgtgcctggatcagggcaggtgtggcagatgctggacagtgcttctgggtgtccactgctgtgctgccttggccttggctcctgctggggactggcccctgggtgttgctctgtccaccctgtggcattgtggtcaaatgcatcagcacgccagagtgtcggggggatgtctggtgcctagcaggtggtctcatcatcgtcctggggctggcaagcacgtgtcctttcccacaccgcacacactctgcaccagcctgcacgtgcgcacgcatccatgtctgtccctgagggatgttcttcttcttgtagacttcccagactcccggccagccatcgaggacctcaagtactgcctggagaggacggaccagaggcagcagctgctcgtgtccctcaaggctgccctggagactcggctcctgcatccaggtgctgtgtgctgcccggccacccagcactctgggcttagacactcaccaggggacccatgtccagggagcctggggcctagtctgccagccctggacttgtaggtctaaggaagaaatgggttgagaagcaattggtgaggtccttaggggatctgaggtgcccgtcagcttgcttgtttcttctttggagggagtcaggactgaccggtaggtctgaggtgatgagacttagttctctcagaacagacctccctgcagggcgggacctgtgaacaggtagaggtggggatggggggacaagggaacgaggctgcagtggggacctgtagaccacctaccggcatggccagctgtctactcgggtgttgcccctgggaggctgtggtcccgggcactgcatgactgctggcttctgccctggctgtaggcgtcaacacgtgtgacatcatcacc

SEQ ID NO: 49111 - DNA, 1031 bp, Homo sapiens
gcctggtctagggtccggccacccgtgggagccttggctggggctgcgtgggggatgggaggcaggtagctgtgtgcagggaggagggagaggcggggctgggctcagctcacacctccatctgggcaggttggggctggctgcttggccctttgtcccaggtggaggccaggccctttggtaaccaaagctaggtgtgcacaggcagggtgggtggagcgagaacagaagggtcctgagaagccgggaggctctgctgggaggctgggctgagctgggacccacctgcctgctctgttggctgtgccaggcaaagtccctgataggctgcggccaggtgcgtgcggtcccagaccctggccacaccctctgcccatcctgcgtctcggggtcttcaggctgcccaccgtatgagtcacggggtgtcctgtccccacagtgggaggggagggctgtgcgagtcagcaggcaccagcccagctgaggagacctggggaggcaggacgtgaccagagccccgggccccagctgagggcagacaggggctgcctgtccaccccccgccccgcaccgcctggccaggctgtaccaggctcagggcccatgtgcacccagcccccgcggcccccctgctgggaccggtcatgtgcacgagtgagggcactaatcccgcggccctggcagccagcccttctgtgttctcagccgtgggggctgggcctggagggcttcggggtcatctgggttagctccacatatccagggcgactggaaaccccatttgctgctggacttcggggctgtgggagagctctagccaccagccctgtcctgccttgagcacctccacctggggtatctgtcccaaagcatgagtctgggagggccgggtgaccccctccccaagtgggctggcagtgggtgggtgcctgtgaggtctgtcccagcctctccctgcctggcctcctgtgggatgagcgttggagggccaggtgggcctagccacaggcagggcagttaagggacaggag

SEQ ID NO: 49112 - DNA, 1101 bp, Homo sapiens
ggccgagggctggggctggcggggccgctcgctgcctctcgctcgcagcagcggcggcaggcgcgggcgagggccacggggagaggagacgcagccccgcgggtggcacgctcggccgggccccggcccgcgctcaacgggcgcgatgctcttctcgctccgggagctggtgcagtggctaggcttcgccaccttcgagatcttcgtgcacctgctggccctgttggtgttctctgtgctgctggcactgcgtgtggatggcctggtcccgggcctctcctggtggaacgtgttcgtgcctttcttcgccgctgacgggctcagcacctacttcaccaccatcgtgtccgtgcgcctcttccaggatggagagaagcggctggcggtgctccgccttttctgggtacttacggtcctgagtctcaagttcgtcttcgagatgctgttgtgccagaagctggcggagcagactcgggagctctggttcggcctcattacgtccccgctcttcattctcctgcagctgctcatgatccgcgcctgtcgggtcaactagcctcaccgaggtgccggagagggagcgctggacaactagaatgttgacctcgagccgaggccctacttgcagcgcaccggaggagaggctctctagtctgaaggcaccgccggcttgcgccgagctgagtgccgggtttccctattccaatcctgtttgaaatggtttcttcagcagggcttaaaagagcagccttcatcctgaaaatgtatttccttttgtttaatgctttgagtagataatcctgaattgaggtcatgaggaggccccccaggccagacagtcctgaacccctctgacacttggaaactgaatataagtaaaatgtccaggtggactctgagtatttcctgtggatcctgggaaagtactgttgcacaaaggctgcaaagctggactcaggaatgtcctccaaccagcagcgctgacctaagagctccctgtgccgtctatccagaccagacttcggtagatgcctttgttagatctatcacatgtaaacgagcttgtatctccttccctgtgccacgagagagattggcttt

SEQ ID NO: 49113 - DNA, 1043 bp, Homo sapiens
gtgagctccgtgcccgcaaacaggtggcggcctgggggcagggcaggggcaggtgagggggagcctggggggtgggccggggtgggccgggcctcacagggcagcctgtccgccggggctgtgctgttcctctccatgtaggggccggtgagggggagtgtggggggtgtagggggcttggggtgggccgggcctcacagggcagcctgtccgccggggctgtgctgttcttctctgtgcacgggccgaaggcgccacagctgctgttctcctgggtctggggagggcagggaggactcaggacaggctcagtgggcagacagaggtcagagggctcgaggtgagggtgggtggggcgggatgactcagcaggtgggaggttgggggtcagtgagggcctagggttgggtgcctcaccggctgccccgtggtgccgcaccagtgcttaatgagactgctgttagtggcgttgcctgtggcactgctcatgatcatgtcggagtccaactgggggccagaggggtcgtgacggtgtgctgcaccctctctcaggactcacccggggctctggcgcccgcggggtccagcccagccctgcccactgctgccctctcctcccctgtcccaggacagggcccagaccctccgctgaccctccatcagggcagggcgggcctcccctcctcccatccggcctgctcaggctctctgggcgggggcggtggccgtcctcacctgcacgatgaggtgtgtgagcggcttcgtcagcaccttgaggatgtcgggcgcctgcgccctgggtgtcaggctggcggcacccagggctagctcacttagcctctccagcagggccgtggcgctctccagtggcagcaggaccagcactgtgagccagttgaagatcccgtgcaccgccgagccgctgaaagccctgtggccgcagagagtgggcagggtcaggtgggggggcccgggctggggctgccactgcagccccagcccagcccttccacccacaactcacctctgaaattcatcccggt

SEQ ID NO: 49114 - DNA, 1043 bp, Homo sapiens
ccctccaggggctgccggacttggaggagtccacacacaggtgcagtctggagggcttcctgcagggggtggagcaggaccctgcactgggagggtctaagtggatagagacagggcagaggcaagaagaacgagcgtgggttccagggggtgccgcacttgtctcttcctgtcagcggcggtgcagcatgacccggagtttcgggagctgaacctgttgggcctccgggcagcaggccgcagacgggctgttttagagggagaaccagctggactaaatgagactggggttggggcacagagctgggggctcagactgggggaagtgtcctggaggcagaatcacagccctggcagcggcagggcagggcccagcatcggtgggactcggcctttgcagatgtggaatgggggctgggagggtcgtccagatggggacctgctggaggtgagtggctgctccttgagggagcaggggttgggggaaagcatctgagggtgctggaatagaggggcttagagccccctgagatgctgggggcaggcccccagggacacagcaaagagctgagaaaatgtggaagtgaggaggtctcaagggaggagacgcagggagggtgtgaaatgtgtgcaggacctgtggggtccaaggaggcagagcagcagggctgaggctggcggccagggaaggggtccaggaaggcgggggcacagccagcctagggccccggggctggtgacacactcctgtctgtggggctgagaggaagctggccagttctggcagcggggcagggtggacagtacctgcagggcgctgagcatcctgtctgcggggctggccagggcagccagcagggctgtggtagtggtgccgatgttggagcccagtaagagggggtacgcccggtccagactgatcaccccgacccctgggggaactgggagtcaccacaggaccccagcccgagcccccgttcccgaggcctctgtcctgcctgctcacccatgaggggcacgacggccgccgtgaagacgctgct

SEQ ID NO: 49115 - DNA, 1106 bp, Homo sapiens
tgcatttttttctagtcttaaaactaaaaacttgagtctaccatttcttggttgcactgaaaataccgcccagcctgatggtgttcccgtgctgtccctcccccttcccttctccccgcgtctacctccccaccccgttctgttccccctccctccttctccctctccctcaaatccgtgagttttggaagccccagggcctctctcccccgcccctcctggatgaggccaccatcccccaaaccggcttgttttgcagtttccccaggatcctggaagctcgctggcgctcgagggtggcggggacacgggggggtgggtgaaggttcgttaccttttctagtgcgttctatcatagttaacggttgcacacttttttaaaaaaagtaaatggatttgccacaattaaatgtcataacatttatgacagaatataaaatattaacatattttaagccaagttttaggtgtattttttgaatcttggttataaacccaattttaaagggcgatgtatccagcgttgtgaaggcaacagagtgtacccatatttatatttttataaaatacctataagactgtgaatctcttgtgctaatggctgagttaattgaaggatcgttttgcccctttttagcctcccagagcttcgaggactcaattcgaacccgaaatcctgccgtgggggaggggttgcgtcgagacctgggcccggggaggttctcctgcgtcactttctgtcctgaaaggcgcccttcctggtttctgtggctccaattttctatgcagccccacaccccttgttgttttgatcctgagaaataaaagggaggctgaattattcaaatttaaatgaggtttccccttcatggaagtgctgctgacccttcgtgcagaaatggggagcacttgaggacacaggtgggtggaggccctttgtgcgtggctggtcgtattcgggcagccctccgtcgctttttataaaactttgtgtgagaagaatatattgataatgtcagtgaaacaagcagacattgaaatggaggcacagattactccacaaggagttcttctgtatattttttctagatgcaaataccttttta

SEQ ID NO: 49116 - DNA, 1058 bp, Homo sapiens
tcggggcagggccctgtggcacagcaatgtccccatctccatcctcacggccaccctcctcacagggcctggtggggcagagcccgtggcttcaggagcagctgtctcagctgctggtctcccacagtgacccagtcacggccgcccagtgtgccatggaactcttgctgcccgaggagcggctgccggctgcggtggctgtggaactccgccggttcaggctccaggggaggtgagcgccgccagggtgaccccagccaggggtgggttccgcccagggtggcccctacccttgggacgacagctcaccagtcttcacgccagtggcttgagaattagaaatcaagacaaaacaaagagcgcagctatacacagagcagacaagacagcagggcccagccctcctcctctgctgccagatccatggccagcccgacccatgagggaccctggggggacagtcaccagggccactgggaggagaggcaggagcaagggtcacgctgggctggactgagccggtgtgggaggaggagccaggacctgagatgcccccaccaaacaggccctgaatgctcccctcctgctccgaggtcagagtgggtgggggaccagggacatgggggcgctaccagctctgctcctcccagggcgactgaggctgactcgaggctggaggtgaaggacatgaaggaccgttactaccagctgcccatccccagggagaacgtccacctcctggcctcgtgggaagacctgaccagacacgagggtgcactcctgcaggtggttccctcggccgctggggcagcgcccggtggtgggatccccctgccaggcactggaggagcatcaggggcatggcattcggagagaggcaaggcctctgggcatgagcccgccaggtgccccagggctgctgtgagggcagccgttccccacactgtgctgctgagactccaggatgctggctgctggcatttacccagtgctgccagcctgtggaaggtgccgtggaatccccattttacagatggtgcccgagacgtggggtgcct

SEQ ID NO: 49117 - DNA, 1556 bp, Homo sapiens
tttttttgagacagagtcttgctctgtcgcccaggctggagtgcagtggcacaatctcggctcactgcaagctccgcctcctgggttcacgccattctcctgcctctgcctcccgagtagctgggactacagtcgcccgccaccatgcccggctaattttttgtatttttagtagagacgaggtttcactgtgttagccaggctggtctctatctcctgacctcgtgatctgcccgcctcagcctcccaaagtgctgggattacaggcatgagccaccgtgcctggccactatcattgcatttctaaagaaataagtaagaagtggggaaaggaggaaagagaagagagagtaaaatataagtgaacaatcgtttagtaaaatgggggtagttgcttacacattcccaaatcgatgtcccgttactccccattctcagagctttagtcaacctacttgtgggtgtcactcatggtggcttgcttccttgtgtgttttctaagttttcattgtgagctcatttactggaactttttccctctggtgacctagggcccacgtgtcccggcaaagtgattaaagaatgatgttttgtttctgccaacttaactacagatagaactcactagggctagaactcactagggctagaactcacgaaagctagaactcatgagagctagaactcgctagagctagaactcactagagctagaactcactagggctaggactcactagatataactcactaggcctagaactcactagagctagaacttgccagcgctaggactcacaggagctagaactcactagggctagaagtcactaggcctagaactcactagagctaggactcactagacctagaactcgctagagttagaactcgctagagctagaactcactagaactgtaactcactagagctggaactcactagggctggaactcgctagaactagaactcactagagctagaactcactagagctggaactcactagagctagaactcactagggttaaaactagggttagggccgggcgcggtggctcacgcctgtaatcccagcactttgggaggccgagacgggcggatcacgaggtcaggagatcgagaccatcctggctaacacggtgaaaccccgtctctactaaaaatacaaaaattagccaggcatggtggcgcgcgcctatagtcccagctacacgggaggctgaggcaggagaatggcgtgaacccgggaggcggagcttgcagtgagtcgagatcgcgccactgcactccagcctgggcgacagagcgagactccgtctcaaaaaaaaaacaaaactagggttagaactcacaagagctacaacttactagagctggaactcactagagctataactcattagggctagaactcactagagttagaactcactagagctagatctcactagggccaggactcactagagttagaactcactagggctaggactaagttcctggagctccttcaagttgcttcaagttccagatgcttgagatgctcaggctt

SEQ ID NO: 49118 - DNA, 1015 bp, Homo sapiens
cagaaacatgcacacagctgttcacagcagcactgtttataacagccagacaagggggtgcggcccgaatgtctgctggacaaacagcccgtggtctgtgcacacagtggggcaggactcagccacggaaaggcagttccagcacatgctgctgcagggatgagttttgaagacaccatgccaagtgaggtcagtcagccacaagagaacagaaccttggccgggcgcggtggctcacgcctgtaatcccagcactttgggaggccaagggaggtggatcacgaggtcaggagatcgagaccatcctggctaacacacagtgaaaccccgtctctactaaaaatacaaaaattagccgggcgtggtggcggacgcctgtagtcccagctactcgggaggctgaggcaggagaatggcgtaaacccgggaggcagagcttgcagtgagccgagatggcaccactgcactccagcctgagcaacagagtgagactccgtctcaaaaaaaaaaaaaaagaaaaaaaaaacaacagaacctgtgtggtctcctttataggaaatgcccaaaatagaaagattcacagagacacaaaatggccaggggctgaggaggggcagagggagtaattgttgatgggcacatggttggttgtctttggggcaatgaaaatgttctgggctgaggcaagtggatcacgtgaggtcaggagttcaagaccagcctggccaaacatggcaacaccccgtctctaccagaaatataaaacttagccgggtgtggtagtgggcgcctgtagtcccagctactcaggagacttaggcacaagaatcacttgagccaggaggcggttacagtgagctgggatcgcaccactgcactccaccctgggtgacagagcgagaccctgtctcaaaaaaaaaaaaaaaaaaaagctaggccaggcgcggtggctcatgcctgtaatcccaacactttgagaggctgatgcgggcagatcacaaggtcaggagatcaa

SEQ ID NO: 49119 - DNA, 1021 bp, Homo sapiens
gcgtgatccccttagggcaacgcgactttatgctgctctgtgaaccctttcccatgccattaagtatttttataaaacatggtttttaaatgctgtttatcattcatcagattctaccttgtgtgatcagaactggggtccttgggaaagcccacccttgatgggggactgttggccccagccccgtctgtgatggtgaccccaacatgtgctgttggcacctcccagaaagggttccccagagcccatgggccacctgacccgtccttgcagctgtcccatggtacatccatgtgttgtgggcagtgagctgcagggaggtggggtgcacagagaagcttgccgcagagctaaaaccaacacggtgaacagggaaggtgtccttcaaaaccgcagcctgggcaggagcagtggctcctgcctgtaatcccagcactttaggagaccgaggcaggctgatcacctgaggtcaggaattcgagaccagcctggcgaacatggagagaccctgtctctactaaaattacaaaaattagctgtgcatgcctgtaatcccagccactcaggaggctgaggcaggaaaacggtttgaacccgggaggcggaggttgcagtcagctgagatcgccccactgcactccagcctgggcaacagagcaagactccatctcaaaaaacagaaaaaaaaaaaacaaacctgtgacaggcccagcgcagtggctcacgcctgtaatcccagcattttgagaggccgaggtgggcggattgcttgtggtcaggagttcaagaccatcctggccaacatgatgaaaccgcgtctctactaaaaatacaaaaattagctgggcgtggtggcaggcacctgtaatcccagctactcgggaggctgaggcaggagaatcacttgaaccctggaggcaaagcttgcagtgagccgagatcgcccccctgcactccagcttgggcgacaaagtgagattccgtctcagcctggacaacagagcgagactccatctcaaaa

SEQ ID NO: 49120 - DNA, 1930 bp, Homo sapiens
cccacatgtgttcaggaccctccctgcccaccccctccctgccgtatcgatcaccagcaccagggtggcccgtgtgcgtggggccagcgtcgccgggctgcccagcctggctctgtctacactggccgagtctctgggtctgtctacactggccgagtctccgactgtctgtgctttcacttacactcctcttgccaccccccatccctgcttacttagacctcagccggcgccggacccggtaggggcagtctgggcagcaggaaggaagggcgcagcgtcccctccttcagaggaggctctgggtggggcctgctccccatccccccaagcccacccagcactctcattgctgctgttgagttcagcttttaccagcctcagtgtggaggctccatcccagcacacaggcctggggcttggcaggggcccagctggggctgggccctgggttttgagaaactcgctggcaccacagtgggcccctggacccggccgcgcagctggtggactgtaggggctcctgactgggcacaggagctcccagcttttgtccacggccagcaggatgggctgtcgtgtatatagctggggcgagggggcaggccccccttgtgcagagccaggggtctgagggcacctggctgtgttcccagctgagggagggctggggcgggggccgggcttggaacgatgtacgataccctcatagtgaccattaaacctgatcctccaccgcggccgccgcgtgggtctgtcctctcagtgctttccaggggccttcctgtgcccagcttctgggcccactcctgtgaggtcactgctgcagggccttcctgcctggacagagttggagctaggccactagaccaccccacagggcatagccagggggaccagcacaggaggggacggagaggagctgcaggagggctggggggaggctgcagtctcggaggggggcctcgccgggtctggaggggacagcagagacagcccgttccccctgccgcctgagggcaccagggagagggctgtatgtccctcacgccacactgtgtgtgcagtcagcagtgtggccacagatgggggccactctctcaacctcaggtgtcctcagggcccagaccgctgctgggcacagccaggctggctgccagctggttccctgccccgtggctgggggacagagcagcacgtatcagctgggctagggtcagggggccactggtgcgcagcctggcacagcctggcaggcttgaggcccagtgtgctgggggtggtcacacagccgtcagccacctccagctcttccagggcattctagatggggtcccgggagggggcaggttttggtgccaatttgagtgtataaagttttaggtaaataccaaatgcctgtagactctgtgttattcagttactatttgaaagtgacatatcgtgaaatcatgggggatccgagtctcctttctgcaaagttgatgagacaagtcgccaccgcctggaatctgctgacgctgccgtgcaggcctcaagggtggcactcttcaaagtaggacagcatgcgaggtcgccacgtgcccacacactgcactgctccaaaggcacatctgtccgtcacctgagctctgagacccagaacagccacagggaccctgcagtcctaacccgtcaggtggctcctggggctgctgccagccgcatgcctgtcccacacagtccggtccgtagggtctgctggagtgagtaaggcctggggggccttatgtatggtccatgaggttccattcctcatgccatgaccaccgggggaagtgaaaggaggaagacacgtcaaagccagcaggcccaggagcagacatagaaggaggtggccccacaggagcagacgcagaagtgccaacggggaaggaggtggccccaagtg

SEQ ID NO: 49121 - DNA, 1049 bp, Homo sapiens
aacaaggtggccacctttgccaaagtggagaaggaagaggacatgattcagtgagaagccgggtgccctgggcgcggggagggctggaggcagagtccaggccctggcatgtccctcccccacagcccctcctccacggtccgctctgtggagtggggtgcctgtcccctgccactgggtgacccacccctctccaccagcttctggaagcggctgagccgcctgatgagcaaagtgaacccagagccgaacgtcatccacatcatgggctgctacattctggggaaccccaatggagagaaggtacagtgacccccaagccccaccccagacctctggaaacccccgacgtggacagacagggcagagccttccatgtttcctggcattttttttccttcccccgggcattcccctagaaatcctttatgcctgagcccagccaggtttggggggtctgaaaaaagagggtgggccctgctccccatctcctccccgctcctccttccccatctctctgcctcggactcatggcaccccgcttcctccagctgttccagaacctcaggaccctcatgactccttatagggtcaccttcgagtcacccctggagctctcagcccaaggtgagttacccaggctgggccgaagctctgcagccactgcggggccacggtggggtgggatccccagggccggccaggcctgagcctcctgcccccgctccgcccagggaagcagatgatcgagacgtactttgacttccggttgtatcgcctgtggaagagccgccagcactcgaagctgctggactttgacgacgtcctgtgaggggcagaggcctccgcccagtcaccatcaggccactccctctgcaccgggacctggggctgggccgcctcgtgctccccgggactgtgtggctccggtctcgcctggagccacttcagggcacctcagacgttgctcaggttccccctgtgggttccggtcctcgctgcacccgtggccgcagaggctgcagtccctgggggccgggaggatcccg

SEQ ID NO: 49122 - DNA, 1052 bp, Homo sapiens
gcccgggctgcaggaaagcatctcaccctcagtcctgcactccgagggcacgtgtctctgtctgggctggggccagcagcaaggcccccctcccccactccaatcacacagatgtgtctgggaagcttttttgcccgttttggatgttgggccttggcagggtccaaagtttggtggaggagaggacctgcccctgaggtggctcaaggacacagagcaggagagggggctcctgcaggcccccagcccgccatggggtggtgcagacaggagccccgctctgctgcagcgcaggcaggctggatcctctgccacatgggcgtggaggctcagggcgtaagtcccgggcgaggacggaaggtcagagcctgggaatgcagctcgggaggagacttgatccagagcgccaggcactgcacctttgttctggagttgaaggggagccctggaaggctgtcgcgggaagagcactgggtgggatttgcctttgggtgggaggtggtgccaggagccagggagagcactggcttcccacaccgaaggggtgagagtagagccatgacccgacgggggctaggtgggcaggggctgccgtcaccctctcacggccctcttcagcccctggcttcctcccccaggaacttccgcaaacacctgcgcatggtcggcagccggagggtgaaggcccagagtaagaccccgtgcggcgggggtgggggggcggcgttgcgcttggctggttggggctttgcttgctgctagctgcgataagaacgacccccgccccaaccccaatcgggccctgcctcaggctcctccccttccagccacttccccagcccggcccaggctcctcccctcccagccacgcccccagcccggcccaggctcctcccctcccagccacgcccccagcccggcccaggctcctcccctcccagccacgcccccagcccggcccaggctcctcccctcccagccacgcccccagcccggcccaggctcctcccctcccagccacgcccccagcccggcccaggctcctcccttcc

SEQ ID NO: 49123 - DNA, 1055 bp, Homo sapiens
gaaggcctcagagcctcttctgcccaagggaaacagacgcattgttttcctgggcctcctggagacagactgtgctttcaaaggaatgtttctcaaactttgggtggccaaagggaaagttaagccaaaaaaatcaaagcgtcaagttaccaagagcgtggtcttggtgagtgagcagcagacattcgagcactgccctctgtgcccgtgtggggatgccaccctccccccacccgccctggctgccagcttctgctgacccctggacccagaagcatctgcttcccaacagggagggagaggcttcaggaacccctacttcacccagccaccgctcctttttgtctctcttagacgacatccctattcgtacctggttccccaaggaaaatcttttcagcttccagacagcaaccacaactatgcaagcgtgagtcttgtgcccacgacttggggtcagggttgggtggtctctttctgctgctcaggaaacagcactttttcccagtctctgggcctaccaggggggctgcttctgaacagacccacgtgcctatgctgtgccaggcctgccagggaggccagggctgactgctcttcccctcccatggctggtgcccagcccccccccccacacacacacagtcaggggacctggcccagggctgcagctgatgagctctcagtggggtgtggggtgtggcaggttctcctgctcctatccactctcctcagcctgtgtctgccctccctcaaaccccaaatagaagcctacttctgtttcatacgtgccataggtcatcacagtttcagggtccccgcagggacctgctcctctctgtcttgacatacatttggcttttctgttctgggattccttccagggaagttccctttgctgcattggtccccacaccaaagaagtgtcctgcccgggggagtccaccccacacccagcctcaggctgcctggtctcagcaaccagtccttgtggcatgggctgcagtgacatcagcttccgttgcccattcagggctggccagcagtgtagccag

SEQ ID NO: 49124 - DNA, 1029 bp, Homo sapiens
gtagacagttgggatgtctgctggttagggggtacacagttgggaggcatgtctgctggtcagagggtgcacagttggggggatgtctgctggtcagtgagtagacagttgggatgtctgctggttagggggtacacagttgggagggatgtctgctggtcagggggtgcacagttggagggatgtctgctggtgtgggcggtggacagttggtgaagaggtttcctgctgtgggtggtggacagttgggaggatgctggctggtcggggggtgcacagttggggggggatgtctgctggtgcttgcttggtgccagtcagtgtccctagaggcagctcccatggggagggagggacagacccctccgtctgtggcagccatgtggctgggaagcagactctgcttctttcttggcctgagtcaagtggttcctccatgagtccgaggtccccggccagcctgccttcctctccatcctttggagtcttgcgagagctgcctcgagctctgtccctctctgatcatgactggtgacaggtggcctgtgtctgctccacctcccttctggcccagagccagaacctcaccagtgctttttcccaaggctaaggccatatggaactagcaatggcctcccccattccgcctcaaatgaggactctgacacctcagtccctggagaggcgagaggaaagggattcccaaggaaaagctgcaggaaaaataaaaataaatccacatcagagagccacgttcgggccgaagctcgggacgagacatcagaccgcgagagccgcgttcgggccgaagctcgggacgagacatcagactgcaagtgaagctcgggacgagacatcagaccacgagagcagcgttcaggccgaagctcaggatgaggaggcggttctccgtctttctgtgctcagcagcactttggtgtgtgtgtgcattgtttgtttgctatctgggagttatttcctcctgattatagaagccacctgccttccactcagcgcctagaggcggag

SEQ ID NO: 49125 - DNA, 1081 bp, Homo sapiens
ttatttctttgttctttctgatcttgatcttgttgtgatattcaggttgggcctcacttatcacagtgcagccatgcctgttccaggagaggggagctgtgcgctgagacgggccgggttcctctcagctgctgcgatccgtctcatccgcgttggtgtcacagcccctctcccttaggggtgggaatggatcttccctgagtgtagtgggagtaaaaaatgggaggtgattggctgagcacggtggctcacgcctgtaatcccagcactttgggaggccgaggtgggcggatcacgaggtcaggagatcgagaccatcctggccaacatggtgaaacccatccctactaaaaatacaaaaattagctgggtgtggtggcgggtgcctgttatcccagctactcgggaggctgaggcaggagaatcccttgaaccagggatttggaggttgcagtgagctgagattgtgccactgcactccagcctggtgacagagtgacactccaactctgtctcaaaaaaaaaaatgggggtgatatctgagagaggtaattctgtattgtgatcagttgatcatctgccgtgacatcgtttttcctcatcaaacttttgtgtttgtcattttaacaaaacttaaattcttgcaaaataacatggacagattctaaaaacatacttaaagttttatcaacagtggccgtctgtcccctcacactgaaaacgcttcggttccttctgagcagcttttcttgctgtttcctaacccatccattctagacacactgacttcctgttgtgggagataaagtgtggctcggtggatggcccccatgcttcctgttgtgggagatgaagtgtggctcggtggatggcccccatgcttcctgtcgtgggagatgaagtgtggctcggaggatggcccccatgcttcctgtcgtgggagatgaagtatggctcagaggatggcccccatgcttcctgtcgtgggagatgaagtgtggctcggaggatggcccccatgcttcctgtcgtgggagatgaagtgtggctcggtggatggcccccatgcttcctgtcatgg

SEQ ID NO: 49126 - DNA, 1030 bp, Homo sapiens
gagtcacccaggggagcttcctcacagacagagtcatccaggggagcttcctcacagacagagtcacccaggggagcttcctcacagacagagtcacccaggggagcttcctcacagacagagtcacccaggggagcttcctcacagacagagtcacccaggggagcttcctcacagacagagtcacccaggggagcttcctcacagacagagtcaccccggggagcttcctcacagacagtcacccaggggagcttcctcacagacagtcacccaggggagcttcctcacagacagagtcatccaggggagcttcctcacagacagagtcacccaggggagcttcctcacagacagagtcacccaggggagcttcctcacagacagtcaccccggggagcttcctcacagacagtcacccaggggagcttcctcacagacagagtcaccccggggagcttcctcacagacagtcaccccggggagcttcctcacagacatcaacggcctaactgagaacactcatttcctgtcattagtggtgttgatgcttctctttctccacacagggggcgacgatggccttctgaggggctgggacaccagggtacccggcaaatttctcttcaccagcaaaaggtaactgcccaagggccagcactcggtgcccacaccagcccccgcgttccctgggtcaccagccctcccgttccctgggtgggtctgtgtgctggacactggttcagaagccgcctctgcttgcagacacaccatgggtgtgtgcagcatccagagcagccctcatcgggagcacatcctggccacgggaaggtgagtccccaggaggctctcgggcccttctcgtctctttcgctgtccccggggggctcctgggcccttcttccctctttcgctgcctttcctcctggcaccattgcagcatttcgtctgccagtgcttcgccggagtgtaggtatatgggtttggtaaaggggactttgtcctcgagggatgcatgggacaggtctct

SEQ ID NO: 49127 - DNA, 1049 bp, Homo sapiens
tctccttgggttggttcttctaccttgagctaattcagagcaaaggtaccgtagggcaatgattgaataattctggactgattcattctttcaacaaatgctatgtgctgagccctattctaggtgattagaatactttagcaaactaaacagacaaaagtcctgctttcttttttaagttttattatttttatttatttatttattttgagatggagtttcgctcttattgcccaggctggagggcagtggtacaatcttggctcattgcaacctccacctcctgggttcaagtgattctcctgcctcagcctcctgagtaattgggattataggcacctgccgccatgcccggctaatttttgtatttttagtagagatgcggttttaccatgttgcccaggctggtctcgaatgcctaggctcaagcgatctacctgcctcagcctcccagtgttgggattataggcgtcagccactgcactcagccttcttaaaaaaattatttatataggccaggcgcggtggctcacacctgtaatcccagcactttaggaggccaagatgggcggatcatgaggtcagcagatcaagaccatcctggccaacatggtgaaaccccatctctattaaaatacaaaaaattagccgggcatggtggcaggcgcctgtagtcccaactactcgggaggctgagacagtggaattgcttgaacccgggaggcagaggttgcagtgagccgagatcgcaccactgcactccagcctggcgagagagcaaggctctgtctcaaaaaaaaaaaatttatttatataaatacattttgaggatggggtgggtggttcacgtcttgctgtgtcacccaagctggagtgcaatggcgtgaccacaggtcacggcagccttaacctcccagggtcaagcgatcctcctgcctcagccttctgagtagctgggactacaggtgtgagttaccacacctggctgattttcacataaaagtccctgctttcacccagcttacattctgtggcggggagacagacag

SEQ ID NO: 49128 - DNA, 1090 bp, Homo sapiens
ggtgccaaaaaagccagctgcgggcccaggacagctgccgtgagactcccgatgtcacaggcagtctgtgtggttacagcgcccctcagtgttcatctccagcagagacaacggaggaggctcccaccaggacggttctcattatttatatgttaatatgtttgtaaactcatgtacagttttttttgggggggaggcaatgggaagggtagaaattacaaatagaatcatttgctgtaatccttaaatggcaaacggtcaggccacgtgactaaaaactgtcctgttgtcgaagcttctcccctgggccgccgggagccccgtggagcgcggcctgcacgggagttgtgtccacaaaggcaaagtaaaggggtggaatcatctggcctctcggacattctctgctccgcctccctcttgtgctgcttagggtgaggtcattttgagtggagccgagtccttgtgggtgaggcaggaggacccttgttcctggtgggcccttctgaggagcgggtgagctcagaccttcctgagtccagcagggagtatgagtgagactctgtccttgtcttgcggcaggagtggtggggttgctaagtcagctgcccgctgttttatggggagtaggatgctctcgcccctgacattggttagttcttgcctgatttatgcatgaagtggctgggagctcagcagtgagcttctgcccagaagaatccacagggcatgttcagcaggcctgctgcagatggtggagggggctggccagccagggtgaggtgagggtctcacttctccgtccgtctgcagggctgtggtttccaggatagccctccctctccttggggagccccaggtgtctggggctggtcagcatcttgtacccatagagctgccccagggaaacatgccaggctgtgtggctgggatcctgcctgtctccaggtgcgcccagccagaggccttgcttcttgggagctggaagcctggccagtccgactctgacctgtctggtctggtccggtccgaccctgtgttggtcccacaggttgctgctacactttcccttcttgaagctccactgccatgt

SEQ ID NO: 49129 - DNA, 2613 bp, Homo sapiens
aggcggcgtcaggtaaaacaggttcagatcccagaagaaaaactgccaagagggagactggcccgttctgggacctgttcctgtttcctgcccctgctgcaagagcataggcagggcctgctggggaggaggcttttttccaccagggaagggtgggctctccagtcaggtcggagaccagagaccccttctaactccacccatgatggcattgtcatcccttacagcttttctttggaacatttcagatggacaaaaagctaaaaagggtaatcagtgagtagctcagcttaataaacacaccctaatcaaaaccttctggctcttctgcctcagccccggcccctccctcagctcagtgaaacagtctttgcctaggtttattggtgcgttgaatgttcagtgccactgttggggttagccctgcgaggatgaagcctgataccagctcctctggcgcagactaaagtgggcagctggcttttaacctgtctgcctgtgttttgtcgtagactgcaccaccccaaacggtggaatgaggcccccatgtgctgagctgtcttggtctgaagaggcctgtagttactttccacttcacaggaaaatgcaacaggctcctgcctgttctggttataaggttactgcacctcacgcagatcccaaatgtaatgatttgaaacatgtggttaacttccagaccaaatacacgctgatcgatgagcaggacatcccgctggtggagagctactcctttgaggtaagtaaggatggctgttccctcccctgatgctcgtggtcagtgcccaggagggtcacgaggaacgagctctctcccctgtgctgcaagagcaggcggccccacaagtggacaactggtgctggcctgtgagccctgagccgtcagccccacttcgagccgtggccctgcagaacctggctgttgctgccactggagcccactgtggcccacatggcctggcgacagtggtcttcctcactttcaccccagctgccagctcctcttgaaagcaaatggaatgttctcatgtttgtgattgtgtcacgtggaccatgtctgttagctcgaagaccctgctctttagagctagccacctctgctgggcctgccttagcagtccctcctggctgcccagctgcctcccgttctctgctctcatggggtcttcctgcctcttcccagcttccattcctgccgctgagcttggcctccctcaccatcctttatctctgtgccccacacattcacagtagtgacctctccagggggttctctatctcactgcaccgtgggctttttttaagggtaggaaaatgtatttgtctatgtcccattgtattttgcagagttgtttgtgagtgtttcttgctcgaatagacagagtggtggtgggccacgctggcccctgggagccatgtgcctgtgggaagctctgcactccccagggtctcagggacagggctggcatttgtccctctggcttgcttgtttcacttggtttttctaagagggaattgaagtgttgctgagaattggaggttttttaacagctctttcccttgttccttctcaggcccgaatggaagtggatgcagatggaaatggtgctaagatatttgcctatgcctttgacaagaaccgaggaaggggctctgggagactccttcatgagctgctgtggtgggtgtttccaagctgtctctgccccccgccactgggctcctgggtgagctccgatggcacagggcgcctggagccccctgccccgctgaagccctgccttgccttccctgaatctcgcagttatttttgtgtccttcaccactaacccaaaggaacgaatgatttgtatgttgcacttcaaacaccaagtggactttctgctgggagcttgcccaggaccggcagcctctggagggacggtggttgctccccttgctgggttttgccgagcccccccggtgtgcatggtagggaccactcagatggggagctgtctcgaggccatctgcttaggtggttttgcgttccagctttggctgtctgtgctctgaagtccaggggccgggtcctccctgtgtccctgtcctgtttgggccacagatcaggtgcttgggtttctctcagcagcttccgcctgaggtaccctcatccaaaggaccaggggcccgatcagatcacatggctgacatttcttcctggaaggactttggtacctgaccagaaatgtctgtgagggtgggaggcagcgatgcagggttagatgcagggtttgctgtctgtttctagggagcggcaccgggggggcgtggccccgggcttccaggtggtgcacctcaacgctgtgaccgtggacaatcgcctggacaacctgcaactggtgccgtggggctggcggcccaaggctgaagagacctccagcaagcagaggtgggtcttctcagggcctggcgatgccagcagaggcgccttttgaggagggccaccgccaaagctcttgtttccaagagggtctcctgttcctcctctgagccctgatgcttctgtgtattttgggaatttcattgtttttccccaaagcgtggaatcctcct

SEQ ID NO: 49130 - DNA, 1067 bp, Homo sapiens
ctcctccctagttaaaatgatactgcccccccatacctgtcttcgttgacttacttggctccatcacagtgtgtgtcatgtgactctcccacatcctgatttggaatattgtctccctactagaatgtaagtccatggtgcctagaacaatacctggtgtacaggagacaaaatatttgttgactgggccgggtgcggtggctcacgcctgtaatcccagcactttgggaggccgaggtgggcagatcatgaggtcaggagatggagaccagcctggctaacatggtgaaaccccatctctactaaaaatacaaaaaatagccgggagtggtgctgggcgcctgtagtcccagctactcgggaggctgaggcaggagaatggcatgaacccgggaggcagagcttgcaatgagctgagattgtgccactgcactccagcctgggcaacagagcaagactctgtctcaacaacaacaacaaaaaaattgttgactgaataaagggagttagaatgtgaagaaaaatccttcaccaagcaaacatccaccctaagtgaaggtgtgggaagcagctgcaggcagctttttcactccatttttccatcagctgctacccttgtgtgcccctcagcacttatgtcaagatgctgctctcagcacgtgacatgctaacactgcagacttcaggtcagtcctgagaggcaggcactgttcttacccacattttataagtgactgaactgaagcaagggagtggtgagaggcagtgatgggattcagcccaggaggccttcctttcaaccatatactgcactgcttccaggaggcgcttcacagatgaccccacctgtggtacactttctgctgttctccaatattcatgctgcctgtcccacaattagtaaaattttagccaagtacaggactgcctggctaaagaccacatttccaacaggaaggggacaggtcagagacaaaaagtgacaatccatttcccagtctgtccctcaaaagtcccaccattaggctgggcagtggtgaaagctgtcaacagccatctgggagcca

SEQ ID NO: 49131 - DNA, 1017 bp, Homo sapiens
ctatggtgtaaaaactcaaatttatctttctatatatctatctctatacatatcatgtatctatctatctacctcttatctattttctttttttttttttttttgatggagtctcactctgtcacccagtctggagtgcagtggcgtgatctcggctcactgcaacctccgcctcccgggttcaagtgattctcctgactcagcctcccgggtagctgggactacagtcacccacgaccaagcccggctaatttttgtatttttagtagagatggggtttcaccatgttggccgggctggtctcgaactcccgacctcaagtgatccacctgcctcggcctcccaaagtgggattacaggcataaaccaccacacccggctatctatctattttctatcatctatctcatctatatatccattcatcctcacatctagataatagatacatagatatagaagagataaaacataggtagtagatagagatgatagataaatgaatgatagagtgatagatgatagataggtagataggtagagagatattttagataaatagataaatgatagagtatagaacggatggatggatggatggataaatggatagatagattgatagaaagtagataggtaggtagagatcatagatagataaataggtagatagatgatggagtgatagatgacagatgatttattgataaatagaatggatggacagatggatggatggatggatggatgagtggatagatagaacataggtagatagatgagatagatgatagataatagatggttggtagatgagatagatgataaatagatgatagatagatagatagaaagatgtgtgtgtgtctattattgttaccatctttaaatttttaagagtctttttctagttcttggtaagaagtgtttaaagcaaatgtatttgttctttttgttgactcatctgaatgccaaacaaaatgtgtgtgtgtgtgtgtgtgtgtgtgttgttacaca

SEQ ID NO: 49132 - DNA, 1049 bp, Homo sapiens
aaagtggtaactggctttctctagtccttctcatgaaagtggtaactggccttctctagtcctcatgaaagtggtaactggctttctctagtccttctcgtgaaaatgataactagctttctctatcccttctcctgaaagtgataactcgctttctctagtccttctcatgaagtggtaaccatctttctctagtccttctcatgaaagtggtaaccatctttctctagtccttctcatgaaagtgataatgagctctctctgtccttctcatgaaagtggtaactggctttctctagtcctcataaaagtggtaactggctttctctagtcctcctcatgaaagtggtaactagctttctctagtacttctcctctgatttctttcatattcataggatctcctgcatggtacatgtattcacacccaaggctctgatttcaaaaccaaccggcagtgaacagcaggaaacatcaatgttcccacttgttaaaaagtcatttcttgacaactgttaggcatctgagattagtcacccatctgctgtcaatgaatgagtgtatctaaaaggttcaaaatactgactctaagaactcatagaaacaacagtacaatggcagttaccaggggcagagggtgcgggtggaagaatggggagatgttggtgaaagggtacaaagttccagttagacagcagaaataaattcaggacatccattgtacaacatggtgactgtggttaatggtaatgtattgtatacttgaaatttggtaagggagcagagctttaatgttcttaatcacaaaaactgagaagtatataaggtgctggatatgttaattgacttgataataatcattctacattgtatgcatatgaagcatagtcttcagattataattcctagagagtgttcctcatactctacggcagtggtccccaacctttgggaccagttttgtcaaagacaatttctccctggacctggggtgaggggggatggttttggaatgattcaagtgcattacatttattgtgcactttatt

SEQ ID NO: 49133 - DNA, 1050 bp, Homo sapiens
atttgggccagtcagaatcattcagcaatgcataagagaagaaatataatatgcgctgatatccaggtgtatgcaagtgataatatggctaatggaagatgtgaattgagaaggggatgtggttattaatgattacttatgaaagaattctgggccaagcacagtggctgatgcctgtaatcccagcactttgggaggctgaggtgggaggatggcttgagctcagaagtttgagaccagccatgggtaacatggtgaaaccccatctctactaaaaaatacaaaaattagccgggcatcgtggcacgcacctgtaatccccagctactctggagactgaggcacaagaattgcttgaatccgggaggcagaggttgcagttagctgagattttgccactgcactccagcctgggagacacagtgagactccatctcaaaaaagaaaaaagagaaaaaagaaaaaagaattctgtctcaagatactagggacgctaaaagtttgctgtttataaaggggattttatacaatgcgtacctttgactttgtgccttcttgccccaggagttactccttttaaatagatagctcatctacagatcctgcagataatccttctggtataaccagaatacgtagttatttatacatatatgtcccataattttttcctttcaaggtaattgatgaattatactaaacaaacaattttctggctgacaagtactgtactttagtgaatttgcttgattaaattgtaataatgaaattaaattttatgcttgctgtgtgtctacaaatgcagttcctgttgaaaatgagacaatctgaagtgccttctaatggacatcccacttccttaatgtttcttttgtatgtgtaagggagaaagtctaatgtctgttctttccctcatagattcttagttgagacactctcctgaaaataaaagtcagattcacaaaagaaaaactgttgagcccagactggtctcaaactagcctcaagcgatcctccttccctgacctcccaaagtaccatgattacagg

SEQ ID NO: 49134 - DNA, 1052 bp, Homo sapiens
agaccagcctgggcaatacagcaagaccctgtgtctacaaaaaataaagaaatattagccgggcatggtggtgtgtgcctgtagtcccagctacttgggggactgagatgagaagattacttgatgccaggagttcaagaccagcctgggcaatatagtgagaccctgtctctacaaaaaatcaggaagtattagctcggcatggtcgtgcacacctgtagtcccagctactcaggaagctgaggtgggagaatctcttaagccccggagttgtaggctgcagtgagctatgattgcaccactgcactccagcctgcacaacagagcaagaccctgtctctgaaaaaaaaaaaggaggggagggcttctcttttgaatgaacctctggtttcgggctgagcatattgtaacaatacaggtactgagggatgttcgtcttttgccatactagatctagtgggtccatggcattcccaactcactggggcatagataaagaatacttacacctgaccctggaaatgcctctccagccatacatttctgtatctctgaatatcatgcctgtgaatagctcgaaagcctacatgtttatggaaatcattcacaaacactgtcatgctatgtgaaccattgaaagctacctctttctgggagcaaattctgacccctgccaggttgagataagttctcctctgaattcattctctgcagcactgagtggggcatttaagacagcttagactagctgtcaatgctcttgtctgaactgtgggttgctgatggcagggtccggtccagtctctctttatatttctggtgcctggtattgtgtgtcagcagaacatttgcttaataactgcaaaacttatagatggaagacatgaacagctgggtgtataaatccacctgctgcacgcagaggtggtcacatgaactttgtgggggttgggggtggcggttgttgataccgctatctgatttatgccatactctaattaccagcagcagaaggtagccagaaggaattcacagacatccctatttgcatt

SEQ ID NO: 49135 - DNA, 1034 bp, Homo sapiens
gtagagaggaagagaaacccagatctccttcctgagcctgggtttgaagcaaatggtctttcctggtctctcaaaggatatcacaaagcaagaattccttcacctgggcacaggctgtcagttacaccccaggtgtgtgcaggaaagccagtgatttatgtctgtctagccaacattcccatgcaccgttgatttcacttctgttcctgaatggtaaatcttggaacagtgtttttgcaagccaagtatgcttttctctgttttctgggtttgtttttgtatgtcaaacctaatcaactctactcgatgcacagagtatacataaagatgctggtatctctgatgtcacccctatagaataaaaaaccactgctttatagagagatgatagaaaacaagttccataaatatgtgaattttgataataaacacattaattcccttctccccttctaaggaggattcccctgcattccaagacaaaggtcatgttccgtagccttgattgaaccctgaagctcaggtctttgactcaactgttctttcagtcctcatgaaccagcttttatttcaggctttattatttgccggttgtgtcatctttatcatttatttctttatttccacctcacattttaatatgccacaattttatgatcctgccaatcatgttgatggatgtctctttcttcttcttcttcttctttttttttttttaacttttgagcaagaggactgctatccaaaattggagaatccaagtcgaaactggactggagcccagtgctgggcatttcaatccatgcaatagctcctcgttctcagcaaattctgtcactcacatcctgtatgaccatgtactatgcttgggagattgactttttaagctttcttatctattttccttaactttaaatctaaaaataaatgggagaacagatgagagtgaaattgcagtgagattgttctcatacataatgtaactctctatttaggaacacaaagactgtaatttcatgttcgttttgaggaat

SEQ ID NO: 49136 - DNA, 1063 bp, Homo sapiens
tagtcatgcgtctaaacatggattacttaatgtaatccctacaactatgctacaagatacttttatcatcacctctggtttaaaggcaacaaagcaaaatttggttaggttgagcaacttgtgtcaggattgcccaacagccactacactatagagcttcttggctgcatgagaagagttctggattgtgaattgaattcagacagtagacctacctggttgctggggagagtctcctgctctggagctgcaggttgtgtataagacaagtctgtttggaccaatggcctctgacagttttcttctcactcctgtattctagtattccatcaagtcctgagttcttgagtttgcctcagatactataaagatatctgggttcaaagttaaacaagggatgtggaggacagtagaagctatgggtactacaagggtgttttgggtaatgctttttctgccatctaaccattccaagcacatttaattttgctaattaagtctttcaaggcatagaaaggaacgacattagaatccatgagtttgagttaaagctgtgttctaaataatactccactgaataccaatgtgtatatttgaaaagtgaggtcaaaattaggggtcagaactagagttgaatacctgttgctttaaagtcatggcccaattatagctcagtcaaaaaaatctagtggaacattcctcctccatgaatttattcagcctgcttgaaataattgaattaattaattggattaaatgaagtaatatatttagagtagtgagcatagtgcctggcttgcaagacaggctcaataaatggtaactgctatcattattattatcattattgttatgattactcttctttccacagatgtgtaaagcatctttgcttaaaatgtgcctatacctccattacattgagtagaaaaatcatagatgagaaaacgtctataatggaaaactaagcagatatttgcatcatcttatcttttttattactagctcaccttatatttaaggtatctctggtaggacccacggtccctagaagggcccacca

SEQ ID NO: 49137 - DNA, 1058 bp, Homo sapiens
gcaatttcaatattttggagtttattgaaatacagaacttacattttaaaaactaaccatcctattctggtgttgatgaattcccctaatttggaattcctagcagcttttaaaggtatacgttgcatgccattatattctaatttaaagatttttagaaaatgtatagagttgagcagtctactttcagaacatctccttcatcgccaaaagatcatttccattccccatttgtaatccctcctcaccatcacttctagcctcatttaattcttttttatttttgtttatttttgtgggtttgttttttgttttgttttgtttttttgagacggggtcttgctctgccacccaggctggagtgcagtggcatgatcatagctcactgcggtttcaactgcctaggttcacacaatcctcctgccttagcctctggagtagctgggactacagacacgtgccaccacacccagcttttttttttttttttttttaatttcttatagagatgggctttaactgtgttgcccaggctggtctcaaacccctacctaggctcaaggctcaagtgattcttccacctcggcctcccaaagtgctgatattacaagcatgagccgctgcactcggccctcatttaattcctttttttttttttttttttttttttttttttttttttgagacagagtctcattctgtcgcccaggctggagtgcagtggcacaatctcagctcactgcaaccaccacctcccaggttcaagtgattcttttgcctcagcttcctgagtagctgggattacagggacctgccacaacacctggctaatttttgtattttttagcagagacggggtttcgccatgttggccaggctggtctcgaactcctgacctcaagtggtctatctgtctcggcctcccaaagttcatttaattcttgattcgacattttttggactttctggaaactgagaaaataaactgttaactatggtcctaccaagtttgacgctgttcctgctggctgtgtgtgtgggcgtctatgtgtggcttc

SEQ ID NO: 49138 - DNA, 1040 bp, Homo sapiens
acagagctgccctcagccccactccttggcctccctcctgtggtcatcagtgcctaaagcccagagggggctgaggcagcaggaggctggtgtgtcagtgctgcctcaagcacacacacacccaggtgaatcgtgacagcatctgggcttgacctcaactttgctgcaaaatcagactggatactgggagtggggagaggccaggcagttggagaaggcacttctgagcctgtggagggaggggagcttcccagctgatatggtttgcctgtgtcgccacccaaatcttatcttgaatggtaactcccacaattcccacatgtcatgggaggaacactgtgggaagtaattgaattatggggacaggtcttccctgcactgttctcttgatagtgaatgagtctcacaagatctgatggttttaaaaatggaagtttccctgaacaagctctctttgcctgctaccattcatgtaagatgtgacttgctcctccttgccttctgctataattgtgaggcctcctcaaccacgtggaaccataagtccattaaaccctttttcctgtataaattacccagtctcaggtatgtctttatcagcagcatgaaaacggactagtacaccagtccccaagagcacagggatgcccaggtctgcagccatggctgggtggctgcatctgtgcctgtgagggtggggctccacccctctaactcagaagggggtggggctcccgcctgttcccagctcccactggctccatggagtgaacagctctggccacgtctcccccaccacagccggcatcatggcagtggccactccagacaggtctctgttgccatcacaagcatccttagcccatcctcagatggtcttttcatccataatgcatgtcgtattctattccacatggcagctgttcataccgtgttcactgtttttgagtttctagtgctttacaccatccctctctctggactcttacttgattaagaacatggaattcccttggctaacccattttcaggttttctac

SEQ ID NO: 49139 - DNA, 1067 bp, Homo sapiens
gagacagtcgtgtcctatatattttcacatgcacctcattgttttttcatggcacttcataaaccatgattcatgtcacactgagcagaatcactacatgaattttctaaatctgttacttgcatcacaaatgtgtgtatccacttgggaattctgtggaatgtctgatattgataaggttggttgacacttcaacaacactgcttttcaatttttttccctaaatgtttacaaaaactcataaaaaacaatcatgcatagcataatatatttttatttttctccttaaaaagattgtctcgtctattggatgtgacatgtaccctcgtgagtcagttccctacgtttaggtcttctacagcatttgttttgaaaacaaaatctacagattttcaaagatatttagttgggaaataaagcagagatattgtgaaaatatgaggattttagctattgcagatactcagctacaaagagtagtggttctaaattttaccactttgctgatgccctgtttttctctgacttcaaactttgtccgtgcacctcattcttccctaagggcagtcaataaagtgggcaactttgaaaaagtatttgcttttcagctaggagatgggaaatacacacacatgcacatgcatgcacatatacatatacatgcacatatgcacacacatatccacagatgaatgtgtctgtgtatatacaaacatatatgtaggatggtaatgcatggtttggctgcaacttgactaatttagttgacagtaggatctgtgcagaagcgaagaggaacagaagagcagaaaagtgaagaagcctctatcatcccagtttttggctaatttgagggcaggaccgagcatgaacctagggtgtggggcagtgggtaaaagggctttttggtagccacagtggatagaagttgccattgaagtttagagatttctatcaaggtttaggcagtagaatagaaatcaagtccctctgggaggtgggaagaatgctagcaggatgagtccccatggtttcgttgccagagccatctagcctgaaatttgggc

SEQ ID NO: 49140 - DNA, 1047 bp, Homo sapiens
ctcacttgcagtacccatgttctccttaggaggctgcattgaggagaggaaaagtggaaaagggttagttcacagcccattgaaggaacaataaacccatccacagacaactagattgagccctgcacataatatgatacctgctctaatttggtacacagtgagtacagtcccttatcccaaactagaaagagcagaatcagaaagggcgcagggccaagtcataaggtgaaaagaatgtaatacacaggttaaaatgaataagtctaactagattgccaaaaacaatctggaccacttaagcttctgcgtttgataatgatatatggttaatctggcagttttgtccacatattgtggcaaaatgtgcaattcctatagtgaagctaagtgagatggttaacttaatgactgtcactattcagaggtgtcatttattagcttctgaactcttagatgttggagaacacaatttgcaaaacaagatattgagttgatggatgaaagtgaacctgaagaaaatagtctagaaaggctatattcatttagtttctttttacttttgattttcataagttctcatagttgaggatggaaaattaaaaacacatgacattggtaacaatacacagttgttgtacagcaccaaaatattgtagcataccagctgtaacagcagtatgaagccagagctgcttcaaggagtagggctttgatagattatttttcttagattatttttcttctcacataacaagaactcgggatgtaggtagcctgaggctgctttgctgatcatgacttagggccttagaactttcctactctgccactgggaattcttgcatgatgactcctgtacctccgagcttaggtataagatgtaggcaggtagaaactgggtctcaagaaaaaagacacacatctgcaggtctgccttcatcttcctatggctacccccagctgcaaggaaatctgggaagctgcatattttaattggatacattgtcatcctcaacgtcatggttgtgaaataaggaggaaggg

SEQ ID NO: 49141 - DNA, 1050 bp, Homo sapiens
acaaagacactcttatcacttgagaaattccaagtgtttagagtttatgtcccaggagccagaactgtctgaggatgaggttgatttcttccttcacagccccttctagctgtccacacactttctgccaggggtttttattgctcttcttgaacattgattactccatatgaacttcagtcagctaaactaactccctaaaatattctgttagccggctgcagcggctcacacctgcaatcctggcactttgggaggccaaggtgggcagagtcaggagttcgagaccagcctggccaatatggtaaaaccccgtctctactaaaaatacaaaaattagccaggcatggtggcatgtgcctatagttccagctactcaggaggctgaagccaaagaattgcttgaacccaggaggcagaggttgcagtgagccgagagatcatgccactgcactccagtctgggcgacagagcaagactccgtctcaaaaaaaaaaaaaaaaaaaaaggttttgttgagccatcctactcaagaaaggggatactttttcatttcttaaatctgtgtttgtgtctttcaggaggatttttaagtagacccattctaggttttgcacatttcttgttacatttattcttaagtatgttatcttctttggtgttattgtatgtggcactttttctaacattatatacactaaattatttctttaaggatatattaaggctcttgatttctgtatgttctgtatgttattttattttattttattttattttattttatttttgtatttttaatagagacggggtttcgtcatgttggccaggctggtctcgaactcctgacctcaagtgatctgcctgcctcggcctcccaaagtgctgggattacaggcgtgagccactgtgcctggccaattgtatgttaatttcttccagctcctttattgaattattttattgttttaagtaattgtgttatttgctaaggattattgtttctctaaggtttttcagatttcttctacaaaataatggaaatgttat

SEQ ID NO: 49142 - DNA, 1078 bp, Homo sapiens
agtgttatgagacatgcatttgcaggacccctaggggcacgtgtctgtctcctagtgcagcccaggaggtattgtcttggaaggcatccctcttaaatcatctcccagaggatggcatctgatgagggtaggatgcatattccaggcaaaggaggcaaaggcactgggttattaaagtattgcaaataactcctgcacacttctggtacaagtacaaattggtacaatccccgaggagaaatatttggtaacatctaccagtaataaaatgtattaatgatcagatatgggacccagctctcccagctgttccatttttgagaatgtttcctgcagagacacttgcccatggatgacgtggcggatgcacagttttgttcacggcagccctagccttcgcacagagttacaaacaccctagatgttcctcaggagaggaaggattcaataaaacactgtgtgtccaaatggtgggaatgccactacaatcaaatgataaggaaggctttctgagatatgatgttaggtgaaaaaagtggtttgtaaatggatgtgtatgatatactatatattatgtgaacaagggaaaatacatatatgcctttacttgtttcttgtaaatgtataaagtcatctcaacgtgtaggtaagaagctgacaaaaatatttgtctcagtgtgtggtgttgttatatgggactagatacaggactcgttggggtgaagaatgagagggagagaatggtccaagaaacagctacagaccttctccaagcttccgcagtcatcaactcatggccaattccatttcatcccaactcctagacatttctgcctgccccagagtagaatatcttgtatatatacagatgtgcgcgcacacacacacacacacacacacacacacacacacacacacacacattcatgtgcttggcttatggcccaaataagatccatgcataaaaattaaaggtaaaatttttattttaaatatgtactttgtcaaacttctgcaataattataaaagccttaaattatgaatagagtaaagggagtttgttattagtatcaaact

SEQ ID NO: 49143 - DNA, 1035 bp, Homo sapiens
aaaaaacagaagtacttttcaaggaaaattggatcagatcaagaaattcttaatagctaagtgaagtctttcaaaattatgctcatagcagtgaactgaactattattaatagtctttgagatgagagtgaaagtgatggctaatggatccagagatggatttgactccttttgtctccaaattccactctttattggctttgaggcaccttaatgaagcccaaggtctagagaaaacagagttgaaaaaaaaagtgtgccttaaattagattaaatggcctcaatgctatggtggaataatacaacaattcctattctcatcacagttacccaaaatagagaaggaactgacaaaggccacttgaagatggtaaaacaaacaaacatgcaacaacaaaaacccggcaacgtggtttgtggatgaaaacccaaaagtatccaattgcagtttgagacgtgtttgggttaggttggcatttgatttccaggtgaaaaaaataaaaggaattaagctcttatagatcaaatgagaatgagaattttttgccaaaactactttgctatatcaacaaaaatttaaatatctcccaaacagagaacactacaaacaaagaacaacccatccatttctaattctaatttaattctatcacaaatgggaactgaactctgatatatggggtttatatttgggatatgtgtttaagctaatggaagagctttgacaggaacaaattgtgaattcagttctatattaatcttagagcttcagttagttatataacagctccttctcccagaagcatattaagaaaaaggaacactcggaatgtttcagtgtactttaaatgaaaatataattttgctatttccactcatttagtcttggtgctttgtggtactcagaaaaaaagattattattttttcctttggaaacttttttaaaatgttgacttttgttgatgaaattctgagaatatagtcgtcggttgcattgcctgctagagagataacaggaacatttcaagactta

SEQ ID NO: 49144 - DNA, 1062 bp, Homo sapiens
caggaccagatggattcacagctgaattctatcagacattcaaagaagaattggtaccaatcctattaacactattccaaaagatagagaaacagggaatcctctctaagtcgatcattctctaaagccattgtcaccctaataccaaaaccaggagaggatataacaaaaaaagaaaattacagatcaatatccctgataaacatagatgcaaaaatcctcaacaaagtactagcaaactgaatccaacagcatatcagaaagataatccaccatgatcaaatgggtttcataagagggatgcaggaatgatttaacatacataagtcaataaatgtgatacaccacagaaacacaattaaaagtcacacaattatctcaatagacacagaaaaagcattttacaaaatccagcatccctttatgattaaaaccctcagaaaaatcggcatcgaagggacatacttaaaaaaaaagtcatctacaacaaacccacagccaacattatactgaacagggaaatgttgaaagcattccccctgagaactagaacaagacaaggacgcccactctcactacttctattcaacatagtactggaagtcctagccagagcaacagacaagagaaagaaataaagggcatccaaattggtaaagaggaaaaataaaaacgaaaatatttaggaatatacctagccaaggatgtgaaagatctctacaaggaaaacttgtaagatctctacaaggaaaactacaaaacactgctgaaagaaatcatagacaacacaaacaaatgcaaacacatcccatgctcatggatgggtagaatcaacactgtgaaaattaccataccgccagatgcaatctacaaactcaatgttttgagtgtcagagaaatgagacacgataccgactcatttaattatgtagcacagtaggtattgaaatggaaatacggcaaaaatgccatagggtccagaaaatagagtacccttaatttgaataatagggaaagactaaacagagggaggggctgtttatttgaggcattgtttccagg

SEQ ID NO: 49145 - DNA, 1026 bp, Homo sapiens
gtgacttttttttttttttttttaaagaatctgggatttactctctcctctgagattttcttaaaagcccatactagattcatccatctgtccaaacatgaagactgtcatctcctgttatagaggagataacttctgatttcagagcatcattctcttgattttttttttttttttttttgagacagggtgtcactcagttgcccaggctggagcaaagtggtgcaatcacagctcactgcaccctgcctcctgggctcaggtgattctcctgcctcagcctcccaagtagctgggattacaggtgcatgtcaccacgcctggctaatttttgtattttttgtaaagacagggtttctccatgttgcccaggctggcctcgaactcctggactcaagcaatccatccacctcggtctccaaaagtccattatcttgatttagcaagtcctgaaaggtggcaagccctaataattgttattgcttatgcttcagagacagacaggtaacctccgccactcttcattgtttttttaatgatttttttaatttaattcacctacttactctttctgtacaatcctctacaagctggtaaaattcccaggacctttaccaatgcaaaactattagggcttaacactttccctttttgcagctgtctgaagttttggaatgtgtgttcatatttttgtttatcagcactcattctgctggttttcacttctgtttgctttctgtttatggtgctcaatattggcttccttctcctaaatatctcccatatttaacctaaataatgcatgattaaaataacaagatgttccttactctaataaaataaataatgaaatagataacataaaagaaggccatgcaagcaataattatatacttacactagtcacacacttatattttataactctatacaagcatatatacgtatatcattataagtctgttaactatatacttacatcattaatggtagttacataatgatagtcctttgggaacaaagagt

SEQ ID NO: 49146 - DNA, 1028 bp, Homo sapiens
ctacttaagattttatctttatacatgtttcatatttataataaatccaagttctgtgggtctgatcattatttgcataagcattaaagtgcactcaaatacttatgcaaatagaccaccagaagggctttgaaaaggggaaacaaacaagcaaacaagcttcccaagtcgttattcacttttgaaattgcaaacaattctcccaaggctgacctagtcctattttcttaaaatgtaaagaaatctccaggtaaacaaccctttaggaaataaagactttatatttcttttgacattaacaaattttggagaaagtttttttcttataattaataataaagggggggttggatttctagaaagaagaatattacattgttttcaaagatactcataatggctcttgaatattaattaactcaacatgcttttcttcaataaacatgtaatagatgttgatgttttaggtactactgtgttagatttgggttacaaaaatcaacaaaacactgactctggactcaaaactgtgaaaagtgacttgaaaatagtcatttagtttgggctaatgagtgggacactgaaaaggtagggtggaaacaaagttggtggtgttgtaggataatagttgaaatatttaggaagaatccagacatttagagcttaagaaatctcaaaaatcatttagaacactttttctatggatgacaggattagatgaaaatggttttattaaattcatacataatagttatattcaaatggttgacaaactgtcctgtttgtcatgtgcgtctgtatgaagagaccaccaaacagactttgtgtgagcaacaaggctgtttatttcacctgggtgcaggcgggctgagtccgaaaagaaagtcagcgaagggagatggggtggggccgttttataggatttgggtgggtagtggaaaattacagtcaaagggggtttttctcttgcaggcaggggcgggggtcacaaggtgctcagtgggggagcttctgagccaggagaagga

SEQ ID NO: 49147 - DNA, 1050 bp, Homo sapiens
cttctccactgttgcagttcagggagctaaggccaaaggctactgcagtggtggactctggggtccccctggtgacaaggaagggactttgagctttggaatgccctgggctgagtcttgccacctgcaggtttgtgaacctcatcatgccttgtttttagcacaacaaaatgggataatagtgactttattattgatatactattatgctgttttcaggtatgtgacactgctgctattttactgtttcttccagatttccgtgagggtggaagaaaatcataccatatcagatgcctcgcagagcaccaggcccaccgtgaaaggtacagcaaattttacttccctcttcttgcctcgttggaaattctttcctgtgagatttcctcccctccgccctccgcgccttctgccatagcctatagcctcctctgggagttcttggataattttgttgccttatacctttgcaatttccagtatggtagccatgcgccacatgtggctgtggagtgcttgaaatgtggccagtctagattgagatgccttgtagaagtataaaatacacactggatttcaaagacttagttcaaaaagaaagaaagcaaggtatcttattgataatgtaatacagtttacatgttgaaatgatcacttggatacgtggagtaaaatagaatgtattattaaatgtaacttcacctgttttcttttgacatttttttgtggacccagaaaattgatagacaggtggatttccttcacacttacacacttgtcttgctcaagaccagccctgcttcctcactggctgctcagtcaaatgcctcctccagtttaagctgtccatcacggggccacccattatgtgtccatctcatcttctctgctcagtgcctgtgcaggcagctggtgttcctgctcctcccgcccagctttgcttatgatgctagtcttgagtgcaggctgctgagcttctcacctttcttcccatacatgtagaacctctcctccagaaacatggggtacttaccagctggcaaggagcag

SEQ ID NO: 49148 - DNA, 1027 bp, Homo sapiens
gcctggctaattttttgtagttttggtagagatggggtttcaccacgttggccaggctggtcttgaactcctgacctcaggtgatcctcccgcctcagcctcccaaagtgctgggattacaggcatgagccaccgcacccggccagtgtaagtcttttgaaacacagacacctagtgcctttcccgtgagtctttcagggaaagattgagttccgtgtcaggttggagttgctgatcaagcgactgactatacggcttcctagccccctttatttgaaaaaccagcgtggtcttcacttttcccttgagcctacaaccacagggtgcctgttcatgtatttccaggaccttatgcggctcctttgctctgcttattccgagaaccaagccttgggactgtgcattttgaatacaaatgaaggcacccggaggaagcccccagagtctcggcacagttgaggaaacaaacaaagcatgctacacgtgcaggaagatccctctttaattcctatgatgacctctctgcttttttattttttaagttaaaaggagtcaatgctttgggttttgttagactggacaaggtagcaagtcatattaaactaacccaggttgttgcttgagttttcactgaacttagactctactgacgagtatagtcaagcagaaattcccctcacgaggtggcctgatggtgtactccagtgggggggtgcagaagatttggagggatctgcttcccgactggggcaggttaacctctttctgccttagttacctctttgcatgtcctaagagcacctgcttatcagatccttaggaggattcactgaattcgtccacttggaatccacatggaaggctgcctggcatgtaggaggtacccagtaaattttagactcctgttatttttgccagttggattcaacagatgtttgttccctggactagtgtttctcacctgggggtgatctgcacctaggggacatttgacaaagtctggagacattttgggttgtcacagctt

SEQ ID NO: 49149 - DNA, 1036 bp, Homo sapiens
agggggtggggagaaagaggaagacagatgaaagcagggaaatccttcttggagtcatagttaaaaggataaaataagagctttagtgtagcctccgtttccagcaatccattttattctttgtccacaaactgaatgaaaataagcagtcattcaaaaatgatatttacgtaacctacaaaaatctcaatcaaccaaggaaaaggtggaatggggcttaatacaatacagggctgtctccggagttccctcccttgatttcaggcttttggtgtaaagctcccgaaagaaagcaactttgatttttattagactcttcaaaatcatctcggtagaatattgaccttttttgtgtgtggaaaaatgacttctacgaattctcttgtaggagtgtacattttggtcattttttggaatgtaggaaaaaaaatgtggggtaccctttattgcattttcaagaccttccaaagaagataattctgattgtaactcattataatctgggaaagtagattgttctggtttcaaggactgcgtgtgctttaaataatcacaggctgctctcagacttgggaacttttggtagaatacagcagtgattctcaaccagggcagttgtgttccttgggggacatttggcagcgtctggagacatttttggttgtcacgttttggggaaatgggtggtgctcctggcatctaatgggtagaggcccaggatgctgccaaacatcctacagtgtgcaggacagcccccccccaaccaagaatgatttagccccagatgttcatagcgccagaggtggaggaactgcctcgggggatgtgtaggagctttactttatgggttttttaatggaaaatatatgtatagacacgtacatatatatacgtgtacatacacatgtagatgactctgctcagcgcacccatgaagtatgcagtgcacctgtcccctgggatctggttatacgatgggtgtccagcctgtgcccaggggatcagtttcctttgtgctgctgcagtaccttgtcag

SEQ ID NO: 49150 - DNA, 1072 bp, Homo sapiens
agtctatttctctgtgacttggggataacagtacatgtgagcgtgaaataagagtataaattgcatcaatgtctgtgtgtcaaggttgcctgaggaggagttggctgggcttgcactgacgcttgattctttgtatcactccgacttaaaccacgacacttccaaggcagagtctaaagcctgtcctctcacaatcttctacaggtgagtaggaggccatagaccttgtgagtacagagtcctaaaagaaggcagaaatgtgtgaatctgccaaaagtaaagaaagggtgttactactggtcaaagtcgttgcaagaatgctggcttttacaactcctgtttctgctgctatcacctgctgcctgtgtcttgtttcctgggctccagatcattttcacatttctcaaaatggtccttggtagctgtggtagatggaataatggccctcaaggtgtatctccatcctaatcctggaacctgtgaataggtcattctacatagcaaagtggactttgtggacgtggtttaaggatctcaaggcctggtgccaggggctcatgcctgtaatcccagcacttgaggaggctgaggtggaagggttatttgagcccaggagttcaaggccagcctgggcaacagagagagaccctgtctctagaaaaaaactaaaaattagctgggcatggtggcacgtgcctgtagtcccagctactcaggatgctgaggtgggaggattactgaagtccaggaggtttaggctgtagtgagccatgttggcgccactgcactccagcctgggcaacagagcaagacactgtcccagaaaaaaaaacaaaaacaaaaggatatcgagatgaggttggggaggttgtctgggtgggcccagagcaatcacagaggtgcttctgagtggaatagggaagctgggggaacagaatcccagaggagataggaggatgggcgcagaggccccagtgatgtgggcccatgagccaagggatgctggcggcctctagaagctggacaaggcaaggaatcgaattctcccctgaagcctttaaaaaaggacaca

SEQ ID NO: 49151 - DNA, 1021 bp, Homo sapiens
cccggtttttctgttaatcatagctggtaataatgccctccggtttatagttttgatgagccgggagctaggctgcgtgttttacatataatatctctgttccatcagctgcataacctagatatccttcaccccatttttatgagactcatgggttcttgtctgggaccatgcacctagtaactgacaagattgcaaactagttatgtcacctgtggagttccacgacaaaggcaattctaggcgatgtttatgtagtgttccttgcatgccagggggattctgtgctctttccatgtgtgaatgatagcatccacctgctaactttgttgggagggttcagttatcctctctgtacaggtgagaacaggaggtactgaggacatctggcccaaggatactaccgctggcacggggtggatggtgattcgccctcagtccctctggcgcagcatctgtgctgtttgctgccaggccagctgcatcccagatagagtgacaggatctgttcgcgtcacatccagaaaaggctctgaggccaagctccctgcgttgcttctcactttcactctggaatcagaggtgcgtgcctggaggacttagctctgcatggacagctggtaaggtgtcacagagggtgaggtgggccattgtagcagagagttgttaagagttggttacgtgggttttctcacagggtacaaggctgaggaatgggaaaccagttaggagaccttgctaatagcgtggaccaaagatggggagtaggtccagacagattccgcagtgttcatgcagtgttcatgaagcaggtgtagacagattgcggggccattcatgaaggtgatttgccggggctttttacggatggaaaaccccttttctgtgttcatcccacctcctgttgtcgacagatgacacctgcacaatcaggtcctcccaactccttccaccacccaaagtgaaatacgcaagtcccagagaactgtgtcattcttaccgaagtggctgatgtaggatg

SEQ ID NO: 49152 - DNA, 1026 bp, Homo sapiens
tatgttgtgtctatctgtgcagtgtgctgtgtgtgtgtgtgtgtggtgtgctgtatgtctgtctgtgcaaggtgctatgtgtatgtcgtgtctgtgcagtgtgctgtgtgtgtgtctgatgtgctgtgtgtgttgtgtctatctgcagtgtgctgtgtgtgtgtctgtgttgtgtgctgtttgtgttgtctctatctgtgcagtgtgctgtgtgtatgtctgtctggtgtgctctctgtatgttgtgtctatctgtgcagtgtgctgtgcgtggctgtgtggtgtgctatgtgtgttgtgtccgtctgtgcaccttgctgtgcatgttgtctatctgtgcaccttgctgtttgtgttgtgtctctctgcacggtgcactgtgtgtgttgtgtctatctgtgcagtgtgctctgtgcggtgtgctgtgtgtgtgtctgtgcagtgtgctctttgtgtgtgtgtggtgtgctgtatgtgtgtgtctatctgtgctgtgtgtgtctggtgtgctgtgtgtgtgtctctgcagtgtactgtgtgtgtgtggagtgctgtgtgcgttgtgtctatctgcagtgtgctgtgtgtgtggtatgctatgtgtgttgtgtctatctgtgcagtgtactgtgtgtgtgtgatgtgctgtctttgtggtgtctgcagtgtgctgtgtgtgtgtggtgtgctgtgtgtgtgtctatctgtgcagtatctgtgcaatgtgttgtgtgtgtgtggtgtgctgtgtgtgttgtgtctatctgtgcagtgtgctgtgtgtgtgtgtgtggtgtgctgtgtgtgcacgtgtgtggtgtgctgtgtgtctgtgtggtgtactgtgtgtgtgtctatttgtgtaccgtgctgtgtgtgtgttacatgtcctgagctcacgccttctgttttcacatttgactgtgattactgtcctttttgagatctgagtaacagggacagggctgggcccgatgacttaggcctgtagtcccagcacttgaggatcatttgagcccaggagtt

SEQ ID NO: 49153 - DNA, 1026 bp, Homo sapiens
gtgctatttctgcagcttattgtaagtctaaaaattatttcaagattaaaagtttttttttttaaaaaagtcagatgaaaacacgaataagtaaaaaaaacataaaaagagagaaaaaaggagccatttatatgattaactttttggttggtgtcgccataagttttttcagttcggattcttagtaaaggatgtggatcaaaacaaatcttcatactaaaacatcagcagagaccttatttcatttgaacaaaatatcatgaagtcaggattcgttttgcatttgaatcttgaacatttaagttttttaggaaatttgtggtgctcctgtccttgaaaggaagcccacatatgttcaaaatgcagtatcttttaaatgcatttgaattttttaaagttttggtgtttgttgtttttggttgtttattgctttgatttttcatgagcagtgctgttcaggggtactattattgtcagttttaaatcactgctgcagcatacttcatttgatcttgagacttgccatgagtcttactgtgggggtggggaggatggggaaagaaaccattgagtatgagttggcatgtcccacagaacagcgggcggacacttcagggggctgtgcctttctcagagactcgagggctatgcccaaatcgttatgcagtgtgtatgtgtgggggggatagttggggggacgggtatggggaaaggagtaatctaccagggacgacccaggacagatcccagagccaggaatgagggttggatcttgggcaaggccatctctgccatgactgcttgtgggaactcctgcttactccccgtgaccctgagcaaaacttccaagtttgaagcctcaattttatgctctgtcaaagaaactagtttttcaccctccaccagaggatgaagtatcattctccacgtgaagcactcagcacagtgcctgtcccctctgcagacatgatgccaatctgtgatgatgttctcttctgtcagcattttacaaagcagatgagagcg

SEQ ID NO: 49154 - DNA, 1050 bp, Homo sapiens
tgcagagcatcagctggtcatcagccatcttgcgggagtgcccagaggggggaagagcaaagcctaccccttctacggagtgtgagggaggcaggcttgggtggaggcaggactgcaccagccttccagagctcagagaggtgacacctgagccaagtgacacacacatgataaagaggaggtttctggagtccagaggaggaaggcatccttggctaagaggacagcatgaactcatagggtacctccaggaatttttcccctgggcagtaggggcagagaaaggtacccaggggggcaggggataaggactggcatggagcatgggctcgatatcagcctgctgattttaatgaaagccgtttggtcacctgaagaacagctttgattttacttctgtaatctaaactcttttgagttggaatataaaactcagtgttccatgtgacaaaggggtttttaaattggtcattcccttaaacatctttacattttcgtatctgttgatgtcatttttttccccattgctgactcctgttcctgtcttctatttctgctcttgacttaataattcttggcttcttgacgtttatcattgccgactgctctgaatcctcatcttcccttcatttatttccatttgtccgctctgtttactgcctgagatgttgaccttttttccaagcatgcactaagcggcattttaaagaagcagcatcatgtcatagctcctggtagtggggctgggcctattcatcttggggcttctttatctaccttggttgtaggtagttaagaaaatcttaacccttgggtcattatttctatagtgggtcaaagagatgaccacgttactaaaactttcatgtctagttgcatattctgttttttttattgtggtaagatatacattacgtaatacatttgtaagtgtacaattcagtggtatgaaaacattcacaatgttgtgtagccatcaccctcttacacctaaacatttttccattatccttctccaaaactctctgctcattatacaataactggccc

SEQ ID NO: 49155 - DNA, 1079 bp, Homo sapiens
tgtgacatctgttgtatttttcacatgaattaattgagtatctattatgtggcaagctctgtgctgtctttgaagcactgaactgtcttatgatacacacaggatgaggacaggatcattttctatatttctgtgaagtcctttttcaaattcccattcttttgctgcttctgcatctcctttgactgctttagggcatcccaggtagaaagcttacctaatgtcaactccagttctttcttttgtagtcttcattttaagcatgatttctgtttttctttttccctttaaagaaagcttctcaaactttgaaatgaaaacaaatgaaaggagagggaaaagattcagaaattattgatagattgctaaaaacaaatgctatgataattttgggtcggagcatctgtcgttttacagcacaacagatttagcttcttaatgatgtttgtatgtttttcctcaaaagtgtattgactaggtaggagttgagccaagccttgaatgaatcatttcctgccaaattcaatagactgagcaaatcctcggagaaatggccatatttctctaacactgggttcctttcagggctcaagattccattttctctcaatactttgctcctacagactaggagtcctcttcatgctacagtatgcagtgtgtatggaaactgtgaatggagaagcagccgttcatgctgccaagtttctttcagaaggtggctccaggtggatgactttcagtctgaactcagtgtcaccaggcatgtgtgtgcccacacactgccactttaagctgtggacaaacagaacggatattctcccaccaaaataaacatacaagcaaaacactctgtcttcattcagcatcatttgcatcctataaaataatggtttctccttgatgcccacctttcttatgggtggttcttaattagttccaaacagaacttaacgtggccatgatattccacttgctaaaacaagggcagtcgagtgttcgatttgccatcattgattagacgcatgcagtcacccagtgctgtttgcccaagcatctgtaggcggggattccccagt

SEQ ID NO: 49156 - DNA, 1028 bp, Homo sapiens
aaaagtgaatttaaaaagaaaaaaagatgagatggtaagatatgaggaaataatgaatgcattgtgactttccacctccccatacccattttcatagtttggtgagtagaaagagaaatgaggatgctggcccaattttgattcccagtggatgaggctcacacagaactgccctgcttcttgacactattatgatattaaaagtaacttgtatttttataagttattaccatcttggcacacttgcattcattttagtcaagtactgtcacctttagatttcaagcttgcagagtcttaaaaaaatacacattggagaacacatagtcttttaacagtaaaatctcagcttattagaatgtttagtgactgaggtattcagagtcagtcagaaaagtatctttaggatttcagcatgtggagatgtctttcatagagaaaccggggagagtcaggcaaaccctagcacgttgagcatggcgtatcctcatctgcacgggcacttagacacctggacaagtccattagcagtaaggcaggatagaggggttcacaggatacgtgctgcccaggatacgtacgtgcagcccagagctgggaggaaatcatgaggaccgactagacatttattgtacagatgcatgactggctggtatggcctgggatatgtcagtgaagatacaccgtgaggttgtgggaggtaggattcacagtaaatcctaaattcttcatctttgcactcacgacgcacaatagctgatcaaagcttttagcaaactgcagcaaatgaaaaggcggcagaacctcatggtgacaaatgcaaaccctggagtcggactgcaagcattcacaccccagctccaccagtccccagccctaggacctagacatggagctgcatgtcagtgtgtccgttccctctgtgtgagaacgggatagtaacagcgctccctcacacgctcctgtacacatggaaaccaccactgccgtcggacacagtgtatgctgtagaagcacttatggtacta

SEQ ID NO: 49157 - DNA, 1649 bp, Homo sapiens
gaataggaatttgattgcaagctttcttctgaacagcttgtaataagagctgtttgtatattaattacttattgaattattgtggattttaatgttttaatttacaagcaatttggaacttattgtggtgacagctgctcatattttgatactttatggtatttagcaatttcatcataaggctattttttcccctggtaatttataacccaatcctgaaaacagtaatttggtctctccagctcactataaggagtattgtcctgtttcatccccactgcagatttttttcatagttaaaagtatattttataagcaaaatcaagattcctttgtgcctgcttccctggtgccctttcatttctattcagagttacagatgaatttagtttcactctcattattttacttcagtggtagattttttacaaattgccctggttattactttcatcttgaatatccttatggtttttgttttcaatgtactgtaatgcactttaggggcctgtgaacctgcttgtaggtttttttttaatctccttcctttaaacaacataactataaacatgactcagtgggaataatttgcttgaatttccttaaaacacttgagtttctatataaactccctaataagaaacaccttcactcatagcttcacttgtggacttcaattatattaaacctggtacctttttattatcactgaagactattaaataagaatttagagaaaatggtggacatttaatttccttagttcttgaattcgtagatgatagaggataattgatactctctaggaggcaggaatcattcacaaccaaagaaattttataaggtaaatatcattaggtaaatggtttactgattagtgtttatagtgactgagaaataaaaacaatttttgatataaaggattatcattttatgagccataaacctggcttcctcataaatcagtgcaaatggaacacttgtgaaacagaaatgtctgaagagtaaatgaaaagttgagacgttagtgggtgcctttggttttcttgattttagaggagccggaggagaaaggattctgacccgtttgtgtgtttttatgagcacagtacatgaggatgcatatatgcacacaaatgtgcctggtagagttattggaaagctagcccaagcgatggggaatgtttagctaaagcgtgttgtcttctcccgagggtgtgcacaggttcatgtatcagctgaataaggccctgttccaaaaactgatatttcaagggaaccttaatttatctttaaatttaatgtaatttaaaattaatttaaatctttaaattatctttaaataatagcagtagcaatagctgagctaacattaattttatctattttgagactcttttatttcagaacttctacatgcataatgcctgaccggccacttttaatttctcctttctttcactttgcaaacaaaaccttacaatctgtgctatggactaagacagaaattaagaaccaataaaatgtgttaagttttaattaggaagaagaaaaaacctaaaggaacgggatggttgagaggtaaacacaccccaatgatttttaagtcttttgtttcaaacctttccctttctccctaggctggtccc

SEQ ID NO: 49158 - DNA, 1034 bp, Homo sapiens
ttcccacagaatacatagctgtcgatggcactttgctttgaaccttggtgtagagggcagtcctcatgccctgggctgaggggtgcatgtgacacatcattaaaagtcaaaaatcattttcatagagcaggtcctccccacatgtacacccagagctcctgtgcttctctcctctttctctgacttcttccaaaatcgtgggtcttgtctccatcagtcaagaatttaacttttcttccaaaacatccccctcctcttctgtgaaggaaggtgcttgtggactggccttaggaaatgtcgcccagacaggaacggcacaccagtgtgccatcactcaagccagaaatgaggtttgcagtgaccttctctgtgcttgagagttctgctacactacgaataccactataataacagcacatttatttgtgggaaattaaacagcaaagccctgggtgggagatccataatttaccatcttcctgtgaaatttagttctggtcttagaaaaaagaggaggaggaggaatttttattcccagccttgtgtgtggtgaggtttgtctggaacagtggttcttgcagaggaatactggccaggagactcacttgagtcaaaaaactgaagaagatccatgaaaacaaccaccaccttcaagtgagccacttagagataagcgcagctaaacgccgggacacccagctgatggatggtttctcttgattttggtgtgatgaagcccacagagctgaagggcattaaatacagctgttagggttaggagtccattcagagaatattctcatgcttgtatctaataatctaagaatatatatgtagattctacaatttttggaattaggttttaaaagaaaaataatcatttaaaagctagcaaagtaagtgtttgttgggggagaaaagtttgatccaaatattaaatcagtcttaaaaaattaaaatatgtacttgagatggagcagtcagtcttaccaaacattacatcctggctcgattgcaggccatggatagttttt

SEQ ID NO: 49159 - DNA, 1020 bp, Homo sapiens
accattgctctagaggccatgtagagatccattcagagaaatgcagctagtgaaaatttcagcaaataggaggacttctgttaaccatggcatggaatgcacatctcccaggtctttatgaaggtgcctaatttccagtcatgacctaccctctccaaaagaggacccaagctgatgaaagaccttcgaggtacccctgtagaactttatcctgcacatttgtcattgtgcatctgcacaggatattcctttcggcagacgactttcagctctttgcagaagtctcagacgccacatccttagtccatctttactggttcatctctttgttccaagaagacttaattgaatgtggatactgttgtccacacgatctagaaatgaaatctgtgttggagagcataatcatgtagagagataaagttatacagccaaaacatgtactcaacattaaaaacccagatgagagagaaatcaagggcacactccctccgtgggttagactgagctttgcacaccgttctttgtgagttgcctgagctgcacccacgctggctgctgtccagagctgccagtggtctagctgagcagccaggtggaaatggagtctgtgtccatgcagggaattcaagaattttggttcctgtgcttgtgggtgggtcttggagtgtaaagtaaaaagcggaatctcggagtcacatagtctacggttcacagtttagttcagcgtcatatcacatgatccttgggcgggttacctgatgtctccaatgtttgtccttatgtgtgaaacaaaaacagtaccaactccaaacagctgctacaaagactgaggtagtggacagagtgcccaggtttggttgaagatggtaatgtggtcagaatcggctctgtttcacagagcatgtgactgcaagtaccagttctgtggcccagtgctgcttgcgggaatgaatgagtcagagtggatgaatgaaatgtcccaggagcacgagactttccttccacaattgctccatc

SEQ ID NO: 49160 - DNA, 1051 bp, Homo sapiens
aatgatgctgagaagcttgaagccatttagtaggagccacgtgagtggcccccatcagccgtgagagtcatgatgtctatgagagaggaatcactgtggcccagagtagataaggaagattccatgtagtggatcgtcaagccaagaatgcagtgaggtcccgctttatccattgactggggtttttctcttccacactttgccaaagacctcaatgataaaagcttgcaggtaaaactctgtatagcattggcagagaatagagtcgttggtgaacccaagggtgggttgcttcattttggtaggagtgggtaggagaaaaggaaggtggatagagagaaagcaagttagaaggaaaaggtaaggttgttgtaaacagccttggcttatatcctccaaaaacacaggggcggaggaacccttggggataggggaacctggaagggcgtcctttggaacctaatgtaggcagttatagttctgtaaagaaatatgcaaggctctgtgcaattgattgtaaaattaatagcagctaccctattactctgttagataaatctcaactacacatttgatatgttctttacaacctggcggtggggacagaacagagggtggattgaggaggagggagagtagacagagaaaagtgaagtgtaagaaagcagcaaggagagcacagcgcagagctcgtctcctggaggaacattcccatctggtgagcgttttgtttattgcaaggtcagtttgcatttggataaggcgaggcagaagggcactgatacggaagcagagggaagccggctgccactgcccctcattggctgaatgaaaggcggcggaagaggagcacctgtccagcaaggctgacagtcctgcctcctgggataagcagattctcagcctgcagagtggtctaaccagggaggtagagtggctgctttccgaactccctgcttcctgctcatttgcctcatgcatggaagttgtaaacagtgtgagagttgaaagccacaccatgggaatgccttggtgtccaccccacctgttg

SEQ ID NO: 49161 - DNA, 1049 bp, Homo sapiens
tagcccataaggctcactctctatctctattggacagtgccggtttataaggagaagggctgtcttttcttgtatgataaatgtttccagagaaaactttgccagaatagttactaactttttcctttgtttgcggaacacagacaacaataatttgggatgcccacacaggagaagccaaacagcagtttccttttcattcaggtgagttttttgttgttgttgttgttgtttgtttttttgtaattcaaaaataataattcaggtcgagcccagtggcttacgcctgtaatcccagcactttgggaagccgaagcaggtggattgcatgaggtcaggagttcaagaccagcctgggcaacatggcaaaacccatcactacaaaaaatacgataactagccaggcgtggtggtccacacctgtagtcccagccacttgggaggttgaggtaggaggatggcttgagcccaggagatggagtttgcggtgagccaagattgcgctactgcactccatcctgggcgacagagccagaccgtgtctcaaaaactactaataataataatccaaaattaggctgggcactgtggctgatgcctgtaattccagcacttcggaaggctgagacaggagggtcacttgagcccaggggttctagaccagcctggacaacaaagcaagaccccgtttctacaaaaaatataaaacattagtcgggtgttgtggtacacacctctagttttagctacccaggaagctgaggcaggaggattgcttgagccaggaaatcaaggttgcagtgagctgtgattgcaccactgtattccagcctaggtgacagaatgagatcctgagatgccccttaaagtaactgaatgcgccgagtatggagcccaggaggcctcattggtcagaaggagacccattttgtggcaagcattgattgctcttaaggtttgcaagatagagatgacctcggcacccacctgctcagagctctgaaacacagcagtgagccagccacagaagcagtgcgggctcctttctc

SEQ ID NO: 49162 - DNA, 1021 bp, Homo sapiens
cacgtttggcttaagtgccaaaacctacctttgtaggcaggaaggatgctatgacaggttcacagccctagacacgcagaccccggggggtgaggcagggatgtctaatgcagaaagctctggcttctgtttttcagagaaaaatatgcccgaggtaaacatcaataaggttcctctaacacttgtgtcttaagaattcatctgtaaagtatttcagcagaaaataatctttcccaaagtgtccccaggccctatggaagggtttcctacccagctgacccaggaagaccacaaaccacattgttctgaattgcgtgagcttctcacctgtgatctggctggccatgaggtagacccaattcccgtcggcaggtcagacatatctaggcgttacttgctctctttttggtgtcaatcagtgtgttaaagaacgttcaaaatgaagagaaagaagctcgctcttccaggtgaaacgcagctgggaagagctgtgaggagcgcctttctgtggctgtggcaggtttggtgtttaatggggcgataggagacattgccttgccccactagcttttccccagtaacacctcgtgggggcgcccttggtcaccgtcggcaggaagccttagctcagagcctcgtggtggagtgaaactcggccgcagaaaggaatgaactattgatgcacgacagccaggagagatctcaagggcattttgccgagtgacaaaagccagtctcagaaggttgcatgctctgtgctttcattgatgtaacgttctcataatgctaaaatgctagaaacctgggacccgtcagtgctgtgggagttgagggagcatgtgaggaggttgtgtgccgatacagtagctgagggagatcttagtggcgacggaacacttctgggtctcagttgcagcgatacacatctacccatgtgataaaatgacagcactctacaggcaaattgcaccagtgtcagcttgccagcgtcgatacaacgctacggctacgcgaaatgtaa

SEQ ID NO: 49163 - DNA, 1025 bp, Homo sapiens
cgggtgtggtggcgcatgcctgtaatcccagctacttgggaggctgaggcaggagaatcgcttgaacctgggaggcggaggttacggtgagctgagatcgtgccattgcactccagcctgggcaatgagagcaaaactccatctcaaaaacaaacaaacaaacaaaagcaacagacatttgttgctcacagttctgggggctggaaatccaagatcgaggcgtggcagattcagtgtctggtgagggcttcctggttcacacagtgccttcttgctgtatccatgcatggtggaaggggcaacagagctctctggggtccctttaataagggcactaatcccattcatgaggctccaccctcatgacataatcacctcccaaaggccccacctcctaacaccatcaccatgaggatcaggatttcaacatatggattttgtgggtgggggaacacacacattcagtctgtagcacacgccagttaggagccactgctatccactgtcagattctccctaatgtgtcatccttcccttggccttagggctgggacccctagggaaccttagttaaggtcttcgcaccttcttctttcgtgtgttctctttgtgctgaagtttgcttcaggtgtttaagagagtctggtccttgaagaggcaggatgaccttggcaagacctggaggagccaggggtgcctgtccagaggcagggagctccttaggcctgcacagtggggcttggccagggatccatcctcaggacttggttctgctatgggaggtaacgcccaccctgtgtctctctagcccgccgagcccctccctctgcagcacacccctccttgctggtcttgcactttgtgtttgtcagggagcatgactaggttggtggggagtggaaaggaaatctccagtcctgagggatgctgtcccgtggccatctcttggtcgagtcttttggaattgtgtgctggctccctcgaagtagaatgcatgtgaccatgtggcacatgcaggcttagta

SEQ ID NO: 49164 - DNA, 1030 bp, Homo sapiens
ccaggcccaggcccaaggcagccgtctttgcacggtgcagtggggagtggaaaggcccatgtcccctctcccagctcctctttttagtggacagctgcccttgggtaaaagtggaccatgctcagcctcagttttctctctaaaaagaggggaacccctggcagcatagtgtctggagtctgcagggcctcagagattgctggacacatagacagcgctcaacagataggaactggaggtttctaagaacatttctgggcccggtttagcatctttgcaatgtctgtgtgccctcgcttctctccctctctagctgtccttcagcctcagcctcagtctaccccccagcttctctctctctctcttttctccctctctaccccctccttctcccttctctctctccctttccctcccactgtttttcttttacagctttatcgagatatgtgattttctttctttttttttgttaagagacagggtctcactatattgaccacaccggtcttgaactcctggcctgaagcaatcctcccatctcaacctcccaaactgctgggattacaggcgtgagccactgttgccggccaatttctacactataaaattcacccattttaagtatacaattcagtgatttatagtgagttcaaaggtgtgcatccttcatcatgattcaattttagatcctttccatcacccccaaaagattctttttattcctttaagccatcccttctggttcccaccacagccccaggcaaccatgaatctcctttctgtctctggacttgcctcatttggacactccctgtacatggaatcctgcagtatgtggtgttctgtgactggctttttgactccgcatcatattttcgggattgatccacattgcaggtggtatcggtactccattcccttccggtgccaagtgctggtccttggtgcagactgaccgcatggtgctgaccagtgtgtcagctgatgcacggtctcattgctttcccgtgccaccctgacaagagtg

SEQ ID NO: 49165 - DNA, 1066 bp, Homo sapiens
catttgctcatctgacaagtcctaaggtcagagagctcccgcctccatgaaactatcactgtggggcagatgatgagcaaaccacacacccgaaacatcacacatgcgcccccttgccatcttctttctcctgcctgtgtccccagcccaagcacggagctgctttctgtccctttaggtcactgtacattttctggacttgtatgtagatggagtcctgcagcaggtgctcccttccacctggctcctatctcttggaataaccattctgagatgtgcccgtgttgtcagatggatcaagagctcattgctttgcattgctgagtattagtgcagtgttgggtagcaagttacatgctggtggcattttgtgttaatattagaggctagtttttagaaaaccgttgcaaggagagcccacagggagaacaaagagagtgtcctgtgaaagctatctcttgaccctgatggagagaagggcgctccagcctgtgcagatgtctgtttccggtgccatcgagctctaacttcaaccttgactctgctttccgagtttgggtaagacttgtttcctactctatttgaggtcatcggagaccatcactttatcatggatgggaaaagttttcaggtgatgaagggctgtgctgttgatttggaaagaggacacaagactggacacttcctttcagggtaccatttctaggccctcttgatattttaatatgttttaaaaattaagagaatgtctgcatatgtactagaggaagtcctgttacacaggaaatactctaaattcaactcacatgcagttggttcccattttcaattcttgggaatatgttagaaaacaaaaattttaaccttggagttaaaatctgttgctattttcttttctttttctttttggagacagggtctatgtcactaggctggagtgcagtggcatgatcatggctcacctcctgggatcaagcaattctcccacctcagctccccaagtagctgggactacaggtgtgcgccaccacactggctaattttttgtattttgttgtcgagacgg

SEQ ID NO: 49166 - DNA, 1108 bp, Homo sapiens
gtagcttgttcacagcccaagaatgcaggagcacgcaggatgctggagcaccagcttttctgacttgttagtgatagcctgggttagggaaggttgtccttggaccacatgggctgggcatgcccctcaattcatggaaagtgactcagaaaagttcaaggtttcaccaagactaagaggtgaggaggaagttctttcagaacataagggtactagggtggtgatttcattctgttctttttttatgtgtggactttttcaagggcacaaatgttttgtgtcaattaaaagcagatttgtatgcattttgttacaatgattatgattttaaagtcttaatagtattatactatacaatctacaaaaagatttgagcatcttataagccctgataattatgcctcgctctaagaaacatgggtatctggaaagccacattataaactttaatattataaatgtgctttctgtttagaaggaattcttggagggtctcctttaagagtggattcctaggccaggcacaggggctcatgcctataatcccagcactttgggaggctgagaggattgcttgagcccaggagttcaataccagcctgggcaacatagtgagaccccatctctacaaaaaaaatttagctgggcatggtggtgcacctgtagtcccagttatttgggaggctggattgggaggatcgcttgagcctgggaggtcaaggctgcagtgagctatgatggtgccactgcacttcagcctgggtgacagtgagaccctctctcaaaaataaataaataaataaataaataaataaaaacaaaaataaaaaaacaggattcctagagcacagccagcatgcagaacttgttttctaaggcttttctccaataaaaggaaccagggctcctcagaggaatgactgagtctagggttggggcagggactgtacaagatgagcctggagtatcttatagtgccagaaaataagcgctcaaatacacccatatgtaaacccagcggtgacaacagtgtgggtatgtcatagggacacaggaaccaacaatgaccaaaggcagaacaagttaagcagcaaaattaagtagtagt

SEQ ID NO: 49167 - DNA, 1035 bp, Homo sapiens
ttgtgaagggcacgatctgcatctggcagctctctgggtggtggctgagggcagagaaagtgagtgactctggggttgatgctgttgcgggggtgggatgaagagacagtggcagctggcccaggaagtcccccaccttccaaaagcgctgtcaaacctccgctgtctccctaccagcttgttccctgaaggtcagcccgcttaggccatgtggattcatctggagcctggggctgaatgcattaaacttatccccagaaggtggtgaaaaagaccacttctttctttgcaggtgagcatgtgaggcgatgggagagcgctttggcaacatctctcaaatatttactgtcagctcctctctcttacttacagtaaagagcagaaagctgggacgtacctaagtggatgacccagggtgcctggtaaataagtgacgccgacagagctaaaagacgtgaggcaatacccaactgaaatgcaataagtttatgacattatatctagtatgatatgagctatggaaaaaatgtaggacaaagaagagagaaaaagaagctaaaatgtgaatccaaggcttctggatcttgagtggttatattccatgtagacattatgatctgaatttttgcatcaaatttaagatataggggtaaaacttcatatcctttgaccttgaaatttaattctgagaattttttcaaagaataattataagtacggcttatgagctttatagacacagatattccttctatcattaatataaaattgagatatatttcacatgtgccataatagtcaccatttcaaagtgtacagcagtggtttttagtatattcccaaggttgtacagccatcaccctatctaattccagaacattttcttcccactaaaaggaaaccctgtgctcgttaacagtcactcccattccctctttcccccagcccctggtcaccactgatccactttctgtctctctgggtttgcctattctggatatttcctttagatggaacctcacaatgtgtggcctc

SEQ ID NO: 49168 - DNA, 1035 bp, Homo sapiens
gttctgcttgctattccagaaagcagcaggattttaggaccatgagaaatgatattgtagactgcagatttttggtataaattcaaataattagggattattcttgatatgcctcagaactttttattattgaaagtgcattgttttcctataaaaatgcaaatcgtatttaagattttcatgtgaattgtgagagtctaaatagtttctgcggcataaatgcatggtttaatggtgcctgggttgtaacagaaaagtgtttgagcaaaaatcataagggaaaaatgattcatattttatgtctgtctacattagacctgctcagggaatagaatttgggaaacacataataaataagaaacctgcatgcttgattgaacatttgctttcttcactatcaggacacgggggcatatattttaaggcttttaaaggcatttgggagagattttatataggccataaaatgcattacccctcaaaaataaaaatcactgaagaatatagttggctcacagaaaaaaaaaaaaatcctctctaattttaagctgctattagttctctttacaaaaaactcgggaaagttattttgttttgcaaactttaaccatgaccttgctttacttccatgtatttaatttcactgaaatgatatttcaaagaaaagcctttctggaaattgtttttcctttaatacccaaaattggaacaacagcactcacaggagcgaggctccaaccagtggatcagctgtttggcgtggatgtagaagaaggtgcattgaaactcagtacatctgtgtttagccttaggcaggaagtctgtttcttcaagtaaacctaacgtactaaagatactccctgcagatggctcgtttccggcccacggcaaggtagacaagtcatacggttttaaaggcaaagccgtcttgtctgtctcatggggacataagaacaatcgattgttgaaggaatcctagtgcttttggcttccagtacagacagacagacagatgtgcctctctcgaccttgctg

SEQ ID NO: 49169 - DNA, 1049 bp, Homo sapiens
ggctcagaaaactcaaaaggagtgttctgtaaaatacttctgtttatattatatgtatggtaattagtatgagtataaaatggtcgggcaaaatttagctgggctcagactttcctgtggatcagataaatggaaatgaaaaaaagtatgaggacacagatttgctgattgttcttcatcttttatatttatttcttaacttgtcttggtctactgtagaatgttccagaaatgtcattgggtataatgtctgatttagcactgacttatttgtgggtttgcttggagtgtattttccttgggctttggatatatgactgccataaattttaattacactaattagacgtaggtggatgcttaagcccagttggagtcctagccctgttcagctgcctctgtcattagtttttctggtgacatggtttggcaccatcttccaacacgttttccagacattagttttaagttagaaaataacttgtctaataaagctactgacattcaactagtgtctttaccttgttgaagtggacttgagtaaaatgcatacatttaaactgtaacttgtgtacccgtttctttccttaactgtgggctttcagattcgtttggtggctagagagggagtcatgcccgatcctcatgagtccatgtgctcgtgtctagtttaggtggagcctgacttggcacaaggctgggtggcaggttttaacatgtgtggcaatgctagtcaattggggatatccacatggctcatagtgtagagaaggcttctgaggtctagacccagcaggtgggaagccagccttggttagtgccgtggaccgcgggcacaggaggaggcagtctcaggagcacctctgccctgcatctccctcggaggatatagggccacgtgtgcctgccacttccctgttctcacagctctttgtgatctcagagaagcctctggattttgtttttgggcgagtatgccaactatgtcctccacagcatggggttcaggttgagtttgccattcctagtttctccctagaaacatatcc

SEQ ID NO: 49170 - DNA, 1072 bp, Homo sapiens
tgcagtgcctgcttccgtatcagtccaaggagccctcgtgtttgccacctttacctttgaacctccccctgcctccctgcctgtgtccgcttttgcagctcaatgcagccatgacaaggaaagaaaagacaaaggaaggccagagagccgcgcagttctctgcaggtgcagatgcaggcagtggaggtggcctgagcaggcagaaggacaccaagcgccctatgttgcttgtcattcatgacgtggtcttggagcttctgactagttcagactgccacgccaaccccagaaaataccccacatgccagaaaagtgaagtcctaggtgtttccatctatgtttcaatctgtccatctaccaggcctcgcgataaaaacaaaacaaaaaaacgctgccaggttttagaagcagttctggtctcaaaaccatcaggatcctgccaccagggttcttttgaaatagtaccacatgtaaaagggaatttggctttcacttcatctaatcactgaattgtcaggctttgattgataattgtagaaataagtagccttctgttgtgggaataagttataatcagtattcatctctttgttttttgtcactcttttctctctaattgtgtcatttgtactgtttgaaaaatatttcttctataaaattaaactaacctgccttaagaacagagtggaaatgtgtggctttatggaaaaagaatgtttaattatggaagcttaaatatataaaaatgtgtgtttttcaagcataaaaacagaggtataaaatcagagaaaatagctgaacgcagcgctcacccagcttcaacacgatcattcacggctgccctctcctttaccctccagcccacctcctcctcttagaatttgaagcaaagcccatatagcttatcatttcatctttaaatatttcaatatgtattgctaaaagagaaaaacataataaccttatcacatcttagcatttaataattccttactgttaccaaatagccaaggttttctctcccatttatcttgtgtcattctttaactctttgaacagaatctaaacatga

SEQ ID NO: 49171 - DNA, 1047 bp, Homo sapiens
gagagggatgagtcgtcgtttcaaggctgacctcttttctctattttgtttcttctccaggagacttcttggcatcatcacaaaaaaggatgttctgagacatatggcccagatggcaaaccaggaccccgaatccatcatgtttaattagcaacaaggtggcaattattttcagaaaaacactgactgtgtcatttaaaaagaaataaatgatatgttattatcccaatgaaagatcatgcattggggacagcagaaacaaaagcttttttggaaaggcggggaagaaggatgaaacctttaaaaacaaaaacaaaaacatcaatgagtaggcattttatagctttaaccccgtatgagtttcaagctgtgtttcctaatgagtttgctactgctgtgggggcatgtgggtgggtaaatgatgtaaatgatgtgatctgtacaagtatgtggagcatgaatgctgactcaagaaacttttactccttctgctcaaggctgatgtttgtaacttatgaacacacgtgaagtgttgagtccaaaagacaaaggggcatcggcatgtcagcgtccttatttattggttcttgaagttttgctgctatgttactgaatcatactaaagacatttgcgcttactttgttgaaaaagaaaaagaaattaaatttgaacacagtgaaagctgcaagtatgccagtgggtccgctcacgaccgtcctgtttcttgctcctgttctcagcctgttatctggcttatccatcagtttctgaaccaacatcaggggcacctgccatgatgagtgtgaagaaatcatttctctatgcaagactggcatcctgggactgcacgatgaactattggagcatacagtactgcggtgtgtctcctcccatacaaagggacacatccttattttgagggtatactcacccgatcattgatttgcatccccatggcatttgcttcatttatttattgcttttgcccatgcattcaatattgatcagctcagcacttccatgggccatagccggtatgcccccag

SEQ ID NO: 49172 - DNA, 1080 bp, Homo sapiens
attacacctttgttttgctttaataatgaaaagctttcctctgaaagttcatttcttcatatgacttctgtaggtgatgatagtgggggcaggaagataatggggtgaagacaacagcctcccagactgggtaacagaaggtccctcttagtgtacgctgcttctatgagaattgttgtctcaaaaggaaaacgctttcttggtagcactcactggagaaggaaaggtgctctgggtgattcctgctacttgacctttgctcaacacattagtttgctgtggctgccataacaaagggccataaatgtagtggcataagcaacagaaatttattctctcacagttcttgaggacagaagtccaagatcaaggtgtcagcagggacatgctccctctgaaggctctagggaaggatctgttccaggcctttctcccagcttctgggatttctttcacatcgggcagcataactccagtcttcatatggtgttttctgcatgcacgtgtgtgtgtgtgtgtgtctgtgtctgtgtgtgtctgtgtctgtgccccaacatccccttgatttttaggacaccagccatattggattagggcccaccctaatgacctcatcttaacttgatcatctgcaaagactcaatttccaaataagatcacattcacaagtactgggggctaggacttccacatttttgaggggaacacaattcaacacttaacactcacattttcagaatgactgtgaagaaattcatccagggtcaggccagctcatttatctggtacctgtcactgctgaattgctccacttgtgctcacttgcacactttgctgggccatgacattgcaaaccagtgtggtttggcccctgtattggcaaaagggtgaacccagaaggcttcacccttttgcgaagctcaatgtgctcctggcccttccacagactgcatgagcagctcatgcatgcctctgatggaagtctcttggtgagagaagagggggagggcaagataattgtctgatcccctgcaaagcatcaggaatgaaaaagagccaagtggctcatctgtcccaatg

SEQ ID NO: 49173 - DNA, 1047 bp, Homo sapiens
gtttttagcagaataccacgatgacttcttcccagagtcggcttatgtcgctgcctgtgaggcacattacagcaccaagaacccccgggcaatttattaaaatgttgttggttctgtaagagcaactgctctgtctagtttggcgctctgggttccaggtgaataactaacaaggtggtgggtctttacccacagcgcaaacacaatgcccaccttggggctctgttgtttgagttgcccacatactgcagttattctgttaggaatgattccctgggtgcctgaaagtgctctgacacgacacttgttactttgcaggccatctgtgatggcaaggaaaaagcaactatgttcacagtgaaatattcgtggaataggttaggccatttcagtagacattgcagttagttagcaagaaccacattgtctctttatttgttagcattaaacaaatttttttttgcaaattggttttatttttttgatgaagccgagcaactctgtccaaaaaggtttagtttgtactcggaaaccacaaagtagtctcaaagtattttagagggaatcgatattgatggcaaaagaaaatttgcagctatgcatttgcttctaacggttccctctctgtgaaacattatttttggtgatctaaagaaagcattgcctttcttatttgagattttacagctatactttgttgtgtaatgttatggttccctttctgtaaaatgttatttttggtgatctaaataaagcctgtcttgtttgaaagaaccaggagagagagttttcactctggccttgtcctctttaatgcagggtaacagtggggtaaccttttgactcataactttaggtttcattttgtttttcctttgtgcctttttttgttaaatccctctttggttttgcctcacttggcagcaggaccagacagtggttcctagaagttcctgcagttctgtgctgtcttgttgctgcattgtggtctcatctggggctaacaccagcttatcctcctcctccctcattaccaactgacagtct

SEQ ID NO: 49174 - DNA, 1112 bp, Homo sapiens
gtagtttgttatatagcaatagaaaacctagtacaccttccttggttgaaccccaatctaggcatctccacatcctcacttactcctaaataactcctcctcacaccaattcactcaggacacctaagagcatatcttggttttcctattatttttgaacatttcatatttaaggtaatgtttgtacgacaaattttttaatgtagtgccctggattgattattatatcattaatgttaaatttctttctgacattaaagctttaaacaatgaagcatgttattggaaacacctttcatttcagagagaaattcctgtaattttgggataattttaatgtattgtatacattctgcattctccttcttgacattaagagcttactgacatgatttccttctgataaagctccttggctatgaaggagacacatccgcttactttgtggtctttggttaagaaaaatgagcagataggttattggttaagaaaaatgagcagataggttatagaactactgatcttctaaattttagaagaccttctgaaattaattttcttttaagacagagtctcactatgtcacccaggctggagtgctgtggcatgatcttggttcactgcaacctttgcctcccaggttccagtgattctgctgcttcagcctcccaagtagctgggattacaggcatgcaccactatgcccggctaacttttgtatttttagtagagacagggtttcaccatgttggccaggctggtctagaactcctggcctcaagcagtctgcccacctcagcctcccaaagtgctgggattacaggcatgagccactgcacatggcccatgatcttctaaaatttagatcagtagttctcaaccctggctatacattaaaatcacccaaggagcttcgccaaacaaagtaaacagaatctctgttggggtatggggtaggaatctacatactgtgtttttaaaggcttccatgtaccttcattagacaccaaggttgggaccactgttttggatcaacctagaatagaattcattccttcagtaccagctccaaagtaagcacagcgctggtggttctgcaactatttagctat

SEQ ID NO: 49175 - DNA, 1020 bp, Homo sapiens
ggccagttacgtatacatgtgcttgaccatccccctattgggaggcccatatagggtagaatataggcatgcaataagtgagatttctgaggtggttgacctctttggatttctaacccaaacctgtagtgtgcccctgacaagttccattggggtgttggcaacacaaatttcagatgctttcatgtttcatccagagatgcccctgtcctatccagtgaccttccccacaaacaggagaagacagtagattaaaaaatgatagactagggctatatgtcaccaggcagatgcagctggaacctatgccccaagaatctagccaggacttcttaaaaactagttaggtctatgagccaataatcaagacttatgttaaccatcctcttgagaggcttaaccacccgttgaatttggtcaagtgtgagtgagtgactgtaagccttggagcctcattgcagggcattcttaattaaccttgaagttgggataatctcaaaagactatgaccaggaaacagtaatagtcaggcctgttcataaagtgctcttgatttacagttggaacatctctatttgtgtgtacctcggtgcttcccagccttttcaagtcatggcaaatgcaaaatccagtaaatgggtgaggttatttgtggaagaaggtaaaaatccagaggacccaactgttcaaggtcaccccctctgattaaatatctggctgagagtctttagttaaatatctctggataaatatctctacacacttgtaactcattcatggcacaccagtgtacttaggcattgtacattattccacaattcttcctaatcccttaaatgtttgttctactactgttgataaaaatcaacttattatctcagtgttctaatttatttaatgaccaaggtgtggttactctgtaaaaatattttccagaaaagatgttcactgccaaacattagaaataccatccagcttctcatttaaattttaattatcatactagttgaaatgacactt

SEQ ID NO: 49176 - DNA, 1034 bp, Homo sapiens
caaagcattcccctttaccttcaaggcatgcaataatatttcagaatagtgtcattttaggaaatatatcaaaaaaattaatcagaaagcaatgatgcataggaagacagcttaatgaaatattgtcctaccttgaaccattttttttttcttcatgggtaagttactgattctattagaactcaaattgtgattgctttctaattcatgggcacttttgcatcttgattactgactctaaaggaaagatgaaatttgttttcccaaactattgttattgttgccattgttattgttattaacatacaccatttactgagtgtttgttatttttcaggcactctgctgttttatgagacaggcattagtgtccccacttacagttaaggaaactgaggcacagagcagttcagtggcatgaggtcacacagctggtaagtgacagatccaagatttgaactctgactctaaaccttgagctcttaatattctattacatttgatttttgctggttgactattgttatgactcttccacaaatttctatattattttatgtctcccaacaaaatgtatgaacaacctgtgattcaaggaactttaaaaaaaaagtcccttttcagatattttaatggctcttgaaattaaaattcaaaaagctctggatcaccatagttaatcagaactagaagctcttatagaattgctttctgcttaattctgtaggggaaaaaggctaaatggaaagaaagtaatttattgccaaaatactgatttctgcctctgaattttggcaaatctcctatatcttttagaattgatattcagtagaagagatcggatttgtgaacctgagccatatatttgctatgctctaactactaaagcagatgggttgactgatgtttattcgttcaacaaacatttagtttttggtgatgcttacttggagctagctacaatacaagacactgtaaaaggaataaaataacagttgtctctagggttccataatctaaaagaggaaggcata

SEQ ID NO: 49177 - DNA, 1012 bp, Homo sapiens
ctgtcgcccaggctggagtgcagtagtgccatctcggctcactgcaacctctgtctccagggttcaagcaattctcctgcctcagcctcctaagtagttgggactacaggcgcccgccaccacgcctggctaattttttgtgtttttagtagagacagcgtttcaccatgttagccaggatggtctggatcttctgatctcgtgatccgcccacctcggcctcccaaagtgctgagattacaggcgtgagccaccgcgccccatatatacctatttttgataaaatatatatttctttttaaaaagtggtatattagggaaaacacaaataatctgttaacattttcaatgtaattccttcctgcatgtgtttttacatgaatatactgtgtgtgtgtgtgtgtgtgtgtgtgtaacaaggatcatttgttactattttgaatgaaatctttttttaagcttttattttcttttttgtggctgatatatagaaatactgttgtttacaacaaaatgctgaacgccacctaggtctaatcatgtgtctatataatttcttggatttctttgatgtgggcagttgtattgtccataatttatgatgtggaaaccaaagctatagaaaagttaggtaattttacaaagaacataatatcagtaaatgacactaagtatgaaattaaatagtaactattatcaatccccttacagtattcattctttgaccttgtttttttccatttgtaatagtgttagcgtccaactgtcagctcatgtccaaatgtcggctcatgaattcctctttaatagctggacttcttttagcctctggctgtgtgagggtctcttgacctcagtgatctcacatgtgccactctgtccttctagaacactattctcctcgcctttgctaaacttgccttaaaagtgatttcctcagagggaccgctaataatgatcttgtttaaactttatgcccttcctactactatcatctctctctctcggtacc

SEQ ID NO: 49178 - DNA, 1038 bp, Homo sapiens
gttttccaatctgataatttaacagtactggggtattgttttatttgcatttctgtaagaactttattttattgactacaaatattttactttccaggatctataaagcaatatagcaatataaataatattatataagcatactcaaaccttgttaacctatcaccgattattgcaatactatttttagattttttcttcaattgcaaaaatactttattactgattaaaaatagtatatatgcactgataaaattttgataaatgcaaagacaagtaatgaaaatcatcagcaataacaatggctaaaagtggagtatacatacaaacaaatacttgttttgaaactttttttggtttactcttagcatagtatctttttccatgtcatgtagtattctaatgtgtgacttttggaggctgcatagtattctaaagtaatatgttttgaatccaatattcttcaaaaaaatatggaacaacagatcttggcttaaatatgaatttttttacatttctgttgtatatactacaagtggtggattgctactttggtggttcccgatgaaccataactcctggtattcacacttctgtggtgtatccttccatattaacctcgggctcggccaataaataggacattagcaagaatgatgtaagcaaatgcttgataagtgctggcacactggagcttatgtctcttgaaatgctcactctcaggatcaaaccaccatgaaaagaaacccaagctagccacatggggaagaaaagaggaaaagatcactccctctcaaccttccccactggggaactagacatgtgaacaaagccatctgattacaacctcacaggagaccccaactgaaaccaaccaaagaacagcccagcagagccccagccaaccaaagaatcatgaacaaataaagtggttactgttttaagcagatatgttttgggttggtttgttacacagcaagagataagcaaaatgtgacagcatctaatatgaatacctgctttagatatgaaaaagaa

SEQ ID NO: 49179 - DNA, 1048 bp, Homo sapiens
aatatttacaagaatcaaattgagaagccattcttgttgagcataaaattcatccttaaatttcacctcaccagacaaatagttatgcctgcattttatcactggaatcgagaaagaaatgatgaattttttaatggcttttccataactttctggtgttttctggtctctttttcatgcctgtctaagatcaggcctttcaaaatatgtactgcttcattctggtggcagtattaactgttaggtgaactttgggagggagtggttgactggagcagtcaaaaaggatcgcatctctttttaggcatcactgagtgttattcacgcaatcaacatggcatctttttgtcggtagctttggtttttgactcatgccaatgcacagcacgttctttgctgatgaatagatttctctgcctcttatcaggagttgtctgctgtggggtagggaggatgttgagttacacacctcaaaatgattgctagtgcatacacatggaatctaacaaaagtgacgtgttttattctgggaaaggtcgagataaattggtgctagagttgtcttgtttgatcattaattggcttgctcctccagccaacttaggtcaccacatttccttctgggtaaaatgagatggctgtgcttcataatctctaggagattatatgtcacaaagtagaggcagcaaattattagcttccaagtagttctgcccaggcaatgtgttaagcagcaggaggaggaagtaagccaaatggaagtgtgtgtgtgtttgggcaacgcatctaacttgaaaggtgtatagataatagactcttcagtcagaaccaagcataagagaataggatttgtgactaagtaggccatcaacagagaacatttattaaggacttttttgtagaggagtgagggtgaactcaaaaaatgtttcagggagtttggtggaaagctatgatgcaattggaaggcgaggatgcctgagggaggagacgtggagccacctaggtgtgtaggcagaggggagggaggtcggaggcggtcccaggc

SEQ ID NO: 49180 - DNA, 1021 bp, Homo sapiens
agaagtgcccgtgtgctgttcagttcttttccagttctctggtgggaatcagctttctcattgttggctgctgctttccgcattaggtttcattgtctcttcactctgtcactcccggaccatttgctttccactttctaaattttgttgctgtcttgcatctacagttgttctttcttggtgtcctttttggatttgtaccttacgtagaccttttctgtcactgggtgggagtgaagataacacatacttgacctgccctatttagttagacctggggaagtttgtggacttctgtttattgatctataaaacatggatgatagtgtccaacttgcaggtaattttaaggtgctatatgccaggtacctagtagatattcagttaatagtggctgctaatataattacagccatagcatttattatttgagcaagcaaggcaatagcaataggtagtgcgaaaagtggacatatttcatgtgtggctgaatgaagtgcgtaagagaaaagaaagagattttcgaaatggagaaaataattagctcagttttagatatgttgaatttgaactaccatcagggtaccagatgaacatactatacaaggggttgcaaattcttgtctggctcagacatgcggatgtagactttaggaatcactggtttttatagcccagggagataccatctggaaacaggtaagggtttcagtctcgtgaaatagcttcatgaagagcttgtcaggaaagggagctgtctatgttgaagaaagctaaggggccaaggaggagagaaagcagaacctattatcagagtggttttatggacaattaggaaacattttcaagaggattactgccaggctgtttggacctgatagaagcagtaatgggtggtaagtcctggctcagacttgaaggtctcccctgtgcctctagctagatgtgtgatcctgtgtaagacactttcccagttagacctgtttccttatttgtttttaaaaaacacttgaggccaggc

SEQ ID NO: 49181 - DNA, 1027 bp, Homo sapiens
ttggattttttcctgggaaaatggagaactactttttatatgtgtatgtttttatgcaattagcattgtattcttggttcagggaaatactttcctaaagcaataatgttagatattaaagattaaaatctaatgtatttgcaatgcattgttaatttacttcttcattctcttcaaaatgatttaaccattcctgttttcattctacatactagaattactctcactagtaattactcatcatttgtgtgccattcatgcacccccacccccataaatcatgttccacagtctcaggcggagggtgggcccccagtggtacaagagttgcttcatacagtctgtaatacatccagctaaattcaagttgtctatgaatggaaagcctttccatagatagagttcagttttaagaaaaaggctaactactgaacttggagaacagacaaatgtgcatttgataactgatgtaataattacaatgtactgtgtggaagatacaaaattacaattcgattaatggactaaatatttttgttactttcttgacccttggggaaagtttcttaattgaagttaaaacattcctttataacacaagacacaagctgactttatcactctcagaagaaatactaagaaggattgtactttgtgagagggtaaacgaagacatctttattcggcaatgtatttacttagtgtcttctctattactgaacatttagtgatttgctctcaaggagattttttgttagaaaaagacttgttgcagtgatcagacttgataaagcaaattgtggtcttttgtggatgaagttcatatgctgtgtggttggtgactatctgattctatggaggctaaccaaagcctagactgagtgtggatgagaccctcaactggggagtgatggggatatcaaaggacatgctgggtgagaggagctgactgtcatgtagggagtgaaccactgcccccagcagagatacagttcggttttaagaaaaaaggcaaggccaggcgcgg

SEQ ID NO: 49182 - DNA, 1030 bp, Homo sapiens
atgacaaagctaagtgaatccttagagaaatggatgtttttgtgtctggctcacagcagtgttttcttttacaatgatgatcaatcctgaagaattaggagcaaactgaaaacgctttaagaaagtgagtggtagcaggagaaagaactaaaatcaagttatgcaacaaagtatttttatgtgtgctttgtccaacacaagggcagtggagtgcacagaaattacatacaagtagctgcatcccacaaagcagtactggtacagagatacctcaaaaacaagttttaatgagtagtgttctcataatatgagaaaataatgtcacaactccacctcatagagaatcccgtaaacaaatgcctatcttattttggtggcaaggcctgaatagttgaaaaataccatatattatgcattacaattaacttaaaacatcaattccttaaaggacattaaagccaatttttggaggttgggagaaacatagcaaacttgtcagcaatttattagaaacagaaattggaaagaactgggctcttctcgtgtcaaaactctacaggtctgggccaggtgtagtggctcatgtctgcaatcccagcactttgggaggccgagggcaggcagaccacctgaggtcaggagttcgagaccagcctgggcaacatggcgaaaccctgtctctactaaaaatacaaaaattagcctggcacagtggtgcgcacctataatcccagctacctgggaggctaatacaggagaattgcttgaacccaggaggcagaagttgcagtgagctgagatcgtgtcactgcactccagtctgggcgacagagcaagactctgtctcaaaaagaataaataaataagatccaaatggttttattttaagcatttgggatggtaatctttcttaaaatatatggtccatttccttgtctcaaaaaaaaaaaatactctatgggtctgaatggcaatatgtcctcgagctaagcttggtttttggaaccattcttgacaagcaagttgggtg

SEQ ID NO: 49183 - DNA, 1047 bp, Homo sapiens
ttgggccttctgctgattcacacagaacacacaatgaaatcagaagaaatctgatatgtacttgctaatgaatgacacattttataaaggaaatcaaggcacagctggcacttttaactctagaattggaaggccatgactatggaagaaaaggcagatcagaactcctggcatgatgacgtaagatttaaaatgctatttggggcaggggtggaggggtgggggactatagactgcaggccaaatctagccttgcccatcattttgcgaccatctaaggctgctctcacgcttcaatggcagagttaagcacctgtgacacagaccagctgtcccacaaagccaacaatatttactatctggccctttaaagaaaatgtttgcccctgttttaggggaaagataagaaaaaggtccaaacagaaaaagtggataacaaagacgagctggaatgataaaaaagctatgcaaaactagaagaactggcaataattctccaaagtgaagggaaggacagggagttgaaatttgaaccaagtaaacaatgatatcatgaattcttgctggactagatttcagagctggagtttgccaagggaagggcttcttactttcttcagtacatttaagcagcagcaaaaaaaaaaaaaaaaaaaaaaaaaagcaaaagcagcagcagaaggaaatatatgtacacatatgtataagcaagataacatgcatccccacactcacccctatatggaaagccacgaatgggcaagcagcatggcgctaagtcagcaggaagacagaaagggaactcaaagaccgactgcatgaggatgctgttaccaactacccagctgcgcaaaagatgagacagagctttctttatatacattccatgcttgacttcagctgccaattatttgattttgtaaacagctgaagaagcaagaagggctgtagcttttcattcagttctgccaaggaaaaactgacaggtgaagtggaagaactgaaaaccctgggagaaaatgacctcattgtctcgggaggggaaca

SEQ ID NO: 49184 - DNA, 1054 bp, Homo sapiens
gttaaggcaggagctgtttcacttctgtggttttttagctggctcctgcaggccatctggacgtatatatgcaggttacgggggttacaatggctgagcttcggctcagaggcctgacaatatccagaaaatgatgtgcacaaaatttggatgagggaagaaaatttggacatcggccctttgctttttggaagtaaaaattcttatctgcaattggcaaaagaataagacatatacatcaatggggacagaattaggaagtccagaaatacatccacacaaatatagtcaattgattttttttttaacaaaggtgcaaaggcaattcaatagaggaaagatagtcttttcaacaagtggtgctgtaacagttggatattcatatgcgcaaaaatgaacctagacacagatcttatttattataccttacacaaaaactaactcaaaatgaaccatagacctaaatgtaaaatgcaaaactataaaacttccagatgagaacagtagaaagtctgtgatcttgggtttcgtgatgagatgtaacaccaagagcaagatacatgaaagaaaaaagtagatcagttagactttattaaaattaaaaacatctctgtgaaagacactgttctttttgttttgtttttgagacggagtttcactctgccacccaggctggagtgcagtggcgtgacctcggctcactgcagcctctgcctcctgggttcaagtgattctcctgtctcagcctcctgagtagctggaactacaggcgcctgccaccacgcctggctaatttttttgtgttttcaatagagatggggttcaccatgttgatcaggctggtctcgatcccctgacctcaggtgatcgcctgcctcagcctcccagagtgctgggatgacaagcgtgagccactgtaccctgccaaaagacgctgttaagagaatgaaagacccagtgtcgaaacccatagagctttacgtcatcaagagtgaaccttaatgtttgcaaatttaggtcaggtgatcccaggatggtatgcagactgtgacaa

SEQ ID NO: 49185 - DNA, 1050 bp, Homo sapiens
gtcctggctatggccctgccttagactgtcttactttgtagccactttgtaagtgtaaaataagcatgtagagcctatcatctctaaggttctttccagcttgagaaatctttatatttgcatataagctattggttagccttgtaaacttcatcttcaaatctgaaagtgttaatattttgaacagttaaatgagagggcttggtaaattttgtaaatatttgttaaagtctttgtgttaaatcattgatattttaatagaattcaaatgatgatcagcaagccaattgaattcttcactgtcactgggttgattttcctgttgggtaacgaatctcattttgtaaacaaagttaattctttcaactacgagaacactctgacaagcaaatacgttgccaagtggttatgttgggaacttcatagaatcctgttaggaaagggcgcacccagttactttggcttcagttcccgtgctccagtcagttgcccccacactgcactgcccttctttgtcttggtgttattattaaggactcatgggacaattgtgcctcatgcagctgcagggaacatgccaaggcagttggaaatgggcgggctttctcctgccggggatatgtctcatgtggacgctgctgcagctgctgtgcccctctcatatcagcacccaagtaagttctttttttgaactaacagtcagcagggtcgcatactaaataccagtccgtgtgctctgtgaattatttcatgtatcactgaagtcatcttgtaggtgtaaattagtcaaaatcttgggttgggggttataggtgtcattatattgttaatgacatttctgaagtaattcccatgtgaacatgtaaagacagtgctgagaaaggacacgttggaaggaaaggcttctcatttaggcttcccaggccagttgcttaaaaagtgttttcatttactcttcagtgcctggcatagtagttggacttttccccaagactcttctgcaaaaactgttccttgggaaccttaaagtttgggaaatcacagtgaaaa

SEQ ID NO: 49186 - DNA, 1023 bp, Homo sapiens
tccagagtaaatctttcaatagacttttgtacctttggtttgaaaaataactacacacatgcccttattttgtttctgctttgcccacgtttaagctttgttgatcctataggtagatggcatttatttgttgaaaaactagtcagaaaaattcttactttatagagaactacagacgtgctagtggcacttttatgcccaatacagcccagtggattatttaatattttctttaattgctgaagagatttttgccagaaataaaacaattagcactcacagatttgatttccataccaatgtgaaatcttgactctgcacattattcaaaagtgaaaccatactgagaacaaagaaagataggatttatgtatggtaaaaaggcaagtgaatgaagctataattttatttcattactcttagtacatccacaactatttccacctaaatagatctttaaaataagcatacacaagtattgactattatctacaaatatttattgtaacacttgaatagaactacaggaagcccttggcactgatagaaaatattgattcactgttaggttacaaaaatttatacatagcaaaatttaatgctctttacataaaaaatattagactacttaaacaaaactttcaaaaattcctggtaatagctaccagaattagaaaagtaaaattaggctttagacactgcctcttctagaacactggactctgacagcacctccactgctggaaagaatagttaaatctgtcatgcaacaggaaaacaaaacactaagctattttggaacaactgttctacacagaagagagcttctcttaatttaaaaaaaaaaaaaaatcccaaataggcatttttaggcattaaccaaaaaagagaatccaaatgaaatattatacttgatgttcaattttaatagcatcttgataaaggtatgcttcctttcatttgaatacatttctgcacatgtatgttataaaatccaggaaacagccaaaccacaagttaact

SEQ ID NO: 49187 - DNA, 1045 bp, Homo sapiens
atcctggtaagcctgcattttgctcgcatcctttaagtaagcccagttagaagacagtatcatgaggaagtggatctggaagagaagggtgagcatgatggctagtgagcattgtgagaaggcaaagcgaggcgctagttagattagacagacttgactttaaaggggcgaaggttaattctgtattaataaatactcgctctactagcagagctgtcagatcctgaaagcatgctctactagttggcttcgcattaaaaggctgaagaaaagttagtatacaaacatagtgaactggaaaaaaatggccaaaggtattgttaagaaaaagcaaaaatgaaatacgagagggtgcttttttttttttttttaataccattttgagagtaattttaaagactaatgcgaaagttcgggagcacattgtatatttgaaataagtgtagtgtgtgcaaagaccattttctacctgtggataaaaatcaattcccccaaaggcctaaaagcatgaacaatgtttattttgagtaaataattaaactacatatttaacatggaaaaaattaaatgaatgtcaaaaccaaaattaagaactataagcaaagcatgcagtctctgttaacaaaacttagttgtgaaactacatttttcattttgtaaatgccattatttcatttcataaaatgtaaaaatcctcagtatcattctttacacttgatgcggcaaacacttctttcctattttcctcgtatttcctgcaaaataaatctacatctcaagttccttatagttcatactttcttctcaacatatttgagaccttcaggtccaggcctattttctcttcccgttaaaatcttacatgcagcttgagaactagctatgaggaaacagttagttattacttaccaaaacacacaatttaaggttaccaattttgtgggctctaacagaatgattgtgttgtaccaaaaaaaaaactacccacatataaatccttttttttttttttttttttttttttccagagaactgggtgaccttt

SEQ ID NO: 49188 - DNA, 1026 bp, Homo sapiens
cagcctcctgagtgcacgccattctcctgcctcaacctcccaagtagctgggactacaggcgcccaccaccaagcctggctaattttttatatttttagcagagacagggtttcactgtgttagccaggatggtctcgatctcctgacctcgtgatctgccctcctcagcctcccaaagttctggggttacaggcgtgagccaccacacccagcctaatttttatatttttatctttgtagagaggttgtctcactgtgttgcccaggctggtctcgaactcctggcctcaaatgatactcccgtgttggcctcccaaagtgctgggattacatgagtcaccatgcctggccatttttcttgaagtattttccactttcctaaaggtttttaaatgcattaaagtctactagataacaaacttaatattagattggtgcaaaagtaattgcagcatttgccattatgtttaactgcaaataccacagttacttttgcatgaacctaatagaaaaataccattttactaaagaaaccaaagtgatttttttctactaattctgaggctgcaatgtggatatttactagaatgttctcttgaaactctgacagtgatatttgtttgcaagtcattatgtgaaacaatcaaaatgtggaaatgtatccacataaataatgacctgtcaagggaaatggagtttgtccattttggtcccctgtgtcattatttagtttgtttgcttggtaggaagcaccactttatattgccagagatttttttttgaatgtttgggtacattatatcatttttaaagctcagaactactacataacattatctttacattatgagttttatttttaaacccctaaattacaactactgatcaaagcttaccactttttagaccttaatgaatcctccattcccagatggttattggaaattggtgttatttatctccatggttatgacaaagaaggtaacaaattgtgtaagtatatttaatttatgttctggcttttc

SEQ ID NO: 49189 - DNA, 1044 bp, Homo sapiens
acaagcaacaaaataaacagataacattggactgcattaaaattgaaaacttgtgccttcaaggacactaccaagtaggtgaaaagacaattctcagaatggaagaaatcatttacaaaccatacattttataagggacttattctagaatatataaagaactcttacaatgcaatgttaaaaagacaagtggctgggcatggtgactcacgcctgtaatcctagcactttgggaggccgaggtgggcagatcacctgaggtcagaagttggagaccaacctggctaacatggtaaaaccccatcttgactaaaaatagaaaattagccaagcatggtggcacacgcctgtaatcccagctacttgggaagctgaggcaggagaatcgcttgaacccaggaggcagaggttgcagtgagccaagattgcgccattgctctccaacctgggcaacaagagtgaaactctgtctcaaaaaaaaacaagtaacccaattaaacgagtgaaatatttgaatagatgtttttctaaagaagataaacaaatgggcaataagcacataaagagatgctgagcatcagtagtcattagagaaatgcaagtcaaaaccaagtgaggtgtgatttcacacctactagggtggctagaataaaaaagacataataacaggtattggcaaggatatggagacattggaagcctcatacactgctggtgagaatgttaagatggtctggccacatcagaaaacagttcggtagctaaacatagaattaccatatgacccaaaattccactccttagtatatgcccaagagaagtgacaacgtatgtctacagaaaaacttgtacacaaatgttcatggcagcattattcataataacaaaaagtggaaacagcctaaatattcatcagttgctgaatggaaaagcaaatattgcatatctataaaatggacaattattcagtcataaaagggaattaagtactgatacatgctacattatgaatgaaacttgaaaatgtgccaagtgaacaaagcc

SEQ ID NO: 49190 - DNA, 1022 bp, Homo sapiens
ttaaacaaaggttgatccacaaaccacaaattatttctgggaaccttaagtttctggaagttgcatgtaaatgtttgtaaacagtttactagcttcaacgttctggaatattctgtcctgagttaggaattactgaattaattctagctgatcagtttgcaagtgtgtgctctgctgtaaggatggaagattgagtgaggcaggaaatggtcttcctcacacctctctcatctcgttcccctcctggaaatacaaggcattgcccatgtccggatgtggcagggattctccactgcggcatgatggacattgaggatggatcattgtgtgttgtagggggttgtcctgtgccctggagggtctttagcagcattcctggcctctgcctactagttgctagtagcaccctcatgaagctataacaaccaaaactgtctgcagacattgccaaacatgctctgcgtgactgccctagagagggcagttgagagaatgggaaaggataatgtgtgtatttgtgaacagataactttgagttaatgaagagatgaaatggctaagtattatcattaaggaggaatttttcatgttttccattatttaaaaaacattggcacagagttttcaaatgttggactgcactgaggtctaggtttctcccctttagtgtttattttctttgaccccatatgcacataataaaaagactgagtaagaatggaatgcttgtaaattagtaatgctaatctagctacatccaagggcttgaaactgctctacaaatatattttcactgtaagtttattttgtttccttcaacattgactgtgttctttttcaaataaacggaccagaggcataataaatttctggttgctaggtgtggtttcctacaaacatgccacatcctactgagactggcttattctgaacactggcactttgtggtctatggtttatattggaaagtattaatagttttgctttttttttttttgacagttgaaattaaacatccaaat

SEQ ID NO: 49191 - DNA, 1064 bp, Homo sapiens
cctcagatgagccacccgcttcagcctcccaaagtgttgggattacaggtgtgagccaccaggcccggccagtgtgttttttcaattgacatatttgtatacatttaccaggtacaatgtaatcttttgatatatgtatgcattgtggaatgattatatcaagcaatgaaaatatccatcacctcacatgcttaccatttttttttttgtagcgagaaaatctactgttactcttttagtaattttgaaatgtgcaatagattattatcaactatggtcaccatgctgtgcaataaatcttgaaaacatattcttcctaactgaaactttgtaccttttgaccaacatctcccaggtgatcatttttgacttgcaaatgtcctattccatttcaatgaaagggaaagcaacactagtatcttcaaaacttgaaaagcaaagtgtctgtgcataaaaaaagaaagatccttttatccccatatttcagtattataaagtcatgttggataaatgtgctgagagaaatttgcattttattgcacacaaaagaaaactggacacaataatataggatataaaattaagtcaagagttggcctttaacaattgtttgtagcttgttatgtagttaaatcttgatgttatttggtcttgtccttatacgtgcattgacttcatgaaaatcaaatttataatcacttgtatataattcagtgtaatccatttaagacagttcacatggagggtccattggagatttggcctttcacccacattcctccactgcacaaataactcttccctgaattgttggatgtgccattttagtgatcaagggaggacccctggaacacaactaccgattgaagcagttccattttcactggggggccatcgatgcctggggttctgagcacaccgtggacagcaaatgcttcccagcagaggtatgttgagaaggtcaggaacagtgacaactgtagagaagtggggataattctgaacttttagttgtaagacattattagaatcaggtgattcctataaatgctaaatagctttct

SEQ ID NO: 49192 - DNA, 1045 bp, Homo sapiens
gagaaaccctatctctaccaaaaatacaaaattagccgggcatggtggcgcatgcctgtaatcccagctacttgggaggttgaggcaggagaattgcttgaacctgggaggcagaggttgcagtgtgcactccagcctgggcaacaagagcaagactccatctcaaataaataaataaataaataaataaaaataaagtagtgacttagtagtttgaaaagttcccccatcacatatatgcatacttttttaaatgtctgtaattcaattttacttcctgtcccccctgcaaaaaaaaaaaaaagcgtaaaatccaatcagtcctactttgtttaaattccacttccccttctacttttagttattctatatggaaataatgtactgaattgctttaaaattgcataaatatgtgtatatatgtgtgtgtgtgtgtatatatatatgtatatatataaacttctcctctacagaatacctttagccttaagtttataatctacggcacacagatggaacagaatgtacctgaatatattaaattttcttccctcagagatgaaaggaggaaggaagtttaaactatgaggaatttttttcttaactgagcatagtacaatcttattaacgattctcttccttgtcattcagcacatcttgtaatactaaacagtcttttctggtgtttttcttctcatgaatttctaatattactaagttctttaatgtaaagtgtattaattgtgtaaacgcttagaaaagtctacctctttacaatgtttcctatcatgaaaaaacgtttagtggttcaaataagtaatacgttgaaaaatggcagtgttggtggtaaagtttatataaaaaatcttcaagattccttctcatttgaaggaactatgaatctcatctctatgacatttgagttaccttctagactagatggagtattactcggcactaaaatttaaatgtcataccctttcataagcccctatgtctttaattgtttaattgtgtcctttatggagatgccctcccccaccca

SEQ ID NO: 49193 - DNA, 1021 bp, Homo sapiens
ggctgaggcaggagaattgcttgaacccagggggcagaggttgcagtgagctgagattgcaccactgcattatagcctgggcgacagagcaagactccatctcaaaacaaaaataaaattaaaaaaaaagagtgggcgcattggctcacccctgtaatcccagcactttgggaagccgaggcaggtggatcacgaggtcaggagtttgagaccagcctggccaagatagtgaaaccccatctctactaaaaatacaaaaattagccaggcgcagtggcgggtgcctataatcccagctactcgggagactgaggcaggagaattgcttgaatccaggaggtggaggttgcagtgagccgagattgcaccactgcactctagcctgggtgacaacccgtctcaaaaaaaaaaaaaaattgttatctattaatcgcattttgtggaataccctgtgtttttttctttttttatcaaaggacaagaggaatttccttcgtgaccctccggctggcgtgcaatttaatttcgactttgatcagatgtaccccgtggccctggtcatgctccaggaggatgagctgctaagcaagatgagatttgccctcgttcctaaactgtaagcagagtgttctccagcgtttcctcatggcctccattatgtgctcagtatcagcacataatgatggaaggggccaaaagggtctctatctgttcataaaagcaggccccgcagccctttggcagctcccctggtcagggcactctggaatcaaaaccaaggtctgacttggcaggaaatacagggtagaggtgaaatgtgcttttctatcccagttacaaggtagaacacatttccctacagaaaccacaaacatgctgcatcaccctgaatcacattctggtctctgaggctcatcgggatcttttttccaagctgactgcattttccattcaggctctgccctccagtggcagtgttcctgctctctttgctaaggcttttcctccaacagctcttctg

SEQ ID NO: 49194 - DNA, 1040 bp, Homo sapiens
tgtcgtttatgtggcagactctccttacctgtcccttcgcattagcagtgccatactgaaagggtacatggccgctgaatgtggggacaagccttttggcctggagaggctcagtagctgtgggaaggtagcttatccccagaggactcctcggcctcctgcctggctgcaggcaggacaatgggaagagccagttgataggcagactatcccttgacccctgtggcttgaccttgatgtcacacccccagtctcaactgtgccaccggtccctgagtgtagagcagcttggctcccctccccacatgggcagagcagggcagggcaagatgggaggcccaggggctctctgggcttccacccttgctgcagacaactcagtacagttttctctggtcaacgaagtagactactgtttgcctaggccgggtgcagttgctcatgcctgtaattccaggactttgggaggccaaggcaggcagattgtctgagaccagcctgggcaaatagtgaaaccctgtttctacttaaaaaaaaaaaatacaaaaaattagagcctggtgtggtggcacatgcctgtaatctcagctactcgggaggctgaggcaggagaattgcttgaacccggcagacagaggttgcagtgcaccaagatcgtaccatttgcactccaacctgggcgacagagtgagactctgtctccaaaaaaaaaaaaaaaagattactgtctgcccttgacatttccacttgacagctttccacttgactgcccttgacagcgtccactgtcctctcctctctcattctctttgtccttgtgtttttatgtatgtaattccttttctgttactttcctggcatcttcagagggagcacagatgaacacatgtttgttttgctatgcttacccagccacatagcggttttaacaaatatttgctagccttttggttcacacagcagcacaggttttctgtctgtgaaaacaccactctggaagtgttcttccagactcagaataacagttatatggaatcttt

SEQ ID NO: 49195 - DNA, 1033 bp, Homo sapiens
cttgatctcggctcatcgtaaccacctccccacctcccaggttcaagcgattctcctgtctcagcctcccgagtagctgggattacagacgcatgccaccacgcctggctattttttgtatttttagtagagacagggtttcgccatgttggccaggctggtcttgaactcctgacctcaggtgatctgtccgccttggcctcccagagtgctgagattacaggccaccgcacccagcctagttaaggatattttttaaatgtaccatctaatctatttttttactacatatgctcacaaaatcataggaattgacttttttattttaaaaagtattattttttagagacaggatctctggaatgcagtggcacagtagcttactgtagccttgacctcctggactcaagtgattttcctgtctcggcctcccaagtagctcagaggcctgtgctgctacgcctgcctaatactgtttttaacttttttagagatagggtcttgctgtgttgcgcaggctggttttgaactcctggcctgaagcagtcttcctgcctcagcctctcaagttgctgaggttatagacgagagccacccacgctcctggtagaattgaattttgaagagtttgtatatataatgtgtatgtgtatgtgcttgtgtgtgtgtgtttcaagctcttccctcagaatttgaggctgtgcctgttctgagtaactgactctgagggaagggtacccaagctccggggtgcagatgccctttacacttgcagcctgcatcaacttgaagaccttttgaatcaccctgagccatatgcttggctcctgctgtggctctcaagaccagcaagaggccctgagtggctggagcctgaggcctgtggcctggggtgctcatagcaggcatgtagctgtccacagttttggttctttacaattgtggaccgccccctctcactgttgacagtaattttagattttttgaaactgtctgagaattggtatttggcaattagtgtttctaatttgtc

SEQ ID NO: 49196 - DNA, 1033 bp, Homo sapiens
tcccaagtagctgggactacaggcgcacgccaccacacctagctaatttttgtatatttagtagagacagggtttcaccatgttggccaggatggtctcaatctcttgaccttgcaatctgcctgcctcagcctcccaaagtgctgggattacaggcgtgaacctccgtgcctggccgtgaattttttttctttttaagacaaggtatctctctgttgcccaggctggaatacagtggtgtgatcatggctcactgcagcctcaacctcccaggctcaagcaattctacctcagcctccctatgaatagctgggattacaggcacatgccaccatacccagctaattttttatttcttgtagagtcagggtctcactctgttgcccaagctggtgtcaaagtcctgagctcaagtgatcctcctgcctcagcctcccaaaatgctgggattacaggtgtgagccactaccgtgcccagcctggatttctttaccaaaggacttgacttctcagaacctttagtcgtcatctgtattgtgactcttccccagagggtgacacagactatttctgcagtgtgcctctatgaccgcacctctcatatcaagagggagagactatggaaaacaaagcagtccacatgtttgtttttattaatcaagacagcaaacagtgcccatgatctaccataggtacctagaatacctaagtctcattttgggcatttcacatagctcagacttaaaagtgaattcaggccaggcgcggtggctcacacctgtaatcccagcactttgggaagctgaggcaggtggatcacttgaggtcaggagttcgagaccatcctggctaacacagtgaaactccgtctctactaaaaatacaaaaattagccgggtggtggcgtgtgcctgtaatcccagctactcgggaggctgaggcagaatcacttgaacacaggaggcggaggttacagtgagccgagattgtgccactgcactccagcctgggtgacagagggagactccatctc

SEQ ID NO: 49197 - DNA, 1074 bp, Homo sapiens
attatgtatttgaacactcttaactcctgtatgaaattacgaaataatatttttctaatgcaattcataaacttcaaatgggagaacaaaggtccagtttacgtctgagcagagtgttaagaattagctttttggggcctgtttctaaggtcaggtattttcatgtttctgcatgacagtgttactacttctcaattacctctctttctttctctccctctctttgtattctaaaagaaagatccagtgcttgcaggactgaaaaagaagctgtggaccaatgtcctgtaagggattcaacaccatcactttggacacttcacttattccctaagggtggagtgccaatctcagtgtttgatttcgtaggttccccaggggaggaggactctgataaaaagccactgcaattgaggatataagttcccttttatgacactgggataaggacaaaaagtcgttgaattaggaactgaggtttaatcaactagcatttaaaataaccaagataggaggtaatgaccctttgaggtgcagagctctggttaacagctggataggaatagtcatgtgtgtgtctactcatttttgtttatgtacctcatactccattcttctttgcttatgctcttctgagcatctttttctttttgatttctaactgacagtgacggcattcaaatacatggtaaaatattaatctttgaattttcatttaacaaattgggtgaattatcttgtgtttgcaagaatcatttttaagccagctatggtggcatgcacctgtagtaccacctagtcaggagactgaagcaggaggctagcctgggccgcagagtgagaccctgtctcttaaaaaaacaaacaaacttgttgtgttttttttttttttttttgagtcagagtcttgctctgttacccaggctgcagtgcagtgatgcaatcttggctcactgcatcttccacctcgtgggttccagcgattctcgtgcctcagcctcctgagtagctgggattacagatgtgtgctaccacgcccagctaatttttatatttttagtagaaacagggttt

SEQ ID NO: 49198 - DNA, 1116 bp, Homo sapiens
ggcctcccaaagtgctggaattacaggcatgagccaccgcgccctgcctggaaggtgttttatgttattttgtgtgttatttatattggtcttgcctagagaagttttgtttaggaaggtatatatcaaatccaaatgacataaaactgcttttgtgggattcttcacaagattcactataatgggcttctattaaatagatatgctgtcacagttttacacttctcagagttatgtttcaaaggaaagaaatttggagacctcaaatttcatttgtgtttcatgcactgtgttagtcacttaaggtgtgaatgcattctaatatctccttaactctgcaaggtaggtggtatccccaggtatatagataaggcatctgagtcttagtcagaaacaaacttgcttgaataatagagcccacagttggtgacgtttgctagggttagtgtatagttgtgtaattgatagtatgacagatgtcttctaatgcccaggaagtttctgcttacctcgttaagttttaacttaatacctcaagaaatctgtttgcctgttcctcctcttcctgctgccctccccctaattcctcttgtttggttctaatgtgattatgaataacttttagttaatataacgggtgtgtcagtatttataaagtatgggccaggcatggtggctcatgcttgtaatcccagtgctttgggaggccgagacgggaggactgcttgaggccaggattttgagacccgcttgggcaacacagggagaccccgtctctatgaagaataaaaaacttagctaggcacattggtatgtgcctgtagttccagctacttgggaggctgaggtggaaggatcacttgagtccaggaggtcaaggttgcagtgagccacgattgggccactgctctagcctgggcaagagagtgagatcctgtctctaaaaaataataataataataaaaataaaaagtataggccaggcacagtggctcatgcctgtaatcccagcactttggaaggccgaggcaggtggatcacctgaggtcaggagttcaagaccagcctggtcaacatggtaaaaccccatctctactaaaaatacaaaaattagct

SEQ ID NO: 49199 - DNA, 1035 bp, Homo sapiens
ggctcaggtgatcgtcctgcctctgcctcccgattagttgggactatacgtgttcaccaccacacctggcaaatttttgtttagaggcggagtgttgctgtattgcccaggctggtttggaactgctggactcaaacaatctgcccacctcagcctcccaaagtgctggaattacaggcgtaagccaccgagccaggcctggagaggaggaaacttttttttttttttttttttgagatggagtctcactctgtcgcccaggctggagtgcaattgcgttatctcagctccctgcaacctctgcctcccgggtttaagcgattctcctgtctcagcctcctgggtagctgggattacaggcgtgtgctaacacatctggccaagaggagatacttctgaaaaatgcttatttcttagtgtatttcctgtggagcagttcttggcttcagcaacctcagacctgatacggtttggatcttgttccctccaaatctcatgttatattgtaatcccagtgatggaggtggggcctggtgggaggtggggcctggtgggaggtgattggatcataggggccctcatggcttggtgccaaccatccccctgatagttctagcgagatctggtttttaaaaatgtgtgatgcccctgaccccttagctctcttgcttctgctctcgctgtgtggcacgcctgctcctgttttgccttccgtcatgaataagagctccctgggcctcgccagaagcgatgccagcgccatgcttcctgtacagccaacagaaccgtgagccagttaagcctcttttcttataaattacccagtctcgggcattctttttttgtttgttttttgagacagagtctcactctgtctcccaggctggagtgcagtggtgtgatctcagctcactgcaacctccacctcccgggttcatgcaattctcctgcctcagcctcctgagtagctgagattacagggacatgccaccacacctggctaatttttgtatttttagtagagatggggtttta

SEQ ID NO: 49200 - DNA, 1028 bp, Homo sapiens
cagcctgggtgacagagtgagactccatctcaaaagaaaaaataggcagactcaaaaggccacatattgtatagctccatttatatgaagtgtgtctagaatagccaaatccatagaggcagcaactagattagtggcctggtgctgaaggttatagaagcattaagggttgatagctaaggagaactgggtttcattttcaggttatgaaagtgttgcaaagttgactgtggtaatgtttgcacaactttgtgaatgcagtaaaattagtgaactgtacactttaagttagggaattgtatggtatgtgaattatatcacaataaaggtgttacaaaataaatcgctaatggaactgaaaaactacaaatgaaccaatctcattcctcaagtagcctcagggttaggacaggcctcagggttttcttggtgaaaattatttatgcttccccttttttctacgaatttcatgctcactgtatttttgatacggcttgacaccatattttctgggattgtgtgggttttattatcattaagtgtctgagaaattctgtgttagagataagcagtcttctattctcgtttgtttgtttttgttgttgttgttgagatggagtcttgctctgtcgcccaggctggagtgcaatggcgtgatctaggctcacggcaacctccgcctcccaggttcaagcaattctcctgcctcagcctcccgagtagctgggattacaggaatgcaccaccacgcccagttaaatttgtatttttagtagagacgggacttcaccatgttgatcaggctggtctcaaactcctgacctcaggtgatccgcctgcctcagcctcccaaagtgctgggattacaggcgtgagccaccgcgaccggcctgtagtgccattcttatacctaatggttttcagggaatagatttgaaactattattattttttttgagacggagtctcgctctgtcacccaggctggagtacagtggtgcgatctcagctcactgcaacctccgctt

SEQ ID NO: 49201 - DNA, 1566 bp, Homo sapiens
cgaggtcaggagatcgagaccatcctggctaacacggtgaaaccctgtctctactaaaaatacaaaaaaaaaattagcctggcatggtggcaggcgcctgtagtcccagctactcgggaggctgaggcaggagaatggcatgaacccgggaggcagagcttgcagtgagccgagatcgtgccactgcactccagcctgggcaacggagcgagactccatctcaaaaaaataaaaaataaaaaaactgaattctgttagtttattgcctcaagaatgacagttacaggccaggcatagtggctcacgcctgtaatcccagcactttgggaggccgaggtgggtggatcacgaggtcaggagatcaagaccatcctggctaacacggtgaaaccccgtctttactaaaaatacaaaaaaaaattagccgggtgtggtggcgggtgcatgtagtcccagctactcgggaggctgaggcaggagaatggcgtgaacccgggaggcggagcttgcagtgaactgagattgcgccactgcactccagcctggacgacagagtgagactctgactcaaaaaaaaaaaaaatgacagttactttcccttagtttatgaagtggtccaggtatacctcagttagctggcattcagcagcttggcacctttcactatttgtagcaacaggacgccctgtgcatcagtgaaaatgtcccagagcagtcacaaatgcaaagatggccgaaaacacagcgtggttggattgatggcttcaggaaaggaatgcttccattggctgtggaagccagtcccccttggtgcctttcacatggggagaatcatgcaagaaatggcggaaaaagaagaaagacaagaacagaaaagggaaaagaaaaaatggagaaaagagtaaaaaccagaaaaagcagtgtcgaaggttagctacccaacccagtgatgtgacaatgacagacagccatgaattggttagaagagagaacaaacagtgatctggggtggttgttctcagactcacaccgatcattgaacttgtggttaaaatgcacattctgattcactaggccttggttggggcctgaggatctgcattttaacaaatgcccgggcaacagtgatgatgctgccagaccttggatcacacttgaagtagcaggggtctagggtgtttttgtttgtgacttttggttttattgttttgattgtggataaggttattgctaagcaccagcagtaatgactgtgttcatttcaggatgtgacacattgaagacttgcctagtgagtaatctctcttttatacagatttgtgccaaaaatttgaaagacaaaatgtgtattgtttccagaaaatgttctaaagcttgatttcttgaagcaacacatatttcacttaaaaggtagatataggccgggcgtataatcccagcactttgggaggctgaggcaggcggatcacctgaggtcgggagttcgagaccagccttaccaacatggagaaaccccgtctctactaaaaatacaaaatttgctgggcgtggtggcgcatacctgta

SEQ ID NO: 49202 - DNA, 1058 bp, Homo sapiens
ccctgtagcatctgcacttcaggaggctgaagcaggattgcttacaatcaggagttcaagaccagcctgggcaacgtcgcaagaccctgtacacacacacacacgcacacacgcctgtagtctcagctacttgggaggctgaagtggtaggattgcttgagcccaggaattggaggctgcagtgagttcgtgccacatggcaacccagcctgggcgacagtgcaagatgctatctccaaaaaaaaaaaaaagttatccttttgaggaaaaagtaaaattagatccttacacaccagaggcaacaatcaattccaaatagattaaaggcttaaatgtcaaaaattaagctttgaaatttgtagatattattttgatttatcaatagataaatatttttcaaaccttgagtttaggaaatatttcttatagcacaaaaagcactgtcagaggaaagattgtacaaatttgctttattgaaattaagaactttgttttcgtcaaaagatgccctgaaaaaaagtgagaagatggccaagcgcggtggctcacacctgtaatcccagcactttgggagcctgaggcaggcggatcacgaggtcaggaattcaagaccagcctgtccaatatggtgaaagcccgtctctactaaaaaaataaaaaaaaaaaaattagccgggcatggtgtttgcgcgcctgtagttccagctactcaggaggttgaggcaggagaatcgcttgaactggggaggcggaagttgcagtgagccaagatcgcaccactgcattccagcctgggcagcagagtgagacttcatctcagaaaaaaaaaaaaagtgagacgacattacaaactggggagaacatatttccaacaaatataaccagcaggcgatttagtatcaagaatatctaaagaacactaatgtgaaaaggacaaatagccctatggaaagctggatgagagacatgaaagggacatttcatagaagtggaaaaacaaagatacgaagataccttaacataaaggtccataaacattcaaagagatgttccacctg

SEQ ID NO: 49203 - DNA, 1039 bp, Homo sapiens
tctcttgagagcagtctgtggtgctctcaatacatagttagaccaccttacttcaccaaccagcattttcccctctcatgtagggtattgtaactggaagagttccgtttctccagctgggaagggattgttctgttgactttattatacatcagtaaccacttaacagttttgtttggaaatactaatgaacttttaccaaatgtctaaagtgtgccaggcaccaagcaccttacctagtgccaccatcgcatttactgttacagctctgcaaggtaggtggaggtatccccctgtacagaggagggcactgcgctccagcgtggagaggaattagcccagggccacacactggccaggatttgacctgggccattcctaccatcataccatgctgcctccagctaaggaatttgggaaaatatggggagggaaaaaaggaactgtgtgcatgatgtatggtttagtactttgctcttcttatccttctttgtcttggtgcactctgagccttattttcagtgtggggcagaaataggaaataccaagctggtgagggggacagcccatgtctgacagggtgggggaacaggcaacagtcaaagggccacgcttctgcccatgtgggatggtttgcaaggtggtgtcaaattgccgcttctctcagcggagtatacagggacagagagagagctggtgttcttagctgcagtggtagtagcagaacagcagggtgagcagggtgctgtaactgctgtgatgtttcctccccactgtgttcctttctttggtgagtgatggaagaaactctccttttcccatagcacattgataaggtgttcaaacataaggaactgcaacagcagctcgtggatgccaaactgcagcaaacgacacaactgataaaagaagctgatgaaaaacatcagagagagagagagtttgtaagttctacttcttaaaaacaaagacattattgccaacattgtaactgaggccatttgaaacatcaaattgtaaccaaggccgtttgaaacat

SEQ ID NO: 49204 - DNA, 1667 bp, Homo sapiens
aagtttcggcagaatatgtatataaagatgtcacttgtggacaaaatagtacatagaggcaaatcactagacaaataagcttagtgtttacgtgactgaacagtcatcctgctttggtttcaggtgtgggatttggaccatgaggggctcccgtagaggatggcggtttgtgtttgattctgatttgggatttcagtacatattctccacttcccatagaaggccacttattctttgaaaactggtgttcatgtttgccgttcaatgaagtcccttgtcaaagacaaggacggtcaattcacgtgtcactttcactaggcagaagtttctccaataccttctggctacttgaaagttactacaaaaattccaccagcaaagtactccaggtttttcaaaagggaattttcattatggatcagtaccaaccgaaattgattttcatttccaaaacaaacactggcaccaacatttttactttgggaagacttggcagagtgttagtcatgatctgttacttacgtgttcagtctgttttctcacccccttcttagttaccatctcttttttaagaagaaaaaagaaaagccacagtattatcaaggtctctacacttggactgggggaaaatttgaaattaagcacataacttttgaattagttctttgtttcaatgttgaatgtggcgcagttatgcagatgattaatcaggctgcactgatggaagttttgactttgtccctggtataatttgcattgaaatgctttatgaaataaaaggttctactagaactgatgttagcacattccactgagcaaaactatcagactgacacttgttaaattgcttactggactgaataaactctgttttgtccagttaaaagggttttctctttgttacaagtgttatttgtaaagtcctgtcacattcatggtcgaaactgggttgaaagaattgaaaattgtccaacagatagatagataggaaaccgcctggagtggaggagggttgtatctaagcctccactatcagtcatgttaattcaaggggccacagtggaggaaaataaatccacaaagtagattatctaattaccatcaaaatgagtcagaagcaaaaaacaccaccctccaacagcctcttaggagtacaccctgttctgctactaaaatactagactcatttccctggtggtgggggggaatgcaggtatagatcagaaatataatccaccttaaaattagtactaatgatcacattatttcacaagaactctgctggatgtacagctcttaacattttattaagccatttgtgtagcccaccacgtttctttgtggtgcttgtcctgtgtggaagattgtaaatcttgggcctgttgcatacttccaagggctttaaagcaatgtgattaacagtacttggcctgctgcttttggcttactttgtatttttagctagatgctattatagtgttgaaaggatatggattctgtctgggatgcatttgttgtcctttcagaacccttcctcccattaccctgtgaataaaaacaaatgggaccccctgagaaggacatcttcctacagtgatcacctcaccagcccagtgttgtggctttgtagcgcaccccgtatctaccatattctagaacactgtaat

SEQ ID NO: 49205 - DNA, 1060 bp, Homo sapiens
cctccagccccgccccccatatcccctccttctgccaactttatcacttaagacagactgcctgggtcaccctgtttatgacaatagaagaataaggaaaggtaaagaaaagaggggaaaataatgtgagatgaagcaagatgtggacttgagttgaaagggaaagataaaatgaagcccttgtttaataaaatgagactcaggattgtgaaaagcagtgattgaagctaaggtgctgatacagagtggcttaaagtggagtgatagtgtggaaaggaaataggatggagagaagatgcaaagaaaaatgaaaggaaaatgaagggaaagatgggatggttgttacataggagtgatgatgtttatccaaaggaataagcaggaaatagaataaaaaattgtagaaccaatggaaggagagtccacagactcttggtgtaggattcaagcagcatttaaaggaatagcttagaagtaggtggcattaatgcctttacatttatgaaaataggtaacatgatatggggaaaaagaacaaagggctgatttagaatgtaaatctataaaaatgaataaggccaactttggaaatatagaacagttggcttcaactttggtgtctgtaaagagagtgtgaatgtgtgatttatagtagcctagatgattccagggctctctaggtactggcatcagacccgaggcatgtgttttcataaggagaagcggatacactatgatcgctgtgtgtaacagggagatcaccatttgtaatagctgacccagttcttggagccattgcctcacagtcccacacagctgctgtgtttgagagatagcaaaaatgtgcaagaaagtctaagtcagtgacaatgcaagtatgcaaaacctagaggcagtcagacctggaatttgctcagtgatgtttggattttatgtctctatatttatagctatgaaacatcttttattactgagattcctgtaagaaaaatcacactaagctggtacctaacctccttttcctcaatgaaacagttattttcatgaggtaatttttttt

SEQ ID NO: 49206 - DNA, 1624 bp, Homo sapiens
gtagccactttggtggatgtgtaatgaaatctcatactggttttgatttgcatttctctaatggcttgtgagactgaacaccattttatataatttttaactacctagatattctcctttgtggattacttgttcaagatgtttgctcatttttatttctcttttctctctcttttttaacttttattttaggttcaggggtacatgtgcgggcttgatatataggtaaatcatgtgtcgtggtggtttggtatacaaattatttcatcgcccaggtaattgctcatttttcagtaaggttctttgcaccttttcttactgtcttacagatgtcttttatgtattttgaatatgagtcatttgtcagctgtatgtatttccaataccttctcttactctgtggcttgccttttcaatctcttagtgttatattttgagggcagaagttcttatttttgtatagtccagtttatcaatccttttctttatggttagtgtgtttttgtgttctcttctgtttgttcttaaacaaattcttcaccaacctcgaggtcatgaagatatctcaaaagttctagaaatttttcattttgcctttgtcatttagatccatgtttcatatggaattgatatttgcaaatggtgtgaggtagggctcaagattacttttttcccaaatatggatgcacaattggcctactgccacttattgaaaagaccatcatttccccattgtactgcagtgacacttttgttacctcccccacctatgacttttctagaactctgtgctaacctttatcttagcttttctcattctgtacagtagacattgttggtgccctgtctatattccatctctcatgctgaaggctacttactgcaaactcctgtaactctgcctggaacttttgttttgtactggcttatggaccatgcttggccttgcttgttgggaaggccagaggtgccagcaggttaatgcctcagaagcagcactcaaccaaatatggacagggagttggtggatgaatgcaccagtgccattactccttggataggagaactctgcagcattttctccaccatttctcagaattctcaagtaggactgagctccagttacccacagtgatgacttatttgatgacacatcctatctttgctgtcttcctttctccatctcacttcttcactcacctatgggtgtttctggagtcacctcccacataaactacttgcactcaaacctgtacttgcagtcatagggtctacttatgggggaactgcaaccaagacaatctatttaatctttaaactgtgaaggcaaagacctagggctgggggtatggtagagatgaagtttctcactctttttccttaaactatttagcccaggattattatattagccacacgcccagcccctcccagaacactctatagtgtgtgtattagtctgttctctcactgctataaaaaaactacctgagactgggtaatttataaagaaaagaggtttaattgactcacagttttgcaggctgtacaggagccatggccaggaaggcctaaggaaacttacaatcatggcaaaaggaaaagggaaagcaagcacatcttc

SEQ ID NO: 49207 - DNA, 1031 bp, Homo sapiens
cgtgtccctcctcttacattggggattataattcaacatgagatatgggtggggatacagagccaaaccatatcagtgggtctggaaatagctgttactaccattagtggatgcacagtttgaatccctgtcttggcatgggagagcttcagtgcttcagcagtgagaagggtaacaaaaggaactcaaatctatgataatgaagacataccccctaaatttctccatgttctattgacaagcctttgagagtgttgtttattgccctttggaatgcataagtgacagccccaggagatccaaactacctatttgagaaggataattttcagccagagcagacacagaaactgctaacctctgaaaggaaccaggaggtaatacattgggtgaattgatcattttgggttggtgtggcaacactgatcatgggctcattctggttttggaaggatggtcctgcttttccttccctttctgttcagtctaccacttgtaaaaaaccttcacagtttggttagtgtgttctcttggatgtttctgtaattgtggttaagtttcttttcctcctggccctgctcagtgagcttctgtgaggcattatgagatcctaacagcttcattgaaagctgctttgaaacccatcacagaagagctgagaagaacacaatctttcaagggtttaataattcatggttgtaatttcctcataaccagtaacagcatcacatttctttctagacttttcttgttatactggattgggcttttaaatcaaaactcctgaattactttatctaagaaatccttgagattctgttggactgatattactaagatgataatgataaagatttctttcttcctgtgtgtggaggccttttctacacaatgccatcaggacagtgtaaagtccacataaactctcagaaacgtcttcagtctcagcacttctagtctagttttaatgggcattacttttaaaaggcaatgacatgtaaaaatctctcctattgtcccatgttagtccc

SEQ ID NO: 49208 - DNA, 1033 bp, Homo sapiens
tgtcccaggccaggcgtagtggctcatgcctctaatcccagcactttgggaggctgaagcaggtggatcacttgaggtcaggagttcaagaccagcctgaccaacatggtgaaaacccgtctctactaaaaaatacaaaaattagctgggcgtggtggcatgcgcctgtaatcccggctacttgggaggctgagacaggagaatcactttgaacccaggaggcggaggttgcagtgagccgagattgcaccattgcacgccagcctgggcagcaagagcaaaactctgtctcaaaaaaaaaaaaaaaaaaaaagaaaaagaaaaaaaagaatgtccctaatgtggtccttgttttaaccattgcatgacactgttggtgtaaaaatgctcttatggcccagcaaactcccttcctttatagtggcagtttttaacatgaggttttctttattccatgtgtgcagttggtgttttgaacttaaatttcacaagagtctcccattgtctctgttaaactgaatcttgcttgctttgctctttcatttccaatcagtggtgatggtttaaaatcttgattcaatgtgtcagctactgctcacagtattttgctctctgcatacaccatgaacaagattctatgctgtcacccacatcttcgataaaattattgttcagacggattcaaggccagagcccactggcaggcagtactagcaatgtttctccaagttgagatctattaatcaacattctttgggtatcattgttgcagcagccacaggtgcactcccctaccttcctgttcaaatcacatttctccaccttactcacaatatctatcatcacgagcaactgttaagtggtttgctgaaatcaagataccatatgtctgtagcattcttttgatctcccggtgtaattaccctactcaaaagggaaatgaggttaatctggctcaaactggactcaattccagcaatcagaggggccattttaattttcttatatataatgggtaaggagtttatttggg

SEQ ID NO: 49209 - DNA, 1035 bp, Homo sapiens
ctgtaggtgacagctaagaccatggcctacactttgttttccttcaaccccctaacttcttcctatggccaaccccacccccagtttttggaagatcgctgattttttgtcttagatgactgagtgttatcaacaggattctaaatgtgttgaggcagatacgaaacaaattcacacataccaccccgacatttcgtgtgtgactgccttctgctagtacaatgtcacgttatttcacaagcccctcaaaattctgtgatggaaatattataatattcttttgatagatgaggaaatgaaggctccactagtggctttaagaccacagtgttaaaaaattgtctggtcttggattcaaatgtggttcttgcatcttcagtttgggcacctcctctgctctaccctgcttctctctgtcagcctactactcttcctcccatcaccaccaccttatggccactgaggtgacattctccctcccagtttatgatggagaaacagaggcaaagaaaaaaaaaaaagacatgaggacaatatccaggtgcaactttgaatactcaaaagggctgggattagaacatctaagcaaaaaggctcatgaatcaagaggtacttctggtgcagccagagcaggcatacaactgggttataagttaacacgtgtatttgggtgaggctgtggctgtatgtctggttctaattagttgcttagttttcccccaaaataaataggaacatgctgattgtctaaaataagtcattcactatagcaggagtcattttatatatcaaggcctttactatctaaagccaaaacattcacctcatggacacacaagtttcttttctagctcagtggtcacccttttgtattctctaaggttgcttgaaggctggtgtaaatgaactgtgggggaccccaattcaggaacgaatcaacccaaattataatagattgccatttttttcatttattcagataggccaagatgaaaaaatgataatggtcaagtttggggtgggcataagggtaat

SEQ ID NO: 49210 - DNA, 1102 bp, Homo sapiens
ccatgctctctctgaaggttttatgaaagaatccttccttgcctgtctcttgtcttctggtggttgccagaaattcttggtgttccttggctttcagacatatgattacattctgtctccatctttgcatggtgctgtcttctcagtgtgtctttacatggccttattataaggataacagtcattggagctagggctcaccctaatccagtgtgtccttatcttaaattgattacatctgcaaagaccctattaccaagtgaggtcatattcacaagtactggggattggactttaacatatcatttcaaggtgcacaattcaacccataacaggcttgtatccagaatacataaagaaagtatataactcaacaataaaaagacaacctaattttttaagtgggcaaaagatttgaatagatattactccaaagaagacataaaaatggccataagcacatgaaaagatgctcaacatcactagtcaccaaggcaatgcaaatcaaaaccacaacgagataccacatcatcatacccattgggaaggataaaataaaaaaggcagacaatagtaagtgttggtgagaatctgaagaaattggaaccgttatacattgctggggaacagtttggcagttcctcaagatgttaaatgtagagttaccatatgactcaacaaattcactcctaaatatatatacaagagatctgaaaacatattctcacacaaaaacatgtacattgctgatcatagcagcactattcatagtaggcaaaatgttgaaatagtacagatgtccatcaaccaatgaatggataaagaaaatgtgggatatccatgcaataaaacattgtcaataaaaaggtgactaaaggcaataaagattattgatacatgctacaacatggatgacctttgaaaacatgctaagtgaaagaacacatttgcatgatcttaatgatatgaaatatccagaacagataaatttatagacagagagtagattagtggttgtctagggctgggaagaagggaatgggaagtgactgctaatgagtatggagtttcttttaggggtgatgaaaatattctaaaatta

SEQ ID NO: 49211 - DNA, 1086 bp, Homo sapiens
gttttcctttttcaccctcccttctcatccctataaaccatattttgaagcccttctccaattgcttgattttcctaatagtaataaaaagcctagacagtttggatggcatctgtaccacctcttttagggattataacccaatttttctccaacagtgaacttatgggtcttttatgatctggctttaggtctcttgaatgaggctgacatgaggatgtaaggcttgaatcataagattttaggaaaggctctgaaaagcaagctctttctgaggagtgttgattttttttgggggaagattattttgccagtgttcaggtaagaattcacatttgcttctgttactagtcatgatagctgaatggtgtgcttcattcagatactgtgtagtgatcacttactttgaattgcatattaagacatgtgaccatataaccttttatttgaaccaagcaatttacatggtggagctgaagattggttgttactggttcatttttagtgagcactgactgtttctaagactctatcttggtcagactctctcttgaggtctcccagggtaagtcagccagactgagagtgacccaagaagatggggcaacattctgaagaaaatagaaaatagtgctgtcatgtggtgaagaggccagggagcatttgtttccccatgcccctacccaccccgttatttattgattctgctcataacgtaacagtatatgtatttttgttgttgttgttgttgttggagacagggtctcactgtcacccaggctggagtacagtgatgtgatctcctctcactgcaacctccacctcctggactcagtcctcctacctcagcctctctagtagctgggaatacaggcatgtgccaccatacctggctaatttttgtattttttgtagagatggggttttgccatgttgcccaggctggacttgaactcctgggctcaagcgactctcccacctcggcctcccaaagttctggggttacaggcatgagccactgtacctgcctgaacagtatatgcacctctataaagaatgatcagatgatcaatattaatgtattgc

SEQ ID NO: 49212 - DNA, 1050 bp, Homo sapiens
ttttaaattactattccatggggattctcctaagcttgtcaattacagacaggtgctcttgttttggagccagagcagcagttgtaaaaaggtgaaactggaaggtcaggataagctgggttatgccatgacaataaacatctcccaaatctcaatggctcatataacaaatgtttctttctcccctacgctacatgtctaaggggtgtcaccaggggtgctctgttagttgtaattgttcttggatctggactgatggaggcttcattctgacacgtgtcacaaaggagaatatagtaaattgtatactggctccaaagttttcacctagaagtgccacataccacttttgctcatccttcattggctaaagcaagtcacatggccacatccaacctcaaagaagtaggtgaaacaatcttactaagaaggaggagagctaaagctttcctttggcaaatggcactgattaatactataatggggtaataatgaggcctaggtaaacagggtaggacttgagcaaaacttgtggcacaaatgagaaattttatgtacttaatgcttttttagaaaaatgctgcttccaaaacagctctaacatccaggatttcttgcctagccagtatttctgtgcctagagtgagattcagagaatgaaacccttttttactgagatcctgagagttgcctttcaagtgtccatagagtataaataacaatagcctcaaagaaacaattaaaggctctccgggtggcttatctcagatccactgagaaatgaaaacccccaaacatgccagaacactaaaaaaatggctgtgtctgagggtggtctccttgtcatgataaagctttctcctcatccttctgaaaatgataccaccctcatgttagcaacagtatcgctgtctggaaaggggctggctgaatctggtgggattactttgagttgcataaacacagattgaattaagcatggcgagttgatgatggggagtgtagaaagagtcaggaccttgcgttgggataataactagttcattatct

SEQ ID NO: 49213 - DNA, 1035 bp, Homo sapiens
tctccccttccctccctcatttccttatcccttttcccctctgccctcctctctccacagctttggtaagaaatagccagccttgaattcaagcataattgctcggcaggggggacttccttgaaaaaacctcaaatttttgggctgtaacagtggaaatctgtttgaacccttgaacttcctttattgttgaaatgaccacctacagaaacatgctgggggaaagtagcagaagcacagtggtcccttttatgggaaaaacagtagctggaattatttcacttttgcaagaattctgtaatgaggaggcatttctgaagggagagtatggcacaaacattccacaagttggagatgtctggactgagattgggatattgtaataatcgatgtttctgggcttagaaacagagtcttcattctttttttgaccacaagcataaaagctggtaactgtagcatttctgtctacttttgttgccatttgcatgggctcgctctgggtactggagattttcaggcacacaagctgcaatagaaaggcggctggtatttgcctcttagaaagtaaagttggcatgctatgatttgtattttccaaccaacaggctgtgtggactttttcctcggttcactcaggcaccaggatatcttccatttatggatgccctgttcactcagtgtgccagagagggcttgtgcatgggtggacatacactgataaatctgggaagtcgttgctttcagtctctctctcaccctcatcctctctccaccctaccccccaacgttttcatcttaaaccaaaaatcagagtatgccatttatctgcttaacaaatgcctataaccctcacctatacaagataaagttcaaactccttagcaaggtgtaggtctgaacccagctcacttttcccaactcatctctttacacttccctgcttcccctggactccagcacatgtgatgtgcaggtctccagatctaccatgtttatttcacttcattgcatgtgctgttgctcctgctgctt

SEQ ID NO: 49214 - DNA, 1662 bp, Homo sapiens
tttgtggatagaaccaaaaaggaatgggattattctgctgtagatattcttgtcgcagttttatcttagtgtctttatagtttaacatatatcctttccttttattaaatgcatcgtaaaatcagcaagctttgctatagactttcataaacagaattttccctttttggtatggagcctggaaatctgaaggacatggtactgcttacgggcagatcatttgtttaaactcttcaacggcctgccgtcagcaccaggaacatttttaaatcgggttctgagctgttaatctttggtttgcactaaaattctcaattgaaacatttttctttttcaagtggaccttctgaatctggacataaacttctaccgtctagtgtgtttctcagaataggaacatttaaagaaagcttttgggtgactgctatttctggattgaagtgagaacaaaaatgtagacaaaatgcacatgtagacaacatgaaaaaaataactgttgtctttaatgctgtgggaagcctgggtggtatttgccctgaattgtgtcaatttatgtaatattgcttaaacttggtctgctgcttgaagaaccatatatgtgcccatgtgtgcatatatatgatagaaagagagaatatttctagatttagtgtataaagaataatggcctagaagttctagaaagtgcgaatccattagtcatggccgtgaatcgcccacctcaaggatctgttgccaaccaactgtaaggtatgtaccatgaaaagctaaaattgtttcctgatatcactttaaaaggtaaggtatatgatagcttcttttctagaaagtcataattttgaattatcaaagtgccttgcttataaatacttttggaataagtaattctgtctttcctaatatttctagatattgggagcaaattcgtgtttaccttatgtgtatccctcatggatttttccatttccattgtattaactgtgactttcttcagcaaatctggtggttgtagatttattttaattctccgtgccatagtattctacctcagcatgcaatctgctgattccttcccctttctaaaatgagcttgcattttaatttttaaaattagtattaaccaggtaataaatattaactgagtaccgactatgaacctgactctgagaaatgtcataatgagatatttaatgacaacagtttgagaagctaaaaaataatttgccaaagcatataatttatttgctagtgctttgttcattcatccattcacccattaacctgacttccatcttcttattccctatctgctcatccgtccacccctgcacccatgcacttatccaagaatccattcattaatttattcactcatccatttattcacacactcatccacccatccacccatctatgaatccacccgtcaattcattcttccatccactcacttactgaactatccatgtacccatccacccatctattcatccactcatccattcttgcacccatctacccatctactcattcacccatccaccagtccacccatccattcagccacccatccacacttccacccattcacttgtccattcatccatccatctgtcgttcaccagacagatgctgaaggcctttgatggtcttgcacttatc

SEQ ID NO: 49215 - DNA, 1058 bp, Homo sapiens
atggattaaatacattccattctatggatatactacattttatttgtccatttattcattgatggacatttgagctgttcccacctttttgctattatgaatagtgatgctatgaatatttgtgtgcaagtctttgtgtggacatatgttctcatttcttctcttatatacctaaggagtggaatttctgggtcatatgataactccatgtttaacccttggaggaatagattatgcatttttgacttgttattgtcccatgaggtctgaagttaggaaaggtagggagaataacttcttatggggtagacatcaatggatctcagcagtgcccaggctggcagtgccatttttatgagtgtaacaagtttatcttcttcagccctttgaggcctcattttccagagactactggccctcctgggtctgtgaccctggccagaactaggattttttatttttaacctctcataagggattcctacgaaatatgacccactagagtgcttggtggactgtcaactctgtatctgtggggaacaaaatccagctgttcagcttggttagctgctgtctcatctggaactgcctttcctaggtttatttccccaaacaatggcccaagttgtaggcttgtggttgccagccccctttaatttggtccttagttgcatagtctgttatttgtgctgtgactggctgtgattgaaggggtatgctttttcctaaactcaacagtgtagtaagatgcttggtggactccaataattcatctatcccatggagaatgtgaggagtgtgtgtagtgatggtgaggggcatggcacactgaggggaaagtacctttaaaacagaatactgaatttaatatcagatcaggctgatgttaaacctctgctttccatatgagaacactttcccaggggatttaattgtaaaatgacaaaagggtcttagtgcaatttcactgacaaatggccttctggtgtggatttccatgacgcaagcagagccaactaagagcttcgtcacttatgttcctggagcacatagaacaa

SEQ ID NO: 49216 - DNA, 1030 bp, Homo sapiens
gaagggttctggaagtcttatgcatttttttttttccatccagaactgtcttgttggctttgtgtttttgcaatgttgtagcaagagcatcatttacttatgatggcttttatttcacccccagtttatactattttttttggtactaccagccagtgagcactgaaatgtgggggaaaatgagtttggaaatgcttccttcctggtgcgtgtgctgggatgcagacttgtatctgaaattttggatatgtgctatcggctggttgtggtgtagatcagagccccaaagggcacatcgagcatttcatttggccaccagattgtcttttacaacagaggaggtaaggtattttaaacaggatctgtgttaggctgggaagcccacacaagatgggaaagactcatttctcctaggtccttccccctaagtacaactagaaaccctggaaataaagcaaaaaaataaataatgctaatagtatctacttgccccaagggtaaatgctgccctaacttctgacatcatagtgttatcttgcctctttttgtgttttaggtaaatggaatcatttagtttgtgctaaatgattttttgtgtgtctggctttttccattcagtgttatgtttttgagattcacccatgttgttgtgtgtagctgcagattgttctagggaagaattttgaccaaacattgatcttggactcttggcagagttaagacttgagtaaaactgaatcttgtggcagtttttactttttctcttagtatagaagcataaaacctattaaatgaacagaattttaaaaataaagatcattgttctttaacaaacaattgctgtctttgcattttctctttcctccaaaatcgctgaggtctcgacttactcactgctaaaaaaaaaaaaggggggggggactctgtatatttttaaatgaagagtgctgtttttacctaaatcaatctggcctggtatatgacaacatttaaaaaaaaaaaaaaaacaacaactcaaagatagagccta

SEQ ID NO: 49217 - DNA, 1253 bp, Homo sapiens
gtgaaccacctcgcctggccttaatacattttttaaattgaagcataacatacacatagaaaactgtaccaaaattaacagtatagcttggtgagttttaccaacgaatattataagcaccccagaagcccttcctgtctctgtccacctgccctgcccccaggatagccactcttatgacttctaaccccatagattaattttcttgttttgaactttatataaatggaatcatacagtatgtgcccttttatacctggtctcttttgttccacattatgtttgtgagagtcaaccatgtcatggtgtatagtagtggttcattcatccatattccattccatggtgtgaatagaccacaatgtattgatccagtctgctctctatgggcatttggatattttccagtttggggctattactagcagtgcttctgtgaacattcttgggtgtgacttttggaaaacatgcgtttgtatttctgttgggtatatatccaagggaggaaattctggatcattcaagagggactattcataaatctcgttttgcttttttcctccatcttctctaagagagggtagttataggatttcaggactggaggaggccccacagaacatgtatctggctggtgtttttctgattctgcctcaatatcctctaaggagttcaggcatcttcagtgaggggagaggcgagcttgtgtggggctctggggctctgcttcaaccagagcaatgcccccttcatctgattcatagacagtggtgaaattacaaagaacatattgtttcaagaatgagttctataagtttgtttgagtctcactgtgtcacccaggctgcagtgcagtagtgccatggcgtgatctcgactctctgcagcctccgcctcttgggttcaagtgattctcgtgcctcagcctgccaagtagctgggattacaggcatgcaccaccacgcctggccaatttttgtatttttagtagagagacagggttttgccatgttggctaggctggtctcaaactccttacctcaggtgattggcccgccttggcttcccaaagtgctgggattataggccaccatgcccagccatttttgcttgtttgtttgttttttgttttttgtttttaagagtttgaaaagagatgatttgggtttattgttttcacttgagaaaggggcaagcaggcctacacagcagactggggtggattgatgtacgtggggggtgctggcatttta

SEQ ID NO: 49218 - DNA, 1074 bp, Homo sapiens
aaccgtaggaaggtgcatagctaaggaatgcttctaagacagtagaaaataaagccttatgtgaacaaggagaatctctgtgcatggaccttcagggatggggatatgtgcttgcagggccagggagggaattgatgggagctccatatctagttaaagcacttaacctctggggtgaaatcttagtccagagaacactgaatggtttcacagcaaaatgtcatctgatgaaccctgctgtataaagtagcagagaagtggtcgtaaatttgttcggggattcttgtgtctcattctgactttggtttgcaatatgataggtttgattttcctaggaagtctcctgatgccatgcccacttgtgttaagatcaaggcacttagttgtatgtgaaatgtgatcagggaatgcaccaaggattcggcatcttgggggcattatctctgatcctaaggtagatcagagaaagtcaaagggaaggagaaatgatgagggagggcaagataggtagatagatactgaaagagagagagagagagacagagagagacagagacagagagagacagagacaagagacatagctgggctgtttaggattatgaaaaagcatatctgtagtgccctgttaaagatgaaaattttaccccaaccccattcttcaggctcccaccattagatccacagtgagagaatgtgagagagacagagagatctgattcccaatattccttttggcttgaagcttctttgattctaaatgcagggaaggacattctctgcaaggcagagcaactttcaacgtaccttgagagttcaaaggtcagtgtttatctctaagtgctgttcaactgtgagcacaggaaatgttccctgcaaatcctgtgtccaggggaatttgggtccagcatccagaccaccatagactcaggttagggtgctttttagagttggatgggaatcagtctggattttttggacccaaaggacactgacctggtggagtgatgtagccaccatgtgcagaacagttttcatgggtgagtctctcaatgtgtgatatcaaaggcgtgt

SEQ ID NO: 49219 - DNA, 1085 bp, Homo sapiens
acactgtgaatatagcacattttatcagaagcctaaagaagaagcagtgcagcttttgtttatttgattttggagatgggctgaggacatgtaattggggcttgggcagagctattgagggatgctgtaatgggctttttaatccctccctccccttttcctcctggaaagtagtaaatggtgaggacagtcatgtaacttataatttaacattcttcataaatccatctttgccccattcattagcctaagagcaggaattagatgtcttgtgttgagcttaacacgtgggcacatagtgggattcagaaaatgtttgctccatatgtaatgcaggaattagccaggtctccctactgtcttggatttggttcccccagacacagatcctggcataatgattcaagtgaaggtaatttattttgtgtgtgggtgtgtgtgtgggggtaacactacctgtaggtagtgagaatatgatacagggaaggagggcaacaagtaaaggacattatcaagctgaatcctacagaaggattatcccacccaaggggcaagggagctggagtatttatacaccaacctcccaataatcattgcttggaggctgctcctggaggcattcattagttcttggcatttctagcccacctcgtgcatgggcagagtgaccttctacagtcctggttcaggaaaattagcccgtaggctcagagatgcaggcactagcagttggaaatctcctggtgcttacctgaaaggtctgagggatatgtgcaggggcactgacagtgtctgctatggtagccaagtttcatgcatccatttatccactcaacaaatatttattcaaccactcctatgttcctggcactgttgtaagtgttgaggatacaacaataaacaaaacacatacagatctctgttttcagagaacttgcagtctagtggaggtgaccaacataagataaatatgttatactctccttaggtggtgacactgtaatgaaaagaaaaataaaggtggggaataaggattgctgagggtgccatattaaatcaagcaatcaaggaaagcctcacggaga

SEQ ID NO: 49220 - DNA, 1073 bp, Homo sapiens
atttttttgaaagggttttcatgtctctatctccttcagttctgctctgatcttaattatttcttgtcgtctgctagcttttgaatttgattgctcttgcttctgtagttcctttaattgtgatgttagggtgttgattttagatctttcctcctttctcctgtgcacatttagtgctataagtttccctctaaacactgctttagctgtgtgccacagattctggtacattgtgtctttgttctcattagtttcaaagaacatctttatttctgccttaatttcgttatttacctgttagtcattcaggagcaggttgttcagtttctatgtagttgtgcagttttgagtgactttcttcatcctgagttctaatttgattgcactgtggtctgagtgactctttgttatgatttccattcttttgcatttgctgaggagtgttttacttccaattatgtggtcaattttagaataagtgaaatgtgttgctgagaagaatttatattctgttgatttagggtggagagttctgtagatatctatgaggtctacttggtccagagctgagctcaagtcctgaatatccttgttaattttctgtctcgttgatctgtctaatattgacagtggggtgttaaagtctcccactattattgtgtgggagtctaagtctctttgtaggtctttctattggtgatggagtaacaggttctgctcataccattgtggtttgttgcctatgatcataactaaaaggaatgctacatttcagttagagatgacaaaaaataaaattttaaatttctctccaagtttctggacctcctaaattctagcttaagttcccctgatataggatcaagctacatggtgacttgtaagttcttggagggcagatattatgttccaaccacttacatagttgaattctgttttttgttgtggaaaatgtcaaatatataataaatggaacaatatgatgaacctttcctaggcacctatgaaccagcttcaactattaccaactcacagccaatattgtttcacctatacctttacccacttccctt

SEQ ID NO: 49221 - DNA, 1032 bp, Homo sapiens
gatggtagaataaaattgttttccttgatgtaggtatcagagggctagtgggggaattttttaaaaacccaaaacattttgcatgtgcatgccattgaggaagggacttcccagccattgaaatattataacatcccatggataagtgcttgctttggccttgggtgttaagagttctgatggtcacaatcacttctttgtgttggagccatggaccaacaaggttgggtcagttcagctcgagaacagttggacagattgaggcacttcttacttctaaactcacatttggctgttctaatctggacgtattcaaaacaactggctgaggcagggaagcggaactgaagctttttaatgcttacagggaatattgatagcccaggtgaatgctcctcaccccttgcctccaaatactccccagccttgcctcacacatccattacatgatactctgtgtttacccggggcttgtcccaacagaacttagtaatcctacttctatcttggtctggctgtgtatttacatggtaaacatttctacaaaagacagggaaatattcacttcaaaataccctataaaaattgccctttagagatgagtggataggaaaaagcaaacatttcatatttataaaatgaatcatttttataaaaatgttactcatagaccaaaaacttaataatattgttggtagcacagtaatacttgtataggtttgtttcgcattgtagagatatatagatgtattctttcatatacataatttcatctaagcttctcagaatccagtaaggtagacaccattatctctagttttaaaaatgagaaaacaggggcttaggaaggttgtataaatgtccagtattatgctcctaggcagcctgaagataaggatatgaggctaggtcttctcagtcaaaactaaatgcctattggcatatttcagccaagggtaccttagaagccagttgtaaacccattggcacacagctgtctcaaagtatctgtaccattgagtgtctaaccag

SEQ ID NO: 49222 - DNA, 1028 bp, Homo sapiens
gcttaggtcatcctagagatgaggggcccttgcagatttggagcaaataacacaaatttggagaagcagaatgggcttttctttcagtgtgtgtggattctttgtcaaacatactcagttgttattacctgacatgtacatgatacagtgaaagctggccctattcatcacctagggcagtgcctgtatgacccttccatgcttcatgtgttactgacctgtgcttactaaaaactctgcaaatatcttctaaatcatcaaagaggggttagtgtgtttaataccatttcaacattgggagtattccattgtgccatgaatctttgaaaactggtaattcatgtataggataaatggtgattcaactgccagctctgaaattctgagtctatattatataccaaggaatatttatctgttttataagtctattattcagtgataagacttgtccacattatgtacaaagaaggatgttttgactgctaactagtgagattttacaagttcatgtatattattgaaatgtttttgtatatgctgtagcttgaatgtagaacctctttcatctatagcctgttgaagtctggaaaaccttttaggatcctttaaaatgactaaaatgttaacatggtttggataattataatgcttaacatctattgagcactcacacctgccagatgctcttctaagcactggacatttattttgctcattcaattctcacaacaaccctatgggatagaggtatgattattaccattttacagatgaggttaaatatgaaggacacgcagctagtaggtggccaaactacaattggaactcaggcagtctgggttcttaacaagagtattattctgcctcaattacttcaaatgtagtcaataatttgtcacatctgacttgaatcaagtgaaataatcattaagatgattttcctggtccagcgtagaaatgggatgcaagccacatgtataatttcaagttttctaggagacaaactgttaaaagatgtaaaaaaa

SEQ ID NO: 49223 - DNA, 1027 bp, Homo sapiens
aggaaccaaatctctctgggagtgctggctaactcaccccttcttcaaacacgctgtgtggcttcaggatatggctgctggctttaaaaaagaaggaaaaataaattaagacacccacactgcaagacaacccctgtgagtatatgttatactgggaatgccccatttctcaaatatttataaatatatggtctcttggagtgttctaggtctgtcatttgggaaggttagacagccctgggccactatcctttttcgtaagcacagggcactttcacaaataccagattgacagctgggtgatgccaagggaatggtgatgtgttgccctgtgtatatctgggatgtgttagacatccctcccttccttctttttctttgttttccctccctccttcccttcttcccttccttctttcttttttcttcctccctccttcccttcttcccctcctttctttccaagcacatcagtgagaatgtagcacagcttggttttctgaagtccgtcaactactgtgtactgcttgtcaagaagggtgctatataagctgaaatgctgctctaaatttcacattatcccttcctgctgctcattgagttatttaattagaagctgccatattttctagggaaaacactttgaacagaaggcctgatttcactgagaatggatgcctttattatgtgtcaaggagctaaaaattgctagtaagatgtcagtgtgtatatgtatatgaaatacagaaaagtgcatgtacatatatgaagagcaatcaaaagagaaatgcgaaggggttggaaaatgaagaggtgtcagatccagtcgatgatttggttcctgctcaggagtgtgtaagcttcagttggctccagtttggctaacactgcaatgcctttagtgtcactgaagccgacaaagaaagctgacgcgttgtttttctagggggaaaaaaaatgctctccttccacattcccagtgcagacaacagcagaaaacagaaatgagaccgtactgcccagagtc

SEQ ID NO: 49224 - DNA, 1046 bp, Homo sapiens
caatttcccctaacatcttcctgtgtcagtgcttctcttcagagttcgggattttgctcccttttccatgccccctcctctttttccttttgataccaggagctacttcacttaaaagtgcctggattctaggagtaccttggtttggggcccttcaaggccaaaatgaagataaagagatggagctgcggggcatatataaatcatggtttctttcttataatttctttccagattgttctaattgcccacaattaggaaatgtcacttttatagtcagaaaacctagataatattttctttcaatcaagattgattaagtctgtccatagcctataacaatagctaatatctcttaagtgctttgtctcagccaggcagacgctatgctaagtattatcatgtataacgtcatttaattcttgctacaaattgaatgagattagaattgttgtccccattttatagataaacaaatggagacacgaagaagtgaagtgacttgttcaatgttgtagggctggaaagcgacagagataggatttgaatccgacaatttggactcaatttttaaccatgatgctttgtgtataatccccaccatgtaaaaaatataagccaggcaaaaattcaagaaggaaatgtatcaacatttgacattgatttgtctggatggtgcaatggtacgactatggacttttttccttctgctgattttctgattattttctcaatgaccatatactatttttccaataaaaatactttatttatttatttatttatttttatttgagatagagtctctgtctgttgcccaggctggagtgcagtggcgcgatcttggctccctgcaacctctgcctcccgggttcaagcgaatctccctgcctcagcctcctgagtagctgggattacaggcacccaccaccatgcctagctaattcttgtatttttagtacagacggagttttgccatgttggcccggctggtcttgaacttctgacctcaggtgatccacctgcctcagcctcccaaagtgctg

SEQ ID NO: 49225 - DNA, 1023 bp, Homo sapiens
tgggaagcatggatgctccttctctgtggccaaaatggcagagcagccctgaaaaaactttcttggctgtgctgtaggctttacacaggcttgttattattttttgaaccctctgagattgacagggcaggaaatggtatcacgattttctcttaacttctaaagtgacttgctatagtcacctaggtttttcatgaattatagaagagaagaggcctaaaaactgaatttcccaatacctgggacaatgctgatttagtaagttggggtttctaggagaagatagaaatacattgacatatattaatccattgattaattaatttatgaggcaactgccatctacattaaagaatacacatttttttcacttaataaaaatgagatctctctcatgcacttcttaagcttcttccaaaaacaaactaccaaactggtaactgtccaattagttggaataaattgaacaggcgccctcagttaattgtcaaactgagtagtctaaaaaccacgtaacaccaccaagcacagagtgttccttcccttcctcaccaggtctgctgctctgggaacagggttgagaaccccttccagtttcagtccagcgaagatgcgttctttggccatgaactagaagccagtcctccatgcagtgcctttcgggctgaagccagttgtccactaaatctgcttgggaactgatttgttaattattcttttccttttgtgacatttttcaagataaacttacttgggccagcctcctagaaaaccttttaaaatgctaattacgcaattgtgcgaataatgtaaaaatgagtcctgtggtgcactcagcacttgactaattaacaagcagtaaatgaatcctagcctaggaaattctgtacagggctgtgtgaacggcagagagcttcctggagccacagttggaagagtggttttaagcaaataggttcttagagaaattgaccagtgaaaatcaagaattatttggtcatagcataatcttttaccaaaatt

SEQ ID NO: 49226 - DNA, 1050 bp, Homo sapiens
gtcgggtggtctagtggttggttaattggtttactcaatactacagatctattttcacaaactgatccattctgtattttttcacactgttaggtgtccttatggcatagaaaatgctagatatttacccaactctatattctttttgttctggacacacagagagactacatttcccagcattcattgtagttagttggatagaaccctgtgattgagttatgacgaatgagatgtgagcagaagtaatggagtccactttcagccctggccttaaatttttcctttctagtcctccaaatagtctctccttattggcctgttggctagattcagagaatctggtgacatacactaggcctgttggagaaggtggggccacaagatagaaggagcctgattccctgaatgacttcatggagcagagcatctcagctgaactgtgtgtgtgctcagctccagtgtgacagaagcaggaaactgacctctgttgcctaaagccagtgaaatatgagaattgtttgttacactagttagcccaccctaactaatcttgtatatgtggccaaaaatcagtactgtcctcatacacattctacaagtttcagaggggcatgtagaacacacttctctgtaatttgcactgaacagtaggtcgtgaaaatgcataaccaatgagccatgtggctctttgatcaccatgtccaattaagccacatggttatgtgattttctggtttgagtcagctttttatctggggcagatgcaactgtggacagtttcttgtagtaaaaactgatcatttcagtaagtggcttctccagaggatggagaggaaggtacagaaattcatgttaattaccaaacacttcaggctttagcttcagattttttttctctgagaaaccttttctaaccccactcatgtctgggttgcttgcctcccatgcctcccaccctgtgttcttgccactgcccatgcacctacagcgacttcttacctcactggctggtaatgtctagctcttgatcttgactctctttctttg

SEQ ID NO: 49227 - DNA, 1009 bp, Homo sapiens
ttttttttttttacagccttttgctaacactcccaaggggaaaagagaaattgaaaatgccaagtgtatttcagtattactgctttttctccttctcagaacaccggagccggagcgatcgccgagagcaaagagcagctgcccccctttccattgcagctcctccactgccagcctaccctccagctcacagccagaggaggcgtgagtttaaggaccgtcactttttaacggtaagtttggtggccacctgcagccctatgcttgctgctgaggaaacatcagtttgtctgggagtcagtttcctgcctcccagtgagagaggctgggctggctaagagctcaaatcatgggcatttgggaacaaattaatttcccttcctttcattcctgaaagaaacgcctcttttttggaatacagacatattttttagttaactggtagcacaatgcagtaaagcaagaataattacagactaaaatcaggaaaaaaaatacatacttcaaacctcggttcttctgcttgcaagctgaaggattcaggataggttacttatgttctttgccctcagttccctcatctgtaatatagggatattaatagtacctggtttatagggctagaggattaaatgagataaggcatgtaaagtgcttagcccaatgactgactgatacagagtaagacctcaagaaatgttaaccacagctgccactactgttattactggtaaagtgacagcatggctgacttggtggggtgaactggtaaagaacttaagtgatacgaaaaattaccatttgaagagtaatcatgtcatcatttcatgctttcccattctccaaaggaggctagttctccagggtaacttaataccatggtgacgtcatcgcctctggggctttcagccctgaccagatggatgtggctgtaactcagcccaagccctcaagcatgggtcacagatgatgaagctgagcccatctcaaaacacctgcaaatactatc

SEQ ID NO: 49228 - DNA, 1050 bp, Homo sapiens
gtccccatctcccattatttcctccaaaaatgatatagaacaagaagggaaaaataaaactacacagaaaaacacaccatcagcataacttgaggacagagaattcccaaacatcaaattgactgttaagtaaaagagagaaaacaccaagtctcagcatatttcctcctgttacaaggtgagggagggcagattcagaaagccacatggaagaaatgaactagcagtgggtcctaagattgatctaaaaccaccaccagaaaaattgtctgccctaagtctgaaaaatactacagattttttcagatagacacaaactacaaaaaagggcctaaaagtatgcatattttacaggagcagttttctctatataaagcttctgggggagacaaaagacaaacaggaagggaaatctgcccttcagcaattgggagtgaagaagaaaagaggcaaaaaggaaatttctaggaccctgcaagacaaaataaaaccaaaaaattcaaggacacgcaggagttgtatgtgtccttcaactcctgcctcaccaccaaaacaaacaaatacactaaaatatttgaacttcaacaaactgacagaagatggtgccattaaactagggatcttgtgaaacacaccaaagccacacaaatgagtaagagatagattagcagatccacatagagtgattgcaaaaggtcaatgaaagaatatatgaagcaagggttttatgtccaaccatgctgttcatcaagtatagaaaagcaattttcaacatacaggaacttagagaattttgcacccatgagtcctttatgaggcatctaccacaggacaagcttcatccaaccaagggataattggggaaatgtcagcaaaaggatgggtagcatacattttaatacatgtaaatgtagatctaaaactaaaagtacagtggagatgaagatagaaaactaaggtgcaattttaaatgttgtgacaacagagaatgatacaactaaaaatgagagaagggagaggtaaagaagaaaatagaataagctaattgat

SEQ ID NO: 49229 - DNA, 2897 bp, Homo sapiens
gtgtggaggggggtgctttgggtggtccccacagcctttccggagtgcccgcgcgtgtaagcttttgagatttgacaatttgtgaagtgcttggtgctgactttcggggacgacaggatccttttacagtcattctcctgtcaggggaggcaggtggggagcgaggaaggatccagatttcgttaacagagctttgagtttaaagaattgacaaactcccgagttgatttcctgtcagaccttttgcggttgagacatagagtctgaggctttgatggtaaccgcgtttgatttagagacagactgtgcagcttcgctgttttattgtaaatacgtaaatgaggaggaagagaaaaacgtagggtgttgggagcagaggcgggaggcgggagatcctgcgaaatcggagtccctttggagtgggggaggccgtcgaggcgtgcgagggcccggcccccttgccgcgtggtcgttaacaggaaaggccctgatttggttggtggcggatcgcgtccctccctcctctccccggctctccccgagtgcggcaaactggcttcaggttgactaaaagatagcgattttccaagcagctttgccgcgcggtgttttctaaagcggggcgtgggctgggtgcccttttgggcctcacttgtccggcctgcggcaagtgctgggcgatgggatgcggttctggcggcaaaggaagggctgcctttgagagtcccgcaggaaggtttagaaagtgattgttcttaaaacaaacagagcgttttgctgtgtgttcctcaaagtggtcccggtgggagtggcgcctcattgtgagctgtgccttatctgatgaattaatggcaggtgaaagccttgcgcctccggagcgaatatttacgacttttgaaaatgtctttaatgtctaaaaaaagtcttttagaaaatcagacggcctcttgttcttatgttatcaagagtttagatttctgtggtaaatataagtgagtttcattttaagtaaactcattttacgagatttgagatttgaaagtgaaattaattaattttgcacaatctagccttgggctctgagaaaatgttgtaaagctgtaattaatcttgtgggacgaagtgaaaaggaactaaagtgtatggtgtaatgaatagtttaaatttctgtggtaaatacaagtgagtttcattttaagtaaactcatttttatgggatttgagatttaaaagtgaaattaattaatttcgcacaatctagtcatggttgggctcagaaaatgttgtaaagttgtgatttatcttatggaaagaagtgaaaaggaattaaggtatatggtgtaattaagagtttaaatttctgtggtaaatgcaagtgagtttcattttaagtaaactcatttttacgggatttgagatttaaaagtgaaattaattcattttgcacagtgtagtcatggttgggctctgagaaaatgttgtaaagctgaaattatttatcttgtgggaagaagtgagaagaaactaaaatgtgtggtattatcaagagtttagatttccggggtaaatataaatgagtttcctttaaactcatttttgtggaatttgaggtttaaaagtgaaattaattttgtagaatctagtcatggttgggctctgagaaaatgttgtaaagctgtaatttatcttgtgggaaaaagtgaaaaggaacttaaatttatggtgttatcaagaattggccaggcgcggtggctcacacctgtaatcccagcactttgggaggccgaggtgggcagatcacttgaggtcagaagttcgggaccagcctggccaacatggtgaaacccagtctttactaaaagtacaaaaattaactgggcatggtggtgcaagcctgttacgctaactactcgggaggctgagggaggagaattgctttaacccgggaggcagaggttgcagtaagccgagatcatgccactgcactccagcctgggtgacagagtaagactctgtctcaaaaaaaaaaaaaaaaaaaaaagaaatttagatttctgtggtaaatataaatgagtttcattttaagtaaactcattttgtgggatttgagatttaaaaatgaaattaattttgcacattctagtcatggttgggctctaaggcaatgttgtaaagctgtaattgtttgccttatgggaagaagtgaaaaggaattaaaatttatggtgtgtctactatgaaccaggcatgatgctgagagtttaactgtgtaatttttggcctaaatagccctgtgaagtagatattattccaactttacaggttagaaaatttgaggcacagagaggtgaaatatttgcctaaagtgaaacggcaaatttggcaatttggacttggattcaagtgtttataactaaagcccagctccttgcatcataccctggtacctaaaagacataaaaactcacttcaggtgcaatgtgaatgaaaatgacgttatgacccaggcttgttgtctatgtgctccttgagaaatagttctgttggatagatgcggtcaatactcaaaagcccttgctatctttgccatgcattactctaagcacttgacatgtattaatttaatcctcacgattccgtgaggtatgtgctattatcattcccattttacagacaaaaaaaaaaaaggatttaagtaagttgttcaacttacttacacagctagtatgtgggggaggtgggacccaaacccaggtattctgaccacaagcctaaggtcttaatgctgtttgatgctgcctctcatgtaaccagatatgtgtgacagttgccgtagaagtattaaagtgtgagtgttattgtagttcagggaaagccgtgtcacatccacatgggat

SEQ ID NO: 49230 - DNA, 3329 bp, Homo sapiens
ttgttctgttttgttttgttttaggctttcggcagcctgaagctatgctttttagtttctgtctctagggataagtggaaaagagggatgaggaaggggctttcctggcccaaccagaaacaaactaagaacccatgactatattccctcccttggacacccctagtaaacgttctttgcttcagtttcctcataaggaaaatgaggacagtaatagaacctatcccacagggttgtcagtaatttagcaagatagaatacctaatcaaagaatcaaaagaaagtacaaattaaattagaaataataattttaaactgtggttttgctaaaaattctgtaattatgatgaaatgattatccttctggataaaaataatttgtcaaaacaactcaagaaaaagtaggataatttgactagatcatcaaccatggaggaacttagaaaatgttataaaaactggacccagagagttttttttataaattcaaccctttgagcacaaaaattgtcgtgcgatgtaaactttttagagtatagaaagagatgaaaggcttcccagctaattttgcagagcaattttgataccaagtgttaataatgtagcaatacaacactgattcattaattgtgagaaatataccatctcaccaatgtaagatcttagaaatagagatgcaaacaatttctaaataaaacaccaacaaattgaatgttgttgtttataatcagctggacccctcaccccaagaacattaagaaatgtattaatatgttgcatcagtagatcaaaagagaaaagtcacttagtcatctgatgccaagaagctatttggtactatgtattatctgtcctggttttaaaactacatgcaggaccagcaggatactaccttagtttattttggaacatctggctgaccccaacagccctccttagtgggaagaagtagaggagaattttcaaacgtggagacctatccattgtttctacctctaggaatttatcccatagaactacttgcacaggtgcaagactgttctgcagtgttctttataagagcaaaactttagaagtaacttgaatatctatgaattgggggctgtgtttaataaatcatggcatatttacaagatagaacactaagaagtcgttacagtaactacagtagacctaaaagtactggtttggaaagactctttccaccacaggttagttttgcctgtttttgagtttaatatcaattgagtcatatactgtactcttttgtttctggctgtttttaaacccaaggttatggttgtgagattcggccttgctgtatacagcagtagttggtttattcttattgctgcgaagttcctttatataaatataccacaatttaattactgatagcctgtataagttttatggtcagaaaactcaaatagtttaaaaagtgaaatttgattgaagttacagccccaattagagaggtattttataacttgatacttctatgcaacattagtctgcgtttatctaactcgagttagttctcccatcttctttatcccttttgatttctgtcttttgggttcatggtcattagtatctccactatagaatgaaagggaaacaggaaagagatgaaacctgaatctcttaattgtgcctctcattactgctctggttcagaaaggatagggtagctctttcattaacgtacccttcccagtaactgtgatgcagacattcaaagcaaatttctagtacaagatataatccgatactcttgcagccagttttctagttccatagtaaagtgactcagagccataaccaaaccttcctaattttagattgtttggcttacctttcacatccacttatttaggtttaatataaaatttaataaggcaatcctaacttgaaagttgaaatggaccttagagatcatctcaactggtgttcgaaacctggtggatgaggaggtggtgtctcttgtggtccgcccagcccacatagtcgggggggacccaatccagaatagactcctggcttacattttggaggcaatgctttctccttagtcaagagccttttggagctcctttacaaaagcagttagcccttgcgttctcttgttcatttgtttccagcatttactctgtaggctttaagttactaagcagtcacttcacagtttgtaattgtgtttgatttgattcttatttctagtcatgagcaatatggcccttcagttttgaaagatttattctaaattggccatggaagaattctggttttgtcactctctaaaattcaacccaaagtccaattctatttgagttagcattctgagagtatatccatattattaaggtagtaagtgtatgaagtaacttttttatgcgttgcttttcaggagtagaggtttaccactcttaggtgactaagcagtatcacaaataaaccctccagcaagtttaaaaataattaggtccaactcagaggaagtggagtttctcctgttgcacaaaaatgatgtctaacagctccagtgaaatcgatgtggtttgtattcaaattgaaaatctgtctttgttctttttactgtgctatacttctactctaaatttagtttaattttatacagtgaaatgcatagatcataagtaaatttttgttatatattttaacagtaatatataaagctcttgtgacaatttgtgtacaagtttctttgtgaacacacacttaaatttcttttgggtgaacagacagaagttgaattactaggtcatggagttcatgtgaatttaactctgtgagaatctgccatacagtttttcaaagtggttgtgctgtttttacatttctgttatattcttctatatttcttcatccttcaagttgaatcagtatgtagattattaaactataaataatttggcttaacagaaaacaccttttttttagtcacataaggacatagatattaatgctacctaagtagtctaggcaattctcttaactactgtcagtcctaatgtttttcaaaaatctttggagataatgttaactgcctatcaagagtcatttttctctgacataactatgtaaaagcactttgaaaagcataaggcactatacaagggtaagatagtatatttttaaaagtactgaactgtaacccaattccatatgtttttgtgatttctgtcatgtattttgaaacaaaaacatacatagctaccaagtatgtttattataaaattattcccatagttcataattcattcttagaatgaagagttattatactgaagtgtaatggctattta

SEQ ID NO: 49231 - DNA, 1050 bp, Homo sapiens
atcacaaataggcctttgtaacagcctcttgaaagtgaaattaaaccctcaacttttcttttagttctgtctttcatcttcccttttaatttgttggtaaattttcctcagataaaaacaagaatacctacttacgatgaagatgacaacactattctttatgcgtatgaaacaaaacctgaatttgtcaataaagtatgttaattgctaattgccaaatatattaacatttgctgttttaaaggaaaagatgtaaattcctcgtatactatggagttcccgtaaactcacactcaagaaaatatctctcccctgaatttgtatgcttgctttcatcagagaatgagcacttaaccaatttactttcccctttttcttatatagtagaaaattaagagcagttttgtactcactttcagtataaaactctaaacctggattcttctgatataataaattcttttcttgcccccttcctcaattgtcagtttttcattctcatattaatgtgaattttaaaaatctctgcttaatttaagacttctgaaaccccttgaaaagttggtgataaataaaaacaatttaaataaataaatatagctcccccctgcccccagtgttcagtttggctgttacagaaataaatcattaactacttttaaaatattagcaggaaccgaatattgtatctgacgcatcctgtaatactgaagagcaactgaagacagttgatgatgtccttattcattgccaggtatggaagttctgtctcttcaatgtagttttctaaaatgttaagcaaaaattctctttatctcacataaagggaaagtgtacaattaattgaaattttgcctatcaatttatttatgattatcatcccattgtgatgattttttaaaacaatttatagttagaaccacatttcctgaatagcaacatgtagatttaatagctttttaaaaagcccattaccaaccaaatgtagttatgtctctttcatctacattgctcagtattaaattagtttcccctacaaaatccttaaag

SEQ ID NO: 49232 - DNA, 1470 bp, Homo sapiens
ttatatttttaatagttttcataaagtagacgcatattcagagaatatacatctgcaatgagctgctctctagtttgctttacatgttctcataaagaactaaccattctgatgaaaatatggaagcattattaattatcgttaagtttcttctctccataggaaattgacgggaaggctctgctcctactcacgagtgacgtgttgctgaagcacttgggggtgaagctgggaacggctgtgaagctatgctactacattgaccgacttaaacaaggaaaatgctttgaaaattgaaaaaatccttgtgcaaatttagattgggccaacttctagaggcaccaatgccttcttagtgtggaatcatttttctgccctttagtcgtttttgttttgtagaaagtatctctcaaaatatattatagctagaattgtagaactatgttatagtccagtctacttctttaaaaaccatttaaactgctagatagtattagaatagtccaatagaaaattcattctttataggtctttaaaaattacttttattatattgtttacaaatatatttcatgcaagaaacagaaaaaaaaaaaaaccctttgattctggttcatctcgatacagagaaccaaaacagctaagagaggtattatcagggttgacaactcctatgattgaatctatgggaattattcctcagaagagaatttaaaggtgtacccatatatatctctttctggagtattttatctgtctgatgttgcagtattctacaagtttccagaaagagaatagccatataaattattttcctttctgctattatttctctatatgttttatttattcagatttagagtaaaaaataagcatataaacttttattatgtgctcttaacagttttaagataaactataggatagatagaatggttattttatgcaagaaatattgtaccgcaagggtggtttggatgaagtctgactactttttttcaaacaaactattatattaaaactgtcatattttggctaagtttggacctataactacactttcattgtttgcatctctctatgaagatacgtctgtccaaacttttaaaaggcataactgtattttatgtgtttattctttatatagatagtattttatattttattctcacccgaagtattcacacaatctttttaaaaaaaatttgaaatggcattttgtattgccacagaggtaggatgagccatatattagtgaaatgttttattttgtaaaatataaatggattatttgccatcattagtacctctcaacttactttttagaggacaagaaacaatctgtagattggtttccatacagggaagttctccgtcctatgcaatgtttctaattaatttgcttaattctgagccattaatcctgctacactttgaatgatacattaattcagactaatctttgggggc

SEQ ID NO: 49233 - DNA, 1029 bp, Homo sapiens
ggagaatcccttgaatccgggaaggggaggttgcagtcagccgagattgtgccactgctctccagcctgggcgatagagtgagactctgtctcaaataaataaataaataaataaaatcagcctgtaaatttcgattaaaaatttgttaggattggttgggattgttttgggtctctagatcaatttggatagaattgacatctttacagtgttaaatttcaagaacatgggatatcccttcactttattaggtccctttaatttgtaaaagtattttttgtttgtttaatagctttctacatagaagattttccactttttatttctaggaatttgataatttttgatggtttcaggaatggtattaaaaattcatttcctagctttattgctggtgtatagaaatactgttggtttttgaacattaacttttgtatccctcagctttgataagctaattttttctgctagcttacttgtagattgttttggattttctattgtgtacaatctgtggaaaatgataggttttttggtcattcctagcactcatttttgtctagatttctacctgttctcagtgaagagatttgtctgaattatatataatcattattactggaagcagaaagtcttcctaaatgaaagataaaaactacaccccattctcatttctgaattatctttgaatttaaacccaaatctcaaaggtgcctcaatcccagtgaaagctaatagtattttttgagacagtgttataaatgttcctaatggatttataagcaaatcttatgaaatctttaaaatttaattttttttgagacagcttttaatgtgtatctcaaggacttaaaatatgaaaacttatcagtagtttaaaaaattcttccaagtagtgaagtcactagtgaagccataaggtgtctctgatgtgctcatttttcttttcctttttttgagacagggtcttgctttgtcatccaggttggagtgtggttgctcattgcaacctcagccttgagctcctg

SEQ ID NO: 49234 - DNA, 1021 bp, Homo sapiens
ttacagattaattgctgaattttgagtacattactgagaatttggtcagagaaatagaaccactgtgagtattatgggtaaggaacttatatggtaatcagactgtacacaattataagaggtgctggggatgggaatatctatctgaaaaaggaaagacctgaaaaaatcactaatagatcctcctgaggtactggtacaggttgataaatgagagcttactgggaaaattttaagaagccaaatgtgtacagtcaccaaagtaggcatgcagaaaggcttttttctggagagttctgtggaaggctgtttcctccgtgtagctgctgcctctgtgggtccacagccaagcatttgttgttgggtcttgctctactgttggtcagatcagaagaagagctggacacagaggggacaagaggagagcagggacaagctggaagctgccacacacctctgcatttgtcgtcaccctgtgtgaccttcatgaagatcttgtaagaatttggccatcttgaacttggtgtactgtgcaggaaagggaattctgggaaacacagttcccggcttgatcaagttcacaagagactgatccactacattgagcttctcattttgagcatctcaagtctttttttttatgtgtggttaaaaatttttattttttatttttattttttgtgggtacatagtaggtatatatatttatggggtacatgagatcttttgatacaggtatacaatgcataataatcatatcagggtaaatggagtattcattacctcaagcatttatcctttctttgtgttacaaacaatccagttatactcttttagttatttttaattttaatttagttttattaattttttttgagacagggtcttgttctgttgcccaggcgggagtgcagtggtgcaatcacagctcactgcagccttgacttccagggctcaagccatactcccacttcagcctcctgagtggctgggactacaggcttgcattgccacacccagc

SEQ ID NO: 49235 - DNA, 1033 bp, Homo sapiens
agaaagttgtagatagaaagcaaaacaattaaaaaaaaaagctctgtattggatgaattattctagatgctttgtaaaattgttaatacataatttacgggcctacctaatttgggaaataatgactctatttaatttttagaatatgctcgaattgctggaagaaatgccaaatggagttccacctgagaaagtaaaaagctacatctatcagctaatcaaggctattcactggtgccataagaatgatattgtccatcgaggtgagtatgagatttttaaaatggaaaatattaaaacatcaaataaagttaagagtatttcacatgttactgtctttaagaatattttcataagcattggcattgccatttaaattaaatatattttgaaagtgcaagacatgagaaatatttgctctccatatctccttttctatcaccaaaaggatggattacaaatttatttggatattgtggtgagatctttacatttgtataactattatagatccactcccaattgtagaaatgcctagtgatataagagaactcaacaaatgtgaactttgaaacttacttggggataggagaagagcaaaatgttgatctctatagccttggtcctgcaggtagaccaggtaatgtgaaacaactctgaatcaggctttatataggtggttcctaagtcactggcccctattggcactcatgtctcattccttcttacaccaacaatctccagtatgtatcttcacctcctaattttctctaccccttagtgaaaagtgcccgttgtctgcagttgcaggcatgatcaaccttgcataaaggtcataattatactcccataaactgttttgtcctttactgccatgaagtgggtggtttatagcaatgaaagggaaattacttgctcagcatcaactttgtctcttctcctgataatctttcttgcactggagagttttacagtagtgggacacaaattgatacaacaatgaccctaaatatttatttaaaaaattgcagta

SEQ ID NO: 49236 - DNA, 1074 bp, Homo sapiens
tgcatatttctttgtgctttgcattttcaatgcccaaatgttaccctccccctttcaaaaaaaaagcaaaaaaaaaaaaaaaaaagtgcagcaagggaacatttgaattttgcaatatcgagagagggaaattggggagataagaacgaaaagggctatacgacttgtagttgagtacattgctaactaaaacattccatattttcagcttctcttgctgctagatatggctgtgtacctaagttctagctggtaaaatataagtggaagcattttgtggagcctttgggaagtcttctcaaaacagagaaacatacaccttttgctttctccttcctgctggttgaagcatgagatcccctgattagagataggatgcaaccaggtagatgagcctgggcctttgattggctgccgtaccagctctatatgtcttatctagatttctaggcttttccattaaataataatacagtcttgtttgaaaaaacccgaagaacagatatggctggaccggctcctccttgcacatgcttgcccttcctggccacacccagtcacctcacctctaagcccccttccctccccagccttatggtcgctctaacttgaatcctgtgtgcattctcatcctttctttcagagccagccattaaaatcactgcgcaagttgttacatctctcttcggcctcaaatcacccggcttcctcagatccccgcttccagcccttaacagctcaacaaaccaaaaattccttctcagaaattcggattcaccccctgagccaggcctctggcgggagcagcaacatccggcaggaacccgcaccgaagggcaggccagccctccagctgccaggtcagatggatcctggttggcatgtgtcctctgtgaccaggagtgccacagagggcccttcctactctgaacagctgggtgccaaaagtgggccaaatgggcacccctataacagaacaaatcgctcacgaatgccaaatctgaatgatttaaaagagacagccttgtaatttgtgctggtaggggggaggggtggacagacaagccagtgggg

SEQ ID NO: 49237 - DNA, 1125 bp, Homo sapiens
aaaaaaaaaaaaaaagaaataatccttggctcaaagagaatcacaatggaaattagattgctgaaactgaatgacaatgaaaatacaatgtattagaatttatgggatgcaaattagagaggcattgatgataaccttaaatgtaaaagatatgattaacaaagtaaaaaaaaaaatttgtttttgttttgttttgttttgagatggagtctccctcagtcacccaggctggagtgcagtggcacgatcttggctcattgcaacctccgcctaccaggttaaagcaattcttctgcttcagcctccccaagtagctgggactacaggcatatgccaccacgcccagctaattatttttgtatttttagtggagacaaggtttcatcatgttagccaggctggtctgcaactcttggccttaggtgatccacctgccttggccccccaaagtgctgtgattacaggcatgagccactgtgcccggccaaaaaatggttctttgagggaactgttgaagttgacgaaaccatggcgagagagagagagagagagagagagagagagagagagagagagagaaaacaaataaccagtgcaagtgtagggaggagctgctgtctaaggctgagagagaggacccaaggaaggaaaaacttggaagggaccccctactcccaatcaagagatgagatcaagccctcattggtgaggatgtggctatggtccactggatagggcagaagttcactgaggtgcctcaagttacagttgggtctccggctggtgggccaggactggagaggatggagccacccactgaggtgccagcaagactctctttgggctgtgcaccaccgcgtctcccacacactaatggtgaggaagccatgggctgtggtgtcagtgaaatttactagaaggtgggtgccactacattttccacacatgctaaccgtgcggtgctgtagaaacaagaagcaaggcacaccagaaccagaaagaaaagctttttcttttgctgttctttgcagtgttcttcctgcactgtctactaacagagactaacgttatacgagctgccaaagaggaaatgattacagggtccagctctagtatcacaaaatg

SEQ ID NO: 49238 - DNA, 1049 bp, Homo sapiens
ttctggccaggagtgaaaatgcagggcattaattagtatctcccctcatggatttctgtggttcctttctcggttgtccttaatgttaggtgcccctgggcgctgggattgctctagcctgtaagtataatggaaaagatgaggtctgcctgactttatatggcgatggtgctgctaaccaggtaattatgtctcttaacttcccaaaaacagtcttattttcaaagtctttaatatttacagttgaatttctaaagaagtagcatattgcttattaggtgaaatagcaagtcctatggctagctcaaatttggttgacttatggccagattagagattgacctcttagcgttgtttcacaagagacttacgggggcacattcctgtgaaggagctcacctttgctctacatcagtgcttggcaaaggccctgtggtaaaggacctccccacaacctattgcaaaacaatacagacccattctcttggatgtccgggctggcagtgtcaaattcggataatagcgtctgagtcctaactcagtttctatgcttctcttgttaccgagtaatccccagtctgtggccagcactctgtgaagccctgttctagaggctgattcttaggtgctggttcactctggctatccagtgggcctgatagatttcatattgatcttttttccagtgtgttccttactgctagcatggccccaaagaaacaagtagtagttggtttgtcaccttccttagttgcaagagtatgatgcctgctacttctcctccaccacccaccccgctttccctcaccacccaaagctcggttttagaagaggaggctttctgtgctttatgaaagctttctgtgccaggcagagcagcagctgttagagatgatgaagcctggagaaagaagccaaatgaaaccccttttcgtaactacttccagggccagatattcgaagcttacaacatggcagctttgtggaaattaccttgtattttcatctgtgagaataatcgctatggaatgggaacgtctgttgagaga

SEQ ID NO: 49239 - DNA, 1035 bp, Homo sapiens
tattataaagatacatgcacatatatgttcattgcagcactattcacaatagcaaagacatggaatcatcctaaatgtccattgatgatagactaaagaaaatgtggtacatatacaccatggaatattatgcagccataaaaaaagaacgagatcatgtcctttgcagggacatgaatggagccggaggccattatccttagcaaacaaatgcaggaacaaaaaaccaaataccacgtgccgtgggagctaaatgatgagaacatatggacacatagaggggaacaacacacactggggcctaccagagggtggaggctgggaggaggatcaggaaaagcaactaatggatactaggcttaatgcctgggtgatgaaacaatctgtacaataaacccccatgacacaagtttacctgtgtaaaaaacctgcacttgtactcttgaacttaaaaaaaaaaaaaaactttcaaaatgttgccaccactaccatttaactaaagctctgggtcttttaaaaaaagaaatgattagatgatctaagattgaacttgagagatccctgacagcatacacaacctttcatccaaaatacgtaactggccccttgtctcccggttaaatagtcattagcattcctcagcaatgatcccacagcaacaaagtgtcatttggaatgagtaccaactcatttgctataactatggatttttttttttttttttttttttttttttttttttttttttttgagacagagtctcatgctgtcgcccaggctggagtgcagtggcacgatctcggctcactgcaacctccgcctcccgggttcaagcaattcttctgcctcagcctcctgagtagctgggattacaggcaagttccaccacgcccagctaatttttgtatttttagtagagacggggtttcaccatattggccaggctggtctcgaacccctaaccttatgatccacccatcttggcctcccaaagtgctgggattacaggtgtgagccactgtgcccggtcaacta

SEQ ID NO: 49240 - DNA, 1045 bp, Homo sapiens
ttagaaaatttaaagttatatatgtggcttacatttgtggctcacattatatttctattggacaacactgttctaagcaggggtcagcgaactttttgtaaagtgcttggtagtaagtattttaggctttttgggccacagagggtctctgtcgcatatttttggtttttattgtctttttataatcccttaaaaatgtgaaaactattcttagctcacaagttgtgtgaaaacagtctgtagttcggatttggcctgtggcccatagtttaccagaccctaatctcagtagaccggttaggtctgtgacctttaatattctgaagaataaacataaagctttaagattataaacatttgggaagtcagcatcttaatttcctctagaaaatactttgtgttattttcttacacattataaattgttcttcaaaattgagtgatgtagaacttttctttctctcttagtcatctgtctattttaaacattcttatgaagactggctggaaaacaacggactgagcatctcccctttccacataagatggcaaactgctgttttcaatcgtgccttttacagttggggacggcggaaagcaaggatgctttaccaatggtattcttcatcttcttttgtttggtttaggttaatcattaagtgatcacgacagacagcttgttaaattaactatttccattactttgcagttttctgagttttaaaatattgacaatattaaaactttctggttttatataaccttatgggattgtatcattgtggcttgcatacattaaaaatcaaggcatttatggcaatttatagttaggggctttacaatgatctctgggacacccaagatacaggcaggttctgtagatgagagaatgtgagggtcaggggtggcatggtctagatttctttttgttaaaaatttagccccaaatggattagagctaaatgtaaacaatcagatcatcagagttagcagaaaatgcaatagcagatcaaagcatacaaagtggaaagaaggatataataaa

SEQ ID NO: 49241 - DNA, 1046 bp, Homo sapiens
tgtggctgcttagtgaatttgctagtccatgaattgagagaaattgtaaattaacatgatttttttcccttttgacaggttcaattttggaatggtgtttggcgtaattgccatgtttagctcattttttctccttggaaaaacgctgatgcagactttggcacaaatgatggctgactctccctcttcttattcttcctcctcttcttcctcttcctcctcttcttcctcttcctcttcttcatcttcttcctcttcctcgcttcacaatgaacaggtgttacaagttgtggtaagtatcgtcttttcgctttaaataactatcgaaatagagatgcaagataccacttatgatctagtgtaactcctatccataatataaatatgaaaataaattaaaagtctcataattttcaaattacctgcttacacaaaaaaattaataagaatacagcaaggaattgttgaaatatttggtagtagttgtaatattaatggtaaaagagaacaaatgaaccatcattaagactgtcagcaattaaacagatacgtgactgtctttttaagatattaaatgattgttattttcaaagaataggcatgctgatttaagatctctataatgtataagtaaattgcattctaattatatgcaaagtgtttccctttccttttcatggccttcagagcctaaccaataatatccttttaattaaagatataagacctttctgaatggtcactgtgatttcttaatgtgaagaataatgtgctgagttgtactcctttaaaactcatgtgtagacctataccttatcattttatgtctccaaagtttggaagggggctttacattggctcacttttatttcacatttttacatttatagttcccatttccatgagtcatggatgttgtttttaatcatgttcttattaatggagtagactaaggattagtaacagattgggtttttttttcttgtctctttgtgtcctctactaggctgggtcactgggaagatttagaagtcatttgtagagaa

SEQ ID NO: 49242 - DNA, 1051 bp, Homo sapiens
cttgcagtgagccgagatcgcgcgactgcactccagcctgggcgacacagcgagactcgtctcaaaaaaatatataaataaaataaaataaaacaacaacaacaacaaaaatgattataactagtttcttaactagagaaaggacacttggaattaatggaatttagaaaatgattcaagcagcattgtttgaatcttcagttactaaaggaagctttttagatgagatttctgtgtccataaaaataaattccagttgaattaaaattaaaacttgaaaccataaaaggccttgaaagaaaagacccatgttatcatttttatgagcacagaatgaggaagacatagagcgaatagtagaaaccatgaatattttttatgtaacagtaacacctttattttttattttttaaatactttattagagcagttttagattcacagcaaaattaagaaggtacggagatttccccccttacaatgatgaaccgacgtgaatatgtcattaccacccatagtttacattagggttcactcttggtgttgtaggaaaccatgaatactaatagatttgactacctaaattttatatatcaaaaactaaaaacaaagtaaaattaaaaggcaaacaaactgtggaatacatttatgtcatgtattacaaaggaccaatgctgatatttgaagtgatcttacggatcagtaagaaaaagttgaatactttaggagaaaacaagtcaggttatcagtaggcaactcgcagaaggaccaaaaaatggtcaaaagtacggggaaagttcagctttacaaatggtcaaagaaatgtaaatcacattgcagatttgaataaaacgagcttgcccaaggttatgaaagggtctgcttttagagtataatttgatgacatgtatcaaaatcttttaaattttgtgtaataatagcatttactaccctctctgtgaggcataacattaaacattggacaaagattagctcatttaatcctcaaaattacccttttgtgcaaatgtggttatttccattttaatga

SEQ ID NO: 49243 - DNA, 1011 bp, Homo sapiens
cagtgagccgagatcgcgccattgcactccagcctgggcgacagagcgagactccgtctcaaaaaaaaaaaaaaaaaaaaaaagagacaggacctcaaacccataacatgtctcaagagcccaatcccttagcaagtatgctcatctaagaatttcttcctccaaaatatttaggtgtgtgtgtccaaatatctttatcacattataagagcagaaacttaattaaatgcccaacagtttattccatagaacacagtgtagctattaaaaatcatattgaaatagaaaatactcatgggaagacgtctgtgatactgttaagtgaaggggcaaatttcaaaaccagatttataataaaagtatagtttttaaaattatgtgtacaggaaaagactagaaggacatacatcagaatggttcacaatggttttatatgtgtatgtatgtttggggagcagaattttaggcttctgttttgctttgaattttccagttttcttgctttaaacatattttttataattaatataattataaaagaaagcagaaatttcctccaaaaggataccttttagtcccaactcctggactgtaagaaatagattctcagtatgtaaatggtattcctgagcctggtgtgtcccacttagcctaatttattgtctctctttaacagatgacataacttgggagtgattacttatcttacgagaatatatctttgctatctaaaaaaatttgctgtgcagctcttatcttcccttgtgtatgcaataatatatacctgcacattttaggagcacatgattgtaagacaactcctgcttcatatgtttgtaacatgtctgtaggttccaaatgccttaatttcgacattaaatttcaattttaatgtatttgtgtatctcttccacactatttttctgaccaacatagtagaccaactaatggaatagaagggtatggtgctcccacactgatcgggatccctattagaccagctttcattac

SEQ ID NO: 49244 - DNA, 1094 bp, Homo sapiens
cttaagaaaatgggctttaatttttcacccagaagactggcaaagagtaaaattatgatagcatccagtgtcattcagagagtggaaaaatgtcaattatgagagtataaattaattcaataatgcaaactcattggaggtcagctttaatgttcatattttttgacccaacatttccatttctaggtaatttttcatacccttgcagatgcatacttaactggacgcctaacattataagcaaagctgtgtattgcagtattatatgaaaaggttaaaacaccctaagtgattaatagtaggataccttataaataagttgatatgttaataaaaatggattactctgtagcagatataatgagattgatatttatgaacagatatggaaaaatgtcaaaaatatataaatttaaaagcaaatagggtgtgatggctcacacctgtaatcccaaattttaggaggctgaggtgggaggatcacttcaggagttcaaggctgccatgagctgtgatcacagcactgcactccaacctgggcaatagagcgagactgtctctttaaaaaaaacaaacaaaaaaaaacacgaaaaagcaaaatatagtataataatttgataccattggtatttttaagtgatgtatctgtatataatagaaaagatcatttacctgataagtcctagaccatactttgtctggctatttctggaatttaataatttacaacactttaaaaattttaaaaggaacattttacaatgtgaattcattacttggaacatgtgttagctaggtatttggctgctctaataactaaaaataagtggcataaactttcaaaacattccaaatataagtagttcagtgttgatcggataactctgtaatttgggtacacaggttctgtcttgttagctctgctattcccaacatgcagcttctgtgtcgtggacctaaatccagctccatcatagctacattacagcccacagtacagggttgtctccatcacatcctggtgctagtagtgcccataccccgccccataaggaaaactgcaataggaaaagggaagactaggtatgggggaa

SEQ ID NO: 49245 - DNA, 1027 bp, Homo sapiens
gaaataagaaggaacttggcaaacaaaaaaccccatctgggatttagaaaaaattcccttacttcttaaaaattcccttaatacttaaacagttctagtggaatcagtgttggcatgtctgattctatctggggtagagttattttatgtattttatgtggcagccatcctaaagaagttgtcttggcttccaaaaataccatgtgaagtcagatatgttgctctgtgcagcagatgacagagctgaggcaagtttcttctcggatcctgccaaacttatttagagttatttcagctctgaaaaatcagcttcccaattctttatacaaaatcagcttcccaattctttatacaaaattggaggtgttagaaaatagaaattatgctcacagactatatctttaagtaaaaaaatatcctgatacttgtccacatctattggtgtagggaaatatgattaataatcaagaatagttttagtaaagtactgtgtgcaacacaggcaaagtagtaagaactgatttttttaaaaaaactttttaaaatttactcatttgtaagaatttttttattatcaaaaatgtttagacacgatggagaatatatttcctcaatataatataatgcttcaagcaccagtacctgccattcactaatccttagaccatgtctatagatttattctgttctaatctgtttaaagtaaatcagtaaagtaaatagattcaaaccaatagacatttttcttggtaagttggatgctaatatgtgtgtttcctttattatatattgttgaacttctaactattttcataatatcatatttaacttttaggactctaatattttctagtataaacgagcccacatgtatctttctgccagcttcggcagttattaacattttgccaattttttcatctaagcagtccacttttaggggaagtattttaaagtacatcccaggcatcctatcatttcatccataacctttcagcctgcctttaacggatgatgactcattaaa

SEQ ID NO: 49246 - DNA, 1066 bp, Homo sapiens
atctgtcgattctgggccccaaattgagtggcctggctgctaaccccctagaacaggccatgtattttctagttcctcacagttcccaccactttgttttttctgcatatgatccacttcatttatttggtaccagcttggcccatttaagcatttatattagcaaacatgccgtatcattagcgataataaattcctgacttccaattctgtattgtacccagtcctcttaagaaaagttagtaattaagcatcagctgtaaacattttaagatcattactgatgcaaaggcaaatcgggtataacatcatttatgtattcagtgtatattgagtaatccaccttatataagacactgagaaacctttccctcagggagctcaaagttgagtcagaaaaacagaccatacccacattattacagtacaagtttaaatttaagtaatgacaggcaatactgggaaatgataacagtcttgactgagaagatgaaggcaggtttcacagcatcagcccttgaactggccgtcaacagtgagtttacttttaggacgtcaagatggacatggacctcagcaccatagaatagaaggtggtcaaggaactgccagtaattcagtttaggaagagaatcatatgagataaggtagtttaaaagtgagaaggaattagtctgcactcaagagggaataggtaaggagaaaaatgaggaggaggtaaaaatccatgggacttggcaatctgatcaaagagaatactgagggttttagcttggattgatttttctaaagaattcctaaacaactttttaccttatactttaccattagggctgacagatgattataggctagcatttgtctgtgtcattagatgctcacagtctcctttaatattttaaatactgctcctcactcaaaattaaatacccattcagttatgataagaagacagaacaggccagctcagtggctcatgcctgtaatcccagcactttgggaggcccaggtgggtggatcacttgaggccaggagttcaagaccagcctggccaacatggtgaaac

SEQ ID NO: 49247 - DNA, 1023 bp, Homo sapiens
tagtttgacactaaattactgtagactgtaactatgaaataaaacctcaacaaatgaataaatgtccctagtgggggtaattcaggaatgtgtactgtgagttctgactaattacaggatagttttaaaatgttttgaacaaaaacaggattatggaatccacagagtagatgagactttaaatcccctcatcttaatccttggtttagccatgaagaaaaaaaaaagacctgaaagaggttaagtagtataatagtaggagtaaatgtaattttaaggttatacctctttgaaagggtaaggactcttaatgtaaatttcttactctcgcctcaaaatgtaagtacacactgggacgtattttttcattctgctgtttttattagatgttctagaagtattgattgcttttatatatgaggtatatggcctgcatatgtttaggaagggctttctcaatcagtttaatctgctagcccaatttttaaccatatggtagaattcataatgctgttgattctctggtatgaataatatttattattccttatttttctttttcagtgagcatcaccagttttatcccacgttttaactttctaagcatagatctgccagtggttgtggagacatttgtcaagtatcctttctggtgtgaaacatgttttaaaagtgtgttacttggatcttgatcaattttaccttgaatacagcattacaaatatagacctcacaagtatcacttaattgctaacaactaaaaaagagtcttgaaagatgaaaaagatcagattgtacccaggagggaagaagtcagaggagaaagattaatcagagtgagaaaggtttagatgtagaagggaaagaacccagaatacaaattgagaattgaatttacaagtctaaaacattttagtaagtttataaaggatggaagcttcagttactactgaggtaatgaattctgccccatccgagattgttagttctgaccaaatagagaatgtaatcgcataaccagga

SEQ ID NO: 49248 - DNA, 1034 bp, Homo sapiens
gaaaaagcatgtttctatttaagtaagctgtaaaaagtattattgaatatttactgtaaatatatgttcacataaaaaaataacttggagggtctttgtgtccctggcatattatcatcttcatggaaagaatccactgtggtttctgtagagtgattggaaaaatggattattttgaggattgaagaaagtgttctttctgcgttgtcactttgttcaacagtaaaactttattctcagtgttcctactctgcattgtttacatttttgacagttttttttaatcacctacaatctgtaaagaatgtatatattcttttcagcatctcagtttgaaaagacatgcagttaaacttgaccttttgataatcgctcttacaggtcattgtctgttctaacagcaaattgtaaacatgtgcttcatagatattgtggctctcagtcatcactttgtcctatggtatttattgaatgttcacatactaatggtgcacaggtgtttttttctataaatcttctgactgtcctgtaattcattcttaagctttaacttgaaggtatcgtaattgccggcatttgatgtttagcaataaaagaataaatgtgtaccagcattttatgtttatcatcgtctatgtgttgtcttttttgaaactcttttctatcaaaattgttcctattacataaagcaagatcttaatcatttttaaattcttgattctagaaccagccttcagttttcattcgtataatctatacctgaaagtcgttgcaggccttgaaaataagtcttttaaatgaggctcctgtgcactcgctactgtcttggaaatggctggtttatggataaagaaagaggactatcatgtttcctttcattactgtgtctgacagaaaagtctgctgtcagttaggaattcttgaaagagaatgttttaactatggcatttggttcttcttgaccttttgccctagtgcttcctcccatactctctctctctctttctctctctggtagtaagggccagataaaa

SEQ ID NO: 49249 - DNA, 1056 bp, Homo sapiens
caagatcgcgccattgcactccagcctgggcgacagagcaagaccctgtctcaaaaaaaaaaaaaaaaaaaaaaaaaaaaaaaaaaaaaaacccgaccagaagagagaggcctgctaaagtcggaactgtgtgcaggaaatttgaaggggaaggataatttgcaggcttcttttctcggggtgcctctgtcgtggggggtgggagtcgcgggaaggatagaactgccctttctttttctggtggcttttaaacctgtgactgccgcagacttgaatctgcacttcccataggttccacttggagtgtctcgctcataccttgcttttcccactgttttcctcgaattggatagagcaggcttttctcttaccatttttaacactgttcctttctttctgaatttctgagtactcactttgcattttctcccgcaaatttaaaggatctccgaaggcacaagatctagtgaagactgaggatttggagcaacacctgggtttgagtctggcttcttcctgatgggctctgcgtgtggccttgggtttatgttaacctttctgagccttccctgtccattaaaaagaaaaaaaaaagtgtacacctcttcgggcttttactcttaagggggtagctgtggagcacactgtagggtttttaagcaatgtcagtgtatttaggtggtctgaagtgacttagagaaaacaaagcatgttaattttagttcccacatttcttaggtgaggatggtagggcatggagactgctagagatgaaatggtgcttgagtggtggagctgaagagccaaggtttcattaataaccctgccagccttagggctgaatggttaatgaaagctctagcatactgaatttagcggtgaggagaaatagtgtattagggtcacccagctagtaaggggtgagtctgggaagtgtccctgttgtgagcaccttgtgaacactcacctgtatttatcgtccatggattttcttaacttttttttttttttttttttttaattctgagatggagtctcactctgtcgcccaggttg

SEQ ID NO: 49250 - DNA, 1048 bp, Homo sapiens
ttttgtcaaggatttttgtgtctatactcatgagggatattggtccatagatttcttttttggactgtcttggtctggttttggtattagcataatactggcttcataaaatagggaggccttcccttctggaagagattgtgtagaattggtgttaattctttaaatgtttggtagaactctccagtgaaaccatctttgtctcaagatctcttttctggagtgttttttttcttgagagacggtcttgctgtgtcacccaggctgaaatgcagtggtgtaatctcaactcactgcagccttgacctccagggctcaggcaattttcctgcctcacccccctcccctcccgccccgcaaggtagttgggactacaacaggtacgcaccatcatcactggctaattttcgtatttttttttagagacagggcttcctcatgttgcccaggctggtctcaagctcctgacctcaagcagttgacgcaccttggcctcccaaagtactgggattacagacatgagccaccatgcctggcctctttctggaatttttaagctataaattcagtttccttaacagttataggactcttcatgttatttcatattcggtgagttgtggtagtgtagccggattggtaaggcatcagagagaccaatggggttcaggaggatatttattatttaggtgcaccggcccagtcggattaacattcaaaggactgagccgtgaacaaagagttaagttaccttttaagcatttcgtgggggcagggggagatctgtgcaggggggagcatattacagaagcaagaaacaaagacagttattcagttaattgagacatgcattacatcatttcttactttttaaggaaaaacatgttttacgacttgagtttgtctagtgaccttgcagctgcacagctagagaaacagggtcttcacaatgcctgggaaaggaggagagataaggctcactagccacagaaaaacaagcagttaatttttaaaggactccagctctttctctttctcagcgggaact

SEQ ID NO: 49251 - DNA, 1065 bp, Homo sapiens
tgttgagcattttttcatgtttgttggctgtttatcttttgagaattgtctgttgcccatgtcctttgcccactttttgatgggaatatttgttttttttttttttcttgctgatttatttgagttccttgtagattctggatattagccctttgtcagatgcatagtttgtaaatattttctcccactctatgggttatctgtttgatgattatttctttggctgtgcagaagctttttagtttaattaggtcctatttatttatttttgtttttgttgcatttgcttttgggttcttggtcatgaattctttgcctaagccaatgcctagaagagtttttctgatgttatcgttatcttctagaatttttatggtttcaggttttagatttaagtctttgatccaccttaagttggttttttgtataaggtgagagatgaggatccagtttctttcttctacgtgtggcttgccagtggagaaaccaacttctgagtcttctccgttgccttggcaaccttgccgtaagtgggattctgaaggctcagcgtgttagtttgggatttttggggaacagctttattgagatatgattcatatgctatataactcctttatcgaacatgtacaattcagtggctttcaggatatttgcggttgcgtgaccatcatgacaatcaactttagaacattttcatcacctcaaaaacaaaccctgtgccccttagccatcacccttattcctccccgcattcttcccagcctctggcaaccactaatctgctttacatctctatgagtttgccttttctgttttgttttttgaggtaaagttttgctcttgttgcccaggctggagtgcaattgcgccatctcggctcaccgcaacctccgcctctcgggttcaagcgattttcctgcctcagcctcccaagtagctgggattacaagcatgtgccatcacacacggctaaggatttgccttttctggacataacaaatagaatcacttatttcacttagcatagtgtttttaaggtcctaccgtgttgtatggagcgtg

SEQ ID NO: 49252 - DNA, 1027 bp, Homo sapiens
aagggacattgtgcacaacctgagcctggctgtcaggttatctgacgttaggatctggggtttaggggaaaggatgcctgcgtttgtgcttccccttgcgggggagttgcagactggctctattgccagccagctcgcacaccatcttcccgtggagagagtgcagatccctgaaaggagcaggcaagaaggggccgggtataagcctgaccaaaggtgggcccttggacttaggtggcaagtggtaagcatgggcggggaaggcgtgagtgactgtctgtgtgtacatccgtgtgtgtgtgtgtaggggcactgagaataaagtgtgagtgagggcttggagctctggaaatctcggcagttctttggtggctggggctgcagttgctggagcagtaggtgggctggaggttcggctttgggtcttatcacttggcatgatgcgatgatggggatgactaaacaccccttggagccagttctgggagagacctaggagggaaaggggcttttgatagtgaggtatgaaattttcagccttcataactaaaaatatgcttggcgagaatagaaattcatctcccaatttcacaagccaggtgctccttgaccatgagagagctgaaaggaatgtgaatgtaaatcttctgttcctttttttttttaatgtatagatcatgtatacaataaggtagattatcaaacatgtacagcagaaggctcatttcagatcagaagttctacattcagtgagggtggtagaaatgaaaacattttattcattttgcatgttgcctatattttctaattttaaaaatacacatattgcttctttctgtattaataaaagcttattttaaatgaccgtactaatacagtttgtactgtggttaaaatatacatgaccttgaccatgagagagctaaatcttctgttccaaccgcctcattttgcagaggacaacgtcaaggctctggcctgtggaatctgatggctctgcctgaggggaggggtgttgacaacacac

SEQ ID NO: 49253 - DNA, 1027 bp, Homo sapiens
gaggattactgttggatatttttttccagttataaaagcagcacatcctttttgtaaaacatggggaaaaaaaagcttgtcatttatattactcatcagcagtggacaggtatcccctttctagtaccatgtgtcctcattaatttatttaacctgaagtggaatctcatttgttgtacttgaatttatttgcatttctttaatttctgcttagggtgaatattttgttatgctgtctctaggctgaatatgtctacatccttggcgcagctatttgtggtcggcttttgtgttcttaccgtcgtgtaatctggtggtctgcgttgcctttccttgcagggtggagaatgtttatcgctcatgtcatgacaagggataagtgacactgacaactttgttcaggttttttaatttttatttatttatttatttatttatttatttatttacttatttatttatttttaagctcagtcctcaaactgtgcctcattggccttccttctgaacgtttctttctgaccatcttgccttcttccccttgttctccagctgatggtgagaccattctaaaaggcctccagtccattttccaggagcaggggatggcggagtcggtgcacacctggcaggaccatggctatttagcaacctacacaaacaagaacggcaggtgagcagtctccagtgctgttcttcatacctggtcacttatgagcagagagggtgacagagtggaggatgggggtggcatccggcatttttttttctcctttgacatcttttaggatgggaatggaacttggtgcttctcaaccgtagctgcacatcagaatctcctggtagcgttactgaccacaggttcttaagctctcatgtatatagagattgacaggaggccaaacatgtttcccagacaagttttttgttaagactgatgcccagagtgggcataagggaggcagcccaggaaaagttttgtggcttactcccccaagggcagctgcaggtgatgttttgaagggag

SEQ ID NO: 49254 - DNA, 1047 bp, Homo sapiens
agaggaaagaatgaaagaattgagtcaggacagtactgggcgggtgaaacggtaagtccactcttgaatgtccttttatatttaatcgattgaaacaatcatagttggctgggcgcggtagctcacacctgtaatcccagcaatttaggaggccgaggcaggcggatcacttgaagtcaggagtttgagaccagcctggccaatgtggcaaaacaccgtctctactaaaaatacaaaaattagctggacgtggtagtgcatgcctgtaattccagctacttgaaaggctgacgcatgcgaatggcctgaaccgaggaggcaggaagcagaggttgcagtgagctgagatcatcgcaccgctgcactcctgcctgggtgacacaatgagactgtctcaaaaaaaaaaaaaaaaaaaaaaaattcagaatggcagtgtggtccccagtagtgtctgcttaagatgtggaaaagatcaaactcagcacctccttctggcaacatggtgaactgaactactgggcccctcacaccaaaacaagacagtgtatgaacattcatgtgcatggatgcacacacacaaatgctaggtaaaatgaaactaaggcagaaaggggatatggaccaactccaaggagttggaactgcctaaagtggagacccaggtagagctgccacctcatcaaagggagctagaaaactcctgacttcagttcgagaccagcctgaccaacatgggtgaaaccccgtctctactaaaaatagaaaaagtagccaggcgtggtggtacgtgcttgtaatcccagcttctcaggaggctgaggcaggagaatagcttgaacccgggaagcggaggttgcagtgagctgagatcgcaccactgcgctccatcctgggcaacagagtgaaactcgcctcaaaacaaaacaaaacaaatacctgacttcaacctttccaggaaagagaaaaggtcactttttctccttcaggctctaggccccagagtgaagttaagcaattttaagagacttccgacagggtggggtgata

SEQ ID NO: 49255 - DNA, 1028 bp, Homo sapiens
tgctatccttttttttttttttttttttaaatctggagaataaagatcagaggttaaatgttagagattaaatcattaacaaataacccagtaacattatctgaaattattcccctttgataagttaagtctgaattttcgactaagaagctatgggatgtacttgaatttatttttgttttctactttcaagtgaaaaaacaagaaaacaaggtcacataaattaactttgattttaaaaggttcttgcaatttacacagtatacctaaggcctgggctataatctacctgaattggtgtagtccagtttcatttttcagcagtgaaggttgaaacgagtttggtagggtgctctacagtacctcctggtagcccgttatagggctaccagcgagatgccctttaatgctaggttgagcacttcatcagggtaatggcatttacatcctgttaagatccttctttctttgctagtctttaaaaaaaccatagagttacaatgtaggaaagagctcttcaccttagccaaggcactattgacacaattgagaacaggcactgtttagtttcagtgggtttgcctgtagtgcagtaattgccgataggtggctggctgtcaaggagagggtagtcttcctcccctggaagtgagtgactttgtcgttcatccaatgccatgggtggctcactctcacctcactccccaccatcagccaggggtggaagaggcttcctccaagtcctgttcgcctgctctctagcagttgtcctgattggtgcttcacattttacaatttacaagaaaaaccctctagaatgcctcacattctgaaagctgaatttgttcacatggaaggtgaagaagtggttaaatgaagagttgtcaggatgacatgaatttatgggagtttgccttttcaatctcggtgttctttatagatgttagtattccctcatagaaagccttgttaacttgtaacaggtttagactgtactcttggaagctggtgagcagggaagggaaaga

SEQ ID NO: 49256 - DNA, 1127 bp, Homo sapiens
tgctgggattacaggcatgagcccttgcacccggcctatccattcactttgaatgtagtcatttcatatagtgaggtagattcagagagtttatttaaggggaaatataaatgccaaggcttggaaactggttgatatggaattgttgtttaatttggaaaagaacagtatacaacattcagtgcttgtcattaatcctatgattttctttctaaatagctgctgccatcttaagtaaagtaaatctgtctgtggatccttgtgataatttcttccggttcgcttgtgatggctggataagcaataatccaattcccgaagatatgccaagctatggggtttatccttggctgagacataatgttgacctcaagttgaagggtaagtttctactggggtttggtgatacactttatagagagcaatatttgacaggaaaaacatagtttgggatttgaagcatgacttctcactttttaactaccatgctaaattcatttccaagaatttttaaaatgaaagattgaaaggaaagtttgcagaattctggactcccagatctcaacataagactaatgtaggttgttatgttcatgtttggtaatagtaaattctactgccaaaggataaagagcatttgattgagattggaagcaaaggaatagttaatgaaaattatatcaatatactcatttgttgtattcagagtaaacttcatttcttgctcattgtgtcctggattttcatggcttacaaaatgtacttaacacctcatcatcttttgacatcacttttgagaactctggatgaccttgtggttgtcatattgttcttgttaacttctaagttggctctagggagattcacttttctcccatggccactctagcaatgacaagctcacacacacatactcacacgtggatgcatagaaacatacatatgttctcaaatacattcccctgccccccgccaaagttggaaatgtctgttattggaggatattctgttagcattggatctaatttttatgctaagctattggagaaggccacctcaggagggaagtaggaagatttcaaagccagataaggtaattattttgagaaggcaaaaatagtatggtt

SEQ ID NO: 49257 - DNA, 1027 bp, Homo sapiens
gcaaatatctacagtatttttcccttttagagatgtagcttccttagacatctgtagtggtaagcatttcccaaaagcatcttacctttctgaaccttagcagacatactgtgcagcttacctatcttctgcagaggaggaaactgagacctaggagaataaagtgactcactcaggtcacaccactaaagggttttcatcatttcagcatacctaagacagggcagtccaattttcagtattctcataagatggctattactcctctcaaaatgcatttccaaagtaggaacataggacttcgttggccacagggcagacatttttttagtgtctggaattaaaatgtttgaggtttaggtttgccattgtctttccaaaaggccaaataattcagatgtaaccacaccaagtgcaaacctgtgctttctatttcacgtactgttgtccatacagttctaaatacatgtgcaggggattgtagctaatgcattacacagtcgttcagtcttctctgcagacacactaagtgatcataccaacgtgttatacactcaactagaagataataagctttaatctgagggcaagtacagtcctgacaaaagggcaagtttgcataatagatcttcgatcaattctctctccaaggggcccgcaactaggctattattcataaaacacaactgaagaggggattggttttactgttaaatcatgtgttgctaaatcattttctgaacagtgtgttctaaatcagtcattgatttagtgtcagccacgtggagcacctcggcttaaagcagctccacaaaacctgacacaacacacacaccaattaaatggattttgttgagaatttaatcattcaatttggtcaaccagaatgacttcctgtggaactctgttttatgacagataatagttttccaacttgattgagtctctgtataccctgggatattgtattttttaatgaagggcattttcaaacttgtcaacttctcttttcagcacttgaaatgaa

SEQ ID NO: 49258 - DNA, 1038 bp, Homo sapiens
aatccccatctgaaatttagtgtttccttctattatgaatgtcagcaacaaactacactatcttcagcagcacttgcttgtacctttcaccaatagaatcacttattttcttgctacatatggttatcgcaggtatcctgaaacaccattttcactcatcattatcttacgtagttgtcagattacaactagatcttgcagttttgaagtgttatagagcacatgtattatgatatcaccaattttttttaatatttttataattgcatttaaatacaattggtttcttttgtaattctatgtattttcctttttgcattcaataacactcttttaagaagtctgtaagcttcaccagactgccaaagagatctaaaggtagccctgatttttagtgattttctaaagatgtccttctaccattccaccaactttctcagtgttacagaacatcatgtattttattttcttagtttccaagccagcgccctactgggaaggaacagctgtgatcgatggagaatttaaggagctgaagttaactgattatcgtgggaaatacttggttttcttcttctacccacttgatttgtaagtaatacatgtaaatagctagtaaaatctcagtctttatcaattatttttcaggagtatcaaacaaattattttgttcagctcttggtttttaaaaaggcaagctgaagtaaagaaatgtatttaaaaaggtaacatctaccatatatttcagagtcataacacaccgacctcaatacttatgtctacatgattatgttataatggaataattagaggaaagctacaatatattcattaagctatacctactaaggcaagaaaatggactgataatatattagaaagcatttaatagcaagacctatgccataattctttttactgtatctctcttgattagaaaattaattctgtaatcccagcactttgggaggccaaggcaggtggattacaaggtcaagagatcgagaccatcctggccaacatggtaaaaccccatct

SEQ ID NO: 49259 - DNA, 1028 bp, Homo sapiens
ggccctagaaatcgctctctgggaacaagctggggactttgattttgctagccctgcccctctgagcccttcaccaaacttccgcgcgggggcgcccgccccacctcccgccggggctcagcacgcggccttctcccagccaagagccccgtcataggtgggcgccgaccccgagccgatctcgctttattaaattacagaaatcggtattcaaaaaaaaaaaaaaaaaagggcggggaggacactccctcttctctgttcccacaccctagctgattcccaggtttcgggaaactccacaggaaacggaaatggtctctcccaggccagcgcgcgcgccgggttgcatcacccgcctcgcacgggccggcggggcgggggtttggtggctgccctcagtattgcctgcacaaatatctaccaggtctgcgacgaatagctccagcaacttcgcaccgtgttttccactcagcctaccgacaggcactgtgcagattcaagcggagagatgtccaagcagtgaggccgctgctgcaccggccatcctgagcccctactcggccttcccgtctccgcttccccgccccgcactaggacccctgcagatgatcaggcggcagccggggtgatttccttcctcttttggcaacatggcgggcggagaagctggagtgactctagggcagccgcatctttcgcgtcaggatctcaccaccttggtgaggttttgcttggggaggatgcagagtgagctcaggagtggaggtgaccgagcctcccggtggtattgggactagtcagtgtcgggagcatgggtcaggagcctgggtcaggagggagacctggaactgggcgccctaagccatgctcgcgccgcctgtacccaggccagtccacgatctgggcgcaggcgtgtacggtcgtgggacttctagcttctggagggttcggctggaaagtcttgatgttgattgtcatggtttcagcctctgaacgtctgggaagggggtgtcctgtctgcattactt

SEQ ID NO: 49260 - DNA, 1625 bp, Homo sapiens
aagagttgaaaaacactggcggtaagtttgttagtctttgccactgtctaattaaaaaaagacacagtcttgtacagaaaaaaaagcacacaatcttccttgaggacaacagttactgtggctttcagtctcaactatttatttggatgactttgaaaactatacttcggccgggtgcggtggctcacgcctgtaatcccagcactttgggaggcctaggcgggtggatcatgaggtcaggagatcaagaccatcctggctaacatggtgaaaccccgtctctactaaaaaatacaaaaaattagccgggcgtggtggcgggcgcctgtagtcccagctactcgggaggctgaggcaggagaatggcgtgaacctgggagtcggagcttgcagtgagccgagatggcgccactgcactccagcctgggcgacagagcgagactccgtctcagaaaaaactacaaccttgactatagtcccatattttagtccaaatactgtgattggcttctcttcctgttagacacaacctatgcaaaaccaaatgaatttgggttcggtatttctatcgtcattggctttggaaatcatttcacacttaatagaaaaattgtaagagttttacagaaaactcctctatagctttttcctagattgacaaacacacatacagatttatttacatatataagtttttttctgaaccatttgagtgtaggctatatatgttatgcttcttgatctcttaatacttcagtgtatatttcccatcaaaaaaggatattcttatgtaaccacttagaaatttaacattggcaaaatactgaaatctacagtgcatgtttcagttttattacttgtcccaataatgtactttatgttcctcctgtttagaatcttgaattgcatttaatttcatgtctctttgatctttaatctggagctttttcagcctttgtcttaattgacattaacagttctgaagaatacaaactagttactttatagaatattcctcaatttgggtttttcttatcattcggaagcctaacattagattcagttatatattcttaacttaaatacaccgtgaagtctccttttcaggaatcacagctagaggcacatgatatctgactgctcctctttgttaaggttagttttgactatgtagtcaagatgttgtccagcttctctgctgtgtagttactctctacccttgcaactaataagcaatctgtagggagatctttctagccagtacaaatagcctgctgatcattgaatcccacacccctggatgtagcatccactgatgattcttgcctgaatcgaacttgactataatgattacaaaatcatagcacctctacgggttgcagtatcctccctcaactctaccaccccacatttatcatttggcattctttctttgccattatttatttccctatctagttataatatggactcatggagtcctattttattcaacatgttatgatccatcactgtcttcctttattttgatgtgcattgttcgacgtttggccagtggaggtccttcaggctggctcttgtgtccttttgacatgtactcatcatttttttttcttcttcttttt

SEQ ID NO: 49261 - DNA, 3387 bp, Homo sapiens
ttttttgtagacacttggtctcactgtgttgcccagcatgatctcaaactcctggcctcaagccatcctcccacctcagcctctcaaagtgttgggattacagacatgagccaccccgcccagccctgtttcctttattaaggcttccatgctactgtgcccacgatggtctcatcacttgtccaggagatttatctgaattattgccctgtaatttagaaagttaaatttttgttgtctcttaagtaaataattatttgtggtgacttatgcccttttgattttactgtcttttgtgattatatttttttgctattacagacacacgacttccagtgtattttgaaatagatttaagcaataaactttcagtccaggcacggtggctcatgcctgtaagcccagcactttgtgaggccgaggtgggcggatcacttgaggccaggagttcgcaaccagcctggccgacatagtgaaaccccatctctactaaaaataccaaaaaatcagccgggcatggtggcgcatgcctgtagtcccagctactcgggaggctgaggcatgagaattgtttgaacccaggagccagaggttgcagtgagccgagatcgtaccaccgcactccagactgggtgacagagtgagactgtctcagaaaaaacacacaaaagcaagaataaaaaagaatctaagaatatagtgtgggctttctttatggaggagcaggctttgggaacaaatttgaattcagaagataagcaggtaaaatttatcacaagattgtgtggtaatgagagtgaagtggatgtaagatttatgatttcttttattttcattttgcagtttaattggttggggtcagataagaagaggagtgacaatcaagccaacagtagatgatgactgaagaataccagttaaataatacattcggatggatttggaagttggaattcctcttaacaaccaaggggtttattttcaaagcaatattggggaattgatttcacagttcgttaccttagtaggtaacggtaaggttattctctttttttttttttttttttttggttatgaaaacttagggactaaaattaatataaaaattggcataatgttggattgaatctacattttggcagaagttaaacattcccacataatgtcaaaattatacatcatgcagttctgtttttttgtttgttttattttgttttgtttttgagtctggctctgtcacccaggctggagtgcagtggcgtgatctgcaacctctgccccccgggttcaagcgattctcctgcctcagcctcccgagtagctgagattacaggtgcgcgccaccacacttggctaatttttgtattattagtagagacggggtttcagcatgttggctaggccggtctctcctgacctcagggtgatcagcccacctcggcctcacaaagtgctgggattacaggcgtgagccaccttgcccagcccacatcatacagtttgaaatgaaactttgccacaaccagcctttgctgtagcacacacatatatcactgaacctgtttgaaataaagttttttttctttttcatgattcgtctttgagtacctccaggctgaaagactgttgtaccagtaaaaacttaaaggcacaaattctccttgaagaccttctcccttttatgtggccccatattttatgttgctttatctttgaaattttgcatgaaaaggaaatgaatggattcgaatgaaattgtcctttagagcatgattacttgttcccatggacaaatatttttctccccttgctcttcctggcctgaaacacgggaaaccagagtcaaaagttatctccctctccctgtgatgccttgagatttttttctgcgttgtttaatgcctgaaatccaagtcttcctccatgggaaaatactgttataccaaataattctagatgagtaacaaagatctttttaggccttcattttatgttttttcttaactgttatattatgattgtgacatagattatactactactaatttttggatgtttcaaaaggtcaagaagtaaaagatgttagaaagcaatgagtgagtccttttgatttttaacttattccccatgtccctatacttcgtgtgcttttcctttttttttttgagacggaggctcactccgtcacctaggctagagtacagtggcacgatcttggctcgctgcaacctctgcctccctgattcaagtgattctcgtgcttcagcctcccatgtagctgatattacaggcacttgccaccatacccggctaatttttgtatttttagtagagatggggtttcaccatgttgcccaggctggtcttgaactcctaacctcaggtgatccgcccgcctctgccttccaaagtgctgggattacaggcgtgagccactctgcccggcttatttttctttatgtttttgcttcgtaagaggttctgttgagcagtgatttgcaactcttgctgacgttgctggggaagctttaaaaaaaaaaaagatgccccacagagattctgattttaattgttctgatttaattggcttggagtagaattcaggcattgatatctttaaaaactccccagtgttgagaaacaaatttagagagttgagaagtaggtatattaaattacagaatcttactgagttttggtagactgataatacaatttgctttgcttttcttaaatttgcattgagatgggatttgaagcatattgtgctcttgtgaatgttgaagttgcattgtagaagtttagaagctctggctatgggttgcctaaattgatgttttgaggaagcatattaatgttataaacttcgctgactttgaaggttgtgttgtagcatgaggaacacaaataaaacaattctaaatcaaactaattttatatctaacatgtccccatgtgttttgtaggtaccttctaccagaaattttggaataagacttaaaatatagacattgtaattaatctcatgtaagatttgaaaccagaattctattataattaatttcagacatccacatgaattagcaaatttgtaaagcactgtactgagtgtaatgggcatatacagataggaagtaaatggaccttattttaatagaacttgaagccagagcagtgattcttagcaagagatgtacctagttgagaatgtgcctgtaatgtttctcatgaaagtacattacagccaggtgtggtggctcacgcctgtaatcccagcactttgggaggctgaggtgggcggatcatgaggtcaggagttcgagaccagcctggccaacatggcgaaaccctgtctctactaaaaatacaaaagttagccgggtgtgg

SEQ ID NO: 49262 - DNA, 1023 bp, Homo sapiens
gtctactagagggtgaagggagggaggagagagaggatcagaagagataactattgggtactgggcttaaatacctgggtgatgaaataatctgtacaataaacccccgtgacagaagtttacccatgtgacaaacctgcacatgtactcccgaacctaaaataagagttttaaaaaaatctcaacaaaagggaaaaaaggaataaagaaaaaaagtatttttatgggttaataagtgcttttaaatatctcagttttaatttctagtatgataaacatctatagatacgacccacgtaaaaactctttgtggttcttaatttttgttttttgttttgttttttaaattttattgtgatccttaatttttaagagtgcaaaggagtcctgagaccacgaagtttgaaaactactgattccattcattttatttgtatttcagtgtataaataaatatactgtggtttatttatcttttcttcttggagggaccgatagaaactgtttgcagtttctgaatttcaaacactactgctatgaacatccttatacatggtttgtctttcttgggattatatacatatagtagaagtagaattgcttcatttaagaagtctgtgcattatcaactttactgggaattgccaaaatggcaaattgtcttctatttgacactcccgctgtgtttgatcccgtttctccaaatcactgccaaaggattagattttgcaattttttcccaatctgttgggtataaatggcatctccttgctattttcattttgcatttctaagattactagtgaggttgaccttttttccccatgtatttatcggccatcagagttttctattaattgcttgtgcatacctttggttcatttttctgttggattgttgcctcctccttattggtatatgggttttatttatttatttatttatttgagatggagtcttgctctgttgcccaggctggagtgcagtggcacgtggtctgggctcactgtagcctctgcctcc

SEQ ID NO: 49263 - DNA, 1096 bp, Homo sapiens
tcaccaggctggagtgcagtggcatgatctcggctcactgcaacctctgtctcccgagttcaagtgattctcctacctcagcctcccgagtagctgggactacaggtgtgcaccaccacgcccagctaatttttttgtatttttagtagaacggggtttcaccatgttggctaggatggtctcgatctcttgacctcgtgattcgcctgcctcggcctcccaaagtgctgggattacaggggtgagccaccgcacctggccctaaaattttctttttattattattttatttttcttttagcggcagggtctcaccctgttgcctgggctagagtacggtggcatgattatagctcattgtaacttcagactcctgtgctcaagggatcctcctacctcagccttctgagtaccttggactacagatgggcgccatcaagcccagctaattttattttttgtggagacggggtctcgctatgttgcccaggctggtctcgaacaagtgctcctcccaccttggcctctcatggtgctgggattacaggtgtgagccactgtgctcggtcaaattttaaaattttcttgaatctctaaatccagtggggatgtgtgtgtgtttcttaacaacttgggatactcttttaactcgtttggtaatttcaatttgataatgataaatgtaaggtttataattctttcttccttggaacatgaaatataagtaatatacttgaaagagactaaactctttggagaaaaatgtgcagtgtttgttcacttaatcttgccacaggcaaacctaggtaatggactaagtggtagattgaagggctattgcgttttagtcttgattgataacacttaatggtatttgtttatctttgagcaagtcacttaatctgccagggcctccgttttcatatgtcataataataatgaaacctctcattacagtttttcagaacacttcccatacattcccatttgatcatcaccacagtcctgtgaggtatgcatggcagatactactgtcctcattttactgatgaggaaactgaaactcagaggttgaatgacttgcccaaggtcacaa

SEQ ID NO: 49264 - DNA, 1030 bp, Homo sapiens
tgaatcagtgtcatacattcataaaacaaactcggttaattagaacttggttatgttaagacgaatctgggagaacagaaaacagtttttggggtcccttcagttggctattggtccgtatgcatctagcacattgtaggagatttagaaattgtcttcccacccgatagctgccttgtcacctcattatggtgctccatcccctgtgtgcttaggtttttacctttcatctttctctttgccattgatgtttgtattcaagagttatatttttagggttagaaatcaaaatatttggtgtttggcaaacctctgaagtgctagactgatttagtctagttttaaaccaagtgctttaggcaggtgtgaactccagcccaaatgccagtcaaagtcaaggcatgggttttcctagcctatcttataggaaattcctgtaccttcttggcccccataatgtgttttttttttttttttttttttaaactaacttacaattttgtgatccgtgattcattgccctgcgattcttgaaagctctgtctgtttttttgtgagaacctttaaaatctcccttaatttttattttcccagaaataatgtaaaaacacttaaatgaaagtggaaatgtattaattttaaatcctataaaattaatacagaaaatataaatgattgggtcatttaactatatttttttaaataaactgaaagataaagaacacaacacttcacacattttatatttctcttacatactccggaatcatacacagttctttttaaagcacaacattaaaacctttaaaaggtatttaagggtttggtcaagtgaatatgataaaacatacttgtctgtataaagagaaaatgaaattgtagtcactgttatgtactgacattagttacaacctagttttaattcttaaaacaattttgattagcaaagctaaaaaaaaatggatgtttcagttaaatgttttaaagaggtacagatttttacaaggacataatataagttattgttctg

SEQ ID NO: 49265 - DNA, 1108 bp, Homo sapiens
agccactgtgcccggccagcattcttgtatattaggacagacatgaatgtgattttagtagtagtgtataggagtctatagaagctggaaagaaagaaataacttttagtcttcaagagaaaaatcatctatgccagcctccgaagtcacactgtctgaggactttctgcagtgatggacatgttctgtgtctctgctgtcccctatggtaatcagtgaatattgagcacttgaaatgtggctagtgggactgaggaactgaatttttaatttaatttaattttgataaatataaacttaaatagccacatgtggttagtggctaccaaattggacaacacagaaaagtatgcaaaatatatcttaatttgggaagaggactagagggtttacataggtttacattttactaatatgcatgatattgggcctgtgtacacacaagttgatcgtatagtatctgagatttagacaacctgctggtcattgtctgtgatggtggtgaacgaggaggaagaagaggaagtctgggcctgtagtcaaaggaggtgattaaaggaccaaggacagggcaggaggaaattggtgaagaatatgatcaatcaatatacaggtacatacagagcacattctgtcctagggagaagctacaagtggtatgaaaagttggatccactcccaaagggcttactatgtctggggtgagacaagatacggtcacatgaagtgcgtggtaaacaagatacgccataatgtcacagttatgccaaatgccataatttcaaagttatgccaaacatcataatgtcaaagttatgtcaaatgccataatatcaaagttatgccaaacagataaatacaatgcatctccaagaagggagaaatccaccttggccccagacatcagaaccagactgcctggattgattgctggctctgccacttactggttgtgtgaccttgggcaagtcacttgctatctatatgctcagtttcctcatgataaaatgaaatgataaatgtgccaatattatagggttgccatgagcattaaatgacatatgtgagagtgcttagaacagtgcctggaatacataagtgctaatta

SEQ ID NO: 49266 - DNA, 1028 bp, Homo sapiens
gatcttgctctgtcactcaggctggagtgcagtggcacaatcatcgctcactgcagcctcaaactcctgagctcaagcaatcctcccacctcagcctcctcagtagctggaactacaggtgcacacccccatgactggctactttttcaaactttttttagagatggggtctcactatgttggccaggctggtctgcaactcctgacttcaagtgatcctcctacctcgattcctaagtagttgggattacaggcatgagccaccgcacctggcttgggttaatcttaaacatatgctcttctgaatccagctgagttcttagttgccaacattagaatccactttcactagtttaaggagtttattaaaaatactaggtagctttcagagcctcagggagggccagagagccaggcttggaagctacacagccagacacagcacagttagagaaataggcaaagctcctaactacttcatgttcaggtccagaggaacttccatgcttcagtacttatggctctagatacactacccagctctgagtccctggcactctgtgccatttatcaactttatttatttatttatttatttttttgagatggagtctcactctgtcgcccaggctggagtgtagtggagcaatctgggctcactgcaatctccgtgttccgtccgggttcaagcaattctcctgcctcagcctcccgagtagatgggactacaggcatacgccgttgcgcccagctgatttttgtatttttagtagagatgggttttcaccatgttggccaggctggtcttaacctcctgacctcaagtgatccacccacctgggcctcccaaagtcctgggattacaggcgtgagccactgcacccagcttaccatttatcaacattaaaaaaataaatttgtacttgaaactttacaatagtttttgatacataatgagctaagaaatgtccttactaattgagtccatttgaatcagggctttctgttacttgcagccaaaattatcc

SEQ ID NO: 49267 - DNA, 1050 bp, Homo sapiens
agttccaaacatgttcccagtggcacttcttatcaacactgcactttatggcatcaggaaagcctttagcatgactgggaagtttgtaaagtttgtcttcccaagaccataggtataggatgtcatggcaaaaaaaagtgggattttcagtcagacaggtctcagctcaaatcctagtcccattatttattatttatttactggccatgtggttttaggctatcgcagtggccatgaaagtgggccactcagaccccctgctttggaagcatagttgatggcccagctcttgcctctccagaccctgaccatccagatcattgcatttgaacccaggccatgctccccggccaatgactaagcacagtcacttgcacaggctatttctgggagatgtgggattcttccaacaggccactttggctcaagacctggctgagactttcctagggctggctgcgaccccagacacttccttcagttctgcttccttccttctctcctccacaggggtcagactggcatctgacatcagatggcatcaccatctgaaaatcccccttcttcattcccctgctctttctccttgagcttcacagacatttctcccaccaacatctctcacatatctaatcctgtcttggcctctgcttcccagaggacctgatgaattaacacagctactcacctagcctttctatgactcagtttcctaacctgttaaacagagagactataacctaccttgtcttgtgattatgtgacctaaatacagatggaggagggtggcagcatcattccatatactacctgctagttgagattattttgttattctttggatcaaaaagaaatacaacagaagctattatcttttcttaccctgctccagtgagacaccttgaccccctccttgagttatgcaccccctactttgaaggccactagtttgcttgcattcagtccccatttctccacttatccttcaagagcctctctgccctgcacccacctccctgtacctgcccaatctctccaaggcactctgct

SEQ ID NO: 49268 - DNA, 1036 bp, Homo sapiens
cacccgggcgtctaggcgggtctgtgcgccgcccgggcgaggatgcggctgttccggtggctgctgaagcagccggtgcccaagcagatcgagcgctactcgcgcttttcgccgtcgccgctctccatcaaacaattcctggacttcggtgagtacggggccaagggtccccatgggcccggggccgccgccattcgggctgccaccccggatctccgcagcttcggggtaaagtctgtgggaaccgcaggcggggctagggaatatccggggggctctcctggggctcggatttcggggcgcggaggggcagggcctggccccctcgcacccagcctgggacttacccggagacacagaaacggcgtctcattgcaggaccctcatcgcaggcgagactccccaaacctgcggtcgttagcttcaaatctgcttgacacaaacctcacagcccttaaaacttcagaacgagatgtgggtggctttttaatgtttttatttttagaattttttttttttggttgggtaagaactgtttagaaataccttgaggttgaataaattatgcaatggcattttgttccttttctgctctaaggtgttgctgtgtggctggagtggcaggactcgaactgttgtcttcatcaggttatgttaaatcagttagaggcctggcctgcagacgccttagatgcttgggaagagcggacgtctgggatcctagcatcagagcagggtctaatacaactctggctttagtgccagcacctttcgtttctcttctccattggtgtcccacccacattctccctgtccggtgggctggtgggcggctttcacggattgaggtgggaccaaagaagattcgggttcccagcctgcctcaggcctagctgagatgggaatagattccaccaccttctgttaactgaatcatgtttccccagaaaacgaaggagctggttgtgaaacacctaaaagtaaaacgcatgcattgaggtatcagaatggaactcagcatccctggaggaaaatc

SEQ ID NO: 49269 - DNA, 1042 bp, Homo sapiens
caggagtttgaggccagccctgggcaacatagtgagatcctgtctctaaaaaaaataataataataaataaataagattagccaggagtggtggtatcgcacacctggggtcttagctactcaggaggctgagacaggaggatggcttgagcccagattgaagctgcagtgagctgtgtttctgccactgcactccagcctgggggatgtacatgtataggtaaatacatatataaattttattgtgtataattaaggtatacaacatgatgttatgggatacatatagttaaaaggttactacagtgaaattaacatatctatcatctcacatagttacccttttttatttttgtggcaaggtcagctaaaatctactcatttagcatgaatcccatatacagtacaattttattatctattatatattcttcatgttgtgcattagatctctagaccttaaacatttacagaagtagagagaatagaatgatgaactcctgggtttgttttattgatatccatttgctatttgtctgtagatgttgtatgtgtggtctgttagattttctgatcaaagtcatgcttgtttcaaaaagataaatttttgttttcaaaaagataaatttttttcttttcctatgctaagactaatttatcttttgaattatctggttcttaaagatttggtagaacttcatatgaaagtgtttaagcctgtatgttttggggagttttgctctctgatagctttctctattctgtgttattgatctctgtagattttctgtctcttctagagtccattttgatatatttttcttgaaaattatcctacttggctaggcgcggtggctcatgcctgtaatcccagcactttgggaggccaaggcaggtggatcacatggggttgggagtttgagaccagcctggccaacatggtgaaacctcgtctctactaaaaatacaaacattagctgggcatagtggtgggtgcctgtaatcccagctactggggaggctgaggtaggagaattgcttg

SEQ ID NO: 49270 - DNA, 1031 bp, Homo sapiens
tttttggcctggattcgtccttatttgacattgagatctagttccctattttcttgtttacatttcctgggatagcattgccatccttttattttcagtttttctgaattacttcgctctaaatatgtctctaaatgtagtgtaaagttgggttttgctttgtgaatcagtctttttcatgtggtaagtttaacctatttatacttactggtatgatagatctgtcatctgtaatgataagcatttgtaattttctgttgctttctgtttttaatacctcagttttcctatgttatatatttgctttgttttgccatatttattttaataaataactaggcttgaatttttggttctagtggttatctttatagttattactttatttctatagacctttgtcccatatgggtcaccacttgtcagccaggagacctttgagcacttgaaatgtggctagtgtggccgaaaaactgaattgacttaatttaaatttaaaatggatacttgatgcagttaatttttacatctgtgtagaataacttggatatggaatccactttatcacctgtaaattttaggaaatctctttataggtcaattatttctgatagaaatttagcctctgaattgagatgtgctttcagtataaaatacacactggatttcaaagacttaatataaaaatagtaaaatatcagtacatcttatattgattgcatgttgaaatggtaatattttagatatgttgggttaaatggaatattatcaaaaactttatttcttttttatgttaatgtggctactaggaaattttaaattatatatatggcttacatatttctttctttcttttttttttttttttttttttttttgtgagacggagtttttgctcatgttgcccaggctggagtgcaatggtgcgatctgggctcaccgcaacctccgcctcccaggttcaagtgattctcctgcctcagcctcccaagtagctgggattacaggcatgcgcctacatgcccagctaa

SEQ ID NO: 49271 - DNA, 1055 bp, Homo sapiens
agttaacttgattattagtttgattgtttacctactgatttgcaatgtcactttctcaatatgctcgatttttatatatacatactcactcatgggcctggtcctaaactttttatttagttccattgactgacttgtcttataccattcttaatgtattttcccatatgcatatttacaataagatgccagatacttgaatagtttaatttcctgtgttctgtctgcatttcatcactgtattttactgctgcgagatatttatttccaaattttactcttaaactgtatgagacactttaggaggctgaggtgggcggatcacgaggtcaggagttcaagaccagcctggccaatatggtgaaatcctgtctctactaaaaatacaaaaattagccaggcgtggtggcgtacacctgtagtctcagctactcgggaggctgaggcagaagaattgcttgaacccgcgaggtggaggttgcagtgagccgagatcacaccactgcactccagcctgggtgacagagtgagactccgtcaaaagaacaaacaaacaaaacccaaaaaacagtgtgacattatttctttattcatggaagctattgctttgagattgctttaatcagtccttggagattttgtggggattgtcctcatgttctcagaagaagtactgatatgttctgcaattctttattcaacttttatagaacctgtgttatatgcaatcacttatccaaaaagtctggattcctaaaagggtatttgagcattttttttctgtactagaaccttttactttttgcacttctgaaagaagggtttctgtagaaaaaaagtttcaagcaaaaacttggctcatactttagtttcttgtgggtggttccttgttctatgtagtaagaataatgtctctacttataaaaataccagcagacaactagtctggggacagagctgggaagtctgtgcatcagcccatgagatattaagactgaccacgttttgtttccctctcacacagctttctacaagttctgattaaagtcagaaat

SEQ ID NO: 49272 - DNA, 1732 bp, Homo sapiens
gtagaacattttgtttttttctttctttttttttttttttttttttttttttgagacagagtctcgctctgtcgcccaggctggagtgcagtggtacgatctcagctcaccgcaagctctgtccttcgagttcaagtgattctcctgcctcagcctcctgagtagctgggactacaggcgcatgccaccacgcccagctaatttttgtatttttaatagagacggggtttcaccatgttggccaggatggtctcgaactcctgaccttgtgatccacctgccttggcctcccaaagtgctgggattacaggcgtgagctaccacacctggcctgtagaacattttcatcactccagaaagaaaccctggacctgttagcagtcactcccttctacccttctctttagccctagacaaccactaatctactttctgactctgtatagattttcctattatagacatttcatataaacaaaacaatacaatatgtggtctttggtaactggcttctttcactcagcataacattttcaagggtcattgatgtcatagcatctttcagtactttattcctttttatggctgaaaaatattccattgtatgaatataacacattttatttttctcttcatgttagttgggtgatctcagacttgattaagtaacctctttggggctcagattcttcatctgtaaaatgatgctcttggtaattcacctatattgtagagttaaatgagttcatatttgtagaacccctaaagcaatgctagtacacagtaaaggctgtagacaggtttactagcagcagacagtccttgggtgtcagacatgtcatttggcttcccatgtacgccattgattatataataggttggtgcctttattttgtttctggcataaattataaaatattttttaaagtcatttcaggcttttataagacaattggaaatttgaacactggatatttgacattaaaaatatgttaactttttaggtgtgatattggtatctggtcttgtttttataaaggagtgctagctttgagagaggtatttaaaaatatttacacatgatatgaaatgatgtgagatttgcttcaaaattatacacagggaggggagtgaaaaggactgggcatttgttgaaaattcttgaggctgttgatgggcacatgggctcattatactatgctctgtacttgggtatgtgtttggaattcttcacggtaaatgtatgagtctgttctcatgttgctataaagaactacctgaaactgggtaatttatgaagaaaagaggtttgattgactcacagttctgcaggctgtacaagaggcatggcttgggagtcctcaggaaacttacaatcatggcagaagggtgaaggggaagtaagcacgtcttcacttgatggcaggagagagacagcgaaggggaatgtgctacagacttttaaacaaccagatctcgtgggaactcactatcatgagaacagcaaggggaaaatctgcccccatgatccaatcacctcccacaaggccccaccgccaacactcaggatcactattcaacatgagatttgggtgagggtgcagagccaaaccgtatcaatgaagttttaaaaacacttgttttcatcatcttattgtttctgcacaaataaagtctttcactaatttttagggagcttttaaccaagaaccagtacaactagataagtagc

SEQ ID NO: 49273 - DNA, 1089 bp, Homo sapiens
cttggaagtttgtgttcagctttgtgctttcacgtcactaggtggagatgtagcattgtttggcggcataggctaagcaagaggagtgagtcttgatttctcttcttttgacaaaagtactttacagatatttgataaggtttattatagcctaggaaaacacttgtaaatttagtacaattcaaaatttttaacttttttttcaggattgaagttcaatcctacttaagtgtctattttcatactgatcaactcttttaaacattttttttctcctcttactgctgtttcctttttgctgtccctcattatttcaccttgtctgagttattttaatgtctctatctttggttctttatagagatttaattctaaaagtttagtaaaggaatcagaattcttactctgaggtcaaataatagataattaatttggtagcaatatgaagtcaatgaactaaaatttatagtctgaacataccctaatcttatctttgtattattttaggttaataatgtcaatttttaacattaacattctgtagggcttacttttccccctttgcttccttccttctttctctcacctcttgaatattaaacaagcacagtatttactttgcacggtattgatgtggggaatataaaggaaataagagcctgtcttcaaagagctgataatcctgttgagaacattccaaatgcgcccacgaagcagcagttttctactcctaggtatatacccaagataaatgaaggcatatgttcacacaaacatttggacataaaggttcatagcagcactattcataatagccaaaaagtggaaacaacccagatgtctaccagctgatgaacggataaagaaaatatggtatacttgtacaatggaatgtgatatagcaataaaaagaaatgagatcctgatacatgctgtgatgtagatgatgcttgaaaacatgctggtgaaagaagccagtcacagaagaccgcatattattccgtttatgtaaaaagtccagaatagcaaatctatagagataaagtagatccatggttgcctagggctgggtggaggggagtaactgct

SEQ ID NO: 49274 - DNA, 2256 bp, Homo sapiens
ccctttacaaatatataattctggccgggcacagtagctcacgcctgtaatcccagcactttgggaggccatggcgggtggatcacttgaggtcagaagttcaagaccagcctggacaacatggcaaaaccccgtctctattaaaaatacaaaaattagccgggcggtggtggcgggtgcctgtaatcccagctacttgggaggctgaggcacgagacaaacccaggaggcataggcagcagtgagccaagatcacgccactgcactccagcctgggcgacagagcgagactccatctcaataataaataaataaataaaagtatacaattccatattttttagtatattcacagagttgtgcagcccttcccactaactttagcatattttcatcaccccaaaaagaaacctcatagtttttagcagtcactctatatttctaaccagagttttcactgacagtaaagaaccgttttaaagtatatataagtaattaaatggtcattctatttctgtagtaattgtagaaaataattctgagatatggcaagggtttttgaattatcactataatgaaatactctaaaagtcctggtcaaaacagaggaggttgtactcacaaactcactatggatattctcattattttctttgtagagacaagatcaagactaatagaactttctagaggactgaatgctgtggtcctctctgtgaagaaagattgccttctgcaagtcaaacagagagaactgctttctcccacctgctctgagcgtggcatcacagttattcctagtgcttaaatgtgtattttctctctaccacctggactttcccaaagagtttttcctgtagctactccagatcttccactaaagtagtaactttttaatgacatcttgctgtggtgtgattgatgcctgtcaccgaagagcacagagcctccttacagctcttgtgccctcgtactctccatcttgttatcatagcatctgatgtcttcagtccttccaggattctgtgcgcctttcccattccagatacagcagatcgtactgttgctccttgtgaccaaataccatatttgtcccaaacctccacctagggccctgggaccctgaaagtggaagacatcaggtggccatgccctgatgatttagtcccagagccctccgtctctcccgtgcctccctccgccactctatgatttagacttttgccttcttccatctgatcggattctcattgtgagatgtggtgactttcatgttagatcttcttcattgatgccttggttttattttaaaattcatttgtatatgtctgttgattaaagcattcgaaatgttatcttagaatttttcacccaactgcttggtttcaaagatcttaagtgaaaaactgcctcctggtcaataccaaatttgtacagagtgtgaagtggagtttttatgcttctgtcaaacttccatccatctaatactgtacctgtgtcatattttattcctttgtagtcttctaaggaattggaagtttctgtatgatgcgctttactagttgtaaaatagactatcagagggaaaaggcctctctagtttatttttgaaaaatgctccaggtcttaataattttcattttcattcatcttagttttagaattgtcacctcagtctgattttcacaatcctttttgctaaaagttggaagtgggaattagcagacgatttgggataaggaaagaggaatgatgttatatttacccttaggaatagaagtgaccgaagaatccggattgaaaccagcatcctatatacagctccacaggatgtgcttctcttcatggtaattttccatatatatcatctactttgatttctgccccgttttaatgtccatataaatgtttcagtccaatttgtaagtgttgagtccactgatgtagaagttctgacttgtaaaccattcatcctgctttagtcatatgatagtaccgatgcaattagctcctctcccaccaccgtgggggatttctccctgagatgaggtgtgctttgaccagctgcatgtggcttgattgcattcctgtttctcttagttccactggatcttgttttcttttatttcgttatattacctgagctcagggtagttccgttcatctttagaaagagctcatctcttccatccttagaaggatctcatcagagaactcatatgtaatcaatcaggtaaaagaaatactgatgtactt

SEQ ID NO: 49275 - DNA, 1053 bp, Homo sapiens
taaatgagataaattgataaatgatgtaaagaaaattagttgggcgatggccaggggaggcctgtctgaggaaatgaccactgggctgagatttgaggtatttgcagagctggtgaaagggcatttcagcttaacgagccaagtactagcaaaggcctagagagaggaaggaggaggcctgtgtggttgtagcatagtaatcaagtgacaagattggtataaaatgaagctggagataaagacaaaggccagataatgtaggactttgaaagcctcgttaaggagtttgaatcttctaagagcaatggggtggcattggagggttttaagtacagggggtggtggtcacgtaattgggtttacattttaacaggaacagtggtttgtgtagagaataagcactgtggtgcatgtgtgcgtgtgcacacacacgtggagggatgggctggtgtagggtaatggggaagtgtggaagccctggagatcagtcaatccagggcagggctgctagttacttggaccctggtggctggagaggagagaagtaaaggcatttgacatgtcttttgacacaaacttgttaatggattggatgggggaggtgacagaaaggaggaatcaaggatgatttctaggtcatcttaatgagctaatactgtgaattcttgactcacaaaaagcccggaggctgttcggtattcttttgtgcctctttgagcccgtcttcattgtgggactgtgcattgcaagatctgtcagattaatgttaaatacagtatgcactcttaaacagagttgtctttatttagatcctttttggatctgtggtacatgcaaatagtgtatttttcaaagcggtttcctggaggctgtatctagtgaaaagagagggagtacctagatgtcagcaaagcaagcgtgtgagtaaattgaaggccacatttaccttaaagataaccaggcattgactttaattggaaaaatgttaatgatctctggcaggggtgggggcggtcagaagcattaatatgcttcagcttatcaaatatatat

SEQ ID NO: 49276 - DNA, 1033 bp, Homo sapiens
ctggtgctggagaaggcctcagagatcatctagtctagttatgcacttaagaaactgaggctctgaaagatataatagctctttagtggtagaagcttgggcttctcaccctcagtccactctgctgttctggttccgtggtacttctcaagttgtgttctctcctatggcacatcttctctgttattgatgccaacgggttaaataagatagcttaaaaaaactcctttaatctcagagtgttgaacactttcattgtgatagcaggtaatgatcactgagctttggtgaaatcaatgctgctaataaaaatgaagtactccaaaagaccctgttattgtttctcactttctaacagattctaagtaagtcagttgttgctgaatgctccataattatgaaaagaatcttactctttgcatatgggaagatatcctgtcttcattatgactttttcaaggttgaataatcctgactgcacctggtttcagctagtaactttggggggaatgtgatctttgtttaccatgatctttgttgtgtcaaatgaggcataaacagtgtcaaatgtgttgcatgaagtgtgatattagtttgacagtaaaatgagcttatttgaatctttgaatccaatattagggtctttatttttctttgcatagcattttgtttttccatctttaactgttgtgaggatgacttttaattttctgagttactgtgattttttttctttcttaatcttcccatagtccttccttccctctccctccccatccaccctccgttaccccctcaagctgaaagtctcacaactcttgtaagaattttaatcatctgcagaaatgaaaattcttagatcgtcttatttctaccaggatgtgtgaaaaaaggagtcactgatgagtagtctttcaaactggggtaattgaccttgtgaacagtagcctttgcatgtaccagaattttcttagtgtctcagataagtggctgtgttgagtggctttgttgattactgctgtctaattattca

SEQ ID NO: 49277 - DNA, 1051 bp, Homo sapiens
gttggagtgcagtggtgcgatcttggctcactgcaacctccacctcctgggtttaagcaattctcctgcctcagcctcctgagtagctgggattacaggcacccgccacaatgcccagctaattttttttgtatttttagtagagctggagtttcaccatgttggccaggctggtcttgaactccagacctcaagtgatccgcccgcctcggcctcccaaagtgctgggataacaggcgtgagccaccgtgcccagccgaatgacttctttatgcctgtttcttcatctgagaaatagggccctatttcaagagttgccggaagggttaaatccattaattcatattagatgatgagagcagtccttgccagatagccaacactcagtaaatataagctataattataatgctaattattaatctagcaagatggagttgcttaatatcaaatagtagcaaatcatttaatgcattaacattgtaaaaaattttaaatttttattgcccctcttgcatgcaaatatttctgagttctgtagtgtccaagatgagtccttttagcattttgacactggttgttttagttccaattgaaagaggaaagggtacctttttggcttcatttacctttgtgttccataaggattcttgatgattaaatacaagagcatgtattgtaatactggttagtttgtgaagtttttgtcttaaggattttttaaaatatctacttacccagccagtggaaaagaactatgcttttgagatacctgatgttccagaaaaatctgagtacttggaagttaaatactcggtaagtcaaacaaagaaaattactgggttttgcttgagaatgacatttttctgtttttgaactttcaactgactttcagttacgagtattggcagggcttctcaagcccacagttcattgaggtggatttatagtaatgaataattgaaatggataaaattaatttaagtatatagactacaggttacactgcctttctctgcttttgagtatgcatctttaaataaataagttg

SEQ ID NO: 49278 - DNA, 2430 bp, Homo sapiens
ttactaacagcttgatttgaatttccttattttttctccagctattggatcagtaacttgtttttcaaaaattgttttcaagaatagtgcatattgttaaagagggttttgtttttttttgttttttttttttttgccatggaaactaagttttattgggttggttgcctcctattcagctggttcatttttttttttctaggagaagtctggagtctatttgacatcttttttttgtttcaatggttgctctactgaggttgagtagttttttcctgggtcaaaattagactttattttctgatgtcattctaatagcctatcatagaagcttgatcaaagttttctgtgtgatgaggcaagatgccaaggaataaatatttacctatttgggaggagttatagtaataagaattggagttgggttgtgctatgcataaaattcaatggatgaaacaattccaccaagttctgcatatgtgttttatgagtcagtctccaaggaggattctgatatattccatgttgagagcttggccagttacctaagcattttgctgttttttaaaaaagggaataataccattgacctattatatttcctgggatctttttcagcccagaagcagagattaacttggcgagcctctcgtctggttttcttgggtgttaggaaagtaggactaaaacatgcagagaagggagtatgagatatgattgttgtgaagttttcccccttaagtgggtggaacacatggaacaaaatggtgatgagaatagcctggaaaatatgtagaagagagcaatcatgagttcatttcaacacgcatttattcacttcctctatgtacgtcactatgtgaacagctgttgtgtatggtaaggaacttacagtgtgtaataggggaagctttggtcaattttaccttttcagaaggctgaactgagtttctccgctgtatgttgcttgcggcattggtggtggtgggatttcctttgaggaagactgctaaaatcttccattctggcttcagtggatagatagcaaatgtttcatcaaagcagttttaacaactgcagggacttagggttctgtgcttgaccattcttttgaggtcatcaacatgaccagtggaagtatttgatgaccctcctaattctttagggttggggggaatatatttaagacagtttcgtttggaaacatgtactatatgattacctgaaattagactaagatgggtgttggaatctttattttttttcctttttacagttgtgtctaaaccaaaggactgtatttttccatatgctttcaaagaagtcattgagaaaaaggtaaagtgctcattatatgaagcatctgtttgtttggagcgagaaagaaaaggggggtggtatggactagtagaaaaaaggtgttttatattttattagattcattcctgccagattggactatgacatcgacccattaaaatgtattagacatacacctagaagcattatttaacaatgtttaaatgttttactacctgaaaataatgggattctgtactgtattggtggttggataggctcaaacccccctccaatagcttaattagaagcttctctaaaatgcatgatcatatgattcctgttttgggaaggtgttgggtagagtccctccccagcttgagggaagctaaatgaagttgggaatactgtggacgttaaagagccatgtattgacaaagttgacatggggttggccaaaatggatcagtgatctctaaattccagcgtgctccatgaagaagttttcatgggtccttaataaaatggggaggagtgggaagtagtataatgtagtgaatttttcacaaaggtaaatgtattcaattaaaagaattttcttttatggattgtatgttgtttcttttacgaagtgatgatattgatacgtttttaggtttgttttgttttttaatgtcttcatctgacaaaagtaagcaaccttgtcaggttctacttattttatttaattggcttgagaagtccagtagttgggaggtactgttagattaggctattatttgtgaagtgccgtgaattacctaaccaggtaaaatgacctaggaaaattccattagagtcaaaccgactttttttttgagacggagtcccgctttgttgcccaggctggagtgcattggcgtgatattggctcactgcagcctccactccctagttcaagggattctcgtgcctcagcctcctgagtatctgggattacaggctcgtggcaccacgcccagctaatttttgtatttttagtagagacagggtttcaccatattgaccaggatggtctcaagctcctgacctcaagtgattcacccgcctcagcctcccaaagtgctgggattacaggtgtgagccactgcg

SEQ ID NO: 49279 - DNA, 2050 bp, Homo sapiens
agtaaacatgtacaaatggagttatcgccaaaatattgacttagtagttgtatagtggtcacaggagtttattaattcccttggtttggtgcaaatcacaaaactaagtattttaattttatgagttcagtggatctctatgacatattcctttgaaaactcagggctcggaattgatttttctcttgacgatccagtatatccccactagatagcttgagctaataattcattgagctattttttgccccaattcctgagagtcataaggcaacattttgttttatatatcctctggcctttctagtttgtagaatatggaattccttcatttgtcttttttctaggttaatggatcaatcatattgtttttgttttttcagaggaatgtaggctataaatgcctatattttggatgtgatatgggtaatttgggtacattaaagtcttgcaaaagtgtttgccgtattcttccctacattcatttttactcttggataccttatctggcaactgtatagctagcatcctgagttcctgtggataggaagcgatatctctgcacccacttcccttatgatatttcaagacctatctttaaagttccaaaaagattctgtccacagtgttggactgtgacattctgtctcagcaccaggccctcagtcagcctccaataacaacagtttcttggaccccaaggagatgccatgaagcctgggaaacctggcctggcttcaggtgttagagccaagtctatgcgtgagaaatctagatgtaagatggaattctgacatgaatatgggtccctgattctaggtattataatttgtaagtgagacttcctcaaggcctttgggtcttctaatttaataagcaaaactgctataaatatctagtggtaaaatacatataaaattaactatgttgaccattttatagtatacagttcagtggtattaactacactcataatgttatacaaccatcaccacgatccatctctgtaactcttttcattttgtaaaactgaaacgctgtactcattaacttcccattccccggcccctggcaaccaccattctgctttttgtttctatgattttgactactctaagtagtggtatatatttttaattaagtttaataacaagtatatttattgatgtgaattattttaaacttcatctaatttttgataaacataggaaagtgaatcatgttcacgtgttggaaattacggaaatgaaaaatctagttgcatttttgagataatttctactctatatagttttgtttctttgtttttaacaagtttcttatttgaactatttagtggtattatatatttatcttgttgcatatcaattatgagtctaaatcagtagtgtttgaactcaatttttaaaaagaagctaaatgcagttcctgagttttcgaagaagtcttacataaactgtcatacaacaccaggcaggttctgtgtttttaaggaagcaaaatggaattatttgaatttagcttttaccgatcatatgaaaagtatgggacattaaatttgcattttcctccgagaccgtaaggcatgagctgcaaattaaaagatatcatatgagccttgcatcaattaggatgaaataaagtttattccagcaatctgcttagcagccttgttaatgtcaaggctaatgagtgctgctgatgaataaattcctgaagaagaaaggacccccaatcggaggtaagtgcatgatgtcttcaattagagactagaaaaagaaagggcaaagaaattctgtgcgtatgaagataaatcctctaatttgcatttgttataacattatcagctgccttctttttctgactagggtcataatatttatgggtttgaactggaagtactactgcagagaattaatgtgtgcaaagctcctcactggtccaagataggtcgactgaagcgatccaacatgccaaagcttggggtaataataattttcaaaatcttatttatctatttattttaatttgggatagctaccaaggaaca

SEQ ID NO: 49280 - DNA, 1005 bp, Homo sapiens
tgtaatcccagcactttgggaggccgaggcgggtggatcatgaggtcaggagatcgggaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaagcctctggtagtttttaaaatcattggttagaatctagggatagtgaacaaagacagcccatacatgttaccttcactttgtcattcctgaagtgatagcccttagggcaaggttgcatggttcagaaatcgttgagtgctatcatttaggaagaaaatgggaagaatgaatggaagggagttgatgttggttgtataagaacgcaatattgcttgctgatatcttgtaataaaaaaaaaaggaaaaaagaaggcaataaactaagtgctttctgtgttagttacctctcatgacaactccagttttattttatagacagtctcataggggtaacgtaacttgttctggatcatgtaagtagtaaggggaagaactgagatttgaacccaggcctgggtgactcttaaagccaatgtgtacttttcattctgcctgcttgcttcatgtatggaggttttggcagtttttgtatgaagcaccttcttcctaaacctgatactgctcagtgcttgaaatcttattttacttaaagcttataaataaaatggacatgttgcctcatcagataagttaggaatctgtacctttttcgtaatgttctctagaggattctgccactacagatcaaagttggggccactgctcttgcttcttttcttattcatatctttaaggtggtagagttgttattagcacttcatctgaacacttg

SEQ ID NO: 49281 - DNA, 1045 bp, Homo sapiens
acaataaccaccaaatttaactttaataggagaatatctttttccctattgtcatgaatggcaaagatgttttgtggtacacagagctagaaataatttttttttctttttttcttttttttttttggagacagagttttactctgttgcccgggctggagtgcagtggtgcgatctctactcactgcaaccttcacctcttgggttcaagcgattctcctgccttagcctcctgagtagctaggactacaggtgtgtgccagcatacccagctaatttttttgtatatataaaaaaacatttcaacccttcccaagtgtacagttcagcagtagtgttaagaatattcacattgctgtgaaggaattaatgtgaattttatctaataagttagttctgagtaggaaacatttttgacaaaagtgattttgttattagttataatgaaatggagcagtagtacttggtgttatgtaggtctgggtttgaattcagtgtgatcttgggctgcctgtttaacctctgtaagcctcagtttcttctgtaaaatagagttaagagtaatatctaccacacagggatttaaggataaattagtatagtgctggacacagaataaactatcctatatgtttgcaattattattgtcttaatagtggacatttatttttattcagtttcttctcaaggtgaagataactctttgtaaatgtcctacagaaatatagtagctttctgttcttcctttgcaagtaaaaagggtgggtcgttccactactgacatttatatatatgtgtctcttgtttgattttagctcagtttttgtacaggtaaatgtgccgtccattttattttttgaagctgttgtaaaagaataaattactctaccaggcgcggtggctcacgcctgtaatttcagcactttgggaggctgaggcaggcagatcacgaggtcaggagatcgagaccgtcctggccaacatggtgaagccccatctctactaaaatataaaaaattagccgagcacggtgttgcgcgcctg

SEQ ID NO: 49282 - DNA, 1884 bp, Homo sapiens
aggcatttaaataaggtttcattaattcgtgtgtgtgtgtatttattattgaacatctactgcatgccaggcattgttctaggttctcaggatagagtgtcaagcaagacctaaacgatccctgttatgaggcttacattctacccagaatgggaggggtttggggttggggacgacatgggttgggaatgtggggtggtgagagggtggtttgggaaaacagactttaaataagtaaataaacatgtataagaaataacagaaaatatgatagaagtaaatgctctgtagataattaaaacaggatggtgggctagagaatgtttggatggctggtttagattggtcagggaaggcttctttgaggaggtgacatgaatgagaatgacttaagagagtttttttttgctgatggattagcttggagtgtgagtgaaaggtagaaatcaggaggataactagtagagccttttactaagatggaggaaactgggaaagaaggattaagaattctgtcatggatgtgttgcctttggcatgagtaatagaattccagacataataaggaggccattggatgtatagatccagaattccaggaatacatcaagacaggagttatggattgagagttattggctttaataagatgggccagataccaaatagaatttaggtacatcactttatggacactgtaagcttcaactgttttagtactatgtgcatgggtttttcttaatttgtaaaagaatagttacgctgaatattaaattccatttaactccctgtctgtgggtttaagactatttagccttaaaggaggtaggtagtggtcatgggaaaaatgcttatattggggggtctgtactctgaatgctctagagcagtggttggcaaatgatggccatcggggcaaatgcagcctgccatctatttttgtaaataatgttctattggaacagagctaaactcatttatttatgtatcatctgtggctgcttttgtattacgagagcagagctgagtagaaaagatggaggctcacatggcccgcaaagcctgatatatttactctctggtcttttttagaaaaaaagtttgctgacctctgctttagagtttagatcaactctgtccagtagaactttatgatgatgaaaacgttctccatctgcactatccagtgctgtagtctctagccacaagtggccagtgagcacttggtatctggctggtgccaactagctgaggaactggatttttagattgctttaattataattaaaatgaatttaaacttaaatagacaaatgtagctagtggctactgtgttggacagtgcagatctagctggtatatgaaataaacgtcaggatgttcagaatcactcttctgttggcagccgtatctcaaagatttgtcttagggcacagtgaggaagggcaaaacatgtattgaacgccagtgatgtgatagaagctttcctatgcattatttcactgaaattacacaagaatcctttgaaatagataataacgttttcattttttagatgaggaagttaaaactcaaggagataaagtataacaagtggttattttgaatgtaaatccttttagtacagtagggttgtctcttccatctcaagatgtcatttatgactctggttctgctttatattcgacctcttattacaggaagatcatgatttttggtacccatctcaagacacaggtctctttttacatgagaaagatataggtgttttaggggctagttgaagtgagggaagggaaggatgctttcagtttcttaagctaagtttactttaaaattatttaaattttatttctttacaagtatccagtggcttctgatgga

SEQ ID NO: 49283 - DNA, 2426 bp, Homo sapiens
tctccctcagcctcccgagtagctgggactacactacaggcgcccaccaccatgcccagctaattttttgtatttttagtagagacggggtttcactgtgttagccaggatggtctcgatctcctgacctccggatccacctgcctcggcctcccaaagtgctgggattacaggcatgagccaccacgccaggcctattttattttattttattttattttattttattttattttattttattttaagaaacagggtctcactttcttgcccaggctggagagcagtggtgtgatcatagttcactgcagcattgaattcctggactcagacaatcttctcccctcagcctccctagtagctaggactacaggcatatgccaccatccttggcaaatttatttttattttttgtagagatggagtcttggtgtattgcccaggctggtctccaactcctagcctcgagggatcctctcaccttggcctcccaaagctgtaggattatagataggagccactgtgcctggctttattggggaatttaaaactgactatgtacttataagtatactcattgcataactttagtttaacgggaatatttgtcttgatggaataattagtacttactgacattggtattattttatttctctactctcttatttctgtgtccttgagaaagccatttttggtctggattttttattgcattttaaaatgtatgctctgatgtttaggtatagagtccatgcattttcattttcctacctgataggctgaaataagctttgccagcctgcttgccagttggtcgtagactgcctggcttttagttgtgttggagctggaatttgtgcacattaaaagtgtatccaaatcattaatgcaaacattacaatcttggcaagcctttctgggattttcttggtgatgtggtagcacctatcaggatcccttgggaaatggcactaggacagagggctctagcctttgttgatgttggtgatgaaagagaatgagtgactatgaagaattttacaattaaatattaagagaagtctttcatctttacctgtaaataaccaaaaatttcacttttgcaatctttttctttctttctttctttttttttttgtggggggcaggggggcagagtttcactcttgttgcctaggctggagtgcaatggcgtgatctcggctcaccacaacctccacctcccgggttcaagcgattctcctgcctcagcctcccaagtagctgggattacaggcacgtgccaccacactcggctaattttgtatttttaatagagacggggtttctccgtggtcaggctggtcttgaactcctgacctcaggtgatccgcccacttcggcctcccaaagtgctgggactacaggcatgagccaccgcaccccgctgtgatctcttaatagcctagtttttctttaaaaaagtaaaagcaataaaatattatagagacaactaaagaccatttcctccccatcctctctcatttctttttctttttcggaggtaacttgcccagagttggttttgtcattcttgcccatgggttgttcttttttgcttctgcaacgtgtatatacatgtggtgtgttaaaagtttttaccatgtatgtgtcatgctatacatattcttttgcagtttggaaaagcaggagaaaaactctactctgtatgccacattttaagtatattcatcttgatacatttttagatttgattcattcatgttaactattgtataatatttcgatgaatatagcacagtgtattttttaattctgccatcatccatatctttaggtttccaagttttcatttgtcttaattatttgctgttacaaacagtactgaagtagacaataccacctttgtgagagtttctctggtatatttctaggagtggaatttgtacaacatccacagcagtatatgaggctttattgataagagcagccatttaatttatcacagcaagctcatttttaaaaatcaagtagctaaattcatatgtctggctggagccacaatacgtaactccctcagtcacagtgtcagaggctaatcttaagagaattggaaaggattttgatatacaattttgcttctttgaatttttgtttagttctctgttgaggcattttaaacttactatatatatacttagacttgttgcataatccttgatattccacatccttgcagcacttattatctgagtttttattttttggtcagtctcatgggtatgaaagggtatctcattgtgattttaatttacattttaaaattattagttaagttgggcatcttttcatgtgtttattaactcttccattttcttgtctgaatagaacatagatgttctattttgttggattgtatgtct

SEQ ID NO: 49284 - DNA, 1031 bp, Homo sapiens
cattctttcaaaaattgatgaaagtaatgttggtactttcaaataaaggtgaaaaaaggaagctgtaatttggaaacaccccatggaagcccagtccagattataacttagactttcagtaatttgagagaaatgcgatgataaaaattcaagtatatagaataatttatgcttatatatgcttgcattataataaacaatatatacttatatgaaaaatatatggtaagcatataatatatatgttatatataatctattataacagtgttgcatttatagagattaaataagtgggttacacttaggcttgattttaattactctatatgcttgaaaatactgagtatttctttcaaaatggctaagatgttagacttgagacaaattcagaataaccttattcttctttcttaatagttggaaactagcatatctctaagatgcatggatattggcctctgtgtgccttttaggtttttggacattgaaaggtacaggtttaggaggacacaagccagttgatgtaagagacagctgggaagagaaagactaggtcaaatcttgcctggggtctgtgagtgtaagagaagaaagctacatcaaggaggccatttagccatcttttgtttatcccctttgcatttgctgaagttttttgttttttgtttttttgtttttttgtttttgagacggagtctcgcactgtctcgctggagtgcagcatcgtgatcttggctcactgcaagctccgcctcccgggttcacaccattcttctgcctcagcctcccgagtagctgggactacaggcacccgccaccgtgcccggctaatttttttgtatttttagtagagatgaagtttcactatgttagccaggatggtctcgatctccttggcctcccaaagtgctgggattacaggcatgagccactgtgcctggcctgcatttgctgaagtttttgagtggtcaccacatcttagttttacctgtgctttaaggaatccaggtgtgggcacccgcacccct

SEQ ID NO: 49285 - DNA, 1102 bp, Homo sapiens
tgaggcagagtctcgctctgtcgcccaggctggagtacagtggcatgatcttggctcactacaatctctgcctcccgggttcaagtgactttcctgcctcagcctcccaagtagctgggactacaggtgtgcgccaccactcttggctaatttttgtatttttagtagagttggggtttcaccatgttggccaggctggtctagaactcctaacctcaaatgatccacccacctcagcctcccgaagtgctgggattacaggcatgagccaccacgcccggccagatgttaataggttttatatgttgggggagattggctcacatttccattttgagaagatcactttgcctcagtgagttggaggggccagagtggatgaggggaaactgattagcaggctattattagaatagaattccaggcaagtgatggtggtagcttgactagtgtgatggcagtcagtggagggaggaggacccagatatgagagagatttaagagaaaaagtatcagtaaaactgggtggtatattggatgtggggcttaggatggggaaggtatcaaggtcaactcttggctgacttgtgtaggaagatggagtacctttcactgagatgaagagcactggaagatgaccaggtttggggcaggaggagggaaagatgaacagtttgatcgtagacatgttaattttgaggttgcagaatataaactggggagtcattggtttatagtcattgttaaatgaagccatggacatggatgagattactttgggagagaggagagagtggaaagagaagtgggtgtaggactcagtcttaaggaaccccagcatttaatgacttggtagaggaggacaggctttaaaaagtagaccgtgaaagagcagccagagaatgagaagaggtgggaaaacatggtgttgtgaaaccagtgaagagcatttcagggaagtagtaggcaactgtcaggaagagacactgatgatagttttgaaaaatttccattgaattttgggatatggaggtgatcttttactttagttggtgctgtttgagtgcagtaatggtggtcagactgatttgctataggaaga

SEQ ID NO: 49286 - DNA, 1734 bp, Homo sapiens
cttctaccgttctgtctgccctctcctcagagcctcttacctccaattacatttttctcttgtttaatgcttagcagtcttctctaaaaaggccagtttgtatgctatttgcccagttatttttcaagtttgtgtttttactttgccatttctcctgcttttagtgcctttgtccacctacaccactaatttctgtgtagtgtaatttctgtcagtcttcctcaaaactcactttttatgactgatttaaaactgattttcttcactctgcaacttaatgagctcagcttatgtttacatttgtttcttcttaggagcttgatattcatgagtttgcgaagtttgttcactcagttttactaaatagattcaggggccaggcatgttttttcatgtccttcagcaacatgtagtagaatgctttaaagtagtgggtacaaaatggcaaacagtatttttatgctatttaagaaatagctctttcctgtcactttcttctcattacagtcgtaaggtgcagttattactaagtcctgccagtgttacttccaaaatattcggattaatccatttctctccattgacactgccactgctctgattagtttagaccaccatcatctctggccaggatcactgcatcagcctccctgtggtgtctcccttctactcttgtcccccccaatctattctcaaccctatatttttaaggtgtaattgcatcatatcattctgctttgattcctcattgacttcctatttcagtttaccttggactccaaggtcctacgtggatcacttcacctctccttttacctcatttttgtgcctcctacctgctgctccctcacctgcacccctgctttagtccagccacatgggctaccctgttctttcagttcttcacacacatgaattctgtccctccatagggaccttgtgcatctggtttcctctgcctggaatgctccttcccaggcttggtgcagggttgtatttttctctcttcaggtctcagcttatatgtcaccttcttgtgtgtgcgtggtgttttttttgtttttttttttgtttttttttttgagacagagtcttgctctattgcccaggctgaagtgcagtggtgctcttggctcactgcaacctccacctcctgggttcaagcatttcttgtgcctcagcctcctgagtagctgggattacaggcacgcaccaccacacccagctaatttttgtattttttgtagagacagggtttcgccgtggttggccgtgctggtcttgaactcctgacctcaggttatctacctgccttggcctcccaaagtgctggaattacaggcgtgagccactgcgcctggccttatgccaccttcttgatgagacctttcctgactactctttctaaatagatccatccagcacaccgccatctctcatttttaaataaaaaattttttctcactaattttatagggtgaaatatacccatgtgccaattttccagaattaatacatgttaagattttgtcataattatttcagattttaagtaaaagagagcattacagatagttgaggttggtaatgtgtgcccttccccagtttcctcctttcctctccagaggcaactgttatgaagctgatatgtatctttcctttttccatgtttttgttacctatgaatgtgctcacttaatttatgtggatggtatcttatcatttttcagtttg

SEQ ID NO: 49287 - DNA, 1035 bp, Homo sapiens
gataaattgaatcactgtaattatatttgaagttagctattggaggaaaaaatgtagctatagttaaatactatggtaatgcctcctaatttattctttttcattttggagtatactgtttctcccctcctccactcagtttagtgtggcacatttgactgcccgccccccttaggttgggtatcagttatgaacttccagagagaattaggatctggtctcactgtctcctttgcatgtaaatagtaaataattagacatgcagttaaattggagacaataatagctgagatatattaagcatatgatcctgttagacactgttctaagcactttatatgaatagtaaacatataagcacagtccaaaaaatttttttctaactgtataaaatgtaggagtcatgttattttgaggtttatgagaaattgtaatcttcaatttctagttagtggaggtgggcgtggaggagaaaatgtttgcatttattacatgtgtagaaatgtactgaactgagaaaatctaaatggttacaggctagtcatttcttagtatcctgcctattactcatccactcccttggtaaaagctttaccctgttcctataagtgggagctgggtggaggatgggaagcaatcctcaattgagttagatctgactttgcttgattgtgtggcaagttagtatggggttttatgtcattattttatttcccttttatagttgagagaactgaagtacagaaagtataagtaacttgctcaagatcacagagctagtgaataaatggagccataattcaaatctaggcagtccaagcattcttaactgccacagtacattgcctgtgtttttgagtatttgcctgtgcaacaggcattaggagatgggagaaaatagtgttgtatcttcacagtacttggagccatttttgtttgaaaggatgtgtactgtattagtgtgtgtcatcctgggttggttagcatttgctgccactttatagattttctgagagcttcaattttccttttata

SEQ ID NO: 49288 - DNA, 2663 bp, Homo sapiens
ttaagtaaattgccaaggcctctttatttgtaagtggctaaaatgaatatggcttctcacatttgtgccactcttctgaaatacaggaaacacagacatcaacagtatttatctttgtatgcttactaaggaaaatactgtgtggtacaaccactgaaaaggctataatagcttttttgttattgcactttaacagagagctctttcttaaaattacagatttttaggaccaaattcagttcagtcgtctggcctactatgtgccaggtacagtattgaatcctggggatatgaaggtgagacagaccatggtccctggtccctgattatagtctgagttgggagtagaggtggagggaaaggaaagaaattgccctgtgaacaaattccatgccatatgactaaggtaaatttaaagaaaaaaggaaaggtaaacattgcctagagattacagaatgatgcccatgcccacagaatatctcttactgtgagatccattgattctttggtcattgccaggatttgtccagagaggtacgggatgtcgtctttacagggtgaagcccaagaggaaccatattatgttacaaacttgggggcttttcttttctagctagaggtctaaactcaggagggtaaccaagttttttgttttgttttgtttttggtacacaaagaatcttctgtttctacatccagtaaactttttgttttcttaattttaaattgtcctcaggctgtacctttccttacccccatctctgaccaagaagggtggcagggaaggggggttctaattccaactcagctactaatttaggaggtgaccgataacctctacagttccatctgtcatagtgcctttcacataactggtactcaataataagtgtttgccatgggacaacagaacttgaaatcttctgtgattaatttgtattgatttttggggggcaggaactggaagggggttagttttttttaggatgaaaagttgctgcctcacattccataacagtaacacaaattatggataaatcattaagtataaatcacaactcaagataagtgaaaaaaattttcaaatattgaagagttcttttataaattccatctcctagtgagatgcattacatctcagcccagaatgctgaaggttcttgtgattcctagcacagtgcctcatctttggtgtatgatcagtgaagaataatacaattatgaaatgactactagtaatctctgaggacttctgaggataacaggtgttctgaagtttgccaaacttggagaccaccttcccttcctagaacagatttctaggaaaagtcttcaggtctttttgatcacaatacgataggaattgtagggaggacatgaagaaacaaaagatcagtcagaatgtttcacacactctcaattctctaataaacacagtactaagcagtacctagacattgctctttgcctgaaggtgggattctttagtacctcatacagtaaaagatggtgaacctttcagtgctttttttcagggcaaaaacagcagggtcatcgagtcataactcttgtaatctgggatgcaagttatgtaaccatgtcaggattttcttgagggtttctgtccagaagatggaagacaaggagtgttggttgttttctaaacagtgaactctagaaatttgtagatgaatgaactatacaatacaattctagagaaaactgctaagcaatttttcagcactttatggcagtcaccaaggatcattattggctcacccagaacaggtactgttggtattttttttcttttagtcttaatattaggcttaaattagcacatgaaagtgctagttttaaaagttaaaagcagttgaatatcaacagtttcatgtgattcatcctaatggtttttattatttttttctggttataaaattaatacatgttcattgtagcacacttagaaaaatagaggaaaataaaattacagtctaacaatctattttatgcacttccatctttccatgcatatacatatgcacacgtataaatctgttcaccagaatattttcaaaaaacttactgtggattatagttcatttttagagactatctggctgtttaaattgaacctatcataaacatttctctgtaattagtaatttataaactaaatttttatgatttcaggagatagatgtcacgtaatttatttatcaatacccctattttaggacttttcgtattgttttcagtgttttacaattataaataaatagtgctgcaataaacatcttctacatgaatcctggtccacatctgattatttccttaaaatgagttatcaaaagaggtattttcaggttaaaagatgtgaattctgaaaacatatttctaaatttcttaccataaaggatatactaatttcttttttttaatcttttattgttacttttttatttaactttaattttaagttcatgagtacatgtgcaggtttgttatacaggtaaacttgtgtcatgggggtttgttgtatacattattttgtcatccagggattaagcctaatacttatcagttatttttcctgatcctctccgtcctccaagcctccaccctccgagaggccccagtgtgtgttgttcccctccgtctgt

SEQ ID NO: 49289 - DNA, 1022 bp, Homo sapiens
ccacgagtacatctttggaagggttgatgctgctaatccttgcccactctgccctctctgcttcagtttctttcacctgttgtgtgtcagcctgacagtggcccattcctcagcttgattcagttttacagcccagcttagtgtcccaggctgctccctcctcagcagcaatgcctagaggatgagtatatgaaccaagggcacatttttcataagcatacaagaaaatagaagattgttgcctgcaaagtgtatctcagaattgtattttaaaaaaacaagcaacagttttgaccatgccagatgtactcttgtcgctttattcggggccaagggtggactttaccttttttgctcagcagctctgggcactgggtttctctgcttgtctggtttcttgcctaagttcagcatcaatattctaatcccctgggaaggagcagttgagcccacactgttgtatatactatgtgggcttgtatacctttggctgagattatttttctgtcatgaactctgattccttgccttatgctatttaaaggtagcttcaaaataaagttagaaagctgaattgggagcccaaccaattgctttttcttttcagggttctttgctgaataatttctgacacatcaattgtgtaattgttttgtgctgctctccccatttataatatttggagcattggctttttgccacacttgtcaagggtttatgggagttagtgacacgtagtatacaaggttctttgagattctttcatgaaacttggtattatcttgaaagcaaaaggtttaactgttcatttgttagatgactagtgggattttaaacagatataatcacaccatgtcttttttttaaatgtgatgttacgtacatatgaacttttactgctcaaattttaaattatgtgtttttttttcttttttgtgtttataaaatccattattagcaaatacctcaggaaaactttagagtgaaagtcctgaaaaaattttccactccatgttttttaa

SEQ ID NO: 49290 - DNA, 1800 bp, Homo sapiens
agtagagtaagaagtagatatttgcctttggggatcttgggaagaagactgctatctatctctaatcctcatggaatccttaagtggtaggtgccaagggctaaggtgaggggggagaggtggagggagttgtttaatgggtacagagttgagctcctttctctataaagcatttaagcttttttgttgccattaattgcttctatgggctaaagaaactgaaagtgtgggcaggtaatcacttggctactaatataaagaggaagtgaaacaaaggactggcttaatggttcagggtggaaagtatacacagttaaaagtaatgttatatggtcttgtaaatagttgtgcatatatccgatgtcaataagaattagtaataccaagttaaaagaaaagcattattttaatatttgtataccttttggaaatgaaagatgggattatttaaagagcaaaaaactaaagatgttctagttggtaagtgactttatttgatgtgatttgttattcggatttacctgtgattagagtggtcatatattcttaatagtttcttcctttttgtgagacaaggtaagagcagcttggcatctaagttttggataatgtgttgctacttgattttttttttccccaagatggagtcttgctctggagtgcagtggcacgatctcggctcactgcaccctccacctcccaggttcaagcgattcttctgcctcagcctcctgagtagctgggactacaggcgcccgccaccacacctggctaatttttgtatttttagtagagacggggtttcaccatgttggccaggctggtcttgaactcctcacctcaagtgatctgcccgccttggtctcccaaagtgatgggattacaggcgtgagctgcttgcttttgagaggcatcctaaacatgttggatggcctacccttattttctgaactaaaatatgttaaaattaatttggttttgagaacttttgaaaaatcatctgactttaatctagctaatatgagtttttttccctatgctctgggcactatcctaagtattttacatacattacttaatcctcatagaaaccctgtgatattatttttccttttttacagaagaggaaagcagctatagagaggttaaattgctcacttaaggtcatagatgtaacgatggaattaggatttgaacccaggtggttggctgtgggttgacatttatcattttaactgctttgtgatgttactccatactgagcatgtaaatgttcttggcactcagcacattgtaggatttaaacaaataacatttatatctgttgagcttcttagaatgactggagatgaagtagtctgctataaaaataagataggaagccattgtactggacactactgatttagctaattgatttcaatccaggaactgattagacatttctttctttctttctttctttttttttttgagatggagtctcactcttatcacccaggctggagtgcagtggcgccatctcggctcactgcaacctctgcctcccgggttcaagcaattctcctgcctcagcttcctgagtatttaggattacaggtgcccaccatcacacccagctaatttttatatttttagtagagacggggtttcaccaccttggccaggctggtctcgagctcctgaccttgtgatccacctgcctcagcctcctaaagtgctgggattacaggcgtgggccaccgcgcccggcctagacattgatttctaaccttgaggtccatgtgtgagttccaagag

SEQ ID NO: 49291 - DNA, 1095 bp, Homo sapiens
gctaaaccccacttggtcatgtctatgaatactttatttttggatttttatttactaaaacgtttagaatttttacatgtatgtttatgaggaatattggtctgaaattttcttttcttgtaatatctttgtcagtcttggtcagactagggtaatgctgccctcacaatgtgttgagaaatattccttcctcttccattttctgggagagtttgtgtagaactggtattatttcatctttaaatgtttggagtaattcaccacagaaactatctgggcctggacttttatttgtttaaaaatttttaactacaaattcaatttgtttgacagacagtcaagttgtctgtttcttcttgagtgagctttagtataatagtttgtgtctttcaagaaatttgtcagatttattggcacgaagtttttaaataacattccctttttatccttttaatatctagaattggtaatggtgtcatctcttattgctgatgttggtaatttgtgtcttttctttttttccagcgatggtagtcaccctgaactctgtcttctggctcttcaagccagaagaaatgggcatcttgcctggtgcctttcctttttaccaattgtagacatccctccatttttggcaagtttttcgttgtgctccagtgccttcaggtagtggctttttacattgtccagaggttatcaacggtaagaggctatttttgcccagtgctgaagatggcatctctgggttttggttttgtaacattctagcaaagccagacatgctttgctgcagtgaaagtgtggaactggataattgagcagcactgtttattcattgttgcctttattggatctcatatggaataaccccactggatattagagtaaattacagagttaggaaaaggtgaaaaagagaaatgtcgggttagctcttttcaaaatattttcagtgggagaaattgttgtcactttaaaaagtgagctttttaaaaaacgaacattttgagtactgaatatgttaagcttctgaatgattttgagtgcttttgcttgtcatggggaagtttttcaagagaagatgaccttttaggc

SEQ ID NO: 49292 - DNA, 1034 bp, Homo sapiens
gattatatatgaaaggtgtacaatgtgatgatttgatatgcatatacattgtgcaatgattaccacaaccaaattaacacgtccatcactatgcatgctgtaccatacatacccagaacttgttcatcttataactgaaagttcatcccctttggccaacgtcttctcatttcttccactccccagaccctgataaccactcttctactctctgcttctttgagttcaatgtttttagattccacatataagttacatcatacagcatttgtttttctgtggctggtttatttcacttagcataatgtcctccaggttcatccatgttgttgcaaatggcaggatttccttttttatggccaaataatatattccattttgtatgtgtgtatacatcccacattttgttcaaccgtttatccctcagcggacacttaggttgtttccatatcttggccattgtgaataatgctgcagtgaacatgggcgtacagaaaaacctcttcaagataactgatttcatttcctttggatgtaattttttggggaacctccatactgttttccataatggctatcccagtttacattgccaccaatagtgtacaagggttctttttcttcacatccttgttaacatttgttgtatatagctagcctaacagatgtgaggtgatatgtcattgtggttgtgatttgcgtgtcgctgatgattagtgatgttgagtaccttttcatatacctattggccgtttctgtgtcttctttggaaaaatatctattcaggtcctttgcccatttatttttattttttatttttattttattttatttttagggacagggtctcattctgtttcctaggctggagtccagtggcacaatcatagctcactgcagcctcaaactcctggactcaagtgatcctcccacttcagcttcccaagtagctaggactgtgggtgtgcatcatcatcatcaggcttggctaatttttttttttttttttttttttttttgagacggcctcacct

SEQ ID NO: 49293 - DNA, 1047 bp, Homo sapiens
cagcctcccgagtagctgggattacaggtgtaggccaccacacccagctaatttttgtatttttagtagagatggagtttcatcatgttggccaggatggtcttgaactcctaacctcatgatccacctgcctcggcctcccaaagtgctgggattacaggcgtgagccaccacgcccggcctattgtattgttttttaaaatttatccctggaattggtttgtgtttttattttttaggaatgattatatacattgaccttgtgccacatgcttcagattttataagaagtaagctgggatgttccaagttccgtgttgcatagagttcttatccatgaaaaaatgtccaaaaagatgatttagcaaatttaggattatttcatcctaatttggtattctctatagtgggagttttagagtgtttcttgtgataatcattatagttaagatttattgaatgtttactcaaaaaagttgaatttttctactggttttgggactacttgggtgagatatgtgaaatagattcaaatattgaaatattgaggtactcttataacagaaaatatcaaagctactgccatagtttattagaaatcaggagaaagacttttttttattgttggcctgaatgagctgaagttcagagtaagactgtggtcattattcattacctcttttttttcaaacactaaaactcttgggtttctgtggacaaggctgctttttaatggcatgttctccaaacagctgttaagcacccccctccccaataccacagaccacatctgttcccactgttgattagctagagggtggagaaaagagaggctgtagcatgtgtaattaccagtaattaattcttgttgagcctcctcatttccttctattctaactacacctactcttcttcctgcctctgttgtaaattctgtttcatgttagctacttgtggaaaataatcttgatggttatacagctgttttcctaaaattttatattcacctaacagtgaggcttttatttttcttctggtggcagaatc

SEQ ID NO: 49294 - DNA, 1050 bp, Homo sapiens
gctggagtgcagtggcatgatcttggctcactgcaacctccacctcccgggttcaaatgattctcctgccccagcctcccgagtagctgggactataggtgtgtgccaccacacctggctaatttttgtatttttttagtagagatggtgtttcaccatgttggccaggttggtctcaaattcctgacctcaagtgattcgcccaccttggcgtcccaaagtgctgggattacaggcgtgaaccatcacacccggccttccctgtttaattcttcttagcatctccactaaacacaaaccaagaaaggtgatttttctctttgttagaacttcttaggaaaacttcactattctcttattccatctgttttggggttgaggagagctgttatataagaagttattgttagggtttcttgtattcctgttgtaatattctcaagctgacatatttgtgatagatcaacaaagcagtaggtattttgtaccgctacctaagcaataaaagcaagtatgtaatgctgtagtaccagagttgtggtttttcccctgcacaatatattaactaagcagaaaatttaaaagaacaaagacaataaaagtaatgtttgttagtggtagtttgagatatttcaggagagatgagatgtgaagaaaagcaatggccatatttagaaagctgcctcaaacccaagagtatctattgaagtaaacttgatgacagacttttttcctcttcatgaatcattgtattcctataaaagcgaaaattcctcttcatctaaacaaatggcttcaacatctgttttcttagtttctcaaaagggtgtcttcggcttgcatttttttttttaaaagtgtttatctgtttaaaatgaaatatcgtcaaaagcagtttgtacatcaaaatccaagttggtcttcagcttgtaagaattagttgagaattatctggtggtgttgatagtggtataggggaaaaaagaaattacattttgtattctgcataggtaagttcttcttcctaaccatattctttaaatttttttg

SEQ ID NO: 49295 - DNA, 1111 bp, Homo sapiens
agcatgtgaagtgggtttttaagaatccacaggatgaataaatagtcatgctggggacaagaaattataagacacgttataagacagggaagaaattcacttttcctttcacacattcaaaggcatagtttgtagtattttaagttttgggatcaaaataatagccctgtcaaactgtagggcaataatggagagatactcataaatcgtattaaatttgtctttttgggaggagaagcctttcagaaattgttgtttattcagtgttttatattcttcatacatgagctaccagaaggtctaggttgtaaattaaggatttaaaacaaaatcagtttatctggaaactatagttgtatgggagaggtacacttatagtcaagtttataattaatgggcctttgtcattggaatagaaattcttttctcttgagtgaatatttgtttatataacatgcattgtgtttgaaggtgggatcaaaactgattcactcttcatttcttgcatggaaaaagccagcatttaaatgtgtactgtgtgtgggcttaattgctgctttttgtaaccaactttagggtcctgttgttgtggagatgcacttactgatcgataatggtttgctcttcttaagctggaccactaggagttttcctccttttactagagcctaaaaaataaatatttattgaattattactttgtgccaggcatttcgttaggtttaatgcccatgatatgatctctgcctataatttgcttatggtctcttaatcttaccttttgtaagagagtggtgtgttgtggtatgcacagagtactttgggggatacataggactaggatattcattaatatcattcggttggggagtctcgagaaggcttttctgacagtattaagttccttgtgaaataagtagatgttaggtaataataacccctaacatttattgagctcttatgtcccagagaccatacaaaacaaagtacatacatcgttaaatttaatgctcacagtagccctattaggaagcttcagttgctatctccattttacagttgaggaattggaaggttagagaggttatattgtttgcctgaggtcatcgca

SEQ ID NO: 49296 - DNA, 1049 bp, Homo sapiens
aacctctgactccctgcttcaagcaattctactgcctcatcctcctgagtagctgggattacaggcatgcaccatcacgcccccctaatttttgtatttttggtagagacggggtttcaccatgttggccaggatggtcttgatcttctgaccttgtgatccacctgccttggactcccaagtgctgggattacaggcatgagccaccgcgcctggccccctcttgtttttaattcctattccagctgtttgtttcgagggtgaaattcaaaggttttttttttttttttctttaaatggtagatacatttttcctttgaaaacagtctaagtgttatatgtttaagatgtgttcacgttagtacttactacattgtgattcatatgtctggtaggattcaggtgcattttatacataaatacctacatacatacatatacactcacaactgtgatttttacaggagtacttaaaatatatttgaaaagtcaaggggacatttaaaaataatcatttgtagcctcttaatagcaatttgcaatcgcaattcacagtgttttagaaacacttgctatgttaagatgttgtccccatgaactaaaactaagatgtcatcttacaaactaacaacttcctatctttccctcctggaatatgtggaatttgaatggtagtcttcacttgacagcaagcctggcacattgtgctcatactgggccttgaaaagttgagtattttccctggaggtgatgttctgtgccttgaccctgtcagaaagagcagaggactctttatttgttcagcatgtagttgtttgcttatagtcaaggtgttaagggaggtcttaaacattattttaatagtcaaagtttgacttctttatttctggtcacatatttagttgttggactgtctattcactaactaactgaatagtttgaaggcaagtactgtatgtatgcattaagtctttacattcaacaaggactgtttcataattttcatatattacctggggctgatccagccagtcctgtcctttggttgc

SEQ ID NO: 49297 - DNA, 1934 bp, Homo sapiens
aacttgacaagatgaaaacaaactaatgtgataaaggctcttgtttttcttcaagtttgtaatgaataaatacaaatttaaagtttttaatcagtatctctgagaaagaggtttatttccagtaacatgacttcactggtatttacagagggaaaattattttatccatagagtccctcgtatagtgaatgtaaaatagtgatttcagggttttccctttgactttgcactccattatgatgatggcaaggaatggaaggtatgtatgactaaagcggtctttgggaggaaaataattgagaagatagggttaacaactcaccaataaaacgaattaagaatattcaacactaggacagcatgtaagtttttaagcacaaaaacccttttatagcctcacagtaattttttgtatacttctcctgacttatgtagggaacagatatggagcccagcttgtatcgttgcagtaacatcgattgtaaggcttcacctctgacctttacagtacaactgagcaacaaattgatcatggacattagacgtttcattaaaaagtactatgatgtaagtatccataatgatattcttacatacacaacttattgaggtttggtacttgtttattggttttcatgaaactaaaattttgaaaagacttttgggaaaaattcctagtgaaatactattaatacaaatatgataaagtatgtaattttggcatattagcatgacaaattatttgataatttctctcaggcattacatctctttcatttacgagcagtattttaaataatgaaatttttacttcttttagaaaaagccagaatataattaagaaatgttttagtttattgttacctaaataagactaattaaatgattgcttagatctttggataaaggaagaaaaaaatcactattggctattgtcagcaagtagagccataagatcgtgtgtagtgatcttagtggactgcccacacaaaactaatactttgtgtttatgtagcactctaaacgactccataccctagttttttgaggaaatcaaatatcttttaaatttaaatgcagtttttctggcattcaaaagagaatatctaatttttataaatttatagtaaaaatgccagaacagtgagtgatttgtcttcattggaaagaaggcttttattcagagtttttgtttttaacgcatttcacatgaattagtttttttctcttcaaaaattaaaaatttcacatttcccacgtgatttttcttagtgtttcagtatgtcatttgtcatctaaacaaattttctgttacttgaaagtttactgtaacttctttttaaaagctacattggcaacacatttcaaaaaaaaaaaaaagctcatgtcttagttaaggcctatgacttttctaaagattgttctgtactttttactcgtattagttaacatataatagcattttcttctttaaaatagaactcattatgtgaaaagtaactatcagatcattaagatgaagagtaaaaacatagagttccagtattatgattttggtgttgaatatatttatcagaaaagcaagtcagtttgcctaaagattattaaaaaataataattatgactacattttgggaaaatctgaaacattttagtgaataatcctgtgctgcccttactgaacagtggatgggaataaaagttggctgtggggtcacattcctcagtaggtgagatgtgcagcacatgaaaatttaggccaaatcaaaactattcagctcctcatttacaggcctcattgaacagagtatgatccttgcttgactcttgggaagaattctgagctttctctctgtgtttagtctatcaagatcttcaccatggaaatgttaatactagaagaaacttatctatttccttctttaagagggaat

SEQ ID NO: 49298 - DNA, 1117 bp, Homo sapiens
agtttccttttcagtgttggtgaatagagtctcaaagtcagcattgggaaatggatactaagctataactccttcaaggcaatagcacagaatactgcagaatactacagcacagaatattacaatagcacagaatactgcagcacccagtattgtgcctaacgtgataggtgctcggtaaattttattgaatgagttcacgatgtcctgagaggttggtgctatcaagtgactctcccaggtcacacatagtagcatcaagactgtgaccatacttggagaccctagtccggtatcctgcccataataacttggaagacagccagttatggataccaagttgcttagcatcttctttgcagtcactcttagagcaggattgatcaagagccttcgctattcgcattacaagctaggccaggtcacaaggctgactggggcatgagtccagaaggctgatgatagccatccagcaatggactagtacagccattgaaaggaagcacgtgttgaacctggggtttcagcgacttctgttatggtttgcctcctctgacgggaaaattgaaagctttctgaaatgctgaggaaatgccataggagttgtcagatatctgaaaacaagtgggtaaaaacagaaaactacttgtgccaaaacagtagaattcctttcttcagtttgatttctctaacctggtgtatttaggaaaaactcaacttcaggtctaactccagtcatctagagctactgtcttgtagtagagtaagaaattgaaccagaacagatttcatttaacctttcaaaagtgagattttcacacagttgaccttcttgacttcaaggaacaaaacgggactatcagttctctgctgcatgcgtcaacaagagatgggaggagagcgccccaggcgatggctgtttttcatatttggtttgcccagagaatgtacattttggttcacatatggaaatcagccctttgtagatagttacagataggaatttccagatgatcctgtctaccttagtcttgtcttaatggaataaccatatttctgtttaggagtgggttaattcagctgcctttccaaggtaccatggaaaaattctctaagc

SEQ ID NO: 49299 - DNA, 1228 bp, Homo sapiens
ttccacagactctatcatccagcaacactgtcaaattatcattcctctagacagacctccttgttttcacacaactgctgggattgtcgtcacccacttgccatttttatctttttcaattctccttcacctttaagacctaaacccatctcacttctaggaagcctttcgtggacatcacagctatggaatgtttttttttttttcctctgaatccctaaagaactttaaaagtataacttttctccccccattttctttaatatagtctcttatagtcgttcttttatttggcaaatcattttgttccctataaggttgtagacttctggagaacaggggaaagaagaaagactaatatttttttagctgccaaacacttgctaaatattttttacgtatgtacgtttttaaatggtatcatttaattcttgcagcaaccctgtgaggtgggtggtattttttccatttttacaggtaaggaagctgaatcttgtagtaaacacaaccaatgttagaatggtaataatacattgtagagctgagatttaagtttgggcctctctgatttaaagcctatatgctcttttcagaaagcctcctccataaaagagtggcaatttgcttcctaatctgccaatttactagaaagttcaaaaaacagaataggtgttcagtaaatgattaaatttatgactgtggaaatctgaattgctttgacttcatttcttttacctatcagctagtggtaatatgaatcagcaataaaatagccaaagccttagtaagggccctttgtattctcaccaaaggctagtagtacatgaaaggttgacagttgtactccaacattaaggctgtttacttgagacaagttttttttacttgtttgtctgtttttaagcttttctcttgttgattccaacattcactgatattgctaaatgtctcttttctcacttagtatttgtatttcattttaagagagtaaatttcattatataatagtagcatgaataatttatgcctctgtcaaggaactattaaaacacagagatttttaaatatgcatattctaaacttcatataaaaactacggaatggagtttttatttcctctctgagtgtttattcaggagtaaacctgggcacttactaaaaagctatggtcttactgacttcaatttaggatagaatgctgagttgtaattatgtctatagataagga

SEQ ID NO: 49300 - DNA, 1047 bp, Homo sapiens
ttattaagatttttatctttattcttcttatttcttaaattattttaaaataaactagtaaaatagactagataggcctaaaagtactactttaatgacaaagtaatttcttcatttgaggtaaaaaaaattagtatagatcgtaagctaattgtttatgaaggcaaaattaacgaaaatattttgatcacttttatatttttatatttgttttatatagtatcaatatcacaataaaacttgatttttttttaatttgcataagtgatttattgttttgacatttataatttttgttctagtctatcatgcatctttgaaaattcaatattttcttgaaatgtttagtaggtcagccaataaattgacttttttttatccttctcaatttagtgggttttttcaatatgtgtaggacatcttctgttttctatgaatgatagtgttatattctttgtttctatttattttgtgacgattttagcttggaaataatcttggaatgtgtatctttttgacctagagttactcggaaagttctagtctcatttgtactatgttttctggctccctaatacaattataaggacttagtcttttcatttttagtctccttagccttgaggatttaatttaatgtgtttgttcttcagaaagaatgtaagctagttttctacttgaaacgtctttttgtatttttaaatacatgaaacctttacagaggatttgttttatcaaaaaataacttacatgctcttttttaaagcattaatttacatcaatatttatagtgaacttgaaaaaatattttaatggtaatgaaaatataatttaatatcaagctaaatctttttcagccctcttagattccccatttttagctgttgagtcactggagttcctaataaagaaaaatgcgtttttaggaaattacttttctaaggcaaacaataaattgtacacacagagggaaaggaaaggagaacttttcacctgcctcgtgtagggaaaaatctaaacaattacatgaaacacttagcaagttat

SEQ ID NO: 49301 - DNA, 1051 bp, Homo sapiens
tcctaaaactgtacctggggcccttttgcctattcttcacaatatttaatgtaattctgggcatatattacaagtttcattaagggctcattgagaccctccctgtacttgaaaagctcatattaaattttaaaatagtttagccttgaatgaaggtaggaataatgcttactgtgggtgtattgactagatgaattttacattctttaaaggtagcataatttttttattcatacagatctataatacactttccctttttgtgatagtcttaaatggagctagaagaactgattcttggtgctttcccctgagttttgttatagctacttccagaaaagcctattccgaggaatgaggtcaaacggcacagcagcaagtgagggcatccctcagctttggattaacaccacatggaaacattactaagtggcagactaaagtacctgacataatgaaccaacactcatgtatatactgctcttatctaaggggaaaagaccaacaagttgttcagtctagaaataggatatgtggttatgcgtgttattgattcctttattaatgataactcagcatagctctttctggcctgcattctttgacatacattgttctttctgtgtaagttgtcttttctgccttctctacttaccaaacttccactcatttttcaagaccggttcagaagttgccatgtctcaaaatgctccaagatctacagatagtcaggtccctactgggggctccacaggtgagaacaccataagacaagggagcagcagcataccgtgttcacctttataccccagcacctcactctaacatttgccttatacttacgcctctgtggcaatgcatgtagcacgaaagcccacagaccttggtgccttagtatgaacaggtgaactttgaccccatttgtgatgtcttacctcctttgtttaacagataacgttttataacataagactgatttaaggtcttaggtatattcttatcacatcactatgagaaaattcaaacaagatcagcaagggagagtaactga

SEQ ID NO: 49302 - DNA, 1047 bp, Homo sapiens
aaatgtgttccatcattgcaacaacggtatacggtaagtactgtggtatccattttacagagaaggaaacagcacagcaattaagtaactagccaatagtcactcagctattgggaaggttatacatgtatgtggtgcattctttggtaatggtctttactaatgaactaaaacacattggtttacattctgcctgtagtagaagtttttgttgggaagttttgatgtattggagtgaggaagggtgtttcttttaagaaaaaaaaataacatctcatgtgattttcttttttttttttttaacttaatggttttcctaacttctaagtttggggcatagatctatctaattaacatgtcaggagagagagataactagagttatgtcagaatttctgagaaaagattaaataaaatgagtctatcttgataaccaaaaaaaggtttattacttgtatttgtcgatggtgataagtctgaagttttcccttctctccagggctggttgatatgtgaagagccaacctgtcgcaatcgaactcgtcaccttccccttcaattctcccgaactgggcctctttgcccagcctgcatgaaagctacacttcaaccagaggtaacagtctcataatgctaaagaaccatgtagaagagggtagagggctgcttgctttgagaagtagatactgagtatttgccctatgaagatgccctactaccatatgcatatactaatcttatttttaaaaaatacagatttcagaaagatacatgctttctttttttcacatgtcatgagcaatactatatttatatttaaaagggaaactgactaattctcatatgagttatagatttctttggttgccactacataattacaaaagaagacatggccattccattctagaaactgctatcgtctttgggcttgatcagaatcccatttgtaagagccagaaatcctcccaattctgtaccctgaatggtttattttgtggggtttttggtcccctctgctggattaattgtttataagtagctgca

SEQ ID NO: 49303 - DNA, 1044 bp, Homo sapiens
catctggtacccatgggatctcaggtaaatctctggagcctgtcccctttgaaaactgccctgaaggacaatactgagttcccagagggcaccaatatgccaacctttaatatttaaatgtaatcatatcaagccgatttcccactcctcacaataggaattgctcttattgttggactgtgacaaactctgtgggtttcctgctgcggaccttttcctactaagaaccttttctcccaattgttttattgccacattaatgctgctattaagatccgtgtgctataaattagataagctttatatatttttttattcatcgtgactttcttctgttttccaagggtaaaagtatattgagaactgactcttgcaagcacttacttttcgaaagtagtttagaagcaatctagccatgttttacagttatagcggcaattgtttcaacaaccccaaaaaaattgcattactgaaatatatttcatgggtgcaattggccagggacagggagggcagcaggccatttcttttattaaggtcttgcgcaaatgttatgaagagggcagtatctcaagaaacaatttcacagctggtttgctcctaagccactcaagcctaaaaatgcaccgaattcctggtggaaaaaaaagaaatagatgtcactcccaaacaaagacaggtgctaagctgcgggagatgagagaaggggtgaaaacagtatccagctttaatagcaaaagcaaatgctagctaatggcccattctcaggaactcgttaagtcatctctaagcaaccacaggataatacactcgttatttctgctggtatgtttcctaaaagtgaggcgtattgctttgagcccagaatcttagtggatagtgcgcctcacctctgtattaacctgttggcacgagacctttcctgccgtcttatgccttcttaatggaatttttattagtcatttgggtgttcttttttactttattttctttgctcttaatttttagctttttaactaaaaatgtttttaagttacctaatgt

SEQ ID NO: 49304 - DNA, 1062 bp, Homo sapiens
ttctgagtcccaaatctttcttatatccttgataatttttatattatttcttccttcagacataaccttgatatgggctgtgtgtccttggaatgccaagcagagatcattttatgctttgaggtcatagttataaataatgttacttatcatatactccaaattcattcagaatttagtgagcacctactctggaccaacactgatacagccagtaggtatacagcaggaatctaaaattaagtccctgtcctcatggaacttacattccagtgtggggagacagataataaacaataattatatgacatggcaggtagtgacaaagtactgtggagaagaattcagctgtgtgagtaggaaagggactggcacaagtagggtttgttaatttatgtagggtatctagggaagttctccttgaaacagtaatagtaagcaaaggccagagggatgtgaaacagtgggccttgcagatatgaagaggaagggcatgtataagggatctggaacagctagtataaagggcctaagataggagggtgcttggcatatttaaaaaataggaaaagggccagtgtagcaagagaaaagggaacgatggggaaagccgaaagaggtaaggtgagagaatttgggcagagggtggagacactgtgaagagccatgtaagccattgtaagggctttagtatatatgctaggggaaatggggagctattcaggaattccatgtggaagagtgcagtatctgactaagttgactgctttgactgctgtaatttaggcaaaatatgttgatggtagcttggcccaaggaatagaagggaatctgtgagaagtggttagattcttgatgcattttaaagctaaaactgataggagttgctactccaatccttcttcccctgtgacgttatatagaaggaaatggaggagagattccttcttacaggctactgattctcaattgaattctaatgtatttaattattcacctaaaactaagatcttgcctatggaccccatatagcatagcagtatccttactcttaatagactt

SEQ ID NO: 49305 - DNA, 1540 bp, Homo sapiens
aacagtagattgaagttggatctttagagcaaactattctatcatgtgactgttagactccagtttagtggtatcagactatgcccttctttttggatggttatagattaaaggaaaatcttctagggcaaatcttgaaattaagaaagtattaagggtgtgctccatactctgttccttgtttgtatccttatgccttgtccttccaccagtcttccctctcctcttcctttacactcagctgtcctgtaatgcaatgtgtgtgttcctaaaaatcactaagctatggaaaatcatataatgacaaccacacagtttatggaaaaacagaaaggttagggcaacacacaaaaacttcatcagtgacacataaaaaaggatataggaacctaaacaaaaacaatgacatagttttacacatcttcagtagctaagaaatatataaatattacaataaatatggtactttaccccgaaaaagacttgaagtttgcttgtggaagtggactcagaaggattgcagctgtgagtcatgatgacgtagagaatggaaggttatctgaaattggaaggaaagttgcaacaaacaccagatgtgggtgagtgtagcacagtgaactgaggtagctggttgatgtttgaggtatttgcgtatgtgtgttttatgtattcctgtattgcttgggtgcatttcttgcattcacctaatatttcttgcagacaaaatcatgcacgagcaaacacgaaattcatgttgtgttcaaactgttccgtgatatatcaatggcactggaataaattctcatattcaaaacaagcgctgtagcagaaccaactgtatctcgttttgtcttgatgattaaccagcaccttaactgtctccctgctttattgttttctcttcattctcataatgtacaaagacactcgtatttttagaaagactgattggaacatctgtcaaccagataattaaacttattgaatattgtctatctccagcatcctggtctgggacgtgggaaacaaaaaacgttttgaaacaatgggttctgcctttatactgcttgaatatggggaactaagcgcagacctttgaagcaaaacaacagttcttaaaatatgacaacatatagaattaatacatcagtgctgaagagatagggtaaagtagttagtaaagagataggataaagtagttagtaaggtaaagcttcttagaatatataaattttgatccagattgtaaacaaagttgtgaacatggattggggaagtagtcccagaagatgaaaaccctagcatcaaattctaccagcattttggttccaggtaagatggagtaagaatagttcttattgtctccaaccgaaagcaactgtaaaacctggacagcatgggtggagcagttacatggagaccgaaaagtaaacagtagcaggtaggttaaagatgaagaccagatttcttttttttttttcttttttctttctttctttcttttttttttttaagaccggttcttactctgtcaaccagg

SEQ ID NO: 49306 - DNA, 1040 bp, Homo sapiens
catttttgaaaatttcattgttatgtatatgaatctatgctgttctctgaaactattagtcactaaaactacattcatagatataatttgtttcatagtagcttataagggatataacctcattatagactgacaaacactctagaacaaagcagagacagtagagatacattaaaggtttgttgtagccaaatttaaccccccaaaaaagatttaaagcaaacatataccagctactatgtttcaggcactgttctaagcattttttctatttaaactcatttaatatgcatcataatcctatgaggtactgttgttattcctgctttacagatgaggaaacatggttagatgctgtctttatttacttcacattactattaatatgaaagaatacctgagtctgggtgatttattaaaaaaagaggtttatttgacttgtgattctgatgtctggagaacttcaagacaagattggacatttgtatcagatgagggcctcgggctgcttcctctcatgggggaagatgaaggagagctggctgtgtagagatcgcatggtgagagaagaagtgagagacagaggaggggaggtgtgaggctctttttaacaaccagctctaaagggaattaatagagtaagaactcacttagccactccttcccttagggagggcagtaatctgttcatgagagatctactgccgtgatcaaaacacctcccattaggtccttcctccaacattggggatcacatttcaacatgagatttggaggagacaaacatccaaattatagcagatatcttgcccaagaccacccatttaattaagaagtagagccaggatttgaacccagtctggttccacagtgtgtgctcttaaccaccacactatacttgtctcatttcgtatttttacatgtagtagtttaaaataccttggctttacttagctcctttcttctaaagaacgtattcttctagcctcctgattctctctatgccagattaagttcttgcaagtgtctctttatctcgg

SEQ ID NO: 49307 - DNA, 1048 bp, Homo sapiens
ttacaaaccttgatttttatgttattgtttcttctggtttgaaatttatatttaaattttcattgaggtattgatacatgcttacatgtaagagagggcaaattcaatctttttttgacattaggttaacctagaaataatgacattaaggaaaccttttgtagggaggacagtaaacagtcctcagtcccagtgaggaccccatggccaatatttggatatttcaacatctgcagtattgaagccagccgtgtctcctcagatggaaattgccatgtgcagaatgacttgatagaaaatggtgtacattctatataatcttctaacagcagaatgcgaccagtggcacttcccctaaaaaaaataaattacccgaaatttgcagcacattcatattcaatttcatcacagcagatgctcattagtatgttgttattaattggtattcactttaggttttgtttaaaatgaagataataattaggttttaattactgcatcattcgtgggggtgggggttgtctgtggggagagggaaagagtgaaatgcctcttaaagcactaaaatatttcctgatgcttattcagcaacgtgtgttgccaaagactttgaaaaataacttcatctttacaaaaaaaggattctgaaatgaagaaattactgtgtgttttttaagcccatcgttatcaagaacttgctgtaaattgtctacttgatggacatactgaatcagatgataatgtgcaccaccattctttctaatcaaattaccaaaaagacttcttggaaaagtaaccctcacaagcggctgattaatgaagtggtggcaatgttttgtattagaactaattgaagtaatccaaataagttatttctgtagcctatggaaataatttcctttgcaaagaagtacagtggagttggcaaaccagtatttttttttcaccctctgttgttccacatttgcaaaatagctaagttaacatagatattgcaaataaaatagatagaaaactaagtaattgagtggcagggaaaacaggaaag

SEQ ID NO: 49308 - DNA, 1095 bp, Homo sapiens
acccctgtgtgtatatggacctatgagtgcacccgtggcccacccttattactctggtaacactccaagtaactaacttgaatgcagagcgtgatacatacagtagctatttcagctcagtattgtccttaccaaatcacagtcggccactttggtacatgatgttctaactataaaggaagactgaaagaagcctaggcactgtgttgagtgcaattttcaaggaaagagcaagaaatcgaacattttaaaccaataagtgaaagctggagagagaaagaaatgttaaaatatcatcttattttcttgaagtattttccatccaatcttgtacagtcaaaatgagcatttaagtgtgaggaaaaaaacgctgaagatctcagataagactagagagtgtcaggtttcttgattagaagaatttatcatcaaaggcaaaagagaaaagatggtaaagattttttaaaaaacaaaaaatctccaagggatcacaaattagtggtgcaaaatcaagacaacaaaagtaggtgttattcttgttcatttaaactatagttttctctgtttcatgtgtgttttttaaaaccacttaattgtatttgacattgaaaatgtaatagggccttttgttttcaaccagtttactaattgcaaaatatgtcaggaatcaaaagggcaggaggtgttggtatatttttttaaaatatataactcctttttaattttttcccctattttccttatccatttaggcagtgactttcaattagcctgcctactaatatcaggtcactaaactccgtggctgacgctttattccttcatgtgggttgtcactcgtttgcttcagttggctggcaaaggttgttgtatatccattactagcaacacagcactttgcatttctgaattgacaagcagctatattgacccagcgcttattatgggtcaacagctgcgttaaccaacggaaggactgaggggcaattaaaatgaattggcaaaaatatatcttcctaatttactccaatttgttatttatgctaacattgtatggcttctatggtgacactaaacagaatggacccaataatg

SEQ ID NO: 49309 - DNA, 1094 bp, Homo sapiens
tcttgctagatactaataaccagtgctggagaaccttccacattagttccaggaagtgcactgtaaagacctgttggttttagttttctcttggtacatttgaaatatgtcactggcttttaaaattaaatatgctttttatgcttttaagtattgtctcttttgaacttttgagtgtgagggttgaatttttagtgagaaaagaattttgtttggatttgtttttaattagtattttttaaaaaatatgttaagggcttctggtggtggtggaaaatattaattcctttaaaaatctggctgtgttgctagatccacatttgcttttctgtgtttttgtgaacaactgatcaaattagattcgtcactcttggcttacggtgatttgaaattgaaatggaatatattaaagcagccaaccacactgattacattgcaagcctcatttaatttcatacattcacactttacagtgaaaggcagcttttttaatgcatgattgtgactgtaccttgagcaactccaaaggtcatctgtaatgggtgcataatttgttagtgttagatatctgatttatggtaggtgtttctcagcctgatttgtactagtagtaaatatggtgagcatcaaagtaaaatctgtaagaagtttagcctgtcacatttggtggtattgtcttattcttcactggtcagtggaccacagtaaatcatggactagctgtcatccttaaatcgagaaagtgccagtactgagcccctgtagcacaggggttaaatgagctattctttttaagagggcaggctggcccaggtgaaggttataacagtattaccagctcatctaacagtacttgttcacagctacttgagccctagtcccaagaaggctataaaaggactttcagtttcataggagcatggacatttgtgagcttgctcttttttccttggttttctgtagcagcgaagtctaccaacttcatttcctttgtgtcttctgtgtgacaggcactgtggggcagccctcagagatccagagcagaatttgctttttgtttgttttttgtttgtttgtttttggtttttttctct

SEQ ID NO: 49310 - DNA, 1125 bp, Homo sapiens
atcattcagcacttggggaggtttggaaggagaagaaaattggtttctttgcttttaatgctgctttgaaaagatactcagagtttttcatgcgtgacatgtcacatgtttaatgtggacttgctggaagtcagggggtctttagcgtgtgatatttatggggaatattaagtgcagaatgaggtccctccagctggggaaagttgaaagaataggaggcccaggactgggcttgtttgcagcatcagaatgacataggattaagagtttgtaaaacaaggcgaggggttctcattggccagtaataaatgtaatccttggaggtaatttcacgcaatttgcttctgttccatggaagggtcaaatgagaaaaaatgacttaaaaaagagttcattaacaggaagaatggtactgtttctcgtataccatccaactagcagcctagaggggggaaaagaagccctactaaacaaaaaggcaaaatcgacgcaaaattgatatcgaccacaacacacacacacacacacagacacacacacacacacacacacccaactcctttccctcagtcttctccagcagtcccgtctcctccccaaactctccagcggccctgaccaccccaggaaagcggctttcactcagggagagcctgtggatgtggagtctgagggttttagactctcagacctccagtaaggccctagaaagttcccaccgggcctactaaacccgggaacggagtgtgtggtaggaatggtagttggcggccgctccccataccccaggccggggcccttcttgcgagtgccgcccccgtgagtccagggctagcgttgggtggcggtgatccacccgacgacccaagtgccagaagcggccaccagccggcgagccggttccgtgagctctccaacgtttcgggcgggcggggtctccgggcgtctggacccggggttggagaggaggggattgaagttgggggtgaaggggggtgcaggataggaggcgagcccgggacgtgcgggctccagcgccgaagctgccgggcgggctgcccacacccaggtgggcacagcgcctggcaggccgctgacctctgcccaaccctgcaccctcccctc

SEQ ID NO: 49311 - DNA, 1024 bp, Homo sapiens
tcctgtttaatttcataatagtgattttagcctattcctatatagtctgaattcgttttcactctttactgttactctttcagttttgtctcatctagagatttaacaagtatatgctttatgattttgtttcaatttatgtaatgcttttagatgcttagaattgtaaaagctcagagagacgctagatcatatgacaatataccctcctatccccttgttttacacgtgaggaaaccgagattagaaaagtgaaattggagtcccttggccaagtaacttttgacaacagtaagtagcagatccagatgcttggacatcaaagccttgatgcctaggccaccctgctgtaccatttccttccttgtaagtctgaaagttctgggctccagtctcccaagtccagtgttgttgtcactgcatctagcttatgtcccttccttcatctgctaacctagcggtctcagcaacaacaacaacacacatacgcatactaatatgttaacggtgtagttagaatttttttctttgttttcttaatttttttttacaattaacaaacatttaaaaaaaattaaattaaaccaaaccaaaaaacaagggtggggaataatgctagactggtaaaactttttatcagtaaacacatgctaatttcacttggtcatactaattcctttttttgtaaatgcttacaaagtatatatttaataatattgtctttcatttgatcaattgttgttaggcttagaagttggagataggaaaattttagtctttatgctctttaaaacctaaaactatagctacccatcttcagtcttttagtctttttccattcttcctctgctgatttgggaacaataagatacatttctatgtttttattttggtgattttttttcttttgcgtataccctcagatttttaagatattgtttaaccatatatttttctaagagtgtatgtcattttttggtatttttaatctcccgaccatgataaggaactctaatattttatt

SEQ ID NO: 49312 - DNA, 1028 bp, Homo sapiens
tgaccatataagcatctgtaaaacatttctagtttggcataatatctggaaaaaatagaaggcaacatggagaataatctctaaagtatacatttttgtaaaaaaatatgcaatacttgattttgcattatattcttttctaatataggcatttaaggcatttttgccttctaagcactattttaactgtgtttgtagattttgatatgtatttttattatatttagttcaaaattttgtctactttctcttgtaatttattctttaattcaatgattaatttacaattgtgtttttactgtccaaatatgtagggttttcctggttttcatgtaggtaaatttgagaggaaaatgttaacatagcagatctgtgttaacattcagcagatctccttcatatctccaagggaacttggatcatgattgactcttgaccagccactgggaatgtgaccctttggatgtcttttacataaatggtggatttttttttttgtacacctggagcaatggactatgtaggtacctgcttgtcaaaattgctttgtacaaacatcaagattgataaggtatacctagtttctaagtcttggttattgtggctggtcctatagctggatatgcctatatggccagccctctataaaagctatgaatgctgagacttaaatgctcttgcgctcttcttcaaatagagatattctgtatatgttcctgtattgtgctactagagagaaagcacgtatagaaagcctatgtctgacctctctgggttctacccaatgcatatctttttcctgctgcttttactctgctccttttgctgtaatacattttagccttgattataacctaatattgagtcgttttgatgaacctcgaacttgagggtggtcctgggttccccaaaactgtattctaatttaattctattgtggtcagagaatacactccatatgattcctttttttaatgttgagacttgtttcatggcctagaatatgatctttcctggtaagtacatca

SEQ ID NO: 49313 - DNA, 1061 bp, Homo sapiens
tactggtatactaaattcgcttatgtatgactgttcgatatcatctattaagtttttgagcttctgttcaatttgtgtcatttttttctctgttcttcaacttgtgtaatttctattgatctgtcttcgagttcacttattcctgttatgtccattttgctgttaaatccatctagtgatttttttcataaattatattttgtattttaaaatttccttttttattgcctttatttctctgctgaggcttcctatttctctactgaggttttcatgaattgataaatccaaggtctctgtcataattgaggttggttctgatgttctgcctcatcaaactgtgcctttttagtatgctttgtgatttttttgtcaaaagctggaaatgatgtattgggtaaaaggaactgaggtgaatagacctttagtgtaaggttttatgtttatttggttagggattaagctgtgtttagtattttctgtagctgtaagtgtcaggaaataaaatatcctctgctgtctttgttttttacttccctgttacatttgagttcctctagcaactttttcttaagatctgagatatgtaattctttctgttgtatccccctgttattatacaggatccctattgatgtagtaaggtgtagggagagaagtgttctatggtcctatgattgggtctcaatcttttagtgagcctgtgccctagactgtgaccttcgcaagtgcttctcagttttgctttgtttttcccaccttaggtgaaataggaaggctaaatggggacaggaattgggcatttccttcttccaggtcagttaaggtctgctaaatccccagttggttatgttctagtaatatagttgggtcctctgtatccatgagtttaacacgcatggattcaaccaaccatggatggaaaatgtttgggaaaaaaagcaataaagaataacaatacaataatacaaaataacacaaataaaaattgcagtatagcaactatttacctagcgtttatattgtatgaggtattataagcaatatagagatgatttaaa

SEQ ID NO: 49314 - DNA, 1046 bp, Homo sapiens
tggagataatcagaaacctttggaggctatgagcaacctatataatcccacctccctcagttatactgaaatttgagtagcttttcacagaatctgtaaattttttattaacctagttaggacttttttgagccaaatgctcatttctactgttcttaatacaatgcctgtcacaaagttaggtattcagtaaatactagttgaatctattaattagggattcaccataaatttctcgccactaataaattacctaagtgtgaacgttttgtttatctcggaaataagatgattaaataaaaatatttgcatatttttcatcttgcattcatgttgatacacagccaatatatttcaagtcattttaaataaaagattaatctgtccatgatatactttgttagataaagctatttaaatgaattgtttttggataaatcctgtaatggtgttttctacttcttctttttaactcatttgttgaaagacggtagggaatagtggaccaggtaattaaataaagttcatgttgtagtttctgcctcatatgatagccaaagtaaatgagattattaacatgaacactttaaagatgtgtatcaaaattaggaggcttatagagagtctcaagtaattaagtgtgtagcgtagcaaataatgactttctctaatattggggttaagatgttcagcagagtatgaattataaaatcctcaaaatacaacttgaaagacttttgacttttagcccattatcctcttgttaatgcacatgtaagagattatgtggggtttttatgtcattatggcaaattataggctgtactataggtgctattcagtattggatacgaatgagttccaagtagctttgttgatctttcactaaaactagggatttggcattgacttatcagtgtgattattgtaaaagagatgtagtgtggaactgtttcctgagattaatccaagtattcagtatcataatttagaaactcccttcagttatctgccctacgtctccatttactcagtaatgtacgcag

SEQ ID NO: 49315 - DNA, 1046 bp, Homo sapiens
atatttttatacatttaatgtagcctaagtcgacagtgttgataaagtctacagtagtctacggtaatgtcctaggccttcacattcactcaccactcactcaggccaactttcaatcctgtaagctccatttatgataagtgccctgcaaactccttttatggtaggtgccctatacagtaccattttttatcttttatatcatattattcctgtatcttttcaatgtttagatatacaaatacttaccattgttataattgcctatagtattcagtatagtaacaaactgaacagatttatagcctaggaccaataggctatatcatatagcctaggtgactagtaggctatgccatctaggtttgtgaaaatacactccatcctgtttgcacaatgatgaaatagcctaacaatgtatttctcagaatggatccacattgttaagtgatgcatgactgtttatactaaatatatatgaagggccctaaaaagtcattcagtgaaagatctctttaaatttgttaaccctagcattccataaatacttcactcagaatgtttccaaggaactctcattagggtagtgattctcaaactgtggtaatgggagcagcagcagcagcatttcctggaaactggttagaaatgtaattttatagccctacctcagatctatggcatcagaaactctggggtggggcccagcagtctgtgtgataatcagtccttcagggattctgatgcggctaaaaggcaagaagtgttagaaaattttactgttattctccaacttaacagtaaccttttgctttccttcattacacttaaccacaatttgtattttttaaagttctaatgatattctatgaatctgtgaattcatattccataatcataatctattctctgaatttccttccttctgtacctcataaagggtcataaagggaaccctttatgaggtacagaaggaaatactcattgaaggcctatcatggttttcaccctggtataagtgtcatctagctggtgtcaatttggat

SEQ ID NO: 49316 - DNA, 1040 bp, Homo sapiens
agagatttaattggacttacagttccacatggctggcaaggccttagaatcaggcaggaggcgaaaggcacttcttacatggtggcagcaagacaaaatgaggaagaaacaaaagtggaaacccctgataaacccatcagatttcatgagatttattcactatcataagaatagcacaggaaagactggcccccatgattcaattacctcccccaggcccctcccacagcacgtgggaattctgggatatacaattcaagatttgggtggggaaacagccaaactatatcatgtgtatataccacattttctttatacagtgatctgtcagtggacatttggttacttttagttaggagtaatatttagaaactgagatctgggaactagaatatgctcattgctaccagaatgttgttacttctggatctttcagcaatagagctaggaaaaaaaaatcacacatatgtatacatgcatacaaattctatatatgtctatatgtagaaatgtaaacatataaacatatagacatgtatgcatgtagacatatatgtgaaataactaattcattatgctgatctccaattgcaatccaatccctcagggctcttccagccattctacttttgtagagatgtaaaaattccttatagatgttcttccaaaatgagaattccagcacccaaaaacatcaatatattaataactcatttgcttagttgtataatacacaatggtttcggaattgtaatatctatactgtaatgtggagagggaaaacttatattcattcatgcatgcatgcatgcatttttttaacatcttatttggaaataattatagattcacaaaaaattgcaaagataatacattgaggtcccatgcagcctttactcagtttcccccaatggttacatcttacataactgtaagatcaaaactaggaaactgacgttggtacaatctgtatgtatagttctgtgtcattttatcacttgtatagatttgtgtaaccatcactgcaatcaagtagcaga

SEQ ID NO: 49317 - DNA, 1081 bp, Homo sapiens
aactgttaagccagtgactggctgctttgaagaatgtagaggggttggggagagttgaaggtgcagaacaggtagagccattgtagctgatccagatgagagcctagtgtggcttgaactgtggtagtggctgaggaaatgaagatagattcactagttccagatggattttggacaaggtgacaagttttgctcatggacagaaggtgaggactgggagatggggacaataagttctggtgtttgatcttgagcacctgggttgatggtgctattcttaacctcaggacatttgcagtggggacacctagggtagagggctggggaatacatgtcatgtgaaatcttagatccttattaggtatccaaatggaaacgtgaatcaagtagatggaaaaatgaatgtcagctttggaaatatacgtaagggagacattatagatggtattgaagtcatgtgattggatgagctcaccagaaaaagtgtaagagagagtttgacaaatctatccccaagctcagggcagctaacatttagggtatagttgagatgtttgaacacccagagagtttctgttcccacctgaccattaccttattccagaccatggcccccagtgtccactcctagtgtattttcaaatcagcttgtcctgatgtaagtgtgacctctggtttctcctttctagatgtggagaagagttcttttgtcttgtcttatggctatggatagaatgaaattatttcctagtaagaaaaagattccttagagaaatggtagtgatgtaagcctacgtttttctcctctctcctttcacaactttgccatatcttttggcctattctctacctaaacagatgaaattagtatgtaaaccttagattatgcatgtttctgaaaaactactcaaaacattttgttccttcagtgctacatgtagattattatataaaagataaaaattacaggttttgtatacagtattcaaagttacatgtgtagctcgagtctttttaaagctaactggtttgaacagtagtaaaatatgaacaagtttagctatgcaatcattaccttatt

SEQ ID NO: 49318 - DNA, 1047 bp, Homo sapiens
ctcccgcattcctaccttattcatgaaatcctccaattatgttcaaaggcagatcagatttgagagactgtctgtcctgatctcttgctttggctaaatcgaataaaccttcctctgctcctaagcactgatgggtcagggtttggcttactgtgcattgaatacgtgaaccaaaattttgggatttgatgacagaaactgcttgctattgccacaagtagctacaaattaacaatactgcacaagacaagataacccaagccttatagattaacaatatatagccaatcactaaccaatattatttctataaaccaaagagaattcctgacaaacaactttgtatcagcccactctctgtcccccttttttgcctttaaaaatctgcttgtacacaggcaaccaaagcaaaaatgtacaaatgggatcacatcaagttaaaaagcttttgcacagcaaaggaaacaatcaacaaagtgaaaagacaacctacaaaatgggagaaaacatttgcaaactacccatctgacaagggattaataaccagaacatacaaggaactcaacccacattataggaaaaaaatctaataaatcaaaaaatcacaaatgatttgaatagtcatttctcaaaagaagacatacaaatggcaaacagggatatgaaaaaatgctcagcatcactgatcatcagagaaatgcatatcaaaacaacaagatatcatctcaccccaattaaaatggcctatatccaaagacaggcaataacaaatgctggtgaggatgtggagaaaagggaactctcctacactgttggtgagaatgtaaattatcacaaccactatggagaacagtttggcagtttctcaaaaaactaaaaatagagctaccatgtaatccagcaattctagtgctgggtatatactcaaaaggaaaaaaacaaaaacaaaaaccaggatatcaaagagatatctgcactcccatgtttgttgcagcactgttcacaatagctaagatttggaagcaacataagtgtccatcaacagat

SEQ ID NO: 49319 - DNA, 1045 bp, Homo sapiens
gaatatatacaaatataattcccaggaaagaaaatcctcctctttatttttggttttacagacaggaaaataatgggcctcatgctgttttggttaactgggaaaaacagaggagatgtctggatagtaacctgttagctagcctcacactccacatctctcctttttgggttgtatacttagcctgcatcagaaacaagaatcagcttgtattaaataaatggtctcactttatttatatttaatcatttgggaaatgaaatagaaccattagaatagataatagatgtcagttttaaaaataaatactgaggcaaaataaatttctttacttttccatgacatttttctggaagcaggagcctattagactgttacgatgttctattccattgacttatctccaggttcccttttttaaaagactcgatcttttgaaatgcctttacattcaccatttatatgtacttacctacttaccacttctgcatcactagtactctgtctgaattcaaattttgtatgtctcatgcaaaactcaaaatccaactgtgcagcttcttgaccaaaaaagatgggggggagtgctgaatgtcactatctaaataaaaaagaattttactgagtagtggtggcctggagattgagttatgtggaggttctaattgtgaatttcaagtaaatatgagtaagccacccatttggatggcacacagaaatatactattaataattttctggaacatcttaattgaaagagaaaatataattagaaagtgaagacactcattttatttctcaactgagcttggtttgtataccttctagccaaaaataaagcaaatttcttgttcagtatttccagaagcagctctaataactaaatatccaaggacatcttacagaggtttttttccccaaagttgtgagagcttggtaaagatcaactgtgggaaacttctatggaacttaaaagattgaaaacaactaagagtcccccctcagatattgtctgcttatcctctctttgcagatctgctcattc

SEQ ID NO: 49320 - DNA, 1027 bp, Homo sapiens
gatgggactgcgaggttagcttccaagaagaatttttttacccacatgcctagtaccttagtgctctttgatctctcactctctacatgttgtatcattcttcagagcctctacgtgtagcttgagattctcacagcatgatggtctcggggtagttgcccttcttacaggatggctggcttccaagaggcagaaagtaggagttgccagggcagttatggcctacaagtggaactggagtagcattacttccactgactcagttggtcaaagcactcacaaggcctgcacagatttaaaggaggtggcgatatagactccactttttaatggtgcagtgtcaatgtcacattgagtgaaaatggcagagtaaggacctctgaaaattcactcctacataaaaataataagaacactgaaaaatggtcagaatcaacattttcagaactctggaaattaaccaaagggttgcgctaatctggggagcatttattcaagaacaatggctaaaactcattaagaactgcaaaaatttctggcattttaactttccatattcccatccccctctcttcagccccatggtagccttaaaaaaaccaatagcctacaatcagtgaaaaccagcatcctgacagccaccggaaagggtagaacagagttgaagcactctgcaacattccagagaattatcattatttgacctgtctgtggttccctgaaagatcactctcaaagctgtctttattttacctgacttggagcttgctcagtatgtaaagctttttcttcagagaatttgtcaaaaacaacagaggcaattgttgaaccttgaagctgcctgaggtggtacatagattgcaattgaggtagacaataggctaaacaaaaaacttaaatggaataactggaaaatgaaatgtccatgggggcttcaaaaattgtaacatgtttctggaaatctggagggccatgcacatatatagggctctttgcatgctcaagaaaaacctgagaagtctctaac

SEQ ID NO: 49321 - DNA, 1050 bp, Homo sapiens
atctagtgggtaaaagccagggatgttggttaagtatcctacaatgctcaggatggccctgcacgacaaagaattatgtggcccaaaatgtcagtagggctgagactgagaaaccctgttttagtggaaataagtttttatctttccttacattttctccccattcactgttattttcatgttttgtcagtgaattatcagttcacatttatgatctgtggagctctaatatgattgtttaatctgctttgttgtggagagtctatatatgtacacatatacacaataaaatttgccaattttaagtgtataatttgatgagtgttgacaaatgcatacagttgtgtgaccaccatcataacagtgtttgatatgtttaaatttcatgtagtttccaatatgcattcattaaataatattatattctaggacagaaggaaacctgaagtaattcaggtactgacaggtagcttgtgactgataggtagaatatacatggtaattaatgaaggataacacccttgaactgacttctgaattttaccatattttaatattaatctaaagattcttaattttacttggacatgatttgacccctggatgattggctgagaggagtttctatattgtgaaacaggaaatctatattaacatctctcataaaatactgagttttatgtccacaaattcctagattctctttgcatcttctaggtcttttttattcctgcaggtataaaacaagactgagtgtttgaagggaaaaacagaatatatacttctttcctaaaggataatttccagaatgttggttgctttggtagttgaatttaaccttggtaagtagtagcagttgtctgcagtaaagtggatggaaacccttgattccattgctgaaccaccttcttagagtgagaggtttgtcttgaccactaattgctataattggagcttgagagatggtttgagatgagtcttgaaatgataagtgtgtctatctgcttggcaggtgttttctctttccttttaattccctttccaaatcaa

SEQ ID NO: 49322 - DNA, 1050 bp, Homo sapiens
aaaatgtaaggctgtaaggaaaggggtagaagatcagaggaattctcatcaaaatattgcaaattatcccctgaacacaaactggtaacggtggtttgcttaagggaaggaaattcggagattagggatactgggtgaaaggcagattcttttttttaccatatattcctttgtatcttttaaattttgtattacattcgtgatctttcagaaataaataaataaaaatgcagtagcttcctgatcagaaagagggaataattgctgtcacttgcgtttcagaaacatagcatccaaactgatgtgattatggtgacctgtcccacttagttttgctgatgtactataattactttctccagtgaggctgacttcagaaacagttgcagatgcagaattttaatccagggtatgctgtatataagtaacttttgcatttacaatctaccatttggcgttttatggctaataatccacaaatatctaaactaatttataaaggcaaaaactactgatttaatgtagtactctgcttctgtatccccgaggtgagtcagaaaaatttcaagttgccacgccttggccagaccccacagtatattggttattggtcctgaagttagttctttaaaataacttgaaatgtttcatgcttagttctaggatctatactttctttgatttgactgggactgaaaggctcagaataactgaatatccttggctctaaataagaagctgtaactttgggccaggtgcagtgcctcatgcctttgggaggccaaggcaggaaggtagcttgaagtcaggaatttaagacagtctgggcaacatagtgagacccccatctctataaatgctttttaaaagtagcagggcatggtggcatgtgcctgcaatctcagctacttggatgggtgagttgggagcgtcgcttgagcccaggagttctgagctgcagtgagctgtggttgcactactgagctgtgattgcactcaaggctgggccacagggtgagaccctgtatttaaagaaaagaaaaaagaaaa

SEQ ID NO: 49323 - DNA, 1067 bp, Homo sapiens
tattttcttatggcagcccaagcagactaacacagcctgcaaaccccctgtgggttagggctgtatcttactcattgcgctgtctccttccccagttcttagcacattaccttgttatatatttcctttctatttgttgaatgaatgaatgaattaaatcttctcagtttcaaaatcaacaattattttttcagtcagaactcatgattgcaagtgttagaaacccacctaagcttgtttaagcaaaaaacaaatcttttgggtcagatgattgggaatgttctggggtagcttctaaaatctgaggaatgagtctgggagccggggcctcaggtattggcacaggggaccacacacctgccagatcctctctccataccctctccctgaggcagttggccttgttcttgcagaggacgtggctaccaagagaatggcagattgcattttccaaagatgacagcaagaggctcccccatatcccagatgctcatcttacaatgtgacttggacactccaagtcacattgtggggtctgtgttctctgcccttgaaactgggtgggcccgtgactacagtggaagtgacaccatgtgactttcaaggctaagtgataaaggatgaaacagcttctgctttgtctgctggagtgttgcctttggcatcctggctgccaaatctgaggttgccatgctgtgaggaatcccaggccacatggagaggccacatgaaagtgttctggcccagagccccagctgaggccccagctagcagccagcatcaaccaccacatgtgagtgaagaagcctctagatgattccagcccttggtcagccaatcactcttggccttcaactcctccctgcagaggccccagatattagggagcagacacaagccttccttgtgtgccctgtaaggcttcctgacccttacagaatctgggagcatgacaaaatggttgtttgatgctgctgtgctttgacataatttgttacatgacaatggtaagtggaataaagagcccaggatgttcggaggccaagatgggaggatcttttgagccg

SEQ ID NO: 49324 - DNA, 1032 bp, Homo sapiens
caaaagggcttgtttggaaatgatttcgggcttctaaatttccatagaaagtgctggaaaaaagtttaaggcttctttttaaataccatctgaatgatttttcttcccactttggttcacataataattgcgttcttactcttaaatttcaggcagttccttttagtcttgacagtgttgcaaattccattcactccttattttctgaggaaactcctgttgttttgcagttggctcccagtgaggaagtaagtgataagggttttattcaagacattttaaaaaataagcttttattatttgaaaattatgaaatgtaattttattatgaaaatataaaactaatttatgaacaatgttgtcatacctctgggtattggaactaatctgtagaatttgagcaacttaaaattttctattcttcttacagagagtgtatatggtagggaaggcaaactcagtgtttgaagacctttcagtcaccttgcgccagctccgtaatcgcctgtttcaagaaaactctgttctcagttcactccccctcaattctctgagtaggaacaatgaagtaagtgcagttattcaatgaatacatgaatatcattaatttccgtctttttaaaaaatagagacagggtctcactctgttgtccaggctggtcttgaactcctggcctcaagcaatcctgtcttggcctcccaaagtgctgggatcacaggcttgagccactgcatctggcctcccattccttatactacttgaaattttggaaattttgctattttagaaaatgaaagattgtgcacatttactgctggggtagattcttctttagtgtaattttcttatgactctcatgaataaactgatcctttttgtgagttgagctgtggtaaataacatcacattttagcacgagggttgccacctattaattcaaacaagccagaggtcatagatctacttggtgactggtggagctgtgtggatctggtaacttggaagccattgttcactgcctctgctgattt

SEQ ID NO: 49325 - DNA, 1030 bp, Homo sapiens
gttttccaaactttttcaacaggtgttggttcggggagtctggaagtgtagtgcattcctgggatcaaactggtccagccatctgttctttcatacgttggcccatacctgagtttttaaaactgaggaattttgttgaaagcttttattaaatatccaaggagtcttgtactgctcctaaacatgagattcgtgttggatttatcagaaacgcttattcaaaccagtttcttttgccaccattttagactatttgcatgttgtggtacactggtatggtttagtttagcctagtttagttaggcataaaactttaactggctgtgtttgacgtctttcatcttactttatccgctacctttttttgtttgtttgttctcctaagctgtctcgtcataagcatctagccaaggatcattctcctgatttatattcactggagctggcaggtttggatgaaattgggaagcgttatggggaagactctgaacaattcagagatgcttctaagatccttgttgacgctctgcaaaaggtaaatatcaatgcgacatgagaggttggagtatgaccatttcacttttagcctcttaatagaaaaatctgctgtttcaaacactgttgattgaactcttatttgccttctttggggctcctctaattatactggccaaggatggagtagggtcaaaaatgtatattgatatatttcttcctaatgctagaaagaacagcattaggaaaagttatctcacacaaagctttacaaaattattgtggtaaaatatatataacataaaattaccactttaaccatttttaattgtacagttcagtggtattaagtgcaagtacgttcacatgttgtacaaccatcaccatcttctatttctagaactttttcttcttccccaactgaaactctgtactccttaaacactatgagataactgaagtagaacacccagcacagtaccagacagtagatgcataataaatgctagttcccctctgcccttgaagttcttca

SEQ ID NO: 49326 - DNA, 1034 bp, Homo sapiens
aagggggttggaaattggctgttttgttaaaatatatcttttagtgtgctttaaagtagatagtatactttacatttataaaaaaaaatcaaattttgttctttattttgtgtgtgcctgtgatgtttttctagagtgaattatagtattgacgtgaatcccactgtggtatagattccataatatgcttgaatattatgatatagccatttaataacattgatttcattctgtttaatgaatttggaaatatgcactgaaagaaatgtaaaacatttagaatagctcgtgttatggaaaaaagtgcactgaatttattagacaaacttacgaatgcttaacttctttacacagcataggtgaaaatcatatttgggctattgtatactatgaacaatttgtaaatgtcttaatttgatgtaaataactctgaaacaagagaaaaggtttttaacttagagtagccctaaaatatggatgtgcttatataatcgcttagttttggaactgtatctgagtaacagaggacagctgttttttaaccctcttctgcaagtttgttgacctacatgggctaatatggatactaaaaatactacattgatctaagaagaaactagccttgtggagtatatagatgcttttcattatacacacaaaaatccctgagggacattttgaggcatgaatataaaacatttttatttcagtaacttttccccctgtgtaagttactatggtttgtggtacaacttcattctatagaatattaagtggaagtgggtgaattctactttttatgttggagtggaccaatgtctatcaagagtgacaaataaagttaatgatgattccaaatttgtgtcattgcagtactaaatctattttatattgtaaaaacctaacaaaacaggcttttctttcatcaggattggctgttttgttgtacagataatttcatggtgtttcttttacacttgtttattctcgctgcctcctgagatttagtactaatgtaaggaaggcattttaat

SEQ ID NO: 49327 - DNA, 1842 bp, Homo sapiens
ctatgagggttttttttttttttttttttttttttttgagacagattctcactctgtcactgaggctggagtggtcacggttcactgcagcctccacctctcctgggctcaggtgatcctctccccttagtctcctgagtagccgggactacaggtgctcccatgcctggctatttgtattttttttctcttttatagagatgggttttgccttgttgcctaagctggtcttgaactgctgggctcaagctgtctgcctacctgggcctcccgaagtgttaggattcccggcatgagcgactgggcccggccctatgagcattcttagtgtgacacaagattccccaaagatctttttgttaaattatagaaaatgagactataaggatcatgaaaaaagttgatgtaataaggaaaaagacttaaaacttctaacacttacctatattgggcattgaatttataatttattgtggattataaagtgatgaccattgtaatatacttttaaagaataacttgtgaaaaagtatattgttaggatgagatcgcttacctaaaatttattcttcaaagatactcatgctaaatcttggtgtcttcaacgtgtgtatacacacatatcttatatttggcagcaaatggattttcaattttattctcaatcactgcctaacaaggattttctaccacctctgtgtatcaatcatctgtggagctttttcaaaatatatatttgctctataggtgagtctgatgtgtaaccagaggtttttttttgcagtcccttttagggaaaggggagaattgagaccctttgcatgtcatgtgttccaccattaggcagcagtactcttgtttgagtttcgttttgttagtcacacagtcaaaaattccagactgaaacacaaacatgtagtgaaaagctcaaacactagaagagacagggattccacactcacatgtattatatacagtatatgtgcacatatatatcaaatttattgtcacttagcaccttctcggtgttacggttccagctctactataaacattaatatctgttaagacatttgtttcctttttaatccgttcaacaaatacttctggggcatctgctgtgtgctaggcactgttctagagattactgttgtctagaagctaacatatgaagtgaggtgggctggactagctgatctctaaagtctttagtgctagttttctggcattcttttatgtacctcgtaggagagattggattaagttgttatttaaaaaaactttgttatggtatatgccaattgaattttttttgtcactaaatagaatttcattctgaactccagttttctccagtgagcccaaatgtcaagtatagtagaaataggttcttttggaattcttggcatactggctttaggaatagctgtacttctgatgctgttaatttttgaccagaaattacatactctggtgtcaccccttactcctgccattcctttgctgtattgatgctctattatctctatacagtgtgtttttctatttaatttactttgtttaggtgttttgattaattttgtcctcacaattctatctttaaggttagtggctttcattctaagtcagtgataatatccttagcacctagaaagtgcctggcatatagacatttagtaactgttggatgaatatagtttatcacattcttgctattttacttattttttgctaaatctttttacttctgggagtcacttttcttactaatctcattacaatgagaaatcctggaagagatctcaattctttctagtcagacccttcatttttcagatgaaa

SEQ ID NO: 49328 - DNA, 1044 bp, Homo sapiens
ctgaagggctttattttatttagaatcctgtgggttaattgtgcttggcccacagcttgtactgtgaatttagggaccatagactttgtagccaggggtataatttctttgttggcagagcaacttaaagtttggttaagttttcatctgcagtctagtgctttaataacataacttgctaaaaagtgatatagcctgctaggggaaatagtatttagggggaaattattttttccgaattgaagatgaaaatacacagataaatacagtaatagtgatttttatctggcacagatggtttcagagaaaatgttgatacctcatttcttattttactgtaagagaactagcaaaagaagcttattttgtttcttaggtgagtcattctcaaacttggtctcaggatgcttttatactcttaaattattgaggatcccagagagcttttgtttatgtggggttacagccattgatgatttactgtattagaaatgaaaacagacatttaataaagttatgtatgcttttaaaagtaacaaaaccccactgcatgtcaattagatatttttatgaaaaataacttttccagaacaaaaattagaagagaggcattgttttacatgttttacaaatctcctatctggcttaatagaagacaactggattctctgcctccttctgccttcaatctattgcgatataatacgtcatatagcctttggaagaactccatagtacacttgagaaagaatgacagtgaaaatggcaagtaaagtcttaagaaaacaattttgacctctctgacctcttgaaaagatctcagggatctttgagaaccagtgtcttagactgccaagagaagatgtgatgttatcttttgagtggcttatctactgtaaattttattttaactgagatatataacttacagtaaaatgcacaaatatgagattgtatagcttgataaatttttagaaaatatatacatctgtgtagtcattcagatcaagatacagaatatttccagcaccctggaaggttccc

SEQ ID NO: 49329 - DNA, 1044 bp, Homo sapiens
tcactgcaacctctgcctcctgggttcaagcaattctcctacctcagcctcctcagtagctgggattactggtgcccaccaccacgcccagctaatttttgtatttttagtagagatggggtttcaccatgttggccaggcaggtctcgaactcctgacctcaggtgatccacccgcctcagcctcccaaagtgctgggattgcagatgtggccacctctcctgttttaaagatgatcatcccttgcttttagctgttctgcttctaattttatatgtgatattctatcaaaaaattgctgacctctggtctttttgtttaataatagtgtctctataattatggggagaaggtaccacatactgaatttaaatattttcgtcttttatatactatattttaaatttttaatgtttttatttttgctttaacattgtatttgaaaatttcatttgcagtaactcgatacagctttcactttagatttttctgttttgagtattagcccttccggtgttaatttgagtgttcgaatctttaggattaattgtgcaaagatataaagactttagagaagccagccaggcacggtggctcacacctgtaatttcagcactttgggaggcttaggcgggtggatcacgaggtcaggagttcgagagcagcctggccaatatggtgaaacccagtctctaccaaaaatacaaaaaaaaaaaaaattagccgggtgtggtggcacatgcccgtagtcccaggtacttaggaggctgaggtaggagaattgcttggacccgggaggttggctcactgcaacctccacctcctgggttcaaacagtctccctgcttcagcctccctagtagctgggattataggcgcccgccaccacgcctatagcaaagatcgcactactgcactccagcctgggcgactgagcaagactccgtctcaaaaaaaataaattaaaaaaaataaataaataatgactttagaggatacttcttctcagatctttcttagtggaatttgtgtatgtaaaactat

SEQ ID NO: 49330 - DNA, 1149 bp, Homo sapiens
agactgtctcaaaaaaaagaaaaagttaattattaatactgccttgtctaaaatgtcataaatgaaatgagatctttcttttcagtgtattgggttagcatttcatgattgggttagtaacttagaaaagttagataattttgtcaaaaattggtaaaaagctgttaacagataactttgagtttatcttttttttttttgagacggagtcttgctctctcacccaggctggagtgcagtggtgcaatcttggctcactgcaacctccacctcctgggttcaaacaatctccctgcttcaacttccctagtagctgggattataggcgcccgccaccacgcccggctaattgttgtattttttagtagagacagggtttcgccatattggccaggctagtcttgaactcctgacctcaggtgatccgcctgccttggcctcccaaagtgctgggattacaggcttgagccaccacgcccggcctaactttgagtttatcttaacctgttgtttcaacagagtagattgatagttaggcatacccgcattctgtaacatttgatgtgacttatgtctaatattaagtcaacattgctcacctattggctgatttagggactgggatttgtcggaacttcacagcctttgtaacgatttaaaaaaggagttaagaaaggtgttttctttttaaaataagtcttttcgttttgatgatatttttcaacattagtacatgcatttttggattatccagatgactgcctcataatcaagaactgttaacatcatttcggtacttatgttagcttaataatgtgttggtgccaagggcaaatgatgtcacaggatactatgtgtatagagtagtgtaatcattcaggtagaagtaggaacatatgatggtggtatagccatgcaaaactcgaacccatgccttagcattcagtaatacactgccatctgtcacgttatattaatagttttatttgtattccatttataaatttattttagttttagttatgagagcagtaagcataaggaatttaatcctaatttcatttctgcatttatttaagcaacattaaaatagaaagtgattaaattagtttttaaaaattctgttatgatagaaccagaatttgcaag

SEQ ID NO: 49331 - DNA, 1046 bp, Homo sapiens
tttctaaaagaatacatttctgctgccacaaagaattttgaatgcaggatgcagttctgttgcagtgacttataggaagtagccatggatgtacacagtaatttagtgacaaaaatcaggaatctgtaaggggtgtgtatgtgtgtgtgaatagtgttggaaataaaatacgagcatttagctcaagtaacatatttgaatttaacaaagattaattggacatctttatttgcattaacctgaattattgattggatttaaagctgtctagaagtagcatcacactggggatggggggggcaggaaacctgtgcttaatacagttatcttgactggctttgggtataatttatcataatgtgtgataagaatgataaagtctgtgcaaatgataatggcagtgctggtggaactaggaaaagaaaagcttttacctttgagcaaaggccacattttaaaataacttagggatgtttaggtgtatagctgtgggctcaactattaaaaataacttactgtatttcagactccttaacatgaacctcctcatttaacacactctgtcagagggagagatccccagacttctcagccactcctgcctgtttgagaaggattctcaaacaccccctcccccagagaaggggcctcattttgttgcccaggctggcctcaaactcctgggctcaagtgatcttcctgtctcagcctccggagtagctggggctataggtgtgcaccaccacagccagctaatttttataacatgattttttattccatatatctgaggaatacagctaattgtgtcttagttccttgatatgtactataacagtgacaacgatacttaacatgcagaaattgtgaattaagtgaaaaatccaattttgtaaaacatgtttctgcatcaaaaactaaacagtttgtcttgggagtggggttatggtgagattaatggtagtttccccctcccttttctgacattattgatgtatggtgtgatagttaaaactgtaggacactggcacttgtactgtctgagt

SEQ ID NO: 49332 - DNA, 1299 bp, Homo sapiens
ttttgagacggagtttcactcttgttgcccaggctggagtgcggtggcacaatcttggctcactgcaacctccacgtcccgggttcaagcagttctcctgcctcagcctccctagtagctgggactacaggcatgcaccaccatgcccggctaattttgtatttttagtagagatggggtttctccacgttggtcaggctggtctcgaactcccgacctcaggtgatctgcctgccttggcctcccaaagtgctgggattacaggcgtcagccactgcgcccagccagtctttgaagatttttaagcagtgctgtgacatattttgcatttcagtaaaactcatagtgatgatttttaataccgaaagaacaaaacaattgtaggaatggatgcaggcctgacagtcactgctttcaaaagaaagctcaatcccttttccctgttgtttccttttctccccgtttgaatttatagagaacaacagattctgtagagaaccttcatggtatagttggaagagccaagggttttagagtcttaacggaaattattgtgatcttgtataagctcagtgtacttaatctcttagcttctatttatgtctgttaaattggactgatggctgtatgagataggtattatgattaaatgagattatacaaataaagcacctactgttgtgcttgatacacaagtaagtacttaaaacttttcaagaataatatacaaactaagaactggaaaggagccacagagaacttttgaatggaatggaaccaacaagtccacaaaagaaaaaaaatctttagcataaatactgagacctgtttcgccttgcccacagggtggttatggaccatagtgtctaaatataattgattgtgaggtgtatgctacaagtaattataagcaattaaataattagttaaaatagtaatgtttgcaaatgagattacctaaaaatattagagtcaagattatccccttaataattattttcactcacatttcatgtgttttcgattgaggcaccaaaagaatccttgaagtccagcatataagctattaatgtttgctgtttttattttgtgctctgctttatacagtttttgttttttggcaatttctctgtgtccatagaagtgtgtcaaacctgtgataaccttattttagtgtcctttctcatgctgtggtagaaaaactgctgtgtaggttactttttcttctagacaacaatgcactaaaattttgtctttaaaaacataattgaatctgtcatagcaacagcatgttcaatt

SEQ ID NO: 49333 - DNA, 1040 bp, Homo sapiens
ataggtaccatagattgaggtctgaggtctgcagctgtggttgtccgccatttcagatgattgatcttgtaaacagatgatgtaattttactttattggtaaaaacagtacagtactataaatacattttctgattttcttctttccttttttttcccttttcttttttttttttttgagactatctcactctgtcacccaggctagagtgcagtggtgcgatcttagctcgctgcaacctccacctcccgagttcaagcgattctctgcctcagcctccctagtagctgggattaaaggtgcacaccatcacacctggctaattttttttgcattttttattagagacggggttttaccatgttggccaggccggtctcaaactcctgacttcaagtgatccgcccgcctcagcctcccaaagtgctgggattacaggtgtgtgagtcaccaccccttctgagtttctttttttctctagcttgctttattgtaagaatacagtattataatacatgtaacaaaatatgttagtcgcctctttatgatcagtaaggcttcttgtcatcagtatgctgttagtagttaagtttctgaggaatcaaaagttatttatgggccgggcgcagtggcttatgcctgtaatcccaacactttgagaggccgaggcgggtggatcacgaggtcaggagttttagaccagcctggccaacatagtgaaaacccatctctactaaaaatacaaaaattagcccggcattgtggcacctgcctgtagtcccagctgcttgggaggctaaggcaggagaatcacttgaaaccaggaggcagaggttgcagtgagccgagattgtgccactgcactctagcctgggcaacagagcaagactccgtctccaaaaaaaaaaaaaagaaaaagaaaaaaaaaaaaagtagtgaggtctggcgccctctactggtgaaggctaagtatagcttgtgttgtacagttaggtctcttgtctctagtgagtcaaatattttaatggaaaaacaagggt

SEQ ID NO: 49334 - DNA, 1034 bp, Homo sapiens
attctaaccttttttgcaatgtttctgacttgcatggctttagacaaaaatcaaacctttaatttaaccttactcttattttaaggtgtacttgatgatttttagagctcttgggtttgtgatattcaacctaatattctatgtctacattgtgttctttttcttctaaaaactttacatttttaaagatgactggtaatttaaaataacaaaggaatgaaacaaattacattatccctcactcttacattttgtttttctctactttttaatgttaggattttattttacaagatctgacacggttgtaccaagaagcagcaaccaaagtgttaatcactgttcaatttagggctcgctttttggatatgctttttatgtgctggcataaagggaatttctaaaatcagatttttcacttaattttttttaagcatgcctttaaaaaaaattctcttagagaattttaggctttagtatgtagtaaaactcgataaatgaaacagccttggcagagacaccgtgggatgaacactcttggatgtggttgctgggagggtgcaaattttctggaatgaaatttggcagtatttgtcagtggccttcaaagaaattgtttatactgttctagtaattatatatccaggatcctatcctaaggaaaagttgaagttcaacacaaaggtttatatatgagaacattaattacagctatgtttatgtttgttagcagtaaaaattaccaaatactaaacgtccccttaattttgtttaattcatgcaatattatctggccattaatatttttttaagattcttaatcaaaaaattgaatacctagatatattgaatggaaaaggacagagacttatgtataattccagttttattgaacatatatatggacagtttttatttactcttaaagattacaaggaaataaatatcggtggtgtttataggtgtggaattacaggtgttttaaattttattttttatattttctatgagcatgtgtaaactacctgtatatc

SEQ ID NO: 49335 - DNA, 1045 bp, Homo sapiens
ataaaagtaaaaaatagagagcctttttacccaaggtcaaaacataattctgtggcaaaattgggataaagaatccaaagatcctaaaattggtcctgtactcaccctaccatggtgattgtgtacttaaataatatttttctgagtaaatgctggagtgtagaatcttcttaatttcagtattatttatgggagcatttctgtatgtgcaaaattgttataaaatttcataattttccattaaagcaacacataagtatattttaccagtattatattttgtaaatgtgttttgaatttccttatattatttaataatagtgtgagcaattaagaaaaaattgttttaatttctgctttcaaacacgtttttgaattaacatttaggaatggatacagcagaacaatatcttatccatagtgttgcgagatagtcttcatcagccacagtatgtagaaaagttagagaagattcttcgttttgtcatcaaagaaaaagctctgaccttacaggatcttgataatatctgggcagcacaggtaaggaatttaagatgatggctatttagtttttaaaataaagatactaaaaactgaagaaatacagtagctgtcatgaaatggatgcaggcttgtattgtttgactttgagaacgtttaaatgcttgttaccctgccaggaatctttttgaaataaccaataatcttttaaaaataaaaatattcttttatctgtatttgataaaggttgagaatttgtcagtggttttaaataaagatgcaaacagtaaaatcataaggaatgtctattgaaagagagtaaagacatctgtaattggtttcttcatagatttaatagaaagcaaaaacctccagtgtcaggagaattaattcacttgattatttataaagacctgtaataattattccagagaatttataactcttcagaaggattagtaacctttttagtttttgagttggaaactacaactccttctattatcttaatgacagttttctaatcgtggatttcttgggaagc

SEQ ID NO: 49336 - DNA, 1095 bp, Homo sapiens
tggagtgattgagaagggaacaagcaagctgctagtctccgaatgagcataggacaaaaacataaactttctgagtggtgtgatagcagcctccaagccacacagacatgcagtggtaaagggtaaaaatctactagtcaaggaggcttaaacacagcgtttggccaataaggggcttatactgatgcaggggcaactcctaggtaggcaggctaaaggattaaaagaaggaggaaaacatgggggcagagctgtcggaagctgtgcactgtgagggaaatagactatgaagtctatttcccagtcactatatcccatagccatagcccttatttcccatagtcatatttctgtttcccatagtcatagcccagtcactaaacaagcaagcaaacgggtgggggaagggagatcagtattcaggttgttgttgcatatctaacatgtccagattttgatgacaaaaattgaggcatgcaaacaaatgggaagatgggacctgtagactgacgcagagactgcctttgaaggaggccaaatggagggctttgcagacagacttgacagcaaagacttgaattacaaatatgctcatagaactgaagaaaaccatgtctaaagaatttttaaagtatgatgacaatgtctaatctaaattagaggatagtaaagagaaattattttttatttaaaaaatcatgtagagattttgtacttgaaaagtataataaccaaaatgaaatattcataagaggggctaaacaatagatttgagctggcagaagaatgaatcagtgaacctgaagatagattagtagaaattatgcaatctgaagaacacaggaaaagtgaacagaatctcagggaaatattgggtaccatgaaggggaccaacattaattttaatgggaataccagatgaatgagagtgacagaaagagacatagtcactgaaaacgtctctaatttgatggcagacaagaagcttaaaaaagaattgcaaatagggtaaatgcaaagagccccagactgagacacattatagtcagagagaacaattggaaggtggtgagagaaaaacgagtcttcctgcac

SEQ ID NO: 49337 - DNA, 1040 bp, Homo sapiens
tactccatccaacaatagtgaaactactaaaagcacatatcatcttaatagatgcagaaaaagcatttgtccaatccagcctcttttcaatatagaaaggctcaaactaggaatagaagggaacttcctctacctgatcaagactgtcccaaaaaacccacagctaacctcatactaattaatggtaaaaaactggttgctttccccctaggaacaagaatgagacaaagatgtccactccaaccacttctatttaacattctgcttgaggcattagccaggataactaggcaagaaaaagaagtagacaacccaattaagaaatggatgcaaaggatctgaatagaaatttctgcaaagaaggcatacaaatggccaatgagcacttgaaaagatgcttagtattattagttattaggggaatgaaaatcagaaccacagtgagataatgctacttcatacctactagggtgacaaaaaagacaacagtaaatgttgatgaggctatggagaaattggagcattcatatagtccttgtgggattgtagagtggcacccaccttgcaaaatattaatcgtagaatttaccatattacccattcccagttacatacccaagtaaaatgtatacataaatctgtacaacatgaatgaactttgaaaacattatgctaagtgggaaaaagtctgtcagaaaaataccacatattgcatgattcttttttttttttctttttttttgagatgaagtcttgctctgtcgcccaggctggagtgcagtggcgccagctcggcacactgcaacctccgcgtcctgggttcaagtgattatcatgcctcaacctcccgagtacctgggattacaggcacatgccgccattcccggctaattttttttttgtagaaacggtttcgccatgttggccaggctggtctcaaactcctgccctcagatgatcagccctcctcagcctcccaaagtgctggaattacaggcatgagccactgtgctcagccatgattccatttttatatgaaa

SEQ ID NO: 49338 - DNA, 1289 bp, Homo sapiens
tacaggttgagtatccctaatccaagaaatccaaaatttgtctggtcccagacatttcatataagggattctcaagctgtattaagtatctttaattcacatcctcttgtttaataagaaaatacttagtgttaaatccccagcattattttcttggcaacaaaatttcagagtctgctgaatatgatgatgtctgtctttctttttccccccagagcattccgcggtaaacacctctcttttgtagttcgatttccaaaccagggcagacaggttgatgacttggaggtatggtctcatacaaatgatacaattggttcagtacgacgatgtattctcaatcgtattaaagccaacgtagcccatacaaaaattgagctctttgtgggcggtgagctgatagatcctgcagatgatagaaagttgattggacaattaaacttaaaagataaatcggtatgtatgtatagttaacagatttttcaataaaatcaaaccagagactatcgtttaatcagtaaatactaattgagcatttgttatgtttgggactgtgttaggtgttagagttatagcattaaagtatagcatgtagtctttcggattttttggttggtatatcactaagttttgtgttttgtgtaagtatttttccttgtttttgatattaacatagtatataattttcagcttattacagccaaacttacacagataagttccaatatgccttcaagccctgatagctcttctgattcctccactggatctcctggaaaccatggtaatcattacagtgatggtcccaatccagaagtggaaagctgtttgcctggagtggtgagtagatacagttttgaactactgtatgtaaggcatcatgctagggtttttgagaataaagtatatagagtggttctttcttttcttgaggagcttacagtttaatgagacaaaaaaatacagttaaccaccaacttcagaatggatccctctaaaaggtaattgtaacacagttggaatttaaaacataatttccccataggtatagtattgttacttttacataaaattaaccaattagagcttaattataacactattggatgtataaatttagaggaaaacagtcatccctcgtatacgtggagaattggttccaggacctctgcatatacccaaaatgctgcagatgaccctgtgcaaccagatatacaaaaagttagccttccatatacttgggttttgcttgctggaaatactgaattttctgtccacatttgattggg

SEQ ID NO: 49339 - DNA, 1870 bp, Homo sapiens
taaatggaccgtgctttttggtatagactataacaagagttgacagatgacagcccacaagccacatcaagccccctgcttgtttttgtgcatcccaagagctatatttttaagtggctacaaaaaaaaaatctagaagaataatattttgtgatacatgaaaattatatgaagtttaaattttagtgtccatgatcaaaaccaggctcatttgtttacattcagtctacatgactgcttttgtcttaaaatagcaccgcccaggagttgtggcagaggccatatggttcacaagcctaaactgcttaactttcctggccctttacagaaaatgtttgcctatacctggactataatatgggtcatgtgtcatctgcggtattgttccttttttatccttagaaacaaccacttccaacttctcgcttttactttagtatatatatgtaccattatgtctggagtgtcctcatacagctatttctttgttacttacagatatatactgattttctgctgtgtagatgaaaacttaactgttacatacccccacatcctcccagtatttgcttaaatccagattcaacatctacgtttccaagattgtttgaaatatagttctctagatcactgacaacttttatcctggatttaataatttcccttttattttcctgattgtacacctatcacttattcttcccacatacttttttttgagatattttttatctgaatgtgggcaaactatcacgtttgattaatggtttgtgtatagaatcctaggtttgaaaatatattccttctggctggtggcattgctgatgagaagaccaaagtcctcttggtttctattcctttgcatgtgaccttcgtttctggaagttttggttttatccttacgttttgaaatattatgatgtgccttagcgttaagtctgttttgtggtgcgtcacctgtgggcctggagatttcctcagttgagagagatttgtattctttgatagttttctcaccagcattttgcgttttgtgtgtctttgaaatgtctaagtgtgatggtgaatttactagatctgattttaccttttctctcttcccttctctctttaatcttattccacctttggggtggcttctttaaccttttccagctcttctgttggcttttcccctccaaatattctagtgttaaaatttcaagacctttgtctccttagtgatccttttccatatacaggattttgtttttcactaacacattcttgcatttatgttctaatatatgtgtgttcctttaaaacctaatgttcggcaaaattatgcactaaaaatagtagggcttttggggaaaaagtagagttttggcagatcattcaagcctatacaacctaaaaattttttaaatgtattttttggaaatacttacaatcttacagaaaaattagaagtataattcaagaacacttgagagtaatttactggtttttgtagtcccatcgcccaccaaatactttccctacaaacaaggatatttgtctgtataagcaaaattaagccatctataccaggaaattaatgtcgattcattactgccatctacttagcagactctattgagtgttttcagttatctccttcacagcaaaaagatatagttcaaactcagatatagtcagccctccatatacatgggttctggatctatggattcaaccaactgtggattgaaaatgtttgggggaaaaaacattgttgaaagttccaaaaagcaaaacttgaatttgccacatgctgagtactgtgttgaatccacacgaatgaagctatgtgtaagcattgtattaggtgttacctaatacaatgtac

SEQ ID NO: 49340 - DNA, 1063 bp, Homo sapiens
atttctctctaggctattactgatggatattatgttttcttctttttccagcatcatcttttactgtccttgagttttttaactagctttttatattaaaataatttcaaactgtttacaaagaatacagttggctcccaaattcagtaattaacagtttgccgtagtgatggcaaaagtttcctaacatttggagaacaagttgtagacaatcatctttttcttcctaaatagcttagtatatgtcttctaaaaacaagaatgttctcacttacattaacatagtattattcaaaataaaaaaaatttagcatatacagtaatatcatctaatctgcagaccattttcatattttgacactttcctcagtattggactttataacaatgttttctggttgaggatctaaatccaggttcatacattgcataattattcggtatctctttcagttgtctttaatctggaatagttcctcagtctttgtcttttgtgactttgtttttgaatggcacatgtcagttgcgctgaatatctctcattgggtcttatctgttctgatgattatatggaggttgtacatttgacagagtactacttgtatgttgatgtgtctaagagcatcacattgagagacacatgtcactgtgtctttggtgacattaacccagatcacttagttgatagctgccaggtttctcctctaaaggagagagatgctttgtgtagagagatgctttgagacttcgtaactatctttttcctcatcaaacatttgttttatcatctattgtgattgttgcctaaatgtttttactatgatggttgcaaaatggtaattttgttttaattttgtcatcctttctacatttattagttgacattctataaggtagtgctttgttttctcgcctttatatttgtcatatatgatcactcttatgggtttattttattcattgggttataaccattgtaatggttatttattttgatgctcaattgtcctagatatggtcagtggaagcccctataggttagacccagacatacaacctcaat

SEQ ID NO: 49341 - DNA, 1039 bp, Homo sapiens
ctcatgcttgtaatccctgcactttgggaggctgaggcaggtggatcacctgaggtcaggagttccagaccagcgtggccaacatggtgaaacctcgactctactaaaaatacaaaaaattagttggacattgtggtgggcgcctgtaatcccagctacttgggagactgaggcaggagaattgcttgaacccggaaggcggatgttgcagtgagctgagatcgcgccattgtactccagcctgggcaataagagtgaaactccatgtcaaaaaaaaaaaaaaaaaaaattgaatccccaaatacatactggccccaggggtttcaaataagggattgtgagctgtgtacaaatctgcccctcagatggagtttataatcctatagtaacgtttaagcatagttatttacaaggtacttctcacttaatccgtatagcaactcagaagtagactttgctgatggagaggcacaaggactgtagaaattaaatgactaacaagggcataatgatcactaaatgctaacactaagactgaaggttttctgcttcttgagttctgacatttctgccacacaaattgggctctgggtgtaattataatccaccagcaaatatgtgaatccctacctatgtgcttggcaattaaaaccaaagtcaaataaggcagttcttgcactcaaggaactttgagagagaaattggtgccataaaaggtaaaatactttgagaattggaaaggccataacttactttctacctggaaggagcaaaagtgaaggttttgtgcaggatgtagcatgtgagctcatgtttgggcaggatttatatgtgcataaaagtagaagatggtcattgccagtgcgctctctctctccctttctcactcccagttatgtggcttttacttcatgtgtctttgaactccatacactttcctcctcatggtctaccctgatctaagcagtctggacccattgcctggacaatcatagtatccttgatcttcccacctgtagtgttgtactcttctaatctg

SEQ ID NO: 49342 - DNA, 1675 bp, Homo sapiens
aatgtattaaatgtgaaacattttttatttcagaactgttcgtcaggtggcacaggagcagttctttttaatgtgcaccagatgttgcatgggacaccggcctctacttttcttcattactctactctttactgttttgggggtgagactttttaaaatatgcttatcaatgtgattcattctttaagcaagaaacattcagaaatttgtggttttagcttgcattaaagttaggacagtctatatttaataaatgaagtactactttatttcccgcactgtggtagtcatcttctctagttaactctgggtttttaaaaaagtggattttgaggatggacgtgtaaattgatattattctactctgtttccagagcacagcaagagagagagctaaacactcaggcgactactttactcttttaagacaccttcttaattacgcttacaatagtaatattaatgtacccaatgctgaagttcttctcaataatgaaattgattggcttaaaagaattagggtaagttttagttaatactccatttatatgtcattattagtaaatagaatgttttattgatgatttatattttttgagcattttggttaaatggaaaactccaaagattgataaaagggaccaaagaatgtactctgcatcagtggacgttagtaatctgtgattcacaaaatgcatatctagtttagtaaaatgaattgcttacttgacacttgaaatactgatgttcagcttcttttattttagcattttgggcctttttgcaaattctaatttttaaaaaaagtattcttgaattgtttatgtcaaaaatgagtctgatagagcagaactttctaccataacatctgatactttttacttaggcaaaatgatacaagaatttatttctgaagagatttgtagtttttaaccttcaaattagcatttcttctagtagttcataaagccaatttctagaaagttctgaagaaaacaaagttgtttgaatggaaagacttaaggaaattatctcatatccctccagctctgtctcgttctggctcctctctccctctttacctccctttcataagctagacatttgatttcttcccccccccaccccaccccccgcctttggcaggatgatgttaaaagaacaggagaaacgggtattgaagagacgatcttagagggccaccttggagtgacaaaggagttactggcctttcaaacttctgagaaaaaatttcatattggttgtgaaaaaggaggtgctaatctcattaaagtaagttctgtgttcttggttgtaagctacatatcataaccttctaaatgtttataatcaaatttaattaatttatagtagtatcatgtctttgtactttcttgatcttttctcttttttaagaatctttatcaaatttacagtaatttaagaaatacagttatgccttactttattcaagagacatttctaaatttgtatttaaataagatttcatggctggacttgctggcctcatgcctgtaatcccagtactttgggaggccgagtccagtggatggcttgagcccaagagttgaagaccagcctgggcaacatggtgaaaccccttctctacaaaagaaaaaaaaaaaattgccaggtgtggtggcgcacacccatg

SEQ ID NO: 49343 - DNA, 2306 bp, Homo sapiens
catttggcaagataaatttcatctcatgaaacctgtcataaaattcaaactccagattaaaaggtagccaaagtaaatgccgtagagtatagacgtaaaactttattttatttatttatttttttgagacggagtttcactcttgttgcccaggctggagtgcagtggcgcgatctcggctcactgcaacctctcgggttcaagtgattctcctgcctcagcctcccaagtagctgggcttacaggcgcctgccaccatgcctggctaattttgtattgccaccatgcctggctaatattgtatttttagtagagatagggtttcaccatgttggccaggctagtcttgaactcctggcctcaggtgatccacctgcctcggcctcccaaagtgctggaattacaggtgtgagccaccgcacctggcccagacttaaaactttaagttgcatgtattggaaaacctttcaggtcttcacttagaagttccgtaacgttatgagttcgaagaaaatctggctttgaagattagaacgtgagaagttaccattttggtgcaccttatttatgttctcatttaatgcccacaccaggcgcatgaataggctgcagatttcagaccttacagataaggaattgaagctcaaaagggcaagggcaatataaaatattaataacagaaaaagcagaaataagcataattgatgctgttttaagagaaaatcgctatttagaacacttaagaatataattgattatagtaaatctttaagaacatgtcaaattactttttgatgtgtttcagaatgtttggaagttttaaataacatctcaggaatttctgaataaattgattgcttaaaaggttagacctttagctgtcctatcaaatctatgtattgtgagaattcttgtattttttttttaacttaatgggggttaattttttaatcacagattggagtatagtacaacgttgtttgcatccttccctatctgccattgttccctgtcaacacagaaatatttacctaattccatttttggccatgcagtttggtatgatataattaactggccccctagacaatgatacttaatgttgtttccaggtttatactaggtggagggagataggaagatgtacagtgatttacaattatcacaaatctgctgtcttgcttgctcctcaaaatagcattatagatatcaggaaagcaagtgttacttttattattacatttactaggaagaaacagaaagttacctaaaggtgggggaaaaaaagtggtaagcatcagaaccaggatgtgagcccatgtggttttaggattatttaaaactgagaaaattataatgtgttgatatatttagataacatttcattccttgccaaatttgaaggcaaaagtatcaaatattaagaaagtgaataatggctaaaaataaagatgcaagtaaagttagcatgtagacattagaattatactatcttgtacttttgagactgccatagaagcaacatcatatgaaacgggtttgcgggtgattggataagaagctgcacagtggtgcctgttgctgtatattttagattgttggaagatgaagtgcaaactcagaacactgcttcaggttgctgtagggttagtcgaattatgggtggtagaattattgccagggttgctttgtcagcataatagagtttgaaaggacagaatggccgtgttcatgctacaagaatctttccttctctcagcttgtgaagcacttactgagtgggaatatctgccacctgttggaccccgcccacccaaaggattcgtggggctgaaaaatgccggtgctacttgttacatgaattctgtgattcagcaactctacatgattccttccattaggaacggtattcttgccattgaaggcacaggtagtgatgtagatgatgatatgtctggggatgagaagcaggacaatgaggtaaatttgagttaccatttctgttttctgtgtttcaagttatgataccagatactattctctcttaagagagtgttatactttcatcaaacgtattaaagtatatttgaaagttagggatgggccgagcacacacctgtggtctcagctactcaggaaactgaggcaggaggattgcttgagcctgggagctggaggctgcagtgagccatgatcatgccactgcactccagcctgggttacagagtgagaccctgtctcagaagaaaaagaaaaagtaagtagggatggacttctcccagccagcatgaactgctacctcttaa

SEQ ID NO: 49344 - DNA, 1771 bp, Homo sapiens
agctcttacatttaggattttgatccattttgagttaatttttgtatgtagtgtttcataagggctcaactttattcttttgcatgtggattatccagtttacccagcaccatttgtggaagagtactagtcatgcaccacataacaacgtttcagacaattacagaccatatatatgacagtagtccaatgagattataatgtcgtatttttactgtaccttttctatttttagatgcacagattcaccgttggtttgcagttgtctacagtatgtagtacagtaacatgctgtacaagtttacaacctaggagcaattggctataccatctaggtttataggtacactatgatgttcacatgacaaaatacctaatgatgcatttctcagaatttatccctgtcattaagcaaagaatgactatactgatataggtatattttattgacagatctgagcattttatatacaacagctacacaaaggatatattacccccattcacacataaagaaacttgaagcctagaaagtttaagtagtttttacttgctcaaagttacttggtttataagtggtagagcctgcatttatgtctagttcagtctaaattactatgctaatgctacactatattatctatctttcttacacatggtcagggttatttggttatgataactaatatgtgaaatggtggggataaacactaaataactaaaaatttataaattgaaaagtgctttggaaatgagcataataggaatacaaatcatttgttcaataactgcttggcatttgtctcaacgtattttattatactttagctcattggtgacattttttggtttctagagcaatgttgatcccagggatgatgtatttggatatcctcaacaatttgaagataaaccagcattaagtaaaactgaagatagaaaagagtacaacattggtgtcctaagacaccttcaggtcatctttggtcatttagctgcttctcgactgcaatactatgtgcccagaggattttggaaacagttcaggtaaactatggatggacagtaatagagatacttcttaaaatgaacatctcaatacactaacattaaacctctaaaagacatgttggaaggcatctttttttaagcactggtaatattcaaactgtccttaattgggtgggtttttttttttttttttaggtccccttaggaagaagtagaaactgccatagtaagtaagggcaacatcctttagtctcttaaccatattattaactttttattaggaaaacatctaataaatacagaagtagaaaaaatagtatgaacccctgtatacttgtcacccaacttcagtagtagtcaacttgtggccagcctcatttaatctatattcttaacctattttttttttctttttttctttttctttttctttttttcttttttttttttgagatggagttttgctcttgttgcccaggctggagtgcagtggtgtgatcttggctcactgcaacatccgcctcccagattcaagtgattctcctgcctcagcctcccaagtagctgggattacaggcacccaccaccacgcctagctgattttttgtatttttagtggagacggggttttaccatgttggcccagactggtctcgaactcctgacctcaggtgattcccatctcagcctcccaaagtgctgggattacaggcgtgagccactgtgcccggcccctacctatttctttctagattgtttt

SEQ ID NO: 49345 - DNA, 1035 bp, Homo sapiens
attccatctctgccttaaggctattttagcatttctgtttatgctcttccaaactgaagaacacaaacagaggcttatactgggttttttttttttttgagacagagtctcactctgtggcccaggctagagtgcagtggtgtgatctcggctcacggtaacctctgcccgctgggttcaagcaattctcctgtcttggtagctgggattacaggcgcctgccaccatgcccagctaatttttgtatttttagtagagactgggtttcaccatattcatcaggctggtcttgaactcctgacttcaggtgatccacccgcctcagcctcccaaagtgctgggattacaggcgagagccactgcgcccagctgaggcttacactttttaaactttcgtcttgtcattcagttacaattttttctcttgtaatgcctttgcttttttgacttttcagttactcgctgtgctagtggagctcggtttgtatagactagcactttggattatccacactttagacacataatctactcttgacacaagcgggttagttaactacacttcctcaccccactcttttattttgaaaagtttcaaacctacagaaaagatgaagaagaggtataattatcacctttatgttatattctttatgcggttttactaattaacattttgccatatttgcttatcttgccatatgtgtgcttggtttttggtttattttttttttaagttttgtttgtttgtttgtttgttttttgtttttttgagatggagtctcgctctgtcgcccaggctggagtgcagtggcgtgatctcggctcactgcaagctccccttcctgggttcacaccattctcctgcctcagcctcccgagtagctgggactacaggcgcctgccaccaatgcccagctaattttttgtatttttagtagagacagagtttcattgtgttagccagggtggtctcgaactcctgacctcgtgatccacccggctcggcctcccaaaatgctaggattacaggcg

SEQ ID NO: 49346 - DNA, 1081 bp, Homo sapiens
agaataaggcaattttcctacttatgtatgatacagttatatccaagtaatataataacgatttttaatctctaatattcatcagtatatattccgatttcccaaaagtggtctttataacttatctctctatcccaatctgatactcatgaaggaatcacaaggatttggctgttagctctttagttgccttttatgtaaaataatctccctaacttgtgacttgtatcgcactgaaatttttaaagaatccaggccagttgtcttgcagaatgtgttttttgatttgtgtgattgtttcctgatgattagctttatgttaaatgttgagggggtgggggcaataaaactacataattgatgttttgtgtttctcactgcactgtattgggaggcatgtgttatccacttaattattaagtgatattaattttgatttcttggtgtcttaacagatctctcctttataaagggtaccttttcccttttgaaattagttgattacatgtttgaaagtttgaggagttgaatatggtttgaaagtaaatagaacggactggtgtaatttccagtaatgaaacaagctgatttttaacaaataatatatttgattttaaacttactgtatacaaatttttacttgtgtaaaatataatagagatcagattatttgctatgtagaaaaggtttttacaaaagtataaacagacagttcttgcatactttaaaatgtcatttcttgcttagaacaaatacacttaaattctctatatacattattctgtatatacaaaatcaggtattattgatagtttccagcagtgcctgagttttagcagtatgagttctcatttttgtggtatgtagtgatggtgtcttttcttagattactcaagagattaactctagaacaagttaaacctttctctcttcacttgggaaaaaaataaatttaagagtaactagatctgatctttttactatttataatccaaaatttaagcaaaatgaaagaaataaaatagtgattgtaacatccacataagagtgagatccaccacctcatcttaatagtatcttt

SEQ ID NO: 49347 - DNA, 1034 bp, Homo sapiens
tatcacctatgttataaaaccatttattttggaaacttattagcagttctttgagagagatgattcacacgcattatagtaatgaataaggtgtatctttgggagctcccaaaccctttcaccctcaagtcacttgtgttgttttggccttatgcaccacttagagaagtcctgaagtttaaagattgagattgtgggctgtaaagccatactgcctgccacctgcagctcctgagacctgaggcaagttacttgacctctctgtgattactagttttcatcttttaaggttcagtagtacacacttgagaaggttgtaaggattcggtatgtttttacttgtgcggcacttagtatatattacctggcatctgaattacccaacaaatattagctactcttattgttattgtagttctttggtttgtgcataggaaaccaccttcgtgggaacaacagtaaacatcaaacaggtaataatggctagataacaatgacagaaaccagtcaacaatttaccatttgcatattattaatttcagcatttaaatcagctgataggattatcttgattatgctcattgtcatgtatttgtttatacttaaaaattcagataagtcttaatatcatttaaaagtttgcttggggtttttttttttttcctgtggattttaatagaacatctggtaactttgtcttgtttattttaggttgataccgtaaagcgcttgctgattaaaaaattacctcctgttcttgctatacaactaaagcgatttgactatgactgggaaagagaatgtgcaatcaagttcaatgattattttgaatttcctcgagagctggacatggaaccttacacagttgcaggtgtcgcaaagctggaaggggataatgtaaacccagagagtcagttgatacaacagagtgagcagtctgaaagtgagacagcaggaagcacaaaatacagacttgtgggtgtgctcgtacacagtggtcaagcgagtggggggcattattattcttacatcat

SEQ ID NO: 49348 - DNA, 1080 bp, Homo sapiens
cctattggagttctagtgaatgttttatcttaaacctaggacaagggtaaataacaggttctccccttttcctcagaattttatttccttttttattcttttttctcactgcctaagtttcatacttaataagcctgtttctttagaatgacttttttaattaaggaggagctagcttgggcatttggtaaatatttgaatttcattaatgatgcccgaggattattttatgattatattacatttgttttagaattagtcacttgaagcaacttagtcattagtcacatgaagtataatagtatatgtaaaaagtcttcaggtaagtacggtttccatttttcatggtacttatattctgtaaagtcaccacagacactgagttagcaaatactgaaccattactcctaggaggaaatacagaattaggtttctataagcctctgtttacatttttatcaaccagtcaatacataaccttgttgtatgtgtgtttctacttaaagtcatttaatatattttgttgactcataaagttcacagccaacagctctgtaacttaagcctgaacttaagcttctcaatgcattctgcataaggcacatcacagccttcttgtggttaggaacattagatagcacttcaacattatatacttgggtcattttaaacataaaaataaccagcaaaagcacaaatatgtggaaaatgtggcactaaatacaccatgaagaaggacacttgtttacagtttaagctgaaacaagagagaatgacactcttctggacttcagctaggaacgtttgtgttggacaacttgatatttttgctgctctgtatatgtccacagatgacgaagaaagcaccttgatgattgattttgcagttataaataaagtttaggaagtaagcgaattcacaaatgtggaattcatgaataatgaggggatcaattataattagtttttatgagaacttttagaatgttaacttttttcccccgtaaaaactaaggttatccagcttaactggccctcaaactttcactagaatttttctatttgtttttgggggttttt

SEQ ID NO: 49349 - DNA, 1050 bp, Homo sapiens
gcatcactgcactccagcctggacaatagagcaagactctgtctcaaagaaaaaaaaaaagaaagcaagcatacaaggagcttgtgatcattaattaactaccaagtaaggaggctttcctgctattaaaggtaggtgaatgaaagagcataattggccaataaaactttggggaaaacagtaaaaaggatactctagcatgggtgcagtggctcacgcctgtagtcccagctactctggaggctgaggcaggaggatcgcttgagcccaggaggttgaggctgcagggagctatgattgcaccactgcactccagcctgggtgacagagcaagacttgtctcaacgacaacaacaagaaaaaagaatgttctagcatgtacaatgccaactggtttatgtttctagacactatattaatcttccaggatcctcagaaaacacttcacccctggctggtctgactgcagtggtgtttacaactagctgatcacaactacttacagatttctttgttccttctccactcccactgcttcacttgactagacttaaaaaaaagaaaagaaaagaaaagaaaaagaaaaagaaacagaaaaagaaaacactttactccaacatttgtcagaagagttttaccaaggaggaaggcaatgatgatttccatgcccaggaaggaaggggaaggaacctgtattgggcctttaaaagaaatacgttcccagtattaccaccatgaaacaatcacaaaagattcaaactttaaaggcacatttgaagctctacatatattttaatggctgcgaagttctcacacatcatgatgtaagaaacagttttaaaagagacagtgtggccaggcgcggtggctcatgcctgtaatcccagcactttgggaggctgaggcgggtggatcacctgaggtcgggagttcgagaccagcctgaccaacatagagaaacctcttctctactaaaaatacaaaattagccgggcgtggtggtgcacgcctgtaatcccagctactcaggaggctgaagcaggagaattg

SEQ ID NO: 49350 - DNA, 1008 bp, Homo sapiens
aggggagcgaatgcgtaaggttggaaaggggggcgaagaggcctaggttaacattttcaggcgtcttagccggtggaaagcgggagacgcaagttctcgcgagatctcgagaactccgaggctgagactagggttttagcggagagcacgggaagtgtagctcgagagaactgggacagcatttcgcaccctaagctccaaggcaggactgctaggggcgacaggactaagtaggaaatcccttgagcttagacctgagggagcgcgcagtagccgggcagaagtcgccgcgacagggaattgcggtgtgagagggagggcacacgttgtacgtgctgacgtagccggctttccagcgggtatattagatccgtggccgcgcggtgcgctccagagccgcagttctcccgtgagagggccttcgcggtggaacaaacactcgcttagcagcggaagactccgagttctcggtactcttcagggatgagtcatgtggcagtggaaaatgcgctcgggctggaccagcaggtgagccgcaagaaccccaccgggctggctgctgcgtgaattcctcccctgacctaacctggctaatggcgcagcgctaaccggcacccttacttttcattttctgggtgccccgggctggcgggtgtgagtgccccggggctatagagggataggaatgttggttggggctgtcgcccgggcccggtctcggcccgctgtattgtccccgggacgagcacaatggcggcttttgtgtgtgcgtgcgcaggcgggcggagggggaggaagtgcgcgcgctctcgcggggacgcgcatgcgcgaatcccgactgattagtgacctgggggggtttgcgggagtgcgcagcgcggcgggacgcgactggaggcccttttggcttggagggcttcggccttcacggctggcgcagcctggattcccgtccggaggacctggcggcacccggtgtttgcgtgcctgcgagcaaggggtagaacg

SEQ ID NO: 49351 - DNA, 4142 bp, Homo sapiens
ccgggctcatgcttgtaatcccagtgctttgggaggccaaggcaggtggttcacctgacctgaggtcaggagaccagcctgggcaacatggcgaaaccccatctctactaaaagtacaaaaagtagcctagcgtggtggcgcacccctgtaatcccagctactcggggaggtggaggttgcagtgagccgagatcacatgactgaattccagcctggatgacagagggagactctgtctcaaaaaaaataaaaataaaaacaaacgaaacagtcaaactacttaagagttgtgcttaacatagtgttctgtaagtggtaggtatattgctatttttttgttgttcttaagagtactacccgactaaaaatacttgggcaatatttagggatgaagtatctaactaaaagaacggccacttcgaaatttgtcctgacatttttcaggtgtgcattttaggtttaaaatatcaagtattacggaaagttggcattggaaactttcataaccggcactaaaacgaatcctttatctatttgacattgaggaataattttgagattcagtgtaagctttagtttggtgattagggagcctgtgctatggaacatgttagtgaaaatttattttgaatgcatgaattaaatttggacagtttctactgaacagcacaagcatcttggtgtgccgccttctgtagtatatacaatagtaatattgcatttgcttagagcattgcagacttgaaaacattcttagtcacattctcattaagggttggtattagccctgtgaggtggactgggcaactacttgaatgcagtactagcaaatgctagagggcaggactagttttctcttaatgtagtatttgagcacatggggtgctaaccatctcactctcttctagtttgctggcctagacctgaactcttcagataatcagagtggaggaagtacagccagcagtaagtacaacatcttgtgggtttattgaatattagagcttaacatcttaagatttcattgggcttatgtaaaatttaagaaatttgcctttcaattttttactgcttaaagaattatgtagtctttgtgttatagaattatgtagtacttagtgatcaatctaaagcatcgttgccttttttttttttttttggttgagatggagctttgctcttgttgcccaggttggagtgcaatggtgtgatctcggctcaccgcagtctctgcctccgggttcaagcgattctcctgcctcagcctcccgaatagctgtgcctttctgataataaaacatcaatgactagctggctctcttgagtaaaagcagctaatcattggaaagaaccttattatatcaaattatctctagaagagtttttgtccattataaatcctgagcccagtttagaggtgatgggaatgtgtccctgttaactgactatatttattaaattgaattaagggaatatgcatttcattggttatagctactcctttctcctgaagaacagaagactatactgaattttggattggtggttaggttaggttttcaaatgtgtcatttcttttaaaaaggcattagaaaagttgctttttttcttctaaggggggttatttagagacttgttagaggttagtgttaagataggggatcttggtggtttattataagggcaatagacccttatttttagctcagatctcttcctacttattaaaacaaaagtgagtatgggctatgatgtgtcctcatttttaggcaagaacagcttcactgggaacaaaacttggtgtttgctttaactttcaccttatttgtcatgctaagaatcttttaggaactgattgtcctagtagagatttttaaaaatatttaattcagtctagaagtgaaaaagaaaaatgacacgtttactagttataaagcaaatttatttggctttatgttgttttttttgcttatccatattctaggctgtactcctgctcgcatacagagcaactgtcaactttccttaaactcagcaagccccaaattaaaacctgcaattccttgaaattaactcccctttgcagcttttccttgtttatttattgtatgttttgcaacttactggcatagaaacaaaagattgtgagatatgttacatgagtaatcttaaattgttacagtaatacttaatgcttttgttgacagttttgatgacagttctcttaaatctagcaggcctttaaaaaaatcacattaaatgaccactggtggctaaatgtgctcaatttgtggatttcaactattaggttccaaatcagcttttttttatcaaactcctttcagagttctccttatgaagcagtaacccatttaaaattagattcttatttttcccccctctcagtgtccaggtaagtaatcagattggaaggctggagattttaatttcccagaaccattttttagtaacagaaatttaaatgggaaggttttttggcatttaattaattttatatatatatatatttttttagaagggcgctatattcctcctcatttaaggaaccgagaagctactaaaggtaggtcctcacaagtaacttcgtaggtctattttttgcctcctttagaagttagtaaagcctaaggaaaaccaggcatttgggggaggtctaaacatggtgttgtttttctatgcttctgtcagccttggttcaaatactagagcttaataattttggaagaactcatctaatgttacgcagtgggaaattcggcattcctatgtcaaactgttctgacgccaagggcatggttttgtacagtttcactagtgttgtgctgaatctgtttgtaatcattcacagcatggttttagtttggaagaggtgggtgccctactgtgtaaaccaagctgtataatgataacaacctggttatttctgtcttggcaaagttgctagaaatgaagatgggcttattgtagaacagttaacaagttacagcgttggaagtgattctctggtttcatctccttgccttgctgcttttgaaaggttttgtccaaaatgtattacaatatctggtgtcttttcccattgtaattgtaacgtagtgatagatgacagctagtatatgtttcatattatgagacagctgttcgggtgctttatattctgtaaaatagaccatccaaaatttggaggaaaagggaaagtcaggaaaaccaaagattaggagggaagatactgtataaagaaggcagataggaagagtggagagtccacaggggagcacatggtttgctgctgttcctccatctccatatgtagtctgtattaccttcactgtcctggcaatgcatggatataaaatctgtattatttctaccagaagatcactttggctttttttttttttttttttttttgagacggagccttgctctgctgcggaggctggagtgcagtagcgcgggctcactgcaacctccgcctcctgggttcaagtgattctcctgcctcagcctcccaagtagctgggatcacaggcatgtgccaccatgcccggctaatttttgtatatttagtagagacggggttttgccttgttgcctaggctggtctcgaactcctgacctcaagtgatccacccgcctcagcctcccaaagtgctgggattacaggcgtgagccaccatgcctggctggcattatattctttttaggggaggttactttggaatttgtctttatcatcatggatgttctcaatattcctagtatactagctagaattgaccctcgtgtatatggcagtatcatagaggttttagagctggtagagatctggcaatctaacttaactctttcttgctagcaaaggctgttggtcacctgactggcctaacggtaggaggtagaaggcagaaggaaagtaactgaattgagaagctgtttctgtttaataaggtgttgctgaagctagttaaaccctctacctgtctttaaaccctctacctgtctttgggttaatttacatgtttgtcatccccttacctggatatttatagctgtacccaggaaccttgtctatactgagaatatatagtgatgagggtttttctttttcccaggtatt

SEQ ID NO: 49352 - DNA, 1486 bp, Homo sapiens
tttcaaattcagaaagattgataataccttaacatggttcctatttctaattaataataaaatgtatttgtgcttttttaatcaaaggtttctacgataaagacagttcagggtggagttctagcaaagataaggatgcgtatagcagttttggatctcgtagtgattcaagagggaagtctagcttcttcagtgatcgtggaagtggatcaaggggaaggtaagtgatttcttaatcaccttacgtgtatgtataataacagtttaataagtcgttatcctgaccacctgtttggatgttaagcattatgtctgtttggtcattgtattttcttagccgtaagaggcttttactaaattgaacctgttacttagaaattagatgaaaataggaatatgctcattggcataatgaaatgagttattctatttctcgagttttatatgttctacttaaaagagtaagttcatctagtgaatggcctaatttggttgggatttttgtggactctataacaatttctaaacaccttgtatttttgattacacaagtgtggtgaactgaccccacgtgcctaatagctgtggttagtcctgtgtcctgatttttcgcaaacaggcctaaaactcttaaaaacatcttagttcaggtaaggattattttctaccttttatccaaagtctgtcacacaggtgaattgtcctttaagtgacatcctagtataactaggacgattgatatttggtgtgctattttcttgttttccctaccattaaatatatttggatgagcactttaaatgaaggttgtgagctgtgtgccgatttcaaataaaatccttattcttaattttggcatctgtgaggccttttaggctatacaactttatagaaatgtaaagattactgattttagaaaacgaggttatgtaaatgatgctggttagagagccttatttgtcaagtaactcagaattggattgttgacatccttatggttagccataacttaagtctccagatacagttctagagtagggataagaatctgataatggttaaatgatatgattctgattaattgcttgtgctgttcaggtttgatgatcgtggacggagtgattacgatggcattggcagccgtggtgacagaagtggctttggcaaatttgaacgtggtggaaacagtcgctggtgtgacaaatcagatgaagatgattggtcaaaaccactcccaccaagtgaacgcttggaacagtaagtttttgaagtgtatgttacttgtgatgaagccttactagctagtataacaaatgaacttatccattttttgatttgagggaactcttttctggaggcaacactgggattaattttgagaaatacgatgacattccagttgaggcaacaggcaacaactgtcctccacatattgaaagtgtgagtatttttgcttgactttttaagacacagagaggttaaatgt

SEQ ID NO: 49353 - DNA, 2172 bp, Homo sapiens
caggcgaggctttgagggccatgaaggtagatgtttctttataaaatgggaaattgtagaactttgtaggtggccattgagagggctttctaaatgatgctaagacttaagtagaatgaaaaccagttttcaagtgtaatctgtaatctataaattacaaaagggaattatgttgtgatgaacttttcaaacagggtaggtagagttaacttaaaaattaacttatttcttaggaaaatggaaggtatgggcgccgcaaacaatacccaatctccttggtattagcaccaacgagagagttggcagtacagatctacgaggaagccagaaaagtaagtatgagttccagtgattattagctttttcattgattctaattaaatgttttatgaacatgtaaaaattttgaccttgaagttcataacattttttttgcttatagttttcataccgatctagagttcgtccttgcgtggtttatggtggtgccgatattggtcagcagattcgagacttggaacgtggatgccatttgttagtagccactccaggacgtctagtggatatgatggaaagaggaaagattggattagacttttgcaagtatgttttattttgtttttgtttttttgttttgttttgttttgttcttttgtttttggcagagttgcgctcttgttgcccaggctggagtgccatggcgcgatctcggctcaccacaacctctgcctcccgggttcaagcgattctcctgcctcagcctcccaggtagctgggattacaggcatgtgccaccacgctgggctaatttttgtatttttagtagaggcggggtttctccatgttggtcaggctggtctcgaactcctgacctcaggtgatccgcctgccttggcctcccaaagtgctgggattacaggtgtgagccatcgcacccggccaagtatgttaatttttaaatgtatgggatgcagtattaaagttactgcccattagttttgtggtgatgttaacattgtctaaatgttaaggctgagaagtgatgtatttcagacatctaactttcacaaaaagcttgttcatggtaattttaatgttgaaaaatcagtaacatcttggttgagacttacaacaatgatcagctcgtgggacagtcaactaggatgggctaatttgactgtgtaatcttgaatgacttatgtagtggcaagaatcctgtgctgtgtctgtaaaattatgcagtgtgaggcaccatcttaatgaatatataattgtaataacctatacaattgtatttgtaattatactaacagccatactaaaaccatgttgatttctcctcaaattctaaactcaggcttgttttttttcatgacatgacagatacttggtgttagatgaagctgatcggatgttggatatggggtttgagcctcagattcgtagaatagtcgaacaagatactatgcctccaaagggtgtccgccacactatgatgtttagtgctacttttcctaaggaaatacaggtactgtttgatgttgcaaattttatttatttagaaatttgtttatctcaggtaataataaaaattttttttctttcagatgctggctcgtgatttcttagatgaatatatcttcttggctgtaggaagagttggctctacctctgaaaacatcacacagaaagtagtttgggtggaagaatcagacaaacggtcatttctgcttgacctcctaaatgcaacaggtaacattatgaattttttattttattagacatgggggtttctctttgttgcccaggctggagtgcaggggttattcacaggtgtgatctcattactgatcagcatgggagtatttgacctgctctgtttctgacctgggcctgttcacccctccttaggcaacctggtgctcccttgcttccgggaggttaccatgttgatgccaaacttagtgtggacacctgataggcatagtacactacagcccagaactcctagacttagacaatcctcctgcctcagtctccagagtagctgggactacaggcactcaccactgcacccagctaaaattatgaataatttaattgctctggtaataacccatttgggctgggtgcagtggtacagtgcatgtagtcccagctacttggcaggct

SEQ ID NO: 49354 - DNA, 2977 bp, Homo sapiens
agaggcccttcaccagttccgctcaggaaaaagcccaattttagtggctacagcagtatgtataaacatctttcttttattcaaattgagcatgttcaagtatttgttttcttttaagtgggccatatctcataaaagttattttccaggtagcagcaagaggactggacatttcaaatgtgaaacatgttatcaattttgacttgccaagtgatattgaagaatatgtacatcgtattggtcgtacgggacgtgtaggaaaccttggtaagtatttgattacttgatggtttcattgttttttgctgtgatgtgtgcaggaaagaacttgctaggatctaaaatacatttttaacaatgaaagtgacaaagattttgctcaaagcacttgtttaaatattacgtggtaatattttaaatatttctacgtaggaaagtaagaatagtagcaagttactttatggaagacctttgtttatatacttttttgggaactcttttaggcctggcaacctcattctttaacgagaggaacataaatattactaaggatttgttggatcttcttgttgaagctaaacaagaagtgccgtcttggttagaaaacatggcttatgaacaccactacaagggtagcagtcgtggacgttctaagaggtgaggtataaatagtatataatgaggggaatgggtgttcacttacagttcatagtgtttcctctgcatgcataacgtccaaggttaactgtacagtatttaaaaagcttaatcatcttaggcttcctagattctttggtaaggggttgtattagaatgggtgacactctgttggggaaaatatggctggatggggaattgtttgaatggaaaaattagaaattggtcattaggaaagagttaggttactttagtggaatttcatcttcatgtgaaccaacataatttttttcttatagtagcagatttagtggagggtttggtgccagagactaccgacaaagtagcggtgccagcagttccagcttcagcagcagccgcgcaagcagcagccgcagtggcggaggtggccacggtagcagcagaggatttggtggaggtagtgttaatctgtaacttcatagctttgggaagggtttttttccttttagtcatctttttcaaagcctaattaaacaatttaagttcagcactatagaaacttgatggcaaattacgtaagggaaggattgtatttaatgatggataacttcattaatttctctctctttttaaatctctcattaggtggctatggaggcttttacaacagtgatggatatggaggaaattataactcccagggggttgactggtggggtaactgagcctgctttgcagtaggtcaccctgccaaacaagctaatatggaaaccacatgtaacttagccagactataccttgtgtagcttcaagaactcgcagtacattaccagctgtgattctccactgaaattttttttttaagggagctcaaggtcacaagaagaaatgaaaggaacaatcagcagccctgttcagaaggtggtttgaagacttcattgctgtagtttggattaactcccctcccgcctacccccatcccaaactgcatttataattttgtgactgaggatcatttgtttgttaatgtactgtgcctttaactttagacaactttttattttgatgtcctgttggctcagtaatgctcaagatatcaattgttttgacaaaataaatttactgaacttgggctaaaatcaaaccttggcacacaggtgtgatacaacttaacaggaatcatcgattcatccataaataatataaggaaaaacttatgcggtagcctgcattagggctttttgatacttgcagattgggggaaaacaacaaatgtcttgaagcatattaatggaattagtttctaatgtggcaaactgtattaagttaaagttctgatttgctcactctatcctggataggtatttagaacctgatagtctttaagccattccagtcatgatgaggtgatgtatgaatacatgcatacattcaaagcactgttttcaaagttaatgcaagtaaatacagcaattcctctttcaacgtttaggcagatcattaattatgagctagccaaatgtgggcatactattacagggaaagtttaaaggtctgataacttgaaataggtttttaggagaattcatctacttagactttttaaatgcctgccataaatgaaattgaaatggtagaatggctgaccacagcaatgaccagccctcattagggccctggatgatttttggtctaataacgcatgctagtgttgatgttttttggtcaagagggtatgaacaggaagaattaaatgcagcaggctttattttaaatgccgattcacattactctgttcaagctgcgttgagatgttaaactggcttactatagacttcgtaaaaatggctccagaagagtaacaaactgaaatctttgagatcacacaggttggaaatatgtacataactgcacaaggtgtcaattctgctctacagtgcagttttagtcagttttagttgcataggtttccattgtatttatagtctgtttatgctaaatctggccaaagatgagcattgtccaccactaaaatgcctctgccactttgaattctgtgctaattttgtggccagaatgcggtgatcaaaacgctccatctttttacagtggcataggaagacggcaaaaatttcctaaagtgcaatagattttcaagtgtattgtgccttgttctaaaacttttattaagtaggtgcacttgacagtattgaggtcatttgttatggtgctatttcaattagtctaggtttaggcccttgtacattttgcccataactttttacaaagtacttcttttattgcacattcagagaattttatatatatgtcttgtgtg

SEQ ID NO: 49355 - DNA, 1045 bp, Homo sapiens
tgaaagtttaaagaaacttgaccaaaagacagtacaaaaacactggcacttgaatgttgaatgtcaccgtatgcgtgaaattatatatttcggggtagtgtgagcttttaatgtttaagtcatattaaactcttaagtcaaattaagcagacccggcgttggcagtgtagccataactttctgatgttagtaaaaacaaaattggcgacttgaaattaaatcatgccaaggttttgatacacttgtcttaagatattaatgaaacacttcaaaacactgatgtgaagtgtccagattctcagatgtttgttgtgtggattttgtttagttgtgtgtttttttttttttttcagtgaatgtctggcacattgcaatcctcaaacatgtggttatctttgttgtattggcataatcagtgacttgtacattcagcaatagcatttgagcaagttttatcagcaagcaatattttcagttaataaggtttcaaaaatcatgtaaggatttaaacttgctgaatgtaaagattgaacctcaagtcactgtagctttagtaattgcttattgtattagtttagatgctagcactgcatgtgctgtgcatattctgattttattaaaataaaaagttgaactgcacagtctcctttgttgttgtcaattgtggtttattttcagaggtgtaaataaagtgctcttgcctgaaaaattgtaaaatgttattttttgcttgtcatccagtgctattttttgagatgcctcttggatacagaatgactcataccataagtatttgcaatgaaagatgaagatagtattagtttgaaatacagtgaaacaggatttttgtaatagacggaaatctaaaaggcccttactgataatacagcatgtattagaaattggcttatactttgaacaatttgacatgggtgggagtctctttgttctttgaagtatctattatgaaggatggttgaacagtggaagaatgagcaggataaaagtcaagtgtgtcagtagtccaacaagtgatggtaagtat

SEQ ID NO: 49356 - DNA, 1049 bp, Homo sapiens
cgaaactccgtctcaaaacaaaagaaacaaacaaacaaaaaaccaaaaccctgccgcaatccttccactactctcccatgggaggaagctcagagccaccctgaccgctcttcatttcaccacctctctccatttgtcagtgacctgaggctgcctcattgtttctgagcactgttcatatcagctgttcttccacgcttccttcagcctagaccccagaaacagctgcccctctgccttcattctctcacccttctgtaacagatatccccttccactccttccttcctaacagaaccccaatttggttcaggatggcaatgtgcctctctaagaatagttggctcctcagccttgtactccaggagagacttgcctcccagttccggtcaatgtagtaatgggagtaggtgggagtattaggtggaagtccatggggcgggtgccccttcccaagcaaagcctcacaagaggcttttggctctgctcttttttctctcctagaacttggagcgtgatgcccagaagtgtgtgaactggtctgtgaccacaaagatgagaaccgcatgctgagattggtggaatggagacttcagtgagcctacatgcagatgacatggtgacacccgtgcccagcctgagctgttttcttctggccctcttattacatgagaaaaataaacacctatgcaccttggcctcatcccctcggctgtctattcttgcaactttggggcaggtttaaatttttttccaaattaaaaattggggccaggtgcagtggctcatgcctgtaatcccagcactttgggaggctgaggcaggcggatcgcttgagcccaggagttaccaatgaaatggagtgatgtctgggatttgcttccaaatagagaggaagtgggtcagggtatagatgaaacaggattgatcacagttgacagttgttggagttgggtaattggtaagtctttaaaaaaatattctctttagataaattcccaagaatgctgtgcgaacacttatgagcttgatattgtgttatgaattga

SEQ ID NO: 49357 - DNA, 1048 bp, Homo sapiens
tcatttacttacaagcattttttgcagttgttccactgtttggttagccacactgatgccattgatttctcgaatttcatcaccaacatgaagtgtacctaagaaattatataacattataaacatgaaatgatatatgctttcatagtaacaaaatccagaggcatcaatgtaatttttaaaaactaagttgaatattgagggccaatatttcagaggcaggtacaagtttggttgcagcagaattatttaactcatgtagtaacctcatcaaaacagatatatctacttgtggaaggcacagttttgatggatggctgcagaaatctatttttctgagagaggtggtatgtatagtggtttaaaagtatggcttctggatccagactgcctgggttcaaattccagcttccttgcttactagctttaagatcttgggtaaattactgaaactctccatacctcagttttcacatttgtaaaatggagatgaaaatagtacccatctcataggattgttttaagaactaaacaaatttaataaatgcagaaggcttagaactgttcttggcacataccaagcaccatgacagtgttggctgctatcgttatctaccagatatgatacgaaggttgtcaattttccaagagttgtgacatgataatatctacacaacagcaaattctgttaaagataatttaatcttttggttggcatttcagcatcttgtaatacttcagctagaaagaaatgaccaagaaccaatgcttagagtgttatttacaatgttgcttccttatttataaattgtgcagaaatgtacacactgacctggcttcattacaaaaagatacctctgcatgcaacaattaaagaataaacattcatcttaagtacacgtgggccatttataaaaacgattaaagtgctatgccataaagcaagtctcaacaaacctcaaagaaatggtgtcatacagactacattctctgaccacaatgtaattaagttagaagtaaattacaaaaagatatacagaaaatcctg

SEQ ID NO: 49358 - DNA, 1049 bp, Homo sapiens
ataatcagaaaactaaatggaaataatgcttttcagtaagcccggcccctttgaccgatacagaaaacttgaattaaactttgactacgtaggtattaattggcttcattacaattattgctgtaaaaatgaacagtgactagctctggaaagatttaagcgtcagtaattgttggtctcctgccttaaagtttttttttttttttccaatttgagtatttaaagtattttatttaaaaatatttgactgctgtcaaagttgtcattataaaagattaaacatgatttaaattaaaagagcattattttgttttggagggattattgttggtctaacatgggttaataaaattgcttgcaaagataattcacgtggaaaagtttggccaaatcgattgcttttggttatggtgatgaaaaaataaatggaatctgatgttttatgttgagaatgtgtaaaatgctagttgattttatgtcttagaatgctcatattcatatagattcactgcgaatagtgcttaacattggatttcggattgtaatattaaaccctgcagttatgcactaacgagtttaaattttaaaaaagtaaccattttcaaatattcttggcaagttgtgcattacttgatgtttgaatacatcttaaaaatgaaaaactagtgaagcttcactatgtttggggccttcatgatatatggggtaatttgatgaacgattaagcagtttgttaaactaaagaaaaaaaaatcttcactgcttcagactcagtgcttgtgaggtgtcctacctgcttaggacaagattcatcagccttaacattaaaataaaaccttctgtaatatgtgcttgcaaccgcatatagttcttggttgcatctttgtgagcctgaacataccagtggggtgtgtaatgtaaagcctgacattatataacttcgcaccctctgtttgaattgggttctgaatgaagtgaatgagctggagtcctgctgtaggaagtcttgaattatttagtttcatccttcttttaacagtcctcgaagc

SEQ ID NO: 49359 - DNA, 1062 bp, Homo sapiens
tttgagacagtctcacactatcccccaggctggagtgcagtagagtgatctcggctcactgcaacctcggtcttccaggttcaagtgattcttatgcctcagcctcttgcgtagctgggattacaggtgcctgccaccacacccggctaatttttgtgtttttattagaggtggggtttcaccgtgttggccagactggtctcaaactcctgacctcacgtgatcagcccaccatggcctcctaaagtgctggctttgcaggtgtgagccgccgcacctggccaatatcttaagctgttaagaaaaactgcctgagagatgaatttttgtgacttaggtgaagtgataggtcatgcactttaaaccaaaatgaaagttcattgcttggctagctgcagagtaagtctttttctgacttaaattatgtaacatttagtttttgtttacatagtaccaatattctgcatctttgaaaggatttctgttaagtttatttttactttgaaattcattgtgatgcgttgaactctttgaaattgatgttaatgactgctaacactgcattattaataatatttttgaaatgtgttatctagagagctaatttatgttaagaaaacactaccagcttgtctaagaattgaaatggtggttaggctgtttaggactcacatgtattatttgtagattagttaattaataaagtttatttaatgaatgcataattgacagtcttaagtactcatattgaaacttcacatataattttatcagttttccacattggtttgtaaattatcgtgacagtaaattaaaacagtatattaatgtacactatgtgcaagccttctatgtagatagtatgaagatagcatagatatttcttgcccgtgttgaacttaaattctttaagaggggtgagataagtttaagggtgactaacacaggaccatctttgggagaagaaaaatgtgaaatattctgaaagtttatgagaaaggtaaatttaacaattcacaagttagaatggctcttaaagatggggattgtttgttgattgtg

SEQ ID NO: 49360 - DNA, 1996 bp, Homo sapiens
gagggtaggagtgaatggagtagagatgtacccaattaggtcctatttctttgtgttttagatggctttgtgacagtcactgcgctcattcttcattttgatctttagcatttcattgctgactttattttgagtctgatttggcacaggctgatacttgggacctgattaagaactgtaacctgggccgggcgcggtggcgcatgcctgtaatcccagcactttgggaggccgaggcgggcatcacgaggtcaggagctcgagaccagcctggctaacatggtgaaaccccgtctctactaaaaatacaaaaattatctgggtgtgatggcgcgtacctgtaatcccagctactcgagaggctgaggcaggagaatattgcttgaacccaggagatggagattgcagtgagccgagatcgtgccactgaactccagcctggcgacagagcaagacaccatctcaaaaacaaaaaacaacaaaaaaactgtcacctggaagggtgggagtaatcccttgttagacagttttaggtttctgagctaatttgtagactgcttgcaactttcttctataagcttttattattttttctcttacctatttcttccttatattccatcatttgtttacttctgtatattattaaaactgttggtggtgttccattgtgaatgtattcttgtatgctttttgtaattttctctgtggtactattttgtcttttttttttttttgagatggcatttcacttttgttgcccaggctgcagtgcaatgtcgcaatctcgactcactgcaacctccgtctccagggttcgagcgattctccttcctcagcctcctgagtagctgacattacaggtgtgcaccaccacgcctagctaatttttgtattattagtagagatggggtttcactgtgttcgccaggctggtctccaactcctgacctcagttgatccccccgcgtcggcctcctgaagtgctgggattacaagcgtgagccaccatgcctggctgagtattttgcctttgttagaataaatagaagatgctgctgctaagtttattctcaggaagaaagttggggttatacttaagggtattatataaggtcatctaattcattttagtttagaacagtggaagaaattgttttagacaaagggttatttttaaactacaaatttattacgtgttcattagatttttctctctttttgaaaaaaaagtttattaggaaaaattttcagtgttttcagaaagtattgcaaatcaaccatcacccagctttaatagtttgcaactcatgaccagtcctgtttcatctatatatattttgcccctcactcatgttattttgaagcacatctcagcaatcagtcacagcatttaatccatagatgtttgtttctgaaacataaccgtgatgcccttattacatgtaaaataatttcttaatctcaaatatctgtggaccttgttttttgctgtatggaagttaagaaataattgcttggaaaatgagtagaaaacatgtttagctgagtatgtgatgtgaattttgtttgtattttgatactgctatagtgttctgtgatagaatattacataatatgtgacacaagaggtaatttttcctgagaactttatgaatcatagttgcttgagtctggatagtttttatttttagggaaaatttgttttcaagatacagtagttaaataaatattttaggtttctgaatttcaaatatcagaatgagaactacaaaagcttttgctttgcttgattgattggtgaaacatttgttgagctgctgtgggtgagggattgtgtcaggttctggggcaaccaataagacctggcctctgtcctgcagtcagtctgttgggagaggctgacagactgagtgatcatatgatgtattaagtgtaataataaagatacatgcaaagtgctgtgagctctgaaatgatggagtaattaaaacat

SEQ ID NO: 49361 - DNA, 1055 bp, Homo sapiens
tttttttttttttttgtaggcagggtctcactgtcctccaggctgcagtgtagtagtgcaaccttggctcactgcagcctccgcctcccaggttcagcctcagcctcccgagtagctgggactacaggtgcatgccaccactcctggtttttgtattttttggtagagatggggttttatcatgtcggccaggctggtctcaaactcctaacctcaagtgatccacctgcctcggcctctgaaagttctgggattgcagacaagagtcaccatgcccagcccagaatatgtttatttttgttataaagatgaaaaatttggtgatagagctaggacagtagtgcttttttggagtcatttaccccttgagtgtcagtaaccctttagctacaaacattttatatatgatttcagagagtatagggaatcttccttgaagctcaactatggatattagttcaatattttcagctagtttagtttactaattcttgggtagaggtgtaaatgatgtgagtatgtcagggagaaagaaaagctttagaactactggcttggttagactaaaatggcatggattttgccacatagttttgtggtgttccgtggccacatcacatattctctcaaaatctctattaataataaggatgctaggggaagacaatttggattgatcctggagaacctatggctttaactggaaaaatatcctaagcacagtcgccattaacatagttaataggctttagtattgtttcttcagcctgagtgctcaaaatgctggtttgcttgggagggtaagtgttatacctaggaagaacaatagattggaaaactgaagacctgaggccaagagttcaggaccagactgagcaatatagagtgacccctggtctctagaaatttttaaatttagattagctgggcatggtggcattcgtttgtagttccagctacatgggaaaaccgctcgagcccaggaatttaaggctgtggtgagctgtgattgtgccagtgcactccagcctgggcaacacagtgagactccgtct

SEQ ID NO: 49362 - DNA, 1083 bp, Homo sapiens
cgcctttaatcacaacactttgggaggctgaggcaggtggattacttagggtcaggagtttgagaccagcctggctaacagtggaaccctgtctctaccaaaaaaatacaaagctgggcgtggtggctcacgcctgtaatcccagtactttgggaggccgaggtgggtggatcacgaggtcaggagatcgagaccatcctggcaaaacatggtgaaaccccgtctccactaaaaaatacaaaaaaaattagctgggcttggttgccggcgcttgtagtcccagctactcaggaggctgaggcaggagaatggcgtgaacccgggaggtggagcttgcagtgagccgagatcgtgccactgcactctagcctgggcgactgagcgagactctgtctcaaacaaaaacaaaaacaaaaaacaaaagttgtctgggcatggtggctcatgcctgtaatcccagcactttgggaggccgagtgggtggatcagctgaggtcaggagtttgagagcagcctggacaatatggtgaaaccccgtctctactaaaaatacaaaagttagccaggcgtggtggcacacacctgtagtcgcagctacttgggaggctgaggcaggagaatcgcttggatctgggaggcagaggttgcagtgagctgagatcgtgccacagcactccagcctgggtgacagagtgagactccatctaaaaaaaaaaaaaaaaaaaaaaaatagccagatgttgtggtacacgcctgtaagtcccagctacttggtaggctgaggcaggagaattggttgaacctgggaagcagaggttgcagagagccgagatcgcaccactacactccttcagcctgggcgacagagcgagactgtctcaaaaatcaaaaacaaaaacaaaaaaaaccttgctgggattttgataggaattgcatcaaatcaacctgggcataattgatacatatatattttttgctatactgagctttccaattcatgaacatgagttgtctctttgtttacttaggtcttctttgatttgttccatgaacatttgttaagtttatacctatgaatctcat

SEQ ID NO: 49363 - DNA, 1050 bp, Homo sapiens
tggcacgatctcggctcattgcaaactccgcctcctgggtttgcgccattctcctgcctcaacctcccaagtagctgggactacaggtgcctgccaccacgcctggctaattttttttatttttgcatttttagtagagatggggtttcaccgcgttagccgggatggtctcatctcaatctcctgacctcgtgatctgcccgcctcggcctcccaaagtgctgggattacagaccatgagccaccgctctgggccaacttttatttttttaagaaccaactttttattgattgctttttttttttttttttattctgctgttctcctggcttcaattttattgatttcttctctatttccttctttctgcttgctttgggtttatttgctctttatattttctaggttcttgagcttggaagttggattattaatttgaatcatttccttttctctgatgtaacaatttggtgctataaatttacatttcagcactactttagctgtgtctcacatacttttgtatttgtattttcattttgattcagttctgtgcattttaaaatttctttgatccatggagtatttagtagtgtgttaagtttctaagtatttggagggttttctgttttctttctattattacttgcattttttgtgtgtttctcattcatctgctttttttttttaccttcttatgggttatcttaatatattttaggattccatcttgatttttaatgtttttgaatatatttctttgtatagatttcttagtggttgctctggatattgcagtattcatatgtaacttaccactgtctactggtattggtgttttaccactttcagttaagcacagaaacttttcttccacttaggtccttttgccctctttactttaaaaataaattttttttttttttttgagacagagtctggctcagtcacccaggctagagtgcagtggctggatttccgctcactgcaagctccgcctcctgggttcatgccattctcctgcttcagcctcccgagtagctgggact

SEQ ID NO: 49364 - DNA, 1060 bp, Homo sapiens
tcataatatactttcctggtttctggtatggcatgagattttcatttgtactctggacattttggatatcatacatattttgagaactgtgcatcttgttccttttttcttttaagagacagggtcgtgatcagtcatccagactggagtgcagtgatgtgatcatagcttgctgtaacctcaaactcctgggctcaagtgattctcctaccttggcctgctgagtaactaggacaacaggtgtgtgccaccatgcctggctaattttgtttttttgttttttttgagatagggtcttgctctgttgcccaggttggtcttgaactctaggacttaagtaatccgctgcttcagcctcttgagtagcaggagtcacaggtgtgcaccacagcacctggcctattcttttttatactaggcagttcccttgttgaagtgtagtgcaagggttaggtgggtgtgttcattcagcttcttgctgggtcctgctgataattactgtggaaaaagtggggcactaagtcatatggccttaatgcagactggtgggatggaagttcaattcctcccttaccctcacatcttcctaacaaaagttgggcaccattttatgccaccttgttgcctctgagtaggggtataagatgaactttctgacgggccatgctgcctcagcaagagagaagtagggaggctatctcacactgcactgatgctgcagggtgaagaaaaagctccttacctcataccacttcccctgagttgatgccaggtggggaatggaagctcagccccctctgggtaccactggcatttgagaatggctgaaatggttgtcagctactctgtcttacactgcttcatttagccttgatactgggtgaatgtggaggttcagctcttcactggttaccactgataccaggggttggggcagggagtagaaagctgactgactctaactcacatctccttgttcagtcttgttgatggctgggtaggggtgcaggttcaggttcttgctgggtcctgttgacaccaggcctgtgtgtgcaggagg

SEQ ID NO: 49365 - DNA, 1071 bp, Homo sapiens
gaataagcaagggaaaacttaataggtaggaggcattagtcttccttaggcagggaataattattatttcagcaatgtacatgtagtaaagttctacaattttaattcattctagctctaaaaattctatgattttatccttttttctgttcttttaaacttgttcctgtacaatttatagactttttttctgagaaaaatcttcctggagaaaagattgttaggcccttcaataatagggagtttctcttaaaataagtttagccgttttgttatttaagaaatgatttggccgggcgtggtggctcacgcttgtaattgcagcactttgggaatccgaggcgggcggatcatgaggtcaggagtttgagaccagcctggccaacacagtgaaaccccatctctactaaaaatacaaaaattagctgggcgtggtggcaggagccggtaatcccagctactcgggcggctgaggcaggagaatcaccggaacctgggaggtggagatcgtgtcactgcactccagcctgggtgacagagctagacttcgtctcaaaaaaagaaagaaatggtttgtttattttctgtgtaatatgtttaataataatattctgcatttttctttgatccattagttattttggagtgtttaaagtttttcatatatttgtgaatttctccaatttgttcctgttactgatttctaatttcactacattttggtcagagagcatagcttttaaaattttaattcttttaaaattatgaggacggccaggtgcagtggctcacgcctgttatcccagcactttgggaggccatggcgggcagatcacttgagggtcaggagtttgagaccagcttggccaacatggtgaaaccccatttctactaaaatacaaaaattagccaggcgtagtggcaggcacctgtaatctcagctgctcgggaggctgaggcaggagaattgcttgaacctgagaggcagaggttgcagtgagccgaggtgacagagtgagactccatctcaaaaaaatatatatatatatatacggggacttgttttagtgg

SEQ ID NO: 49366 - DNA, 1033 bp, Homo sapiens
gaacagagataactccattttcaaattgtcatgtttaaccagaagtcctttgcgtgatgatttttgtttttaaggaaacttgttgaagtgtaacatgaacccatttgagttcacatatcacaagtgtgccattcagtgaattatcacatagtaaacacatttggtaaatgctacctcaaatcaggaagtggaacagtagtagcaatttgaagcatctcttgccccttcatagttaatacctttatcttcctcctcaagggtaaccattacaccgacttctatcatcatagattaattttgtttattttagaattttatataatggaaccgtataataggtacccttgtgtttggctgcatttgctcaacaacacatttgagattcatccttcttattcatccttgagtttgcaaaaacagaaacatcatttgtttttattgctgaatagtattccggcgttcaaatacatgaatttatcccttttgctgttgatgtctcctatagtggttaaaggtctctggatcttcactcttatttgtattgtttacttgcatggtgggcactttaataactttcatttaatagcttatctttgactttgctgccacccttcacccccccacccaaatgattatattttgatcatgtcttctatactatatggaggacctttatttaccattctctgttttgaaatgtatagtcacctatagataactatacatttcaaaatactaataccgtagagtattagtcatctatacatttctgtaatgtactgtgaaataagaagtaggacaaaaaggaaaggtctttaagtcaaaatgtatctcacagtccagttactgagtttatttttatttcagatgctagtctaataaagatggctgcttatttggtttcctttcccgtagaagattagaacatgtggattaggagagaagttgttgcatgctagtatactgatgtcaagtagtgtagtagtgaaaaaaattaggtgactgtgtgaaaagaataaaggagataaaagca

SEQ ID NO: 49367 - DNA, 1066 bp, Homo sapiens
ataaccctgtctcctttgtttggtgtgctctcctggctggacagcttatttagtagcaccctttctgcagaaagtaaagctcgcctttctgagagatcatttgttcccgcattaattctttttttgtgacaccaaaaactttattcccaacactagttatgttttgggggagtcaaaagttacatgtgaattttcagctgtgctgggggggtcagcacgcctatctgcctcgttatttaagggtcatttgtacttacctcataggtttctgtgaattaaatgagctaaggcatgtaaagtgcaccgtacttagcagtgagtaaatgttgttaataattaacaattctgataatctacttggtgaacaagaataggatatgttagaatgatgtctcatatatgttaatgcagaagttttttatgtctcagataagttttttaggtagataaaggaaatgaaggaaatgattccaggaagagcactgtgtcaggagtgaatcataagaaagatgttactattaggttgtggattctaggtattctttgggatgtttctttttcatatgttccctgaccctatccctagactttgccacttaccagctgtgagactgtggataggctaaactactcatcaaagtaccagtttttgtaagttatttacttttggaaaagaaccagatgtaattcaaagttttctctgtaataccacccttcttatttacatctagtatactttcttgagtggttggacaaagtgggtggcattagcaaagctagcttggaactgagcataatactggatactcttgtgagagtatgtctgaagtgagagcattctgtggccaaaaagtcatacagccactgtcttacactattttcttgggttaatttttgacccatagtggtaaacctagttatgagtctgtcctgctacatttacattctgtgttgatagaaacatttggagctggctaggcttttctagaatctagacaactgctttagtcagttgtacattgtggatgtttcctaagcattgaccctagctccaaggtttttttct

SEQ ID NO: 49368 - DNA, 1060 bp, Homo sapiens
tttagaatagtaatgaaacatgtggactctggagttgtctttttccaatccttacttggccagtaattgtgtctcggtttcccagtctgtaaaatgagagaataaatagttaccttgcgcaagggctgttgtaattaaatgaattaatacatatgtagcacttagtgtctagcttataatagatgccatgtaagtattgtctattatcattgcattttaaaatttcacttacagggctgcctcccacccccgtcatatttactggccagtaatgtttctttttctgtgagttgcagttagtcttttctttaaatgttagcaaagtagtacatgcatatagtttagagtcaaaaaaatcctataaagtttacaaaaagggagcccttatctcccttcagtagagacgcaaccttccttttttatttcctgaatattttcaatatgcagttggttgagtccatggatgcaaaacccattgatacggagggaaaactatatataaaacaatagcaatctgaacatcaaatgactaaaggataacattatagctgcctgaagctgcagtgttggcaggggcaatcataagactagctggagattttacttggtaatctggggaatggaacagccatagtagaccttgataagctcccacatattcatgggtgtctggagagctgcacatgctcaggagagagcagagaggcctccagctgtctactcacctggctcaatgtgcagctttgctcaagcagaaagtagaagtcagaactgattcataagccacctgaactttgagtggggtccaaaccaacacagagggagatgctttggtaaaggacagaagccttactggcacaatatgtttaaacataacctcttatttatcattagccggtcaccaaactatactgacctaggagtgacttctagaaagccaagcttaaaaataaaaattgaggaaaaagtaaaaaacagaagacaactaaccagagacatcagtggtcatacactattgagaagactatagaaatagtccaggcaagtctgtaaacaaaca

SEQ ID NO: 49369 - DNA, 1029 bp, Homo sapiens
atgcatagagaaaagtctgaaagggtatattcgggcctattaaaaagttttttttttttaaagcacttattttgggggagggtcctttatcatgttgcagtttctctagatttaaggtttttcatatgttcaagaaataaatctaagtgcctacattttagaagttgtagaattcaaggcatattttcagtggagctcatgctcataaaccctatctcttccaccttttcatgcaacctgaagtgcttgctttttcctttttatgtgcatttatttaaaaatgtgtgtaaggcaaaggaatgcatactttgctaccaaagatattaatttgaactacatatttaaccagggtacagcatgcagaataatgtagtcttttaccttcataaagatatggtctacataattttgctgcaggcgggctttctttatacatgtatctttttggaattctgagttaaatgtgtgcagcttaaatgacaggcataatgattgctgtaagactgtttctgtcaacctctaggtaaataatagaccctgtggagtagcacaagcaaattaaattaaaaaataaagggttataatgccaacttttttttttttttgagatggagtctcgctctgtcacctaggctggaatgcagtggcgcgatctctgctcactgcaagctccgcctcccgggttcaagcgattcttttgcctctgccttcgagtagctgggactacaggcgcgtgccaccatgcctggctgatttttgtatttttagtagagatggggtttcaccatattggccagcctggtctcgaactcctgacatcgtgatccacccgcctcggcctcccaaagtgctgggattactttacaggcgtgagcccctgcgcccggccttgccaactttttcatatggaaaatcacaggatcattctgaagtgaaattatctctcatactgtccttggccccaaaatacagtttttaaaagatcatttaaggcttaattcgttgcttaatttgagtaaggagacttta

SEQ ID NO: 49370 - DNA, 1047 bp, Homo sapiens
tgtatttttagtagaggcaggttttcatcatgttggcctggttggtctcaaactcctgacctcaggtgatcaacccgcctcggcctcccaccgtgctgtgattataggcgcgagccaccgcgttcaacccctctgctgactcttttgacaaaagatgtgtattaattgaaagtaggaaatagagagacagacagggtagagtgacaaatgtttaagttcctttatcatctcgaaaatgttagatatgggtgacgattaactgggtttccttttttcttccctccatcctttttgtgtgtgttaatgattatttcattaggcagttgttttgttgttgttgttgttggttttgttttgagacagagtctcactgcattgcccaggctgcagtggcgtgatcacagctcaccgcagccaccacctcctgggcttaagtgatcctaccacctctcagcctcctgagtagctgggaccacaggtgtgtgccatcatgccagcataattttaaaaatgtttttgtagagatgggagtctccctatgttgcccaggctggtctccagtaatccccccacctcagcctcccaaagtgctgggattacaggtatgagccattgcaccgaactttgtttttttttttgtttttgttcttaagcgaggaaagagggttacacacacatctgtctcttaaagaattctcaaaaacagtcagttctgggctgcactggaactctactgttccaggaacatgggcttccatttcctactctgcggatctcagctatggcatctacctcttagtccaggagagttactgaagttcttgccatctggatgattctacccaagtaggcagaggaggggatgaagtggagcctgtctttcccttatattccattgggcagaatttaatcaccaagccacacctacaagaatggctgggaatctcagccttcagtctgtgtaaaaatgtgcctaattaaatttacgggttctattaacaaagaggagaaagggtatctgagacacctagaatctgaagcaagtca

SEQ ID NO: 49371 - DNA, 1030 bp, Homo sapiens
ctctagccatctgccagataagaattatatatgacttaaataaaaaggattttgaaatttcataccttcagattatagtaatttctgagacttcagtgtagcattcagacttttttaattatagggaagcagaaagattaattttcagtgattgtgatttggtacatatagctaagagtagaacaggaattgaagacaagttcttttgtaaacccttaggctttaaggataatagactcagcctagaattcgccttgtttagaatggattatccaaacttgttgaatatttatgtgcttaggataggtaaatgttaggatataaatttttaaactctatattaaaggctctgtatttcacaggagaggaaaaatgaaggcattcgaagtgagtactctgtcccacatcacattttcttatctcaacaaagttcttgaaatggtagtgaaagttttttattgtgatagaaactaaccaagtttctttctttgtggataccaaacttgcaagtgttcctgggagtatatcagagatttgagaattcacacacatttcttactttaatgactctgggacacattattaacagagcaatgttacggagcacttaattgttaatgggagaaattttgacaaaattattgggaaccttgagagaattagagctttgttattacccgtgaagataaagaaacaattaagtacctattgtgtcctgaacactgagataaagccttagagaagttttctagttttaatccttttatcagctctttgagtgttactaaaatagaaaggataaattccccaggatctcctgtagcaaatgacaactggaatttgtcatcaagccctagaactgggttctttccgttgttcattttctcctgcagttgtcctgtgttataaaaacgaatttatattgttaaaatagtgttatttttttctttgggagaggaaatgtgagagtgagagcatgtgcatgaattggagttaggaagtaagatcagaagcagttggtgtgtgaagt

SEQ ID NO: 49372 - DNA, 1071 bp, Homo sapiens
ttcacggagattgaaaatctgttgtttagtgtagctacctttatcagtgatcttagctagatcttctggataatttgctacacttctccatcagcacttgctgcctcatcttgcgcttttgtgttatggagatggcttctttccttaaacttcacgaaccaacctctgctagctttacacttttcttctgcagcttcttcacttctcttggccttcatagaactaaggagagagttagggcctttcactggagtaggctttggcttaagggaatgttgtggctggtttgatgttttatccagaccactcagaccatgtccatatcagcagtaaggctgtttttgcttccttgtcttttgtgcattcactggaatagcacttcaaatttcctccaagaatgtttcctttgcattcgtaacttggctgtttggcacaagaggcctagcttttggtctgtctcagctttcaaagtgccttcctcactaagcttaatgatttctagctttggatttaaagtgagagatgcgtaactctttctttcacttgtacactaagaggtcatcgtagggttattaatatgcataatttcaatgttgtcatgtattagggaatacagaagcccaaggagagggagagagactagggaatggcctgttggtggagtagtcagaacacatgcaacagttatcgattgtttactgtcttatgtgggcacagttagtgattccccaaaacaattacagtagtaacaccaaagatcggtgatcacaggtcatcataacagataacaataataatgaaaatgtatggaatattggtttaccaaaatgtgacacagagccattaagtgagcacatggctgttggaaaaatgacaccgatagacttgctctacacagggttgctgtgagccttcaatttgtaaagaacgcaaatatctgtgaagcacaataaagcaaagtgcaataaaacagggtatgcctgtagaattctatgcaatctgctacttttttattgctgcacctttatgtagttggaggacatgctattttgagagcatgtaaagagagac

SEQ ID NO: 49373 - DNA, 1050 bp, Homo sapiens
ctgaaatatcactatctactgggaggtgggtgtggtgggaatcttgttaccgtgtttgttaagtgtattattgactttaaagtgagacataattatgactcataattattttcctttcagcattatctgcataccagaggtactacagtttacagtctgactactggaaggttagtgtacatttgcatgctgatttcatgtttgtgttttgggcagattattgccaattatactcaaaattaattgagctcttgcttttttttgttaattacttaaaatattgcttctaggggaaaggtattggaaaagggttgagagtatttatgtttgtgctgtcttgtatgactctccttgtattttattaagaattagagtcctctgacacattttactggtcaaatgtaatagaagtgtgataagtaaaaatcaagcaaaactaaacaaataacaataacaaaatgattccttggttttcttttctaaagttggtacctgggagtaaaagaaggctgaagacgtgtatatcaggctaaaatgggaaggtgtaatgggaaagttatgataaactctttcttggtgtactctgtttataattggagctttgaggagagctgaacctattttttagaagacctacctaaatgaaagactgtgcatagcagtgaaacaattaatcatccactttcttatcttaatttaagcagtgattaagcatgatcttttacatcatgtttacttttaagtttattgagcagtgagtttttttttttaaatctgaattgctgtttcagattttttgtggattttatttttctattggttaatttgtctttctttttgaagtaggtacttattccagtcttatatagactggctttgtctggaaaagcccttcaacagtcagcctatgcagagattttgagaacaccgtgtagaggttttagacatatatgtatatatattttttcttttttaagtcttttgaaaatatcttctctaatctctggcttttttttaaaagctttatcacatgctataaaattatagctt

SEQ ID NO: 49374 - DNA, 1049 bp, Homo sapiens
cattatgcggtctgcaaataaagaaaattttattttttgttttcttatttgtggatgcccgttagtttttttcttgccttgttcaactggctaggacctcccatacaatgttgaatggaaggggacatccttgttttgtttctctggggaaaacattacatttttactgttgaatgtgatactacctgtagggtttttgtagactaatattgaagatgttcccttctgttgctagtttacttcgagggctcttccctcttccccctacttcatgtttttataatgaatagtgtgaggatataggaaaaaactcagttcctcctatactctcacaacacagaacatttctgtaacaaaatgtgtgtgggttttccccctgcatacctggcaagcaatcagttctgcagtggctgctggtgtcctctaattcagttcaattctgacattatctacctggagatagtttcagatcccacagagtgagagctaagtcccacaagactacccccacttcagatgccattgcaggcctccggaacttttgaatgactggctatataaatcggggttcccatgaccctctccttggttccattaatctgccagagtggcacagacctcagcaaacagttagggtttactgttttattataatgggtacagatgaagagatgcataggatgaggtcatgtgggaagtggcatggagcctccatgccctctctgggcatgtcaccctctagggacttccgcttgtgcagctatccagaagctctccaaaccctgtccttttgggtttttatggaggcattattatgtaggcatgactgattaaatgattggccactggtgatcagcttaaccttcagtccctttcctctacccagaggttggagaatggggctgaaaagtcccaacgttctaatcatgctttgctctttgctgtgaccagcccccatcctgaagctacatagggggctgcctgccctgagttatctcattacagcccccaacctgaagctacataggtggctgcctgccctgagttat

SEQ ID NO: 49375 - DNA, 1030 bp, Homo sapiens
ggctgaaatgaatatgggagtatagatgttataaataaagttttagtgccgcaaaagaaatagcactcgaatataaagtttcctttttaattctcaacaaggcaaggtacttctatagaagggtgcacccttacagatggagcaatggtgagcgcacacttgggcaagggaggggaaagggttctttccctgacacacctggcccctgctgctgtgtcgttcccctattggctagggttagactgcacaggctaaactaattctgattggctaatttaaagagagtgacggggtgagtggtttggcaggaaaaatggttatgacagggcaggtaattggaatgagtcagggtggagcaggtagtcgaaaaacgttgctttacgaggaagtgaagtttaaaagtagaaggcaaagaaatgaacatactgattccttggaaagaaatttagaactcatatataacatagatatctctttgaaattttgatttcaatttctatgatttatagctagtagtgggactgctggatcaaatggtggttctattgttagtttttcgaggaaattccaacattttactaagaaagaatccccaggggttcagatttatgtgggaaatcttgggtacaactctgtgtggtacctaatttgtttcctaagtctcagggcattttattggctttcagtgttggcttacctttctgtattctccttttttttcagcctttttccttttgcggccagctcagccattcatttataaagatccttttaaaatatgtcatctaatattttaaataattttgtattaggaaggtttttcagtatgtatactgcttgccattggccttatttttggaaattatactataatttaaggaaatataaatgaaattgttgggatactatttatttatttttatttatttatttgagacggagtcttgctctgtctcccccaggctggagtgcagtggtgcgatcttggctcactgcagcctctgcctcccctgttcaagcaagtctcctg

SEQ ID NO: 49376 - DNA, 1048 bp, Homo sapiens
cacctctagtttgaggtgggacaagaagcaaagctttcatggggaaggtggcatttaaatggatcttgaatgattaatagaatttatagggtggtggggattgaataagatttcctagagggagaagaatgaagttgggagaatgtacagtgtgtcctgaaatcagaaatgcccgtctctactaaaaatacaaaaaattagctgggcgtggtggcgggcgcctgtagtcccagctgttcaggaggctgaggcaggagaatggcgtgaacccgggaggtggagcttgcagtgagccgagatcgcaccactgcactccagcctgggcgacagagcgaaactccatctcaaagaaaataaaaaataaaaaaaataaaaataaactcatatttctatagtacgctcactccaccctgtccaggcagttgcctaaatagatgttaagatgttgctccctttcctttcacaaccaccctcacccccacacccccattgtctttcaaatcttgactttttaggtagaacactaaatgactctggattaactattaccacttttaccacattctgaatatccatgcctcctctcccccaccctctagattgcatacttcttgagagcaggggaagtatattttattcagattggtttgtttaacccttgagaattgtccctggcaccaagtaaatgctcagattatttcaggggatgggatagtagatgaatgatcctgattaaaaacagtttcaactaaatttaaaattaaaaaaaatttaaacaggaaatttaaaaatggatgttgtctgagacctttgtgactcctggaatttgtgaatacttctgtaatataatttcctcattcggaaaattgggggtaatgaggacttaataaaatgaaattaccatatttttacatttgacaatgtatttaagaaacttagtgtttctagaaagatacttagaattcaaaggaaatgcacaatataattttaggacaaactttagcatttttaaaaagcaagaaaagtcactcagcttgttactggaaag

SEQ ID NO: 49377 - DNA, 1031 bp, Homo sapiens
tatataaatataaattatataaatagctggatcctattaggagtccagaggtcaaagttagtcaggataagtgttgacacatgtcttgtttcatactgcaaaaggagtcaatgatatttaaagcacaagatgttaatgcctaggtgatgattggcatgatgctatttttcttaaatactaaaatttgttttaggtttatactgtgcatttcctttgaattctaactaccttcctggcagtactaaatataaaattaaatccaattcaagaaacaaaaagaaccagaggaagaatgtagatacaagcaagagagaataggataacataggctgagcattctcttattcctgaagaatagatttttaattttagatttgaccatagaatttctgctagtaaatatttttatttcagggctggaatacctctctaagttgattggaatctgtgccatctgatcactgttattttggtgttttaaaaatatattgtaatgcatgatagaattttaggacttaaaacatcttggataccgtattttacaataataacatcatatatgttagatacaagtatttttcctaaaaatctttttcccttcctttacagaatgctgcctttttatatggtcttggtttggtctacttccattataatgcatttcagtggtaagttgacataaaaccagtaattcagtcattttcagtaaatggcttgtttgcttgttttgtttgtgcttgattttttgtgtgtgtgtgtaataaatagaaaatttagtgtcattaaacctacacttttcagtaatcttttgaaatgattagattgttccttgaagggtgttggctcaccttagatttttagagttgtatgttttcctgaaagaatctagtataagattctgttgaagaaggcttagattagaaagctttttggaatttcttagtcattcattatggactggtgttccccaagttatttgaactggtgaatcactgtgatctcagaagtcaagatatgtgggtaaatggtct

SEQ ID NO: 49378 - DNA, 1066 bp, Homo sapiens
caagattgaccacttctcccttccacataccagctagcactttccaatatccagtaactaggcaccaactcataaactctcagttctctgtagaatagtaccacttcagagttggagattaaatataataatagtaatatataagattttctaaactgtaaagtgaagtaccctgtaatattatggcctttgccccattgttgtttttctgtttaccagacaatagtatgcactaatggggtaaaaaggcatatagttttagttgaaagattggtattgttgtcacagcattgccacttagtttgatcttgaattaaataacttctctaggtctgtttcctctttagtttgtttatttatttatttatttattttatttatttatttattttttgagacagggtctcactctgttgcccaggctggagtgcagtggcgagattgcagcttactgcagtctcaatctattgtgttcaagcagtccttccaccttagcctcccaagtagctgggaccacaggcacatgccaccatgcccagagagtttgtttttatttgtagagatggggcctccccctatgttgcccagtctggtcttgaactcctggcctcagggcatgctcccacctcagcctcccaaagtgctgagatttacaggcatgagcccccacgctggcatcatcatttgtttaaaaaacaaaactacatagcagtcacttgcctttcctatagagttttgatgatcaagtgagatacagtacattttataaaatgtcaacccaatgtagattttttttttttttttttttttggtcagagtctcactctgtcgcccaggctggagagcagtggcacgatcttggctcactgcaacctccgcctcccgggttcaagcgattctcctgcctcagcctcccaagtagctgggattacaggcgcccgccaccatgcctggctaatgtttttgtatttttagtagagacggagttttaccatgttggccaggctggtgtcgaactcctgacctcaagtgatccgcccacctcagcctcccaaaatgctaggat

SEQ ID NO: 49379 - DNA, 1033 bp, Homo sapiens
gagtgtaaaatatatgcagcagagtgctagaaaccagtctctaaaaagccattgctttacatgtgcatgcatgcaagcccctgcattcacttgttcttattcattaaggtggctctttgctaggggataccttgaactgagctccttgcctttggaaggaaacctatatcctagggtgagagtaagtgaaatacaaagcaaggaaaagttagactaaaaaaagatagttgggggaaaagataaagtcagtacaatagaaatcattcttccttgtatagcttatagccatctctctaaatatatcttcctaagaatccttattaactatctctgtcctgtaacctttttccttctttccattccattgatcaatatcagaatggtcttatggcagcaaatgtaagagatactgtgctagaagcataggattttggaaattaagcccccaaatataattgacaggcttaataaggaaatgtgataattattactttgacataaaaaaggattaggagaatgaggtagaaatgaattcagaaagacagaaatattaacaaattactactaaagttttcttttttcttttctcttcttttttctttcttttcttttcttttcttttttttctgagacaggatctcagtctgtcacccaggctggagtgtagtggcacaatcacggcccactgaagtctcaacctcccggggctctagtgatccttctacctcagcctcccgaatagcttggactacaggcttgaaggcttgaaccactatgcctggctaattttttgtatttttttttgtagagatgaggtctcactgtgttgcccaggctggtcttgaacccctgggctcaagcagtcctcctgccttggccttccaaagtgctgggattatagatgtgagccacggagcctggtgtaaagtttctgtaggattcattttcatagcactgtactagtcacaagtgttcttaggggtgtaggaatttctactctcctgtatagtcactgctttgggttcagtaaaga

SEQ ID NO: 49380 - DNA, 1046 bp, Homo sapiens
catcatttttataaaaccaacatttcctttaaaacaatattgcataaaacagaagtttcaatgtactaccaagcaagaattcatgcacgtgttaaaaagttaagatatcttatgtctatattctttcagggcaattaaagcatttcaggaggtgctttatgttgatcccagcttttgtcgagccaaggaaattcatttacgacttgggcttatgttcaaagtgaacacagactatgagtctagtttaaaggtaggttgttgggttttttcaagatacaatgtttaattttgtggtttttttgtttttgtttttcttaaatattagagcattgagaaatgttggaatttatattggcactttaaaagaaaatttgaaaattcaggtgacagaactgtttatcaactgtgaagtagagtttcaaggtacaaagtagttatgctaagacttccatggtaacattatacaattacactttaaaaaaatagttttaactaagatctgtcatcaggaaagggtgaaggtttcagtctgtttggatatgtaaataactcctctagaaatgatttgccactgtagagttcagaaccagctgaatggttctgaaaggatgtttttctgtgacccaatcattgaccctgtttccatgggtctcagtacttctaccagcagaagcacatcttatatttaaattagaaaaaagagtgttctctgcaaggcatttggactgttggtttgtgagcataaacgttgtgggaaaagatgatatgttgttgattaacttcgtatccatggaaatgtgatatttctccagtttttaatttttcattgagttttttatgctatctgaaccatcaatttaggtcttgctgggctttttctgaaaatagtgctttcctgcccaacagaggaattatgttttgaaaggagtagcagttgtaggaaaaagtttaagtttttgtgaatttatgtttattgtttataatggttgttgtattctgaatctccattgcagactatcttgattctaaaggaagggtggttgggg

SEQ ID NO: 49381 - DNA, 1069 bp, Homo sapiens
aaacaaatactgttggttttttttttatgcctacataatttataaggtctgttttgatgttttggcccaagtgttacaataaggcatatatgtgccatgcagagttcatacccaccagatacaagatcctgctacatcccgttatttatattgttataggatgtaatcagacagtttgagatcatttatgctggtggttcccaaacccagctctatggcagaattatttgggaagctttataaatcagctgtcatggggagttttaaaaaattaacatcagatttctgggtacctcaaccctccccatctgcactttgcctccccatcccccctctgcctccccatccctcctctaccccatactctagtttttctagttctctatgagatcactggtctgtcattagctaaagaagcagaagtttttttaacctttatttttaatgagtatttttgccggagatggaattctgtttatctgactgctttgaaattcacaatacattgtcttttggctttcattgtttctgatgtggagttgtctgttggtcttactgtttaatcctgtgaaggtaatgtgggcacagggccctcctcccattgattcatttgataattttttttttttttttttttttttttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttaagattagggagtggtgatgactcttaaggagcatgctgccttcaagcatctgtttaacaaagcacatcttgcaccgcccttaatccatttaaccctgagtggacacagcacatgtttcagagagcacagggttggggataaggtcacagatcaacaggatcccaaggcagaagaatttttcttagtacagaacaaaatgaaaagtctcccatgtctacttctatccacacagacccggcaaccatctgatttctcaattttttccc

SEQ ID NO: 49382 - DNA, 1031 bp, Homo sapiens
gaggcggaggttgcagtgaactgagatcgtgccattgcactccagcctgggcaacaagggcgacactccgtctcaaaaaaacaaacaaacgaaaaaactgatcatctcaatagacagttctttcaaatcttccttatgttagcggtgtgtgtgtgtgtagctccttaattgtttccatcattaggacaaccctgtaggtagcaagattggatattagctcttgttttattgcatcagttttttattgatgttgaatcctagtttaagtgaattgcctgaggttcatacagcctagttttgtatttctacctacttttttttgaaaatatttgtttgctcaggcagttatatactggtaatgatatgaataaaagccacttcaatccattgttctgccaagtatgttttacaggtaatatttatgagcctttcttttgttagttttttccttttgttttgggggagttgtcttaaggtttgtaaccatagcaataaagagtttcagttatattagtactcttgagaactgtggctaaatggtttcatttagacatttgcctgtgaaatcctaagtcttacagacattgttaggctgtaacagagttttgatgtctttaaaatcatatgtattataaatatttttataagatattttatatatactagaaactgtatctttaaaatttagatttttaactacttttgtacttatttagattttgtctacagcatttttgacatgtgctttatttatttatttagagacagagtgttgctctgttgcccaggctggagtgcagtggtgcaatctcggctcaccgcaacctccgcctcccggtttcaagcgattctcctgcctcagcctcccgagtagctgggactacatgtgcgcgccaccatgcctggctaatttttgtatttttagtagagacgtggtttcactatgttggccaggctggtctcgaactcttgacctggtgatttgcctgcctcggcctcccaaagagttgggattacaggtgtgagccacc

SEQ ID NO: 49383 - DNA, 1064 bp, Homo sapiens
aatttgccatataatcacattaaattttaattatatggcttcatttttcctttaaggaaagtatgtttgtatgagacattaattttaattaatgtaattttaattaatgtaatattactttaattaaagtaatattaatatggttccttccctaaaaatatttgattactcatagtatgcttagaaggttaaggaaaaaaatttttaaaaacatttgattaactcattattaacatacaataagagttgactgaaaaggtatctaatttttggtgaggatttcctaatccctccccaggcttataaaagagcctaatttggattgcttctaaataaagctggagggtccaaacttttgtgtttctcttctacagtagcagaaactggattttattatttttgtatctttttgcctgacaaagtggctattcgataaatggatgacatgaactaactaaactccatttgcttttggagctagcactattactgttagtgttgtggagtgtgaggctttatatagtgactgtaaaggaggtctggaactgggaaacagtaggtgcctgtctcttgttttcaggtttatatatgaaaatttcttttagcatagattaaaacgaatgtatactagaaagtatgttccttctgacctaagatagtttaatacagtagtgtgtagatgtctttttagtataggtttttaaatttaaattctagttacgtaaaattataatgaaccatgtgtagaattaactatcatagtcatgctgtaattttcagcttcgatgagcagtatttaatcatcagtatttcagtgagcagtattttatcatttttttccagttaactaattttacattgtaaaacattatgatgcttttaatttaatctttttgggtaaatttttccaaatatacaatatacttttcctgactaaataaaggatacttatcacaatttaacttggtttcgggttcaaggttatcattttagacatattattttccatctgtaataataaaattctaaatcttttagacttttcatattctctttcactgcct

SEQ ID NO: 49384 - DNA, 1063 bp, Homo sapiens
aaggtttgagtttttccatcccaaacccttagtatcatattaaatatagaaagtagggataaatttgcattcatcaaatcattttattcatctccctgccgttaagatcccagcacacttttcatcatcactttttactgacattgaaataaatttaatgttggatctagtggacagtgtggtgtttaggctagccgtttgggccatagtttgagggtgggcctttttgggtggcttattaaatagtcagtaatttttaaatgtatgatttctaagtttaatatgcatgtaaaattattttttaaagaatttaatgttataacatctttttaacatgtaaatattccaattcatagtcatttggcctcctctaaccattattattaactgtggatttaaccaaatattctttaattttttttttaaatcgattttcctcagaatacttctgacaattggagtggtggacatgctgtgtcacatcctccagtacagcaacaagctcattcatggtgtttgacaccacagaaattacaggtatgtaagatgtttttgacaaattgtttattaaaaaggagtagaggtagcaaacaagtattaattttttttttttttttttttttttttgagatagagtcttgctctgtcacccaggctggagtatagtggcacgctcttggctcactgcaacctccgcgtcctgtgttaaagttattcttgtgcctcagcctccagagtagctgggattacaggcacgcaccatcacaccccgctaatttttatatttttggtagagactgggtttcgccatgttggccagactggtcttgcactcctgacctcaagtgatccacctacctcagcctcccaaagtgctgagattacaggtgtgagccactgcacccagccctaagtattaattcttataagttaaatggcagtacattcaattaaaatgcacaaaagtaaaatgagcctgcatttaccagaataatgaagagcattcattcttgtttttaatttctttttttttttttaaacaggacatggtttacactacata

SEQ ID NO: 49385 - DNA, 1861 bp, Homo sapiens
tcaataaagaaaatatactgagatgtctctacttggtgtaggtaaatagatagtaaacaaataagcaatacatatataacattagatgatggttgtgattagtgctatggaaaaaagcactaatagaaagggaacagcagaatactagagattggtggtaggagagttgcagttataaatcagaagggcagggaaggcttctctgaaagatagcatttggatgagagttacaggagtgagccttgaagctatttgtgataagattgttccaggtctagggagcagcacggagcaatggaccctaaggtaggattgtgctgtgcacatttgaggagaatcaaggtggcaagcatggcagaacaggacaggcaaggagtgagaagagagagaaatgtgctccagctggaaacaggatggctaaatcatgatcagccttataaggatactggattttattctgagtatccaggaaaccgtagggggattttgaacagaggagtgatgtgatctaactttgtttttgactaggtcctctttggtactctgtggatagactgaaagaggcaaaagtagaaatggtatgaccattttagagattatacctgtaatccaggttaaaagttgatgatggctcccagagtggtagtagtagatggtggtcagcttctgggtatatttggaaggtacagccaacaggattagttgatatagagtgatgtgtgagaaaggagtcccagctggcctgaccaactagaaggatggatgaaactggatggtatcaccaatcagtgagaacagattgagaaaagaactcaagattgagccttagggcattccagtgtattaggctaggaaattgaagaactagcagagaagaatagaagagattgacctgtgacatagtaggagatcaaagacaatgtgagtgatgccctggaagccaaatgaagaaagtttcaaggaggaggacatgatcaaataatgctcataggtcatataaagtgaggactgaaaactgaccatctgagatatttgctgacattattggagtaaggaaactacaggttacaggcaaaatttaccccacgacctgtgttttttataacccgtgagctaagaatgatttttatatttttgaagggttgtaaaaaaagaataatatatgatactgggtgacccacaaagcctaaaatatttgctatctgatcctttacagaaaagatatgctgaccattggataagggcaatttcagtggattgttggggtgcaaaagcctaattgtagttcgcttcaagataatataaaatcggcagagaaaaactgaagtagcaagtatagacagttccagcacacatgcttacagttgtttgggctacacactgcacagtgccaaggcttccatttccatataccgtggcataaaagagaacaacaaccgggtgtagctgacagggaaaatgggattaggagttgttgtcttgttgttgttttaaatttaaaatgagagaaataacagtaaaagtcaatgggaaagattcagtagagagggagaaaatggcaaaggagaaaggggaattgttagaatgggtgagaggatgggattttgggggttcattgtctttaagcattaaacagttgttaaaaggataacacgagatttttgttaaaatgcctatcatagttctaaggtataactggcagttaataagtgaaagcctttgttatgattgtaaagcatagttctattttcttttctctcacatctacttctttggctcacttagttgctgaagttttcaatactctcttaaccctgttttggaaatgtgggattctttaaaaacgtaattcgtaattcta

SEQ ID NO: 49386 - DNA, 1917 bp, Homo sapiens
tgtgcagttcagtactgttaagcatattcacattggtgtccaaccaatctccagaactttctcatcttgacaaactgaaactacacactgaacaactacccatttctccctcctgccagcccctggcaactaccattctactttctgtttctataaatttgactattctagatacctcatgtaagtggaaccatacaatatttgtctttttgtgactggcttatttcacttaacataatgtcctcaagattcatccatgttgcagcatgtgtcaagattgtcttttcattttaagactgaataatatttaaaacactttgattttgaagtttaatttcagtttcatttctcctacatatttttgtcatgataaaatggaaaggagaaatgtatgtggttactatctgattaaaactagaatcaaaagtcacagtgataagatactgtcaaatagaaatatcaccccataaaatgcgttatttaaattgtgaaaaataatgaatattaatttggagcataatatttaaataaaagctctgttttcctgagatctaaccacatattttaattttacagttggaaaataaacgtgatgctttctttcctccattacatcaattttgtacaaatccgaacaaccctgttacagtaatacgtggccttgctggagctcttaagttaggtaagccttaaattaaaaaaggaaaacgtttgtctctttgttttgctatcttttaacttttccagcactggcagatacttttcttttttttcttttttctttttttttctttttttgtattttaattttacttttttttagtactaagaatgagagagagtgtgtgtatcacttctttaatccatgatgtgaatatattgttggtgatactggttactgacaatttggtggaggtttttaaatttagctattactttggtccgtttacataattgtgatttaggttaatagaaaaaatttgattataaaatgtaggtgaaatttgatgctactaataaatactatagccccataagtatttcctggcatctgcagaaattaaataaataagtgaaatttcagtcctttcacacttaattctttctcggatgggatgacatagcagttagattcagggcttcagcgtatggttctgcaaacttggcacatagctcaggttgtgcagaggccctagttttttatgggaactggatacagtgccgtaaaatgctttaccttcttcctttaaaaaaaaaaagcacttaaaatattatcccaaatataattttcattttttaactacatttatgtattcatgaagacctgggacttttctctactaaaactttggtggaagctaacaatgaacatatggtagaagtgaggacacagttgttgcagccagcagatgaaaactgggatcccactggaacaaagaaaatctggcattgtgaaagtaatagatctcatactacaattgctaaatatgcacagtaccaggcctcctcattccaggaatcattgagagtaagtatttgtatcctaaagattattttaggattttaaagatgattttactttggagttttgaaaggacacattacttttatatgcatctcatcattttatgttacataaaatactttgtaagtgttctccagttgtctcgtatgtatatatgtatgtatgtatgtatgtatgtatgtatgtatgtatgtacgtacgtatgtgtattttgagacggagtctccatctgtcgcctaggctagagcgcagtggcacgatcttggctcactgcaccctctgcctcccaggttcaagcgattctcctgtctcagactcctgagtagctgggattacaggcatgtgctaccacgcccagctaacttttttgcatttttagtagaaactgggtt

SEQ ID NO: 49387 - DNA, 1039 bp, Homo sapiens
ttgcaccactggagctccaattttttttcttttcacatttcaggtcatcaggaaaataacaacttctgttcagttaacataaatattggcccaggtgactgtgaatggtttgttgttcctgaaggttactggggtgttctgaatgacttctgtgaaaagtaggtttccaaagtaaattttcttaaaacatatattagaaagcagtaattgtaaacgacaacttaccaagctggatctcctaatggatacattgccagtattcacttaccattcagcgaagaattcattttaaattatttgattccaaacctcatattttgtgttattggaaatactttaagaaagatgccatgaaacaacttcatgcagtagtagtacccatgaattaagaagatagaaaagttgagttattagtttaatttttaaaatgatgcatacttattcatttgaaatgtgtgtattccaagaaaaattgttttgttataaatggttttaggaagtagaaggaattctttattgagcacccgtataggctgtgaataactcaagcttgaccataataccttttgccatatcatgatataaattctttttaaactgacaactttttctatgaagaaattttataaaatgtattatttattttttatttttaaatagagatggggtttcaccatgttgcctaggctgctcttgaactcctgagctcaggcgatccacctgcctgggcctcctacagtgctggattacaggcatgatccaccacatccagcccagattttgttttctctagttgaaagaacttggatagttcctttccttaagatcccagaaatagcttttatttacttctgtgtcttgtgttaaaaagtactttggaatttttttttagttggtttcaatttgatcatttgtctagatagaaccttactctcttcttttctagaaccttattctcttcttttctagaaagtacttcattatataaggacctggtattttcatttagtaataacattagcaaattagtataggatga

SEQ ID NO: 49388 - DNA, 1489 bp, Homo sapiens
tcatttggtcccaatttcctaaatatatttaggatttctgcagaataaatcccattcaacaaatgtttgaaaactcactctatgccagacactgttctaggcactgatgatggacataccaatgtttaagatgaaattcctgtcctctggagacttcaattctagtagaacaagacagaaacccccagtataatttatttatatgaataagataaaatacaataatatttgggaggagggaaggtcggagtgctccttttgcttaactggtctgagagtgtgagttttctgcttagccctgaataatgagatgaaatcaactacacaaagatctatgggtagaacctttcatatacagagaacagatgaaggctaaattgggaataactttggcatgtttatgggacaaaaaggccagggtgactatagctgaatgagagaaaggaagagtgatggtgataaacttaagcaagcaggaatgagatcatacatgggctttctggacatggtaagaagtttatatattaattctaggtgttacagcttgccatagaggattttaagcaggaaaggaataggtttcactttaaatttagaaaatggatctagtgggtgcagtggctcatccctataatccttgcactttgggaggccgaggcgagccggatcacttgaggtcaggagtttgagaccaggctggccaacatggcgaaaccccatctctactaaaaatacaaaaattagccgggcatggtgatgggcacctgtaatcccagctactctggaggctgaggcggcaggggtggtggggcggggggttgcagtgagccaagatggtgccacttcactccagcctgggtgaaagagtgagactctctctcaaaaaaaaaacaaacaaacaaacaaacaaaaaaaaaacggatctaattgctgtgtgtggaatgagttccaaggggtaagcttagaagtagggaggacaaattaggaggcaattgtaacagtacagaccaacctggacagagatttccctgtaaaaatagagagagggggtcaaactagggagtcttatggaactaaagcttgtagaacttgctcatagattaggtggttgagtgagagggaaaaaggaaccaaggaaaacttatagtcttttcttcttgttgcctgattgtcattaatgtaaacattaatcacctctatcatcttttccattccctaccccaccctcaatattcttgataccctttgagactccttccagtttatcattaaaatgttgaggtatcgacatttatgttgttataaagttgtcttgtgttgaggttggacacacaaaatttgtgtgtttttctacttataatttatagtgatactgttgtttcttatacatttcttttttttaacctagatgcacttacattcttatctatactccattttgccctacgctacaaaatgtctcatcatttaaatcttgattgcattcctg

SEQ ID NO: 49389 - DNA, 1052 bp, Homo sapiens
tgtagctatctcgtaaggctgctggctgaaaactgtgtctatgcaaccttccaagtgcggagtgtcaaccaactggacgggagagagtactgctcctactccaggactctcacaaagctgatgagctgtacttcagaaaaaaataataatttccatgttttgtatatatctgacaaaactggcaacatcttacagactactgacttgaagacaacctcttttatatttctctatttctgggctgatgaatttgttttcatctgtcttttcccccttcagaattttccttggaaaaaaaatactagcctagctggtcatttctttgtaaggtagttagcaattttaagtctttctttggtcaacttttttttaatgtgaaaagttaggtaagacacttttttactgcttttatgtttttctgtcttgttttgagaccatgatggttacacttttggttcctaaataaaatttaaaaaattaacagccaagtcacaaaggtaatggattgcacatagactaaggaataaacttcagatttgtgatttttgtttctaatcttgatgtaaatttacactatttataaatacatatttattgcttgaaaatatttgtgaatggaatgctgttattttttccagatttacctgccattgaaattttaaggagttctgtaatttcaaacactactcctattacattttctatgtgtaaataaaactgcttagcattgtacagaaacttttattaaaattgtttaatgtttaaagagttttctattgtttgagttttaaaaaagactttatgtacagtgcccagtttttgttcatttttgaaatctgattatatatattttatatatacttatgtatgtatatataatatatatagaaatctggatatatatgtataaatctttagaacttaaatttttctcgttttaagtttcacatctatggtagatttttgaggtgtctactgtaaagtattgcttacaaaaagtatgattatttttaaagaaatatatatggtatgtatcctcaagacctaaaatg

SEQ ID NO: 49390 - DNA, 1029 bp, Homo sapiens
tagcagttcaagttgactaagacagctggttaaagatataacaaaagtctaagcagaatcggacagtggagttacacaaacctaggtttgggtctcagtgaccttggttaaatcatttaacctcagggactcttagtttccttatctgtaaaatagtcatactacccatctctcaggttcttttataagaatagtgcttatgaaatgcttagtacaaaacctggcacatagtaaatatccaataaaatggccaccaaaaactagtgtattgtaaggcattctcacttctaaggtaatgtttcatcaggccgtataataagtaagcaaaactgtagattaggtagtttttttgggctccttgcattctcttttcccaaccaatggcccagaaattaactagggagtcaatatgatcaattaatccacagcctggtggcaacaccttttttttcttccataaattccaaaaagtgggaaagtagagaatgactggtagtagaagttcagggatcagtagaggtttggaacaagggtggtggtcttttgagtgtgagcttcttctccctaacccttcataccacatccttaaggtgattcgttgttccacacagtgaattttggatacaaaagactcaaggcttttactccattgagcattctgtgcattttagtcaaaggattcattgcagaagcctcgcactggacatctgtagacataacctgtagttgcccatccaccattgttttcaggcactcatttcccagaagacagaaagccccaacttccaggacaggctccacttgccaagaatttctaaactctttgaagatcagcttctaccttatcaggtaccttccaaatattctcagatggatgacaacagtctctcctctcagggttgtgtttgcaagtctagaagtttctgaagaatagtaactgaagagttactattgcatattttcattgccatcaacaacttccagtgatataaagaagaaacttttaaagcatgtgatggcaaatcctga

SEQ ID NO: 49391 - DNA, 1027 bp, Homo sapiens
gctgaggcaggagaatcccttgaacccaggaggcggaggttgcagtgagctgagatcgcaccactgcactctagcctggacaacagagtgacattccatctcaaaaaaaaaagaaaaaggatatgcgatatgcaccattatgagttcagtgtctctgggttgtaggaatataggcaaattttttattagtaaaaagttagatacatatgtatatatttatattacctttctatcttgtctatgtgtttattctcacatgtggagagaaacacacaaaaaaagctaggaagaaactacaccctctattaatagttatatttagaacaaaaattattgatttttaatgcctctgattatactctcaaatttcaagaaactaccaagaaggattatttacaatgtcttttatatagttttctttatccctccttatttttctattcagttttattttcaatatattacactactctgctactttctgttctgcacacatcatcccactttgacatgtctacacatactctattttccatgtggttgtctgtttgatctcattgttagaagaatatattctacaactttgagaaagtatctcttatgattttaacttggagagtgattttctaatgagagctaaaacattatcttgcttttacacttcatcctcacaaatcctgtgacctaaattggaagataccagattttacatatgagaaaacactgtagtgagtaactcaaggtcccatgggtaataagaacaaactgacgaaaacccaaatctccagaaaccaaatataaattctgatactggtgattgctattggataactattttctcttttcctcttttttccgtattccctatcaccagctcacaaaatgcactgtggtgagtatatcttaatattgatttgttatgaaagtaaaggcttttcattttataaaagcattacattgatgaattccactgattgtcttggtaacactattaagagggaagacaatgacagtcccacctccactg

SEQ ID NO: 49392 - DNA, 1050 bp, Homo sapiens
caagtctttgctattgtgaatagtgccacagtaaacatatgtgtgcatgtgtctttataataggatgatttataatcctttgggtatatacccagtaatgggatggctgggtcaaatggtatttctagttctagatccttgaggaattgccacactgtcttccacaatggctgaactagtttacagttccactaacagtgtaaaagcattcctatttctccacatcctctccagcatctgttgtttcctgactttttaatgatcaccattctaactggcatgagatggtatatcattgtggtttggatttgcatttctctgataagcagtgatgatgaacatttttccatatgtctgttggctgcataaatgtcttcttttgagaagtgtctgttcatatcctttgcccactttttgatggggttgcttgtcttcttcttgtaaatttgtttaagttctttgtagattctggatattagccttttttgcctgttcactctgatgatagtttcttttgctgtgcagaagctctttagtttatgtagatctcattagtctattttggcttttgttgccattgcttttggtgttttagtcatgaagtctttgcccatgtctatgtcctgaatggtattgcctaggttttcttctagggtttttacggttttaggtctaacatttaagtctttaatccatcttaatttttgtataagttgtaaggaagggatccagtttcagctttctacatatgactagtcagttttcccagcaccatttattaaatagggaatcctttccccatttcttgtttttgtcaggtttgtcaaagatcagatggttgtagatgtgtggttttatttctgaggcctctgttctgttccattggtctatatatctgttttggtaccagtaccatgctgttttggttactgtagccttgtaatatagtttaaagtcaggtagtgtgatgcctccagctttgttctttttgcttaggattgtcttggctatgcaagctcttttttggttccatatgaactttagtttttt

SEQ ID NO: 49393 - DNA, 1021 bp, Homo sapiens
tttgagatctttttttctcatgtatgtatctagtgttacacattttcctcttagcttcacaaattttgatgttgcattttcattcaatatagttttattttcaatgaattatatttaagtatgttctttaattttaaaatttctggataatttcctgctatctttctgttattgacttctagtttgattacactatggttatttaatttattattattatttcaatttttaaacatttgttcagatttgttttgtggaccaggataggttcatgttgtgaatgttccatgtatacctaaaaataatgtgtattctgttaataggtggaatgttctataaatgtcagttcaattctgttggttgatggtactgttcagtccttctgtatccttactgactctctgtctagtgagtccatcatttgttgaaagaatggtgttgaagttttcaactatagactcgtccatttcttctttctgttctttcagtttttgcctcaggaaatttgaagctctgctatttgctctgtacatatttaggattgctataacttgtttttggattgaccttttaaaccttatgtaacattcttctttgtccctggtaattttctttgctctgaagtctattttatctaatattaatatagctactcttcctttcttttgattaatgtttgtatggtgtatccttttcagccttttactttcagcccatctcattatattagaaattaatggtaatgtttttaaatccattttgccaatctcttttagtttatgtatttaaaccatttatacttaatctaattattgatattttaggacttcaatttgatttgtttgttccctctgtttttattcctttgttttccttttcctgtcttcctttgagttacttcaacattttttagaatttcattttatctgtagtgtttttgagggtatctctttgtatgtttattttagtggtttccttgaattatacatgtgtaacttatcacagcctactggtgtcaaca

SEQ ID NO: 49394 - DNA, 1050 bp, Homo sapiens
atatatgtgtgtatatatatacatacatatacaaaacaattgcttactagatgcacaaatcaatggaatagagagttcataaacaggcatatctctctttacatatatatatctatatcgatcacactatatatatgtgtgtgtgtatatatacacacatatatgtgtgtgtgtatatacacacatatgtgtgtgtgtatatacacacatgtgtgtgtgtacatacacacatgtgtgtgtgtatatatatacacacatatatgtgtatatgtgtatatatgtgtgtatatatgtgtatatatgtgtgtgtatatatatacacgcatatatatgcgtatatacatatatatggactcatatatgtgtatatacatatatatatatatatatatatatatatggactcacagtgtgtccttggacaagttatatagtctctgtgtgcctcaattttctcaagtataaaacagagataattatagtacacaacccttatggggtttttatggattgagtgaatgattatagagcacttagtatggtgcctggtacatatatagtgcttcttatactcctgaatctttttacttctattcagactggattttcattggaattaacaaatcccattattttatctcacattatcattatggaaatttaactgtggagatgaattttaatgaaaaatttgtattgccgcttagtaagataataagatgttcatttttgttttctgttaggaaaataatgcttaacttggtttaatagctgtaggacattaaattgatatcagacgaattacaactcttgaaatttttctttgatttttttttttttttttgagacagaatttggctcttgtcttccacgctgcagtgcagtggtgcgatctcggctcactgcaactctgcctcctgggttcaagcgattctcctgcctcagcctcccaagtagctggaattacaggcgcccaccaccatgcccagctaagttttgtatttttagtagagacggggtttcaccatgttggccaggctggtctggaac

SEQ ID NO: 49395 - DNA, 1062 bp, Homo sapiens
ctttgttgtatttaatgaactgtgataaatgtaatgaactgtggcatttcatcatgtgactgtaccataatttacttaaccattctcttcttattggacatttgcagtatcaccaaactaaaacttccatctggttgtagaaaaattttaatcatgttttaaacttgagagataattcacatttatttgacccttaaccttaactgcagtactaaaccagaaccacccatctgtaagaaagaatctcatatagtgagaacttattatagcaaacaccctgaattagacttataattaaaacaaaaatcagtgtgctgttgttgcattttatacagagaaatactagaataggaaatcattgttttagtctcagaagttcattttaaaatctcaatgaaattttattttcacagatggttggtaaaggctttttcctagttcagacaaaggaagtgtccatgaaagctgaggatgctcaaagggtttttcgggaaaaagcacctgacttccttcctcttctgaacaaaggtaccttctggatgattggtatacttttgtggatattttctttacatgctgatttgatttacttttgcctttaacatttgttttacattgccttctctttctcatttgttctttgttttttttctattattgttctgaaatgtcaaaatttcacatcactcaaggagccctagacaactaactagaaattaggcattctttttttttccctatcctctgttcttagtactgaaagtcacattttattatgtatcttattatcattttaattgttgtattattgttgtacctttatagtgtagtgataaatatttcatgctccctgctcagagttgcaaagcacttgatgaagattctttctaccttcagtgtgctttaatcatactggaaaagaaataagaaatataaagtggtatactattttatgtatttaatatgattgattaacttccatgtataattagaattgttttccctagtgggtaaatgccaccaataaatttcagatactggatataggtcttcaaagagagg

SEQ ID NO: 49396 - DNA, 1045 bp, Homo sapiens
ggatgtagtgccgaacccctgtaatcccagcattttgggagggtgaagtggaaggattgcttaaggccaggagtttgaaacccatctgggcaacgttgcaagaccttgtcactacaaaaaatacaaaaattagctaggggtgatgcatacctgtagtcccagctactcaggagctgaggtgggagggttgcttgagcccaggagcttgaggctgcagtgagttatgctcatgccactgcactgcagcctgggcaacagagcaagaccttgtctcaaaaaaagagaagaatgaaggtaatgatttaacaacagaaatctatgcatccatattgttaaacaaaaaggggagagaagaaaagaatgttcatctgctgtttatggaatattgtgagctaaaaaatgcagaaggaatgctggactttggaaatcaccatttccaaccccaatgtaataattatttcagacaaagattatcagtgggtgctaaaactattggggtaaaagttgctaagaagtaggatatttggctgggcgtagtggctcatacctgtaatcccaacactttgggaggctgaggcgggtagatcacgaggtcaggagttcaagaccagcctggccaacatggtgaaaccctgtctctactaaaaatacaaaaattagccgggtgtgatggcggttgcctgtaatcacagctactagggaggctgaggcagataattgcttgaacctgggaggcggaggttgcagtgagccaagatcgctgctgcactccagcctgggcaaaagagcaagactctgtctcaaaaaaaaatggccgggtgtggtggctcacgcctgtaatcccaacactttgggaggccaaggcgggcagatcacaaggtcaggagatcaagaccatcctggctaacacggtgaaaccccgtctctactaaaaatacaaaaaattagccgggcgtggtggcgggcgcctgtagtcccagctactcaggaggctgaggcaggagaatggcgtgaacccgggaggtggagcttgcagtgagccaag

SEQ ID NO: 49397 - DNA, 1052 bp, Homo sapiens
tgctaggattacaggcacgagccaccgtacctggcttagaatcttttatactatttcaccctaacttctaaactgatcttatattaaatattttaaaacttgtctcacagtaatctggttttaggatcatgtagggtctggacatttttaatccctcattttactgatgaggaagaaaattgaggctgggcacagtggctcacgcctgtaatcccagcactttgggaggccaaggtgggtggatcacctgaggtgaggagttcaagaccagcctggccaacgtggtaaaaccccatctctactaaaaatacaaaacttagctgggtgtggtcacacgcccctataatcccagctacttgggaggctgagctaggagaatggcttgattggcggaggttgcactgagctgagatgatagcaccactgcactccagcctgggtgatagaatgagactccatttcaaaaaagaaaaaaagaaagaaaattgagggccagaaagtttagacggcctgtccaactcacaccatagtcactgaactttaatgttgacctcttgactttatccccatgattaccaggagaagactcagcccatccatcccttcctgtatgaagccttttctaatactctgaggtagaaaggccctccatggtgctcacatagtactctttatagatttccaagtacctgcaacacttcactctatttctttatccatgcgtttcttgctactcaaagtgtagtccatgggccagcagcatcagtatcacctaggaatttgttagaatttaaggctctactccagatctcttgaataagcctcgacttttttttttttttttttttttgagatgctctgttacccaggctggagtgcagtggtacgatctcagctcactgcaacctccacctcctgggttcaagcaattcttgtgcctcagcctccggagtagctgggattacagttgtgtgccaccatgcacagctaatttttttttttttgtatttttagtagagatggagtttcgctatgttggtcaggctggtctc

SEQ ID NO: 49398 - DNA, 1034 bp, Homo sapiens
tctttcaacatagtactccaccattgcctggcttacgtgatttctgatgagaaggctgctgtaatccttttttttttttttaataccttaagttctgggatacatgtacagaatgtgcaggtctgccacataggtatatatgtgtcatggtggcccgctgcacccatcaacccgtcacccacttcaggcacctctcccaatgctatccctcccccagtcccccatcccccaacagactccagtgtgtgatgctcccctccctgcgtcgatatgttcccattgttcgactctcccacccatgaatgagaacatgtggtgtttggctgtctgttcccgcgttagtttgaggctgctttaattcttatccttgttcctccatagttaatgtgtcttttttcctctgactactttgaagattttctttttgtctttggttttcagcagcttgaatatgatatgcctaattgtggcttttaaaattttttcatttttgtcctgctttgtgttctctaaactttattatatctgtggtttgttgcctgtcactaattttggaaagtttctcagccattatttcttcaaataattctatcttgttcttttttttttctctttctgggattctaattacaagtgtgttatactgtttgttattgccccacagttcttgagtgctcttcagtattttcattcgtctctttttaatttttattgactgatcaataaccttgatcttcaagctcactgagtctttccttggctatgtcaagtctactgttcagcccattgtttttcttactgttttttttttaatttctagcatttccctttgattcattcttacagtttctatctctttgctgaaattatctgtctggtcttgcatattgtctattttttacattagagtctttaagatattaatcatagttcttttacatttttttctgatagtctcaacatctgcatttactgagtctggatttagtaattcctttgtcacttggaatgttttcttgccttttgttacgcct

SEQ ID NO: 49399 - DNA, 1034 bp, Homo sapiens
aggacccagtgaaaagctcatcttttcactacagtggtttcttccacctctgaagccccacaggactaaatgtgctcaacactcatttacccagatgggatagtgtggtagagtacttactggctacaatgtcctttcatctctgtatgtacacttagagtgtgattttgcagatccttgcaacaagaggtggagtctgtttctctactccttgaatctgggctgtccttgtgactcactttggtcagtaaaacatggcacaggtaactccagatgacttatgagcctaggtctcaagaagtgttgtagcttctttcttactctccattctgaggcaaccatgtgaggaagccccagctaacctgctggaggaagagagatggtatggagagggagagagagatccagtcatcaaccagccatcagatatgtgagtgaagccatcttagaacattcagccccagtcacattggcagatgactgtaaccatatgaaggaccacagaaaagaccagcagaacaaccacctagctgattctagccgaaattgctaatccacagaattgtgagctaataaaatggttattattttaagctactaagttttggggtgaattacatagcaataaataactgaaagggcagggtttgtactgctatatccccagggcctagagggcatgaccatggcaggttttcagtaaaagactgttgtggattactgtcattgtggtgtcactcctctctttgcttaatagacaaccaaacttcccagtcctcttggctctcacaaaagttcaaagcttgacttcaacacattcttccagaataacaccttgaagttcttctttgccccactgcaccagcatccatccatttgcccccatcacagccctatgacagacagttcattacaccccacctcagctccatgttgcgtccctcctacttacccttattctctaaccctgtggggtcaacccattgaccacctcagtgccataaagctcttctcaacttcccagccccccatcc

SEQ ID NO: 49400 - DNA, 1097 bp, Homo sapiens
aggttgataccgtgtctttgctattgtgaatagtgctgtgatgaacatatgagtgcatgtgtctttatggtagaataatttattttcctttgggtgatatacctagtagtggaattgctgggttgaatagtggtttgatttcacattctttgagaactccccaaaccactttccacagtggctggactaatttacattcccatcaacagtgtctaagttcctttttctctgcagcctcaccagcatctgttactttttgactttttaataatagccattctgactggagtgagatggtatctcattgtggttttgatttgcatttctctgacaattagttttgttgagcatttttttcatatgtctgttggccacttgtatatgacttcttttaagaagtgtccatgtcctttgcccacattttttttttttttggatacagggactcactctgttgcccaggctggagtgcagttgtacagtcagtctcagctcactgcagactcaagctcccaggctcaggtgatccccctgcctcagcccctcgagtagctgggactataggcaggtgccaccatgcctggctaattttttttttttttttttgtagaggcagggtttcaccatgttgcccaggctagtcttgaactcctggtctcaagcaatctgcccactttaacctcccaaaagtgctgggattacaggcgtgagccattgtgcctggccttttgtccaccttttaatggggttgttttttcacttgttgaattttttaagttccttatagattctagatattagacctttgttggatgcacagtttgtgaatatttttctcccatttgttagggtgtctgtttactctgttgatggtttcttttgctgtgcagaagctcttattaggtcccactggtcaatttttggttttgttgcagttgcttttgaagacttaaccataaattctttggcaaggctgatgtccagaaggtatttcctagattttcttcttgtatatttatagtttgaggtcttacatttaaatctttaatccagcttgagttaatttttgtatatggtgaaaggtaagggttcagttt

SEQ ID NO: 49401 - DNA, 1035 bp, Homo sapiens
ctttattgaagtataatttatataccacaaaattcacctgcataagtatataattcaatgccttttaatgaatttactaagttgtgcaaccatctccataactcagttttagaatatttccatcacgctaataaaatcccttgtactcatttgcagtcactccactcttctcccctcagccctaagcaactactaatctactttctgccattgtagatgtggacatttcatataaatagaagcgtataacatatggtcttgtgtgtccagattctttcacgtagtataatgttttgggggtttatctgtggtggtacaacatatcaataattcattcctttttgttgctgaataatattccatcatgtggatgtaccacatcgtggttattcctttgctagcagatgggtatttgggatagttccagcttttggttctcatgaacagtgctgcagtgagcattcatgtacatatccttgtgtagacataagttttcatttctcttgggtagaattttaggagtagaattgctgggctgtatgttaaatttatatttaattttttaaagaaactgccagttttccaaggtggctgaacccttttatagtcctaccaataattcctgggaaatatagcttgtgtacttgaaaagcatgtatattttgcttttcttggagtgttttgtagataccagttaggtcaatttttaaaatagttcttgtttaggttttgtatattctttatttttttctagttctatttattaccaagagtggaatgttaaactctgttagtgtccaattgtctgtttcttcagttctttgtctttagttttcagcagtttgatcatgatgtgcctaggtgtagattcctttgtatttattctgtttggtgttcttagtgtcttggcagttttaaacttttttttatttttattttttatttttatttatttttttgagacagagtctcgctctgttgcccaggctgtagtgcagtggcacagtctcggctcactgcaacctccgcctcccg

SEQ ID NO: 49402 - DNA, 1031 bp, Homo sapiens
atttttaaagaaatgaccgaaatattttctagaatagctatactattttacattcccacaagccatgtacgagtgatatagtttctctacactttctccatgatttgatattttcactatttctttatttcagctattgtaataataagtatgtaataatatcttgtggttttaactggcatttccctaatggctggtgatactgaatgtcttttcacgggcttaaatgccatttgcgttcctctttggtaaaatgtctgctgattttttttttttttttttttttttttgagacagagtctcgctgtcacccaggctggagtacagtgatgcaatctaggctcactgcaacctccgcctcccaggttcaagcaattctcatgcctcagcctcccgagtagctgggattacaggtgcatgccaccacacccagctaatttttgtatttttagtacagacggggtttcaccatgttggccaggctggtctcgaactcctgacctcaaatgatccgtccgccttagcctcccaaagtgctgggattacaggtgcgagccaccatgcccggcccatctcttgatttttaattaggtcatttgtttccttactgttgaatttttagagttccttatgcattctgtaatataagttcattgtcagatatgtgttttataataaatattacatgtataatatttctaagaaatgaccaaaatattttctagaatagcgattcctttttacattcccaccagcaatgtatgagtgatagtttcttcacatcttctccagcatttgatattacacgtgtgtgtaatatgtgtaaatattctgtcccattctgcttgcttttgcgtcttcttaacaggggctttctcagagcagaagtttttttaaaaatataagtagatagtttatttgggccaagtttgaagaccacaacccagcagcatagattcaagttgccctggatatgcttctgagagcaaaagtctttaattttgatgaaaacacatttttctttgccaatc

SEQ ID NO: 49403 - DNA, 1050 bp, Homo sapiens
tgatccaatcaaattagggctcctttgaagatagttcctgagatctgtgtttgagatttcttctgaccgcaagaggctctttccctgctgtctctttctctggttctctctggcatattaggcagcctaggcttgaacttctgtacactcagttgcaaatgaagtcagtttcattgcaggagaattgaagccccctattctatgccctgcctctctccctgggaaaaatctttgagccacagctctggcgcagtggatggagataaatggtgagcttccctctgagtgtcagccccaggtctcccaggtttgcctcttctggtatagaacccccaccccacaaggtaacgccagagcaatcaaggctctggtattcttggtggcacaacacccaaggcatagcctccatcccatgagttgggggctaggtggaagaagggagcccccacctctcagccacattctcctggaacgtagcctcagcaaaagtagctgggaacgggataagagatgccgacatcctgttcttcccaggaagaaaggagcttggagctggggtagaaggaaccctgtgttcttggctactgtactctggcatgagatctttgctgggagggaagatggaggaagtggttctagatccaaatactgcagactttgactttactttatgaattttagtagattttctcgaataagtacttcatttgctgtatgcccttaaaaccatttccagagactttaaatggttgggttttttttaattgaaataactttcaccaattttgctgggaagagggtcgtccatggagctgctcacactgttatgccagaagtggaactctgtgagctttttaatgtaaaattttgttgctgctattcttaattgctcagagtggccttgtatttggatttctacctcctcagtagattgtaaatagcttgaaggcagtagccctgacctttattcattatggaatcatgatagcccctggtagcatgttgtatgttgtggcacataaaagaatgtcagtcactggctatattgct

SEQ ID NO: 49404 - DNA, 1086 bp, Homo sapiens
ttgctagccaggaaagctcacccttggtgttcagcgattttattgagagttggccacgtaggcattgctcaccatccacgtggctgatgttactctccagtccctccagaggtcaggctgatagaaggtgccccaaagtctctaccataaatcacatcgttagcatagactatctcacttggcccaaggacccaaggtaaacaaagacactcttatcaggcaggacattccaggggcttaaaggttacttctaaggagctaaagacaaacagccaaactttttttttagacaaggttatcctttaccgcacaatacccaagagaaacaaaaacatatatccacacaaaaactgctgcatgaattttcatagcaccattatttcataacagacaaaaagttaaaacaacccaaatgtccatcaactcgatgaaatggggtatatccatacaattattttttgcccataaaaaggaatgaagttataatacatgctacaacatagaggaacctgaagaacatgctaagtgaaagaagccagactcacacagccacatattgttgtaattccacttatatgaaatgtccagaataggcacatcaatagagacagaaagtagattagtagttgcttggggctggagttggtaacagggagtaactacaaatggacacaagatttggggttggtggtgatgaaaatatcctgggattaggtagtggcaatggttgcatgactgtaaatatattgaaaaccattgaaatgtacacattaaactggtgaactttatggtatataaaatatatcttaataaagctatttctgtcatttcagtgaatgaatataatgaccatgctgtaatgcacgtagtaaagtgtttaaagacacatgtataaaagatgctttgtacaagtgctatttgcttgccacaatgagaacagtgctatctcaattttttattttaaatttgtaaagataaaaatattttttaaatgggcataataaaacctctctatcaccttccgtggttacagtggaaataagtgagatgtatgcaaaggcattttgtttaatagaatgcgccaga

SEQ ID NO: 49405 - DNA, 1073 bp, Homo sapiens
cccgagtagctgggactacaggcacgcgccaccatgcctggctgatttttgtatttttagtagagactgggtttcactatgttggccaggcttgtctcggactccttacctcatgatccacccgcctcggcctcccaaagtgctgggattacaggcgtgagccaccgcgcctggccttacttatttttaaagcaaattcttctagatcctgagtttctggctttttaaattaaaattacaagaaaatgtattgattcctctggtgttaacaggtctggagacatacatttatgatgctttggagctattgataatatatagagtactttattcattaattatttcattctaaaaaccctgctttatatatccccagaatactaaggcctggtggggaatatcttataaataattaatggttattactaattattaataataaccgtcaatgaaagtaagatagaaactgttaagagattcagttaagtactgtgtaattttgtgttgattatatctgccagtaatattcatcatgcattgcatagaagtgggattgtctttctttttctcctagctggtttgtgagaaaattgtgagcaattttgcacagggagacttcgatgtctgactaacatttattgactgcttgtatgtactaggaataattctaaatgctgatcatgtgttatttttttctctttttttctttttatttgtcattctaaatgcccttcatgtattgtctcatttaatcctcacaaataggcacatttattctcgtcatactacagatggggaaacatccgtaagtggcagagatgggatttgaacccaagccgtcttaaggactgcactggaacggtgttttttgttttctaaaatgggggtaataatacatgtaaagtgattagaacatatagttagctctgaatacatggcagaacttactgcagttatggccttgtttaaggctcccagccaccctgtgagttagggatcaacatgatcccccttttctacaagaagaaacaggttctgagagaataaatgacttgcccaaggccactcggtac

SEQ ID NO: 49406 - DNA, 1060 bp, Homo sapiens
tggggtagaggaaagctgttgatttctgtaagttacccctgctgtatgcccttattatttctaatacttcattgttgattctgatgttctttctaagtagttggtcatattgtatgcaaatctatcctgtcacttatttatttttcttcatttatagtattgtccaggacttttagtaccatattaaatagtataagtgatactgggtacacaaattaagatttactttggctggttgtggcagaaagtccaaaggataatggcttagacaagatagtttacttttctttcccataaaggcagtctgcagaagagcaattaatctagggctgacaggcagccccttctgtgtagccatcctcagcacatggcagttgagacagtaggaagaagggagaggaataaaagggaatgtgtctaaagtttctccattaagtatggtgcatgcagtaagtttttagaatgtatcctttaataaatcaagaaaattatctaatcttcgtttgctaagattgaccataaataagtattgaacttcaaaatcctgtgctttttttctccctttgtccattaatttcataaattgtggcctggcatggtggatcacagcaccttgggaggccaaggtggttggatcgcttgaggccaggagttcaagaccagcctggccaacatggtgaaacctcatttctactaaaaataaaaaaatcagccaggcgtggtgaagcatgtctgtaatcccagctactggggagactgagacatgagaatcgcttgaacctgggaggtggaggttgcaataagctgagatcgtgccactgcactccatcctgggcaacagagtgagactccatatcaaaaaaataaataaaaattttgtaaattgcattaaatgatatccttggcattcttgagctataccccacttgatcatggtatgtatgtatatgtttatgacttcttactttgaaaatatctcaaatttacagaaaggttgcaagaaaaagtataatgaattcccatatatcctctactcagaattacttgttttaagtatttt

SEQ ID NO: 49407 - DNA, 1063 bp, Homo sapiens
tgagtagctgggattacaggcacgcgttaccacacccagctaatttttgtatttttagtagagacggggtttcaccatgttggccaggctggtctccatctcctgatctcgtgatccgcctgccttggcctcccacagtgctgggattacaggcgtgagccactgcgcccagcctgtcctttgttttttaaaacaatgctacagtaacttttttgtacatgtgcaagtatgtgtatactttaaattcccagaagtagaactgtgggtcaaagggtatatagatttttagttttgtcagctattgccgaattctcctctataaggattattccatttttaactcctaccagcaatatgaaagtacctgttttccatacagtcttgctgtttgttttcaaacattggactgttgtaaatctgttagattaaaaatgttctatcaaatcttccttactagtgattattgtatagtacaatactatattatttaatagttatcataaataataattttaatataactccaaataatgtagatactccctcctctaggaggtagagcttaattaccctccttttgactgtgggctggtcttagagactcacctctaaagaatagagtatggaggccgggtgtggtggctcacgcctgtaatcccagcactttgggagggcgaggggggcggatcgtgaagtcaggagatcgagaccagcctggccaacatgatgaaaccccgtctctactaaaaatgcaaaaattagctgggggtggtggcaggtgcctgtaatcccagctacttgggaggctgaggcaggagaatcgcttgaacccgggtggaggttgcaatgagctgagatggcgccaccgcactccagcctggcaacaaagcgagactccatctcaaaaaaaaaaaatagagtatggagagagaaatagagaaattttacagggaagaaacctggcagacagcaccttaactaggtgatcatggttaacatcaccagagataagtcatgttgttatcatgtactcttctgtgatatgatcagaagggcatttcac

SEQ ID NO: 49408 - DNA, 1050 bp, Homo sapiens
acagtcgaattgttaactgtaatcatgaaagaaaagcacagagcgttctgagagcccatagcaggtagctcaagcctgaaggccactctgaccaggccaagtcaaacctgaaactggaggctgtggttttgtagtcacctctgtcttccctgaggggaagctgaggctcagagaggtggaaccatgggtgaacctttagctgtgccctgtgccttgctcctgatcacagggacttggatgccacagtggcttcaggtctgccctggggccagcattgtgattccacagtttgtagaggccccaaccctctccccaggaagtactctgcctagtcagggagagtggtgcatctgttttaaaaaaaaaagtcccatcagaggattggtgcttaacatttctggagagataaagacaaagtgacagtggaactccttcctgtgtttccagatagcctcaaaaccagggaattctcttttttttttttttgagacaggatctggctctgtcgcccaggctggagtgcagcaatctgggctcactgcaacctctgtctccagcgctcaagccatcagcctccagagtagctgggaccacaggcgcatgccaccacacccactaatttttgcctttttatttttattttttttggtagagacagggtttcgtcatgtttgccaggctggtcttgaactcctgagctcaagcagtcctcacgcctcagcctcccaaagtgctgggattacaggcgtgagccaccacgcccagcccaaaaccagggaattctcttgaactccttcccctcccctgcatcctgttggccaccaggtcctgtcacttccatcacagaaacgccaccttccctccctcgccattcccgctgctcatgccaatcgtcacgctctcacccactcactgtggagccctctctggtatgctggcctcttgtcctctttctcccacgccctcacctggaacattcctcaaaaccacctctgactacccacgcctctcctcctctgcttaaccagccccagctcagcttaagcataa

SEQ ID NO: 49409 - DNA, 1049 bp, Homo sapiens
ctctcccacaccagtttcggaaagtccattgttccctccgataacaatccctccccagcaaggcttaacaaaatgaaacttctgggcatcccaggtcaaacctccctgcttctgtgcagggactgtccctgccgagtaaatggcaccccacccccagcccatttccctccccgagcccctgctggatggtccatgcagaccgacctgcccctcttcatgctgcatctgcccctgtgctattaggccatgagggcagagaccatgttctggccatgtgcagcagggcctggcccaggagtggtgcttagtacctgagtctggaacagagatggagtgtggtagaagctgggtctccagatgctggaacattcaaggaaaatttctcaagcgtagcaggatccaacccagtcctagagctaagaggaggggtgcgggtctggctactgacttctagggctgaaacactgaaaggtttctgaatagaggagcaagtttcagggagaggaacctaataaagggattgaatacctgaggcggggaacagtcctgggagttggtggccttaagaaggcagaggaaggagaggagggagttgttgtaccaaatgggggagttgtttattcctgagctgagtgggttggcacagaggacaaatgagagtctggaaagggaagatgcacagtactgagaacaacatcagaaggttcagaaggcacctgccaccattgcctaggggctttccttcctggggcactgcggggtccctgggagatctcttcatccaagtttggagggtgcagtgggaaatccctgctccctctgacggcctggcctgtgcctcacagtgtggcgtccagaacttcaaacgccgagagaagtgcttcaaatgtggcgtgcccaagtcaggtgaggcccacctacctctcgtgctctccagggcggagcggttggggagaagggaagggtgaggggtctgtgctcagggcttggtatagggaggagggtgaccagtcgtggagccttccccttatcaccagcctgtctcccac

SEQ ID NO: 49410 - DNA, 1016 bp, Homo sapiens
gctctgctgggaaaggtggtcaggagccgtagcccagaggccagatgaagccttctgcagtggttcggactagggatagtggctggcccgtgtttgaggatgcagggcagtgggtcagcagatagagttagtagccccagggtcatgagggttctgggaacctcacctccaccctcacccccagattgccaaggacatggaacgctgggcccgcagtctcaacaaacaaaaagaaaacttcaaaaatagcttccagcctatcagctccctgcgagatgacgagaggcgggagtcagccactgcagatgctggctatgccatcctcgagaagaaggtgtgttggggccacccccctgcaccctgccccacaatcttgtccttcctttgggccctctgtggagtccctgaatttctgtgtccctccaccccagggagcactagccgagagacagcacaccagcatggatctcccgaaattggccagtgacgaccgcccagtgagtgcccaaggcagagaggggcgggggctctgatctggccaggcctgaccgcccaccctcaccctctacagagccctccgcgaggactggtggcagcctacagcggggagagtgacagtgaggaggagcaggagcgtgggggccctgagcgggaggagaagctcaccgactggcagaagctggcctgtctgctctgccgacgccagttccccagcaaagaggcgctcatccggcaccagcagctctcagggctccacaaggtaacagcggatggttggcagggcatgctggggcctggcccactgaggctcatcctcttcacttctcatcctgtccctcttgcagcaaaaccttgagattcaccggcgagcccacttgtcagaaaacgagctagaagcactagagaagaatgacatggaggtgaggtgtgacctgaccctgggctccctcccctgtgtcccttccaagtccccatcacctcaggcagctggagttcaatttctcacgtgttaaccc

SEQ ID NO: 49411 - DNA, 1663 bp, Homo sapiens
agtcctttccctcccaggacttctaacatctcctttcccatttgtctcagagcctccttgctcttagacacccacttcctgattctcctctcacgttcccatggacttctcagttaacccctcccagaaagcttgacatgctccagccccccttctctatgccctagcttctccatcctgctaacctgcctcctctcacacctccaagactcctccctcaaaccctctggtttgggaatagagaatgcttacgcttgaaaatcttcagtttggagactcaggtatgtttagaaactaagccacagctcagctttgccaaacagttcacagtgtgtatgttatggtgggggcctgagcaaatgttgaggtaggaagggtgtagattgtttttctgctgggggtgggggatctttagctcctctgcagagtttctgtcccagactcctgcttgccttgagacagggctgttccaaacctttgcagtcaaaatccacttgaacaatcatctgaaacttcttagactcttgctgcctgcactggggatccagaggtgaaatgtccagatattaaagtgctctctggccctggatcatctctaatttatggagtgaggaaatggcatgtcccaaacaaactgaccaatgacaaggcaaggagataactaagtaatagaggccactacacgtgcccagggaggaactcacatcctcaggtcagtgagttctgaccacagaccttggcttctttaaccctgccagcagccccttgaagacagtttcatttgtcccagcttttggagaaaatgaggctcagaggaaatgagatctctaccccaggtcagtcagagagtcagtaaatggaaaatatggttcacctttgtctctactaactcaccaagcctcttgctacccaggttggctcttagcattctaagcaattcacctggctatctcaggggctccagccagcctgctgcctcccctcatctcccattccttagccctgtggactgggccctgagcccaggggcatttggcaaacagtcccccaccagctgcatgcctctgggcgagtgaatggggttctctaagcctttcttttcccatttgtgatttgggcatagggttatctgggtcatggggattgttaagattagacaaagccctttcctctttgattgacacacagtatgctcttggtagatagtagggagctcttgtcattgtggttggtgctagtgacaagtgccaagatggaatcttaggtacattgggatacttagtgtcataaaagtctcagtgtgggaggacttgtgtgaacagaagactcagtgcctagaggagcacttggggtgaggggaagtgacgctgggtcctcccatctccagcatgtggacccagtcacccccaccaccagatttcacttccacagcaggctttattgttctgtctctgggacctagcaggtgaccctgggcaagttacttctcatttgtccggcaaggacactaaactctgccttgctgggtcagggtcatggaggggatgaaacgtgataacacgaggaagcagcctgggcttcagagtcagcagatcctggtctggtcccagctcagtgtgtgggaaccttggtcaccgaacgtccctgagtgaatttttttcca

SEQ ID NO: 49412 - DNA, 1916 bp, Homo sapiens
ttatttatcatctcgataaccccgtggggaaggtaagtggtattatcacccctgtttcacaggtgagaaaactgaggcctgtggcggttaattattactgttagtgcgtggcaggctcaagatttgaaaccaggtctgtcctgaatccacatccttcccctgacctcgacacaagtacattcttgtcattcctttcactccaggattggagtctctccctcattatgctgggctgggaagaagcaaatggcttagtggtcagcagtgtggatttgcaaatcagaccacctgggttcagatcttaggtctgacagctgtgttaccctgggcaagtcctcacctttctgtgcctgtcccctctttgctgtaaaatgggggtactaatacttaagtcttcccttcccccacagttgctactaacaaacagaaaaacggtacccatgtgctccagggtcacctctgacctttttttcctccagatgtccagctcgccgctgtccaagaaacgtcgcgtgtccgggcctgatccaaagccgggttctaactgctcccctgcccagtccgtgttgtccgaagtgccctcggtgccaaccaacgtgagtgtcctctccgtggagactggcagacgaggtggtgggtgggaaagtcttttgtatcactgtctgtctatccatgctccactcctgtgtgtctccctaaacttgttcttttcctctattcctagggaatggccaagaacggcagtgaagcagacatagacgagggcctttactcccggcagctgtaagtggggccaaggccgggctgaggggtgtggaatgggacattgagaggataaggttgggtggggcaggccctgacctagagtaccccctaacctggcaggtatgtgttgggccatgaggcaatgaagcggctccagacatccagtgtcctggtatcaggcctgcggggcctgggcgtggagatcgctaagaacatcatccttggtggggtcaaggctgttaccctacatgaccagggcactgcccagtgggctgatctttcctcccaggtacctcttcctagcacccttccccctttcccccttcccgaggcaccactgttcccggtgccacagccatttcatctttttccctactgcacacccttacagttctacctgcgggaggaggacatcggtaaaaaccgggccgaggtatcacagccccgcctcgctgagctcaacagctatgtgcctgtcactgcctacactggacccctcgttgaggacttccttagtggtttccaggtatcttgggggtactacccagccttctgcccagttttctcagagcccatctctggtttattcagtagtgttcaatattgatttaatgggtcggcctgaatgtcaggttttgtgctgggggactagagtatgcaggcagcagttagcccctggccctgccttttcttttcttctttttttttttttgagacggagtcttgctctgtcgcccaagctagagtgcagtggcgcgatctcggctcactgcaagctacacctcctgggttcacgccattctcctgcctcagcctcccgagtagctgggactacaggcgcctgccaccacgcccggctaatttttttttgtatttttagtagagacggggtttcactgtgttagccagggtggtctcgatctcctgaccttgtgatccgcccgcctccgcctcccaaagtgctgggattacaggtgtgagccaccgcacccggcctggccccgccttttcaagtggggaagatgtgtacagacagtacagcatagtggttgtgggcacagactgtagagccatactgccttgctgcaggcctccagccttggtagtgtgacttcaagcaggttgtttcatctcctgtacctttgttttcc

SEQ ID NO: 49413 - DNA, 1057 bp, Homo sapiens
ccatttcgagagtcagctgtgtgaagtctggaatatgctaataagcatcagaaccttgtgaagattgtgcccttgtgtccgcggaggaccagagtatgttgaggttccagggggtgctactcgggggtagggctgcggaggggatctagtgtgtaataagggggatcagggctttcatgaagggatctaagtgtgaaccaacaaggattatatctgtggagatatctctgagcagagagcaatagaggacaggaatgtgtgatgatctcggtgtgctaaagtggattacagctagggagggctgaagtgtgtgctaatgggagtcagggctgaatgagacctgtgtgcactaatgagggtcaggccatggtagaacagtgtgtttgtgtgtccctgcggaatagggctgagtaagggttcagggtgcactaatggggaggcaggactgtgtgaggcccggcgtgtgctaatagaaatcaggcctgagtgaagactcagtttgtgctgacagaggggacaggacagtggaaggactggaatgtgtgttaaggatggtcgtagctgtgaaggggcctgagtgtgggtaacactggttagagatctatctgtaaggttcactttatgttaatagcattcagagcagcatgaagaaggtccagtgagtgctaatgtgggtcagctatagagtaccccaagtgcatgttaatagaggtcagaatcatgtagggggaacagtacgttaatgaggggagtcagtactatggagaaggtaacaagcagctaggccagggaggggcccaagaatgtggtggcaagagttacttagaggaggctaagtgtgtgctgacagagttcagggcggtatgttatgtgttagggctttgaatgctgatgggtatatgagataatagcaggtaagatgtagtgaggcctccttgagggtctagcgtgtattaatggggatcaggacatagggtgcgatgaccaagtccttagtggttggtgtgttgagtatccttgagtatgagagtagtctgaggatgggtgtatgtctttg

SEQ ID NO: 49414 - DNA, 1026 bp, Homo sapiens
cctctccctgccaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggtgcttgaccccgtctggatggtggaggaactggaaaagggggttggacctggggaggtggagctcatgatcctgtttctctcttgccttacctgctaggacatcaacaagcgcctatcactaccagctgacatccggctgcctgagggctacctggagaagctgaccctcaatagccccatctttgacaagcccctcagccgccgcctccgtcgtgtcagcctagtaagcaccttctgttcccgtcctctcctttttcttctctcccagacccttctcctgagccagctttaacctgcctcatttgtcccacagtctgagattggctttgggaaactggagacctacattaagctggacaaactgggcgaggtgagaggcaaataggaggcccatggtggggatgaaggtcagtgggaactcctggaatctcatagcacctctcctgtcacacttcctcacattccagggtacctatgccaccgtctacaaaggcaaaagcaagctcacagacaaccttgtggcactcaaggagatcagactggaacatgaagagggggcaccctgcaccgccatccgggaaggtacacacccccatcccatctgccccaggcttccccaacccacccctggcgcacacactccataatgagaacaaagactggttctaagaccccccaaaacactctggctttcatgggaatgcctgtcacccacatatccaggtaataatcagggtaaccaggaatctgttcccatttggataaaaggtagatgaattgcaaaccagggtttggttctgagaacacccctgaaagtgctcaccagtttatttactgtaacaatttctagtcagaatatcacatggaatgaat

SEQ ID NO: 49415 - DNA, 1031 bp, Homo sapiens
agtccctcacccttgtctttgagtacctggtaaggttgagtggcagtaggtcccagggggaggtgaggagaaggccaggagccataggaagtaaccctcattcctgtaccacctcttctttcctcaggacaaggacctgaagcagtacctggatgactgtgggaacatcatcaacatgcacaacgtgaaagtgggtgtggggcaggaagcaggggcacaagggggcccccactcacccactccaacccacaaatctcccagaaacggacttttccctttggctttttttgctaggagcccttggagggcactgggaccctgtcctcttttgtgtgacaaggctctgggcctagtgtctgtgtttgggaggggagcagtgcctgctgggggtcgggctagtggatagtctttgacctctgcctgccattcctgggtccccagctgttcctgttccagctgctccgtggcctggcctactgccaccggcagaaggtgctacaccgagacctcaagccccagaacctgctcatcaacgagaggggagagctcaagctggctgactttggtaccactggcctcccctttcttattggctccccagcctcctactttcccatgaccacttagtctcacttcccttcagccttgccagattttgcctaggacaccctcagtctcaactgcactctccccgagactttgcccatgactccctcattctagctgtcctttctctgatttccaggcctggcccgagccaagtcaatcccaacaaagacatactccaatgaggtggtgacactgtggtaccggccccctgacatcctgcttgggtccacggactactccactcagattgacatgtggtaaggacaggtggaagtgtggcaggggccatgtggtaaagggggtggcttggtcacaacagccacccagccagctgcctttctattcactgtgccctccctgcccaggggtgtgggctgcatcttctatgagatggccacaggccgtcccctctttccgggctc

SEQ ID NO: 49416 - DNA, 1057 bp, Homo sapiens
atgggaagatgaggcaaaggcccagtatggccatctgactaggaaaccatgaagaggagggaatgttcaggacggtagggggtagattttggaccactgagtaggtagagaaatcctttaatacatggatcaaattaagcagtggggccatagatggacctggaaatttcaattattagtgtccaggaagtaacagaaaccatgggcatgggtgagagagtttgcaagaggccagggatcaatgacacaacctggggtttgccctcagatatgaggataattgaaacttattttctttgtcctgtgagttccagccccagtcccaccatcttgggcaaagccaaggattgttttctaagcagaagagggggtgagcagggccaggcaaatactgcaagtaatggcaaccctaattaagtggctgtttactaaagcccagtggtgggggcccatgaacttctaatcactctactgtgtgtgtttgttttttgagacagagtctctgtcgcccaggctggaatgtggcggcacaatcttggctcactgcaacctttgcctcctgggttcaagcgattttcctgcctcagcctcctgagtagctgggattacaggcgtgcacaaccacgcccacctaattttttatttttagtaaagatggggtttcaccatattgaccaggttagtctcgaactcctgacctcaagtgatccacccacctcggcttcccaaagtgctgtgattacaggtgtgagccaccaagcccagcctctaccgtgtctttctaagcactttagtgatgtttcagcttgcagcctcatggtgccatgatgactgccatgtccccagagatggaaaagcaagcagggaagacagaacaccttccttacctgtctgtgttcttttaacggctggaacttccacaagctcctcagcagacttcctgtgccatttcttggctagaatcagatgacatggccacttctggcagcaagggaggatgggaaaaggagggccttgcaaagggggacaggattgccaggctggatttaaaaggtct

SEQ ID NO: 49417 - DNA, 1030 bp, Homo sapiens
tgtgttgtacataggggttttggcaaatagatcatgacatatatccaccagtgcagcttcatacagtttcattccgtttcacctgtgcttcagcgattcatcctgcctttccctctgcccgaacctctatcaaccactcattttttactgtctttgtagttttgccttttttttttttttgacactgtgcctcactctgttgcccaggcaggagtgccatggtgtgatcactgctcactgcagcctctacctcccaggctcaggtgatcctcccatctcagcctcctgggtagttaggaccacaggcacatgccaccatgtctggctaattttcagtattttttatagagacacggttttaccatgttgcccagtgtggtcttgaactcttgggctcaagcaatttgcccacctcagcctcccaaagtgctgggatttacagatgtgagctattatgccaggtctagttttgccttttctaaaatgtcatgtagttggaatcatgcagtatgtagtcttttcaaactggcttctttcacttagcaatttgtatttaaggttcctccatgtttttttgtggtttgatagttccatgaattggaagtaccacagtttgcttattccttcacctaccgaagggcactttcattgtttgtaggttttagcaatgatgaaaaaagctactatgaacattcatgtgcggatttttgtgtgaacatgttttgaactcaattggctaaataactaggagcataattgctatgtcatataagctttataaactttataagaaactgcccaggcagggcgtaatggctcacacctataatcccagcactttgggaggctgaggcaggtggatcacctgaagtcaggagttcgagaccagcctggccaacatggtgaaatcccgtctctactataaatacaaaaaattagctgggtgtggtggcaggtatctgtaatcccagctacttgagaggctgaggcaggagaatggcttgaacctgagaggcagaggttgaagtga

SEQ ID NO: 49418 - DNA, 1030 bp, Homo sapiens
cacgaaggagttgttatagatgttcaagagtcatatattctatttcttaataattatctcctagagatgcaatcgttgacatttctgggctgtgaatcactggcccagtacacacgctataaatcacctccatagaacaccctgttttctgacttccaaaggctcctaatcactgcttcacacgctcagcaacactgaccccaggatctggtgttgattaacaaacactgatccataatcacttccatctactgtccccccaaaactcacttacttcatccccaaaccccttaattacaaacacttaatcactaagaagcatagatttcataagactaaggccccacccagaccacatggaacaaaagctaccccacaggcaccagtcatatggcctctaaccactgacccctagagcacccatatcccagaagcccaccagtcactatcttgtagcttggaagttgtcactcccatcctcacaagaaaaagagctgaacaaacggaaacaaaacaactcttcccagatttgtcagagaattgagggcacagggcaaactgatgccctgaaaaagtggaaagacagcaatacagagaatcacagcttatcaggagcaggcatgagtaggaaaaggtaaaccaacagatcaactattggagtctgagctgctctcaactactggacatgaagttcctctgtcccctcatccctgccaaaacatggcatgatccagctctccaatttatggcaggtgtaatggggcaggtgtaaataagttgattacatcatgtttccttttatttatttatttttttgagacggagtcttgctctgttgcccaggctgcagtgcagtggcgcaatctcggctcactgcaacctccacctccctggttcaagggattcttctgcctcagcctcccaagtagctgggattacaggcacccaccaccatgcccggctaatttttatatttttagtagagacagggtttcaccatgttggccaggctggtctcgaactcctgacc

SEQ ID NO: 49419 - DNA, 1050 bp, Homo sapiens
caaaatgtgggtcttctcatttgcctgctgcgaactgggtctgtgtgtgggccaccattcttgttactgcattgccaggaaggcttccatctttccttcccctctgcttgggctacaatggtaatgttctgtttatagtgttggttcttgttattcattaattctaataccttgatttaaacaatattatcatcatcaccataatctaatcattgcttaattattataattgctgtaatatgtaatcaatacagtattcatctagtcacgctaagaaagccaggtgtctcctttttgctgctatagttactatgtagcatagtactgtatacctatatactacaggtagtactggatagcgtctaccaaccctggggatgttggcattggcttttcctctgtgtcagatgggcacaattatgttacagagaataaggtagctaatgcaatgatcagttttacagttgaggaacatgaggcccagagaggttaaatgtctttcccaaggttgtaccttgagtacctggtgaggcctagatttgaacatgagtccagactccaagctctttacctctaagcttctcatgctgctgaacaggctctaatcatcatatatcaccaatgttttaatcctgcatctatccatattatattgatacatcagtgaggaaggttggcattctgctttctcatctgtgagatggtcacagacccaggtaatggtcagagtcagaggggtgggggatgttaatgattagaaatgctgctgtaggcagggagggggaggggcagcaattcctccctcctgcttttgttgggagactcggatggggaagctccacatatgagcccacagcacagaatcatagcccagtaaacacatctcacaaattcatggaatctggcaatgctttggtcctgagtgccccaaaagacagggtgaaaataaatgaccgaggaaggtaaagaacagtgccactcctgatgctcggtaagtgacagttgctatttttcctccccacctctgacactgccctccctgcctgcagg

SEQ ID NO: 49420 - DNA, 1042 bp, Homo sapiens
gatgctgggtccccagaggtggagcccagtcttagagaggcaaagcctgggaatttggctgacccaggggctgtgggccaggaccatgggcaggcgggatctgagggcagcagtggagggccgtggggccactcatcctccctctctccatagctgtccactgccaaggagatcatccagcactttaagggctgccctgcggacctagtggtgtgtgacggggctcctgatggtaaatagcaacagaaagtgggaggccaggcggggccccctgtgtgtgtccttctctgtatctcccaccttggttgacttattcacctcttcagttactccctgcctctcccttccgcactcagctttctcccacatctggcaacttctccctacctctgctgcctgttctctctctgcctctctcttcctcccacttgcaccccaccctttgagtttcatgtctgttgtctacctttccctgctctcatctctctgcaactgtccaattccgttgcactgttcattcattttcagccagccagccattcaacacacatttactgagcacctattgtgttgggaaaacattcatgaataaaattccattaatctttaacctcatggagctgatgttctagtgggagcaaatgggaaagaaaataaatgattcagctctgtaccattaaaaggggatggggccaggcatggtggcttccacctgtaatcccagtgctttgggaggatgaggtgagaggaacacttgaggcaggagtttgagaccagccttgcaacatagcaagaccctgtcttaaaatattagctggcatggtgatgcatgcccatagtcccagttactcaggaggctgaggtgggaggatcacttgagcccaagaggtcgaggttacagtacactttgatcgcaccactgcactccagcctgggcaacagagtgagaccctctctctaaaaaaacggggtgaggaggccgggcacagtggctcacgcctgtaatcccagcactttgggaggctgaggtggtcagatcacc

SEQ ID NO: 49421 - DNA, 1067 bp, Homo sapiens
cgccacgcgcgggggcggggctagaggtacaaagagagtgtctattggttgggagcggcacgggccgccttcttcgcttcaccattggctcgctccgtaaggcaagagaacccactaggggatgagcccgaactagggatgtgacagagcgcgagacccagcctaaagagagcccggagccagcgtgggaggccgctgccgtcgcgcgccttggtgagtgccctccacccggcccctgctccctcccccagctctccccggctacgcggccagccctcggcgtgccagcgcgagaccctttgccacccgccccccccaccgcccttttgcgcctgcgcgagacccccagctaccgcacggttgtccagaggacagaagatccgtcttctcattgggcagcgggactggagggttctggttcggattgaccggctttgtgttccgttctagcgctgcacgccagacaccggcctttcaatatccgtctcttccctgcaggttgacggcgttgcacgctctcgcggggaggctctggctttccaaacgctggcaccgagggttgtagttctgattcgttttctttcctctgtcccccagttgcagttttcaggactacgtgggggagggaatagctttttgttgaacggtttaagacgctgacctgtgcaactggaccacgcctggttcctgtgtctcttaccaaaccgtgaccccggagcacaggactgggtttggtggtcgtgagcagtttgtgacccttgaaggaagacaccaggcctggtcctgtatctccctcgccagactgtgaccagggagggctgggatcaggtgttgttcccatgtgcctcccaccagactttgacccccgagggctgagaccgggactgtttctaccacatcataatatggcttctaaagggctggaacaagctttcagcctttctgtggccttgtgtttcagtcatgttctttttcttttcttttttattttattttgagacagagtctcgctctgttgcccaggctggagtgcagtggcatgaccccggctcactgcagcctctgcc

SEQ ID NO: 49422 - DNA, 1034 bp, Homo sapiens
gaggctgaggcgggcggatcgtgaggtcaggagatcaagaccatcctggctaacacggtgaaaccccgtctctactaaaaatacaaaaaattagctgggcgtggtggcaggcacctgtagtcccagctactcgggaggctgaggcaggagaatcgtttgaacccggaaggcagaggttgcagtgagccgaggtcgcaccactccactccagcctgggtgacagagcaagactccgtctgaaaaaaaaaaaaaaaaacggaatgtaattagaagtgttacaatcctgtctgttaactggtaaattcggtccatttacatttctcatgataataaactatttgaatttgattttattatctcattctgtactttctatttgtccaggtttttctgttccttttttttttttttttttaacttcctgcctatacacacgcagccatcagcccacaaagacatgactaccaacgcgggccccttgcacccatactggcctcagcacctaagactggacaactttgtacctaatgaccgccccacctggcatatactggctggcctcttctctgtcacaggggtcttagtcgtgaccacatggctgttgtcaggtcgtgctgcggttgtcccattggggacttggcggcgactgtccctgtgctggtttgcagtgtgtgggttcattcacctggtgatcgagggctggttcgttctctactacgaagacctgcttggagaccaagccttcttatctcaactctgtgagtcctgatttctttcatatgctgtgggatgggatttgctgggcagggatcggcttgcatgtttacctatccacctattcttcttccattgatttattttaaatttttatttaatcttttaaaaaatttattataggccgggcacagtggctcacgcttgtaatcccagcactttgggaggccgaggcaggtggatcacttgaggtcaggaatttgagaccagcctggtcaacatggcaaaaccccatctctactaaaaatacaaaaattagc

SEQ ID NO: 49423 - DNA, 1047 bp, Homo sapiens
tcacctacattctctctctctcattggctacttcactcactccatcatctacacctgcttccttttataccacacacacttcttgagtaccaatcacagccacactgttttgtgtcaggctttacacatattaccttgttttagagaaataaaccactagaatccaaacagttaccccatttcacggatgaggaagcagacgcatgggaaggttatgaagtctgtcttcttgcagggacccccagctctcacaagtgtgtgttcctttcactgcctttattcttcatatctctctcttcttttcttcagggaaagagtatgccaagggagacagccgatacatcctgtaagtgtttgcctctgtcaatggagactggcattggttttcggggggtggtgagttggggagcactaatgggctaacctgtaggaagagcacaccgataccagtgtcccctcatgctttctcctgcaggggtgacaacttcacagtgtgcatggaaaccatcacagcttgcctgtggggaccactcagcctgtgggtggtgatcgcctttctccgccagcatcccctccgcttcattctacagcttgtggtctctgtgggtaaggaaagggcactagaggggcactgggcactagaggggttgatgggggatccacagacacagatgtatccctgtgggtgggatctctcaacggtgcccttccaggggtaagtcagactgaatgacaaaccccctgaggctctggaaaggtcatgcccttctctgagcctgcactctcaggtggggagggttcatttttcttcctcctcctccttctccatcacaaagtctcctgtgaaggttacatgaggtggcccagggtggcaagaagcccctggaacctccaggatcagggctctgagatcccttcatgtaagattctgtcatattttttttaaaacagggtctggctctgtcacccaggccagagtgctatggtgtgatctcggctcactgcaacctccacctcccagactcaagcgatcttcctgcctcagtc

SEQ ID NO: 49424 - DNA, 1043 bp, Homo sapiens
ctacaggcatgtgccaccgtgcctggctaacttttgtatttttagtagagatggggtttcgccatgttgcccaggctggtctcaagctcctgagctcaaacagtcctcctggcttggcctcccgaagtactgggattacaggtgtgagccactgtgcccggcctcagtcatcttgtgttattaaattgttagctttctttagttctagcgatatgagttatctttagtcccagaatcctaagctgtcttggatttgaggattttgaacttccttaaatctgaaggtgtgagctctcctgagttctgaaattctcagctctctggtgtctggaatctcacttttctgatttctcagattttcagctctgtgatttcagaatacttagctctgagaccttgaatgatgacttggaaagtgctttggaatagagaattggcgaaagtgtccccttcctcactggggcttctccttcccctcctgccacccacaggccagatctatggggatgtgctctacttcctgacagagcaccgcgacggattccagcacggagagctgggccaccctctctacttctggttttactttgtcttcatgaatgccctgtggctggtgctgcctggagtccttgtgcttgatgctgtgaagcacctcactcatgcccagagcacgctggatgccaaggccacaaaagccaagagcaagaagaactgaggagtggtggaccaggctcgaacactggccgaggaggagctctctgcctgccagaagagtctagtcctgctcccacagtttggagggacaaagctaattgatctgtcacactcaggctcatgggcaggcacaagaaggggaataaaggggctgtgtgaaggcactgctgggagccattagaacacagatacaagagaagccaggaggtctatgatggtgacgatttttaaaatcaggaaataaaagatcttgactctaacactgagagatccttaattactaaccccagagatgcgctatgactgaccccacagatcccaccatcatt

SEQ ID NO: 49425 - DNA, 1066 bp, Homo sapiens
ttggatgtttcttcagggaaatgtgtgcatattcacactacgtgggttatataaagactatatatagtctcctgtcagttcagatcaggttttgctactaggtgagtttgtgtttgtagacattctttgcctgttttttgtttgtttgtttgtttgtttttttgagacactctgttgccaggctggagtgcagtggcacaattccggctcactgcaacctctgcctcccaggttcaagcgattctcctgcctcagcctcttgagtagctgagattacaggcacgcgccaccacgcccagctaatttttgtatttttagtagagacggggtttcaccatgttggccaggacggtctcgatctcttgaccttgtgatccgcccgccttgcttctcaaagtgctgggattacaggtgtgagccactgcgcccggccttttttttcctttttttgagagggagtctcacattgttgcccaggctggagtgcagtggcgcgatctcagctcactgtaacccctgcctcccaggttcaagcgattctccttacctcagcctcccaagcagctgggattacaggcacctgccaccacacctggctaatttttttttgtattttttagtagagatggggtttcaccatgttggccaggctggtctcaaccttgtgatccgcccacctcagcctcccaaagtgctgggattacagacgtgagccaccgcgcctggcctctgcctgttttattagtgggattgagggggtggtttttttaatcagtataaaatgtctctttgtgttaaatgcttttggccttgagtgatgctttttctgacattctcatggctactatttttttctgtttgtgtttaccagatatacctttaggattctttaatttttaacctttttgtgtcacctagttttaggtatgtctctcatacctctcgtaaaaacgtcatagcagaatttatgctttttaaggcaactgacagtgaaatcttttttttttctttttgacacgtagtctcgctctgtcgcccagactggagtgcagtggcacgatctcag

SEQ ID NO: 49426 - DNA, 1019 bp, Homo sapiens
gagacggggtttcaccatgttggccaggctggtcttgaactcctggcctcaagtgatccacctgcctcggcctccctaagtgctgggattacaggcgtgagccaccgcgcccggccctacaccactttttaaaagtcgtgtttcttctcttttttataatgttgtacttctgatttctagggaatgattagcaaactcacccctgacgctatgtcccttggacattatccttgtatacacaaaaagtgcaattaacgagtgggtagaagtcaaggggtggagcctccgtccttgggcttgaagccaatgtccctcaatgcgcctgcgagactcccacgccctgggaaggatgcctatcgattcgctctgggctcggcagttctttctgatagcaggcagccatcttgcctggagcctgagaaagggaggagagacagaaggaaccggcgacagtggtctcagggccgctccggggggcctcaagaaccggaggcagccccggaggtggtccccgatcccgggctatgctcttggatctgagaagggaaggcggagggcggcggggacaagatgggtggagaatgtcaagcaaggaatgctaggcgggggaggggcgttgctatggcgactggggaggggcggtgtctgttctgaatcgctgtgtgtcacccgggcgctgcccaggaagggcagggctggggtgatgaccatggtaacacccgggggggagttcgtgacatctccggcgcggagggactcgatgtctatggcaatggtcgcctggtggaagggacggaactagatcccttcgctcgggacgctcacattccaggcccttgtcctgcaggctgccgcgggcggacacgccagaggaggaggccggggaatggccgcggtgtggcagcaagtcttagcagtggacgcgaggtgaggcgtggggtcaaagcccatgggagcagaacttactgtggtgcatgcgcaatggcgataagtgaggctgggcggagaacttgccttat

SEQ ID NO: 49427 - DNA, 1021 bp, Homo sapiens
gcccgagaggggtctctggagaagggaggggaaggaagaagtgtggcgggggagtactggagctacctggagggccgccacttggacagaggacaggctgctaagccaggaagcagaatcaaagtaaacagcagtccccatgtgtctcctgtgtgctgtgcactgttcttggctgaggtacagtgggacccctacccagggaagggcctggtcagctacgcttggggattggcaggaggctgccgttgctggcctcagggaagaggggccatggggccggagatttgttggcgtggattgggaggcaaggacaggctggggctaggatggcagcaaagcttcccatttcctaggacaggtagggaaccagctggggaggaggcacccactgccgtctgaagcaccagttggcactgcgcagccctgggccgagggagagcttctctcactgtgctctcccttcatctttcctcctcctctgctgctgtctctgaagtgtgtggcctcagcctctttctggctctctgaacctgggcctccctctgcctctgcctccacctctcttgtcttgaggcccttgccccctttccccatggcctgggtctcttcttcccctctctccacgccctccctgctgggtcctgcatgggctcaggctcccttgcctggatcagtaagtatctctccctgtggcaccctgggtcactttctttcttgcccttgctttggtctctcctgatcaccttcctgctccgtcccaaggcactggaggctccaggggttcttgggcagctcttgctgggtggcggcaggaggtgctcgcgtggccccagttgggccctgcagccaggccagcctgcactcaccgccagggactcctcctgctagccagaggcctgaggcgggccaggcagttgccagctgaggcccagctcctcaggaagggccgacagactctctgcgtcactgcccatgtgtgtccacgggcaggggtgcctcctgctccctgtccttcagaagt

SEQ ID NO: 49428 - DNA, 1023 bp, Homo sapiens
cccatgatgagctattactgttatcatgatctgattgtgtgaatagatggtggatgtgtggacagagtgatcggggttcccccaggggcttccagatttagaggcctagtgctatgtggcttgaggaaagctagcttccagagcaggtatctgagctgaactttaagaggagaaaaagagtgagtcagatgaagagggtgactgagggaagggaagaacagacagctgaaccagtgtggccaaaggcctgaaagtaggatttggtgtggctactgcaggggagcagagaacattacctgaactgaggcgggctagggaagaaacagaatgtgtcttatatcctggctattccttcaggttgacagttgggggagccaagccctaatttgaccagggggttggtgtatggacagctcagttggggaagagacagggccctgaatctcatctcccatctgtgtctagcctagaatatattgatctgatggaaacaacccagtacatgaatgagggagaactccgtgtcctagcagacacctacgactcagtttatctgcatccggtatggatgagaactctgcgggcagggaatggtggcaatcttggggtccccatccctatgcccaccccaccctgggggaagcagctgagtggatagggctgttctctcccttactccctttctggctccccactgtctctccagaactcatactcctgtgcctgcctggcctcaggctctgtcctcaggctggtggatgcggtcctgggggctgagatccggaatggcatggccatcattaggtaggactctacagcatttgactttttacattgttttaaagtccttccttcaagtgtaaaatgtattgatatgggtaatatattcatgtgattcaagaatccaaaggtaaaaaagagaatataattaaaaatctgtctcccatccttgtcacccagacacctgcctcctctcatgggaggtagtcattggaaccactgactcatgtgtcctcccacaaa

SEQ ID NO: 49429 - DNA, 1041 bp, Homo sapiens
gggccccaagtctttcggatttaactctgcctcggccgttttattcagttaaggaaactgagtcactccatcccaaagccagattcccgcggttctaagctgaagctgtctcgggtgcatttgcattccaaaaaggcgaagggtcccgctattactgctcctggtacctggagctgccaagcacccctgcgatggggcgccccgggggctgtgcgccaggctgggagtatccttggggggcggggcgagggggcttccggggcggcagcacctggcccggctccggccccgcccgcgtcagctctgcgcggtgattcactccctccttcgccccggggcccccttcccggccagacggcgggcaagacagctgggtgtacagcgtcctcgaaaccacgagcaagtgagcagatcctccgaggcaccagggactccagcccatgccatggcggattctgagcgcctctcggctcctggctgctgggccgcctgcaccaacttctcgcgcactcgaaagggaatcctcctgtttgctgagattgtgagcgttctggggcaggcgcgtgggcaaaagcgggatggggtggctggaccatgcggaactggatggtccgggtgaggcaggcacttggccggggcgctcggcagtggggtgcaggtgggtgggttcacggtggaggcccgaaacccggggcgcagggcgagtcggtggggtttgacgaaggttgttgagatctggtggtccccggggtgaagcaaggagcctataacgcatacggagggctacgtggggacagcctgcgtgaactcatcagtggacgcatcgaaggggtcccagggtgctgggaagtgggggcctcctgtggcagggcgtggcgcggcctgggcacaggagggcgggctggcagcgcgcccaggggcagggcctgttggggtggggcccccccgccccgcgctagtcccgcggtgtagagcgccccgcccttcgccagttcttcctcgcccttcagaggccgggcgggatgtccttagcttttcggg

SEQ ID NO: 49430 - DNA, 1024 bp, Homo sapiens
tgagtcacttgtaaaaggggtgcggcgcctttaacggagtcctgcctctctggtgtcactctcaccgcttcccaaaggggttgctgggggaaccgcgtgttccgccccggtcaaggccacaaagctggcgtcagcggggctcacaaaacacctggcagcgccactcccctcaggctgcccgtaacctagaagggaaaagaggaaactgaggcacccaactctactccttacttgttgggtgaccctggccaagccattaaacctctctgtgcctcagttttctcgtctataaattagaaagagtaataatagtacccagagcattagattgtcgtgatgattgaatttggaacacagtgagcacataaaaagtgtttagctattattgtatgtcatttccccagccctcgtaggcatcttagtatgggacccccaatttaaaccaatcttctcagccctggttgctgattgaggtcccctttcccatgtcacccttccagatattatgcctggtgatcctgatctgcttcagtgcctccacaccaggctactcctccctgtcggtgattgagatgatccttgctgctattttctttgttgtctacatgtgtgacctgcacaccaagataccattcatcaactggccctggagtgtgagaaggggtccacaatggcaagaccagggaggggtctgggcagttaggattgtcggggaactgtggttgctgacttccctcttctcctccctacacctcacaggatttcttccgaaccctcatagcggcaatcctctacctgatcacctccattgttgtccttgttgagagaggaaaccactccaaaatcgtcgcaggggtaaaggccatgggagcagctctgaagcacagagcgaagggtttgaggagccagggaccatttctgcctttgcttctggcagaaatcgtgtgacccacagcaagtcacacttgtcctcagacatggaggaaagtctggcccaggacttggttttgcctcccaaggtctt

SEQ ID NO: 49431 - DNA, 1032 bp, Homo sapiens
ctcctactccaagatcttaggacttgaggatttccctagttcctggttttccaaatggaagtcacagtcaccaacatccaggatctgtctgaactgtaggcatcctccctgccccgaccctggtactagtgtttccaaaaggctgcagggctcagcctgatccctgttgcctgactattcctgtgatcaagctggtccccttcttcagggcagttcctccagatgtgcagaccttgcgcgccttcaccactgagctggttgtagaggctgtggtccgctgcctgcgtgtgatcaaccctgcggtgggctctggcctcagccctctgctgcctcttgccatgtctgcccggttccgcctggccatgagcctggctcaggcctgcatggtgagtggccctcctcctaatgcacacatcctctttcttcctcttttacaaagtaaccaagttcctttgcaacacttgcctttcctctgcaacacttgcctttcctctgcaacacttgcctttcctctgtcatttttcctgcggcttagttttcattagtggttaaggctgctgactgtactgccaaactgcctgagtagtttagatcctagccccaccacttggtaactgtgtgaccctaacccttctgggccccagttttcctatttgtgaaatggagatgataaatgtagtgcttttatgaggagcaaatgagtttatccagtttgcacctgggctgctcctggcttctatgttttaaatttagctgcaaaataccacccccaccccatagtatccatttcctagttccagaaaatactctgtctgggtcatatactcctaaactaatcactctgtgctctgattggcccagtctggatgacatggtcattccttttttttttttttttttgagatggagtctcactttgtcgcccaagctggagtgcagtggtgcgatcttggctcactgcaacctctgcctcccgggttcaagcaattctcctgcctcagcctcccgagtagctgggactacaggcgtgtg

SEQ ID NO: 49432 - DNA, 1050 bp, Homo sapiens
gggcccctggctttttcatagcactcatcagcccagcacgtgctaagctttgttagagaatgtcccatggcagagcagatgaacatcgccaccagtcgaggggtcatcggccaccctgcctagcagttctactatatttttttgatccactcgtttctcctctgaagtgactctttcaaatgttctttaccttcagactttctctcctgcttcaaaaaacaaaacagaagccataagaatggaactccctataacttgtggcccccaagtctgcacgctgatttccctcccctgtgttacagatgacgaggagtcccttcttgctcaggccacttctccctcctgtgctctgggtcccagtttctgctacttgctctagaatctgacatcatcagtcaccttttctctcctggcaggttttctgctgccctccttgcttgatcctctattcacctttgcctgtgccagcatcccttctgtctccgctgaccccacgttctctccctcctgcttctggccagcacctcatcaccctccccttcactgctgacccctgcagagttgcctgtacttgccttctgcacttgctcacccccgtaagtgttagcccccggcatctgccagattctgcaggtggttttttagttttcctcttgaagtggttgaccactcctacttaaaacactttgtcttcccttgccttgagaccacactctgctggttttcctcttaactctctggcccttctctttctcctggctcttcccttagcttcatgtatccaaactcggcatctccacttgactgatggcccaaataattcctcaaactcaccttgtcggggactgcattcatcacctctcccacagtgttcccaagcagcctctcactcccctacctccccacttgctcgttttgcttttcagcatccttaagtaagccctgcctgaccctgtagattgggccagggacccttattctagggcattctttccttttctaaaggcactgatcgcagtttgtagttatatctttattagggggttgctg

SEQ ID NO: 49433 - DNA, 1021 bp, Homo sapiens
ttacaaagataaaatgagagatgatgttcagtagtttgcctgaagtcattcattgtgtggggccttccactgagacagagtgctggagtgggagcaaagttgagatgatttgaatttgggtgcctatcagatatccacctagagatgttcatttccccatggcctggggtatagagagggtctgggctcgagtagagatttgggatccttcatgtatagatgatatatgaagcctaggatatgagtatactttgagagggaaaaggtgccaagggtagaattctgggggaaatccaggtactcagtttgagggatttccctcacctccttatatagcaacccaaacaaaaaggaaacaagttatccagcctcagaggaaaagctgtattattttgtctacttctgcttcagtcccttctctgtttattgtagatactacttattcaattatacctcttttcttctggtttcttcttctcttcctttccactggacccattcgctgtcgtccataaacatgttctggtcttcgtttgctgtatcttctagctaccagtacctatctagtcagccacttaatttttctgggcctcaatttcctcagagattgagggacgtgatgtagggaggaggttatgatttttaagaagcctctttctgacctaaattctgttctgccatcttatttctctaccttttcccgttttgggttgtgttgactgttcagttcctttttgaaacttccctcccttggccacagagttgtactcctctagttccctttctgcctgcctctgtcactgcttctccattacttttgtttcctcctgcctcctaattatgtccatattcaggggtgtaaagttctttaccttttttctctttatactcactgcctcagaaatttcatctacactcctggcttcaccttttttttttttttggtttttaattatagaagtaacacacaattacatgttcctattaaaaaataatatagatgcatctagagtaaaaagtg

SEQ ID NO: 49434 - DNA, 1049 bp, Homo sapiens
cctacccaccacctatccctgtgccaccaccattccacccaactagctgcattttctaggttatgccccttgtaggcagtgtcgacctcagcctcttgcctcgttttgtggactgactgttgcctctgtttctaaaacagtcaaagctctatggcccttagttgaaacctgtaccctttaagctccaaccagaaccctgaggatgggaatacacatatctgtagacacccaacaaagtatttgtgttttacagagttggcatgtttttttttttttaacagcttccgattagctgtttagtcaccccccagcccatgagtcccccatgaggtaccataagcatagccactgtaaaagtctctgataatttgactgcttttgaatactccttgtttattataatgactttcgtgtgctttccactgttcaatttatttttcagacattcatctagatttgactcagtatctttacattctgtctttacttttaatgatgtacttactgtgtactccaaagacagttcaacctagcaactattaaactgactttcaacatggcacgattctttctttttttaatatttaatgaaggaaagccctactgctctatttccccagaggtagaaatctcaatttatgttgtttgagctgggagaacttgttaattaaaactgtcgaactgtagtgaattttgctattttaatatatgtttcatcagttgatgggggcaggggttggaatagtaaagagtacacagatacttttgtgatttggttatgatgagactgatcttctaatggatcttcaaattgacaaattctgggaaagccaaaaaccaatcccaatctgtatagaactgtaccactattccaaaggtctgtcttaattctttgagcctgattctcttgccttcactctgctttaggaccagtctgctttaggacattagagctaatattagccttagactggagccatgccacttccagaagggttccacactgggttttgaatccaaacaggcctaatcttccaagattcttaaaa

SEQ ID NO: 49435 - DNA, 1049 bp, Homo sapiens
tatcggctttatatattgttggatttgctaaaattctgttaaaaatgtttacatgtatgtttattagtgatattggacttcagtttttttttctcaagacatctttgcctggttttggtatcagaataatattggtctcatagaatgggtggagaacaactctgtcactagaactagtattatttcttccttcaatgtttggtagaattctagtgaagccatctggacttggagttttatttaggggaatgtttttaactacaaattcaattttttaatagatgtagtatattcaagatatctacttcttcagtatactttggtaatttgtgtgtttcacataatttgtccatttcatctatgttttaaaatttgtgataaaattcttcatggtattttcttacatgtttaaaatttgtagaatctgtagagatgtcccctctcattcctgatagtgataacttgtgttgtctctcttttcagtctgttctgtctggttaggggttgataaattttatggatcttctcaaagaactagctaagcatttccttgatttttctttcatttttatgtttcctttttaaatgttttctatctcattgatttttatatctctgatctttttttttttttttttttttttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatca

SEQ ID NO: 49436 - DNA, 1029 bp, Homo sapiens
taagcactggtttcactgcatcccacaaattttgataagtggtttcttcattttcatttagttcaaaatgttttttaatttttctttagacttctttaacccatgtgatatttagaagagtgtttaatctccaagtatttgagttttcaagctttgtcttactgatttctagtctaattccattgtcctctgagagcatactttgcatgatttctgttcttttaaatttgttaaagtatgttttatggctcaaatgttttctgtcttagtgaatgttctgtgtgagcttgagaagaatatgtattctgctgttgttaaatgaagtgttttatagacatcaacttgatctagttgatggatgatgctgttcggtttacctgtgtctttactgatcttctgtctgctgtatctgtcaattactaatagaggggtggtgaagtctccaactataatagtacattcatctatttctccttgtatctctatcagtttttgcctcatatgttgacgctgttgttaggtgcttatttattagagattattatgtgtttttagagtattgacccctttatcattatgcagtacccctctttatcgctgataattttccctgctgtgaagtctgctctgtctgaaattaatatacctactccacatttgttttgactagtagtagcatgttatgtctatctctgtattcttgaagagatttctgaagatgtctgctgtaattctgtccttgctcctccataggtaaaaggtaaggtatttgttttaccccggcaactttgaagatttttttcctttgattttctgcagtttggatatgatatgcgtaggtatagatttttttgtattcatcctccttagtgttctgtgagcttcctgcctggacctgtggtttggtatctgtcattaatttggaacaattcttagtcattattactttatgtatttcttctatttctttctttctttctttctttctttttttttttgagacgaagtcttggcctgttgcccaggctg

SEQ ID NO: 49437 - DNA, 1070 bp, Homo sapiens
tgtaatgctaagtattgcagagaggctgaggacaaggaagatggctgagaaaagattatatgacctagcagttaggaacacagcaattaccttgaaaagccatctcagaaaaatattagaagctaaatctattcggtttgtgcaaaagtaattgcattacttttaatggcgaaaaccgcaattgcttttgcaccaacctaatagatttcaagggaaggcaaccactgtagaagttttggtagtcataggagagagaggaagggtaaaggcttgaaatgataacaaggacaagggacagcattttattcttcagggtaggggaaacctaatacaatttgtaaccagagaagaaagaactgactctggggaggaggagaggtagaaggagaagacaggattgagggtaccagtgttaggtgaaataagacatgtacacgtgagacaaccagagaataagccaaactgtataacatcatggtaattttccgaatccaggcagtaacagatagaaggcagagaagattgtggaccggagtggccaagagtaggtgtcaaacaatgtgttagatttgactagattcttcaagtatgtaagtaacctgtgttaacacttttagcacctaccaaaacatacacgacatggcttcccgcccgttggaatgtaggcataatatcctcaactttttaatgtatttcttgtcactaggtggtcagtgaatatttttctttcccttgtacacacagggtattttgtttttaagcattggagagcaacaatagaagcagtgtgtctgaatgctggaacagtctgggaattcaagggctgtgaattttgtgatggctttactatttccctaaagcatgattctgggccatttaatttctttatgccagagtttcttcatctggatgacagaaatgatgagaaggccagaatctaaattactataactgtcttaaccctatcagtctattagccacagtgcatcctaagtccccagttcacgattccatttcccatcattttctttggtgaatgttctgtgtataatactgtttgctctttctca

SEQ ID NO: 49438 - DNA, 1054 bp, Homo sapiens
ttcagatgtgaggggggcaaatatgttttcaaaaacttagtgtgcaatagagtccattatagaaattaaccactgctatatgttttaagtagttcaatcacctgttgtggttcagtcttgattattgtttattttgttaggtgataagtaggaagatgcacttgttatcccacactatctcttgttttgttttgttttgtttttaaataatgaacagtgcaatctttgaacttgagtttttaataatgatagcaaagacaatggtgagaacttgaaacagccagcatattttatattgccaaagtacttactgatgactgaccacactgtcttgtgaggaactgggtcccctgcactggatcagagccaaatgcaagccacccatcagttcagaggaagcaggaaaacatcttttgggtggtgcatagaacattgagctcttaaaaacccggagaaaaattaggaatttagaaagtaagtgggaggtagaatattgagtccttttttaaaaaaaagaattgatgtctaaatatgtagtctgaacttaagtgtcctaaaaccttgttttttgtttttttgttttttgaggagtcgtcttgctctatcaccaggtgggagtgcagtggcacaatctcggctcactgtaacctctgcctcctgcctcccgggtccaagcaattcccctgcctcagtctcccaagtaggtgggactacaggcgcacaccaccatgcccagctaacttttgtatttttagtagagacggggtttcaccatgttggccaggatggtctcgatctcttgacctcgtgatccacccatctcggcctcccaaagtgctgggattataggtgtgagccaccgcacccagccaaaccttgatttttttagccacctctgggattgcctgggttccctttggagaagaaactaaaagttatggccatagaaaaagccctggtaagaaaatatttgaatggtgtaagatggtggaaggaaagccatcccacacccctacaacatatgttctggcatttataaactgcttgattgtgt

SEQ ID NO: 49439 - DNA, 1046 bp, Homo sapiens
gaggcagacctaatcaggtgagcacttacaagggcccaggtttttgctgagagattcgaagcatgagagagcatttggagggggccacgtgacaaggaactgcaggagtcctctaggtgatgagttgctgccccttgttgacagccagcaaaagaatggagggacctcagtactacagctacagggcactggactcagctggcaacatagatgagtctgcaagggcttcttccccagagatccagaaaggaacacaggaagtccaagagcatctcaccctgtgagaccttgagcagggaaaccagtcacatggtgcacagacctctgacctacacaactgtgagctaataaatgagtgttggtgtaagctgctaagactgtagcaatgtgtttaacaccaacagaaaccactatagattttgatacctggatgtgaggtgtagtcactgtaaacaccttaaaatgtagatgtggctttggaactggatagtaagcaaaggctggaagaattttgagatgcatgacagggaaagcctaaattcccttggacagactggtagtagacgtcagctggatatccaaactgctttggaactcctcttttctgccttctgttttctcctgtataaaatagaatgtttatagatgttatcctatgcccgtcccatcattgtatgtggtggtgttgggggaagatagcttgtcactttagtgctgatggtccacagttggagagggattttgccctaggagttttactggataggatcatacccaggaatctcatccgttcatgattcagatgatgaaattcagatgagcttttggaattgagctgatgccataatacaaagaaatttggagactgtgggatggattgaatgtattttatacgtgggaaatactggatcactgagggccagagggcaggctgaggcaggcagaattctaagatgacctctaatgacctctggtcttatatgaacttctcttgagtataagagcagcctgtgaatatgatgagataccactcctatgataatgtt

SEQ ID NO: 49440 - DNA, 1101 bp, Homo sapiens
taatgttttcctttatcgttagtggtttttgtgttgtgttttagatataatttaccccaaggtcatcaagatatgattgtatcttattttctagaagctttatctttttgaattcattttgtgtatggcataagttaggagccaaagttatttttttctatatggctggatatccaatttgtccagttccacttacttaaatgattatctttctccctgagtactgcattggtatctttgttgtaaataaggtgatcatatgtgtgtgtctgtttgtggactctcttcttgtcctattggtctatttatctatctttatctaaacatatatatctttatttatctattcctgcgtaacaaaatgttactgtacacaaatcatactatcttaattatggcttttctgactgtgaaagttcttcaaattcttctagatggctttggctgttcttagatctttgatatccattcatattttagaatcagtttgctggtttacattttcaaattatctgttgagattttgatttgtattgcattgaatacatagactgtttggatgagaattttctctgatttaattttcataatattctaatctacaaacatgacatatctctgattaacgtagggcttctttatttaagaaatgtcatgttgatttctggacaaaggtcttatgaatttttttattagatttgttcctagctatttgatattttctgatgctataggaaatggcaattttaaaatttcctctttatactttttactgctaatatgtggaaatacaattccattgtgtaatattgaccttatgtccactgattacaccaaattcatttattctaatatttgatatatattctttaatttttaagtgtaaaaaacatgttgtgtcttttattttttcaagagctgagaaacctttccccccaaaaccttaaaacacaagcatccatatcttattgactgcaactgggaaatgactattcccaaaccagtcactggagtggtagtgagattactatgacctggttagtcaatcacactactatatatatatccgctacactgtgttataaatcaaattttctttat

SEQ ID NO: 49441 - DNA, 1934 bp, Homo sapiens
cctatggcattaaaaatttttcaaaaacatcctgtaacatcctatataagtttattctctaggcatctagcattctactggaaattgggttgtttcagatttttaaaaataattgacactataataatcacctttgagcatataacactgtaaagatatgagtatattttttagaattaatgcctggagaggaattatgcatttcatataagactttttataggtatcatcatatcatcaaattttcatcttggaaggtgctatgaatttataattctatccagtagtatatatgagagcttgttttgttataatagcttaaaacctgtttaaacataattcttttcagaaatacagtagctatatttgcttagtacaagagtgatatatgctcattgaaaccattcagaagatgaagtatgaaaagaacgaaaaaccacactttcagatttttttaatgagtacatagatacatatatacttttaaatggaacagaggcaaagagaaaggtgaggatattgaagacaacaatggagttaaaaagaggggcttctttaaagtttgagatcttggaggatagcaaaacaataagtagaagacatatatattcctttaaagagagcaagggtagatagcattttaattattactaagtcagggaccacgactaaggcccacggagattcaagaaaggaggaaaactctcagggaatagattgaaatgactcccaagtggaaaagtggatccataaaactggtgaaagttggcctacagaacaaagagaatagctataagtggggttcataccccaaaatttcaactatacagggaacagtggttaacatggtcataacagaatcactgattcccaccatcttcctgatcttttcaactgagcaagttttccctgtttcggtaagtggcaccatcatccataaaaatataggattcatcatttactgctgtccttccctcatgatctcacagccgttcaagtttccagcagaagtcccagacatcgaggaacacagacaatccatccccactatgtaccgtctgaattctagctctacaaaatccatgggaatgttaaaatggatgttgtttcatgacactaaattgtggaataatgatgagcagacatattctgttcatttttcttcttcacttatgtctatcctgtattttatcaatattttgttttccatattccattcttattgaattcctattctatccttcataaactgtattctatatttcattctaaatttcattctattccggtatttaaaaatctatactgtttatttcatagtccatttatttcaggccattgcacattttgttccgttctatattccttccaattttgatttccttttattttctttaatattttatttcatactgtattgcactcattccttttctcatatatttttattttattccatatgacattagatatttctttccattttctgttccattccattttccaattaaattccattaaatttccaatattccattccacatcctgttcaaacccgtattctactccccattttattccagtttccattgcagtctccatttcatcccatcctgcataccatttcaaatccattttccatactatattatttaacactccaaataccattccattctatttttgtgttgcatttcagcccaattgttcaccaattccattaaatatccgattttattgtgctcaaaatgttataacagtgacattcaggagactagtttgccaatatttttaatcaaagaattacaaatgtggctgggcgcagtggctcacgcctgtaatcccagcactttgggaggccgaggcgggcagatcgcctgaggtcaggagtttgagaccagcctggccgacatggtgaaaccctgcctctacta

SEQ ID NO: 49442 - DNA, 1050 bp, Homo sapiens
gaaacagagagaagtgcttgtcagattgaaactaaagctggaaaaaagaagcccgctctggaagaaccttcttccactagcttccccttgcctgccactcggcctgtcttctgcaccttttttcccacctctgctttatctttcactccctccttcctcttctactctttgattttgaagggattacattttctctagactcatctgtatgttttcttgtaaaattctgtgataaattcccatgattttatgttaccttggtatccatttcagtcttcctctaaaacacccaaactacttgaaaaagcctaaattttctgtgctttgaaatgtaaatttgttgccctgttctctaaaattcggtaaaggcatcagccatgtgggacagacaaatgtcagtttattccatttacagagaaatagtttgaatctaactgttctttaaactatgagttttacctgactcatagctacaggcttaggattaaagctacaagatcttttttgtctgtctgtattttctttgtgtgtgtgtgtatatgtatatatctgtatattgtctacagaaccaaattggcttataaataaatgaatactcgtaaattaagcaaataaacgcaaatgcttttcaagttcatgtgacagccatcttttggtggatgggactggtctaatattgttggtttggtggcaatggctatgtcttctgagtcattagaaaaatacgtatatatttaaatttagggttcttttatacttatctggcatacagtaatgtaaaattgttgacagaaaattttgtttacgctagtggctagatttttctagtgtctcatgaagtcttctagatgtaattgttaagagtgaatgaattgaatggatgtaaatgggataaaagtttgtaaatgaacttttgaaaatggttatgtttcataatatgtttacttgggaggacgttcattcaattgaattagatcatttccagataagatgtaattctgagacattggttactgaatacgagttcaggctcatatgcttttggcttct

SEQ ID NO: 49443 - DNA, 1001 bp, Homo sapiens
gcaggggccatcttggtcgtgcctggagatgtccagtgtcggtgagacttaggatggtgcatggcaaatgctcattacctcctagggcttcagttttatggggattcaaggggactccctggaccccaccatggtccagctttgctcttagggacacccatggcctcctggatttcaatatatgtttcaagcagaaccccttattcccttaggtttagtcctatcctctctgttgggattagcagggtcagctatgggagttggagccttgggaagccagcataaactgtctcaggagactgcagcggccctccaacaaacagcaaaggacctaactaggcttcaacaacagctagactccctggtgctatagtcctacagaatcaaagagccttagatctcctcacagctaaataaggaagaatatttttgtatctaagagaaaaatgccatttttatatcaacctgtctggtctggtccaagaaaatattaaaaatattattttccaggcagacaaaattgaatctttaggaacttctgtggaaacttagaagcaatggctattatctgccctgcttcccttaatataagtggcaattattaccatacttttagccttaacttttgggctaactttgtttaaaattctaactgatttcttgctctctagcttacagcaattccaggaccacatgatggttttgcaaagcttccaacctttagctgctaatgagctatctcatttcttgtccactggtcccatgaatgacatggcttacactccattagatcaggcaagaagagactttagggcccagctaggcagggacaatgttgcactgagcaggaagcagtttcagaaaaaattacctagcccctcaacctcccatatgattatgggccctaaaatctcttaggtggggaattgaggcaggataggtggtcaaggaagtgaccatgtcctcgggatgcagcaaccatggcgaccatacagtcaaca

SEQ ID NO: 49444 - DNA, 1049 bp, Homo sapiens
gtgagtttttatttaagtgtacttttttagtttaaaaaaaaaaaaaggatgctggtgaggtggtggagaaaaaggaatgcttatacactgttggtgggagtgtaaatcagttcaaccattgtggaaattcctcagagacctaaagacagaaataccatttgacccagcaatcccattactgggtatatacccaaaggaatataaattattctattataaagacacatgcacatgtatgttcattgcagcattgttcacaatagcaaagacatggaatcaacctaaatgcccatcaatgatagactggataaagaaaatgtggtacatatataccatggaatactatgcatccagtataaagaacgagatcatgtcccttgcagggacatggatggaactggagaccattattcttggcaatccaaaacaggaacagaagaccaaataccacgtgttctcacttataagtgggagctaaatgatgaaaacacatggacacatagaggggaacaacacacagaggggcctattggagggtagacgatggagggtggaagaagggagaggatcaggaaaaataacaaatgggtactaggcttaatagctgggtgataaaataatctgtaaaacaaacccccaggacacaagtttacctatgtaacaaacctgcacatgtacccctaaactttaaataaaagtttaaagaaattctcactccttcagggattatgtaaagagtttttggcattcatttaagaaatcaacagttgatctagttataaaccaattgaaagaagttgtaaaataagttgatgatggaattccattgtatcaggagaatatcaccaatgctttttacaaatgcctttatgcagccatgatgcaaaatgaaatcaataaaatatcaattattgcaaagttaaaaatagtgtactttttgactaatttttgaccaaaaagaaaactctgttaaatatttcaataagtttattctgagccaatgtgtcaccatggcccagggaacagtctcaggaggtcctgagaaagta

SEQ ID NO: 49445 - DNA, 1073 bp, Homo sapiens
gaaaaggatatgaaaaacagagattttacataaggaaggatcttgtatggtaaattcttgtcctaaaaggaagtgactggttgtttaaagaaagcatgtttagaacaagtcagaaagtttaagtatgttgtaagagagtatgtgaaagtcatgaaaaaattttaataattaaaggaaaggattgtcaagattaacactaaaattattttagccacccagtaatatatttctccaaattttattgcaagttataaaaatggtctaagcctaaagttattctctaatggcaagttaagggggaaaatgtatgctcttctcaaggaaaacgttagctttatatgaacgtttctggtaatgtacggcgacatctagtggagacaaatgggtattgcaatccattcacttatcaaactcagtaatggtctataggacccccactaacggtggtaatcctaatactcatattctaacactatattttaaaccatcttgtaaaatttatctcttttcacctagaagcaatcaaactccaaatggtgctagcagaaccacacatggacaggccattcttctgagaacccgtagctcaacctcatgagaaggtccaattgcttttcccccacatgatgccccttttcagcaggaagtagccaggaagaatcatcgtctaacaccccttaacaacagttaggtttacttctcttgaggggggaataataaagttattaaggaataattttaggcagatagagaaggtaaaaggagttatcagtgaggctttttttttttaaaaatagaaacagctcctgaaacatttcttaacagaaaggcggcttgaaaaaaccaggcagacaagtattgatatgcaaatgcaggcgattataaactaggtccatccaatatggcaattcccaccctcatccccatgtcaccaagtgtcatggccgcctccagataactccgcgtgtgcaggacatcttggcggcccacatttgcatattaaaaggctagggtgggaaggccaggtttttcttgggctatgtaaatgacacatctggtcaaaccaatcccct

SEQ ID NO: 49446 - DNA, 1090 bp, Homo sapiens
atggaaccaagttggaaaacactctgcaggatattatccaggagaacttccccaatctagcaaggcaggccaacattcaaattcaggaaatacagagaacaccacaaagatactcctcgagaagagcaactccaagacacataattgtcagattcaccaaagttgaaatgaaggaaaaaatgttaagggcagccagagagaaaggtcgggttacccacaaagggaagcccatcagactaacagctgatctctcagcagaaactctacaagccagaagagagtgggggccaatattcaacattcttaaagaaaagaattctcaacccagaatttcatatccagccaaagtaagcttcataagtgaaggagaaataaaatcctttacagacaagcaaatgctgagagattttgtcaccaccaggcctgccctaaaagagctcctgaaggaagcactaaacatggaaaggaacaactggtaccagctgctgcaaaatcatgccaaaatgtaaagaccatcgagactaggaagaaactgcatgaaataatgagcaaaataaccagctaacatcaaaatgacaggaccaaattcacacataacaatattaactttaaatgtaaatggactaaatgctccaattaaaacacacagactggaaaattggataaagagtcaagacccatcagtgtgctgtattcaggaggcccatctcacgtgcagagacacacagaggctcaaaataaaaggatggaggaagatctaccaagcaaatggaaaacaaaaaaaggcaggggttgcaatcctagtctctgataaaacagactttcaaccaacaaagatcaaaagagacaaagaaggccattacataatggtaaagggattaattcaacaagaagacctaactatcctaaatatatatgcacccaatacagaagcacccagattcataaagcaagtcctgagtgacctacaaagagacttagactcccacacattaataatgggagactttaacaccccactgtcaaaattagacagatcaatgagacagaaagtcaacaaggatacccaggaattgatctcagctgtgca

SEQ ID NO: 49447 - DNA, 1090 bp, Homo sapiens; identical to SEQ ID NO: 49446

SEQ ID NO: 49448 - DNA, 1035 bp, Homo sapiens
aaggtgattgtacgagaagactcctaacataatttttttttttttttgagacaaagtcttgctctgtcgcccaggttggagtgcagtggcgtgatctcagctcactgcaaccttcgcctcccgggttcaagtgattcttctgcctcagcctcccgagtagctgggattacaggtgaccaccactacgcccagctaattttttgtatttttagtagagatggggtttcaccatgttggccaggctggtctcgaactcctgacctcgtgattctccagcctccacctcccaaagtgctgggattacaggcctgagccactgcacctggccagaaatttttcagagtggaagttgctctagaatatagccaacacttgcctttgtcttggtagctattctaatggttatgaatggtatctcactgtggttttatttcgcatttctctgatgatggacctttccataagtttgttagtcttttggatattttttatgaggtgcctgttcaaatcttttgactactttttctcctgggctaacttttttttattgatttataggagctctttctatattaaggatgtgaatgctttgtcagatatatgtattacaaatctcagtggcttgtatcttcagtctcttcatggtgtcttttgatgaactgaatatctgaattctaatatcattccgttcattattttttttcatttatggttagtgcttctttgtactgattaggaaacttttatatttcccaaggccatgaagatagtttcctaggctgtgttattgtttaacctttcatatttatgtttataatctgtaattgatttttgtgtatattgtcagtatgggtatatgtaaaggccctttttttgttgttgaagtgacattcagtcaaccccaaaccacttattgaaaagatcattctttcccttttgtagtgccatccttttcattaactcaaatatataaatcaataatttgatatagttctgaattctgttcagtttggtttgtctatccttgtatgaata

SEQ ID NO: 49449 - DNA, 1070 bp, Homo sapiens
tactactggggctcaaattggttattatgtcaggatcccactatatttaatcaaggtgcctcctgtaatctaaggggagttcctgaacaggaaagagataaacaagtatacctcacattaactatcagaactattgccttgcctgaattcctcacatttgtaccattcattgccttaaaatatcccatagtgggtatgagcactctgatccaatgagtgataaaattaagtatttggcacatgtgaatccgtttgacaatgtgagatcccaaggactatacccccagttaaaataggttaatacagcccactgtaaattagaataagtctacaaatatggaaacccatgatacaaggcctatttggtgaaagggtgattatccccatgtcttctccattaacaacccaatttggcttgttcttaaacttcaaatgaatggcacctaatggtggattaccataacgctaatgttgtggtcccacacattaaggtccccatacccaatattgttgacattactgactccatccggtctgtgactggtaaatattttgctattatagatttggctaatgtgttctattcactgcctatttcaacagcctttcagcctcagtttgccttcacctctgaagggacacaataaacatgtacctggctactcatgggatacctccacagttttgccattgtacactatctttgctggcaagatcttaactgtaccgagctttttctagatgtacaggtgtgatgttacattgatgacatccttccctgaggagatttatttgacacactcattcaggaaatacagatactcacaaaattgctcataaaatggtatggctgttgtgccacacgtagtgcaaggccctaccacttttcaatacctacacattatttgctaaactgaagaccattctgtctctgacactgtcagaaaagcagctattgaccctgtcagcacccacaacttcttttaggttcatttgtgttctggagacaaaacattcctcttttataaattttattgaagcccatttacgctatttcttacaaatcagtt

SEQ ID NO: 49450 - DNA, 1684 bp, Homo sapiens
ttatactgtttttaatatttacctatgtagttacctttaccagtgtactttatttcatcttatgatttcacgttactatctagtgtcctttcctttcagactgaaggacttcctttagtattgctcatagggcatctgccagctacttgatatctctttcagttttgtttatctgataatgtcccattttctccttcacttttgaaggatagttttacttcctttattagatatagaattcttgattgcagttttttttctttctgtaacttgaatatgtcttcccactgctttttggccatgacttctgaggagaagtcaactgttaaacttctgttttcttgtttgtgaagagttgtttttctcttattgctctttgggattttctccttgtttttggctttcagtatttttattatgatgtgcctatgtgtatatacttctcatttttcctacttggtgtttgtttgctttttagaatgtgtatgtaaacattttttcatcaaatttgtgatgctttcagctgtaatttgttcaaatatcttcttcctcttttctattttcttctctgattcccattatatgtattttggttgctagatgatttcttacaagtttctgaggctgtgtttatattgtctctgtgtgtgtgtgtgtgtgtgtgtgtgtgtctgtatatatatatatacacatacatatatacacgtatgtatatatacacatatatatacgtatatatacgtacatatatgtatatatacatatatatatatgcacagacacacacagtctcagaaacctgtgtgtgtgtgtgtgtgtgtgtgtgtgtgtgtgtgtgtaaaatttctgttcctcagactggatgatctgaattggactatcttgctgactatttttttctatcagtgtaaatctgctcttgagcccctctaatgaatttttcgtatctgttactttatatttgtagggggcttgaaggatttaggggcttatcaaagaaagacatatgtctatgaggtggcagtatcacacacaagctttattgggagatgtgttgacaggcttgcatgttggggaagtctctcacagtaggagcctgtccagaggccatggcttgggagttgctactctgaaggggaagaggccatggaatttccagagagggagattgtagaggggacttgacttacatgtttaggtgatggctactcagcagcacagtggggagtctctgggtcagagagagctctaaagggcaacaatgtgtcaaaagacaaaattacaacaaatttagtttaaagatctcacttggccgtatttgtgattctagaatcaggcaacactattccacaaaatagaatacttgttcaaatgagctgagagcagaagaggttgacttcgtagaggagaagggctgaagaagcaaagaacaaagtgtatttattgtatgtgtaaccactaaagtatctactcagtagcttagccatcattggataaagatttccttaaatgcctgggaccaataaattgcatcatctttaacaaagggatctgtatacatcttggggcatgcaacacttagccaggcagtttacaaccgtacattagccttcacttcctgattgcaaagagccgaaaagtcagttagaagtgagagtttatggccttctcaggtgtttcctga

SEQ ID NO: 49451 - DNA, 1051 bp, Homo sapiens
tatcaggatcatgctggcctcatagaatgagttaggaagtatttgctattcttgaattttctggaaaagtttgtgtagaactggtattatttcttttttaaatgttggtagaatttgcttgtgaagtcgtctgactctttaaaatttcgttgtgggaaggttatacagatgctccttgatttacaatggtgttaaatcccaataaagctgtttaagttgaaaatactgtaagttgaaagtgcatttaatacacttatcctagcaaacattgtagcttagcttagcctaccttaaacatgcttagaacacttaatattagcctacagttcggcaaaatcatctaacacggagcttcttttataataaattacatgaatatctcatgtaatttattgaatactgtgctgaaagtgaaaagcagaatggttgtattggtactcaaagtatattttttatggaatgtatattgcttttgtgtcatcgtaaagttgaaagatcataagttgaaccatcataagttgggaattgtctgtactactaatttagtttctttgttcctttgttactaatgtgtctttttgtttttcctggattgtttccagagtttttaaaaaaatctcttaatcagattgattgtgatgagccttgtagtttccttcatgtttcttttgcaccaaatttgttgatattttttgatttggaagttaaaattatcgctaaaataatggcaaaacccacaattaatagtaacatttgaagaaacagtggctaagaattttagctgccttcctctcccgggactctgagcttcatctccttacctcaggggatctgccaggtgaaaagtattaatacttctctcatccgctttggggactttacctgtgtattaagttgcttgccattgttcaacagtccactgatatttttcatacttcaaaaaaattcttttctgtttcattttggatgatttttatttccattttttcaaattctttaatctttccttttccatagtttaatatgtcatttatccaatttgtcgtatttt

SEQ ID NO: 49452 - DNA, 1099 bp, Homo sapiens
gcttcaccatcaggaacaaggtagagttacccagttcttaaaaagattgagtaggaatggagaggacagatgtggtgagagcttcaggaacagagtcaggtcattctaggaattataaccaaacaagccaaaataaagtagaattcagcctataaggaagtggagaagctagggtatgtggcatgattttctccccagatggatttagctataggttgcttgtgtatcacccagtattcagaggaacttgaatttgaaattgcttcaggaatatgcagtactctagcactgagtcaaaaataagcgtgactttcagaaactcaaggtataagaaatattaataaattgattttctaccttctcacttcaaggaggcagtgtgctacaccagaaagtattcaggatctaccttcaggtataactgggtttatttgccagcttaaccaccttctagctgtgtgactttagttatattaataaatctctttgagtctcaccttgctcattttttttttaggtcaggatataatactgtaccaagttgtaaggattctagataaagggtataaagtgtctagtatggcgcctggcatgtagtacatacctaataaatatgttattgaaatatattattgttggttctgcaaggatcttaacactctataatagacctctccaaccccagttggggaatgaatgtgttacacttgtgttgtgatagtattaatcactttagattatggggcttctgctggcttatatggtacctttgtgtgaattgtaaaataatacctcttcctcaaaagactttcttaccacttgctagaaaattgtcataataaacacagatatctttgatggtcataatgtgaatggtattctgcagaatcatgcggcccacaatttgcaaaacctgaagttggtaggctgaataaatggccccccaaaactgtctgcattttaatctctagaacctgtgaatatatattacctgaaatggtaaaagggacttcggcagatgtgatcaaattaaggattttgagatgcagggataatactggattattagggtgggcccaatgtaatcacaaggatcctt

SEQ ID NO: 49453 - DNA, 1025 bp, Homo sapiens
gctctggccatgtaagatgtgcctgcttcactttcaccttctgccatgattgtgagtttcctgaggcctccccagccaagcttcctatacagcctgtggaaccataaactaattaaacctcttttctttataaattatgcagtctcaggaatttccttatagcagtgtgagaacagactaatatagaatttgtttttaaagctttgagctctagaaagtttttgtgtgtatatgctgcattttcctcaggtgttcttattactttttagtcagtttttacatatcttgtctaatagctttgttttatttctctctgactgctgaaactttttaatgtttgtttttatgaatgatcactttgtgggccttgatgtagattggaatgtatttgagtcagtactgctagaatatcaactatgtgcagatatgaatggtgttactatggaaacgaggtcacatgtgagttctgatcttcacactgccttatttccagcgaaaagttgccatttctttagaacactgattgtccccggataaaactgtgaacattccaatatttaggcctagtcaccttggacacaaattgcactctgaaatattgttctttcactgagagcagacaagcacagtatttaagtttatatgcaaggtctcaaaagctaacacaaagctagctagcaaaaagaaaaaagaaagagctaaaatgactgttagatgtaattctacataacctgtttttaacaagagcattctataagactaaattctaaattttttcatcaaagggtgtttttctactcctgattaattttcacctactgtaccatggtaactctacccattcagaatttgaattcctagttcagggaaaggaggaatctggggtagtggcaatgcaatatccttgtttagacttgatgttaatttgtatcagtgtttgctggtaatgctaatcaaaaacaaactccacctagaaacctgttagtggtaaaacatggataacaccagtaaagagaatttatatg

SEQ ID NO: 49454 - DNA, 1053 bp, Homo sapiens
agggagaggacaggataatgggacactgggatcattgtgtgtgtgaaaatgtggatgggacatgttgatgtagagggaggttggaatggggcaggtgtaatgtcattatggaagataggtacatgatggaagtgagaaggctggtgtatgtctgtgtgtctatgtgtgctggggaaaatgagaagtgtgtctctttgtgaggacagatggatacagtgagcatgggtaatcacagtcaatgaaaatgtgataatttggagtgggaaaatcatgagtgtctgaatagggttgttgaataaagtatatgatgggaaaatgcaaagagtttctgagtgccagtgaggaatggggaatatatgtgagtgagagcagagttgatgtggttattggttgtgagtatgtatgaaatggaggtggtatgagaatgtgtggaaggagatttggaggatgatacaagtttgataatggagatgtggactgtgtgtatgatagtgggtgtggctagacactgcgtaatggtgtagtgtagggattgagtaattggggtgtgactatatgaatgatggggatggtgtgtatgataatggggattgatttaagttagtggtatttgacagtgggtgtcgtgggtaccatatctgttctggtctaaagacattttatttatgatagtacaggataggacagagtatgtgtggaaatgggagtgatagagacagtgtacatgttagtgggcatattaatccattttcacactgctataaagagatacctgagactggacaatttattaaaaagaaagagggtttagggtgctggtattgcaggtgtgaaccactgcccttggcctggaagatctccatttttatgattttttttcatttttaatttttttttaagagacagggtatccgccgggtgcggtggcttatgcctgtgattccagcagtttgggaggccgaggcaggcgaatcgcttgagctcaggagtttgagatcagcctgggcaacatggtaaaaccctgtctctacaaaaataatgcaaaaattagac

SEQ ID NO: 49455 - DNA, 1033 bp, Homo sapiens
gtagggggaccggcagccaggcaggcagacgggtagcaggggccagcactggcccccctcccagcttggcagtggcatgaagatgggagtgggagtgtatagtggaggaagcacctgccgggacccccacctgccagctagttggacaccccaaggctgtgtgctgcccacctggtgttccccaacacccccagccctacccagtgcacccctccggtgcctgctttccctgatgcctgcgatttagaccagcccggctgtatccacggcaacagaagcaggagtgtcactggccgccagatcactgagggtcccacaatgtggcccgggctgtgatttacctgggtgagacagcttgagccccatcgtggattccaagacatccctgctgagagagccaaggtaagcagtcagcatccctccaccaaggatggggggctgggacttctgttctgtctccccacacatacttcagagtctccatcactgccatgctctctgtctctgtctgactctgttagtctctttctgctccatcaaggggctccttggtacccaagcctggggactcctcatcttccccccatcttccccaatcccaaatgtcccatgagaaagggaaccaccacctgtttcccctcacagggtctgtttttatcatcatggttgcgtttgggcatgaggctgtgttaatctttccttgtgtgctggctgtggaagggatgcctgggagcccggcggccgtgttcccttcacaatgcctgcaccctgggcaggctcagcctcttgcggctgctcctctccctctccctcctcctccactctcctccaggatccctggcctgctggccgggtgtgtgtgtgtgtgtgtgtgtgtgtgtgtgtgtgtgtgtgcacctgggtagcaagcaggtgggtagacatgacagagaagctgctcccagcccagaccatcccccactccttctttcctcctttccttccttccttccttccaccctccccacctccccatctctccctacaggtagca

SEQ ID NO: 49456 - DNA, 1034 bp, Homo sapiens
gctcatgcctgtaataccagcactttgggaagctgaggtgggaggattgcttgagcccaggagtttgagaccaacctgggcaacgtgacgaaaccctgtctctaccaaaaatacaaaaattagccgggcatggtggcgcgtgcctgtgatcccagctattcaggaggctgaggtgggaggattgcttgagcctgggaggttgaggctgcagtgagccatgatcacctcactgcactccagcctgggtgacagagtgagaccctgtttccaaaataaataaataaataaatgctcacaaattgaatgcaacagaaaattttcattttgtgtatcttaaaataatgatgaagcttttcccctaagtgaatgcagacattgctctacttaccctaataagtcttctttagtattcaaattgcaacaccaagtaaacatcacccagggaaccatacttgacttcacatttcctaagttgaagttttgcttcgaatccataaactctgtcagtagtcttcacgctattctttagtgtctttaacattttttatgtaactttattcgtgtgcaaaaaaagccatttgttgaagccagtaaacataaaatctgtgcctgagctcagaagttcgaaatcagcctgggcaacatggtaaaaccccgtctctactaaaaatacaaaaaaaagaaaaattagctgggcatggcagtgtgcgcctgtagtcccagctacttgggaggcagaggcaggagaatcgcttgaacccaggaggcggaggttgcagtgagctgagattgcactactgcactccagcctgggcaacagcgagactcaaaaaaaaaaaatctgaaaaatgagaagcattcacaaagaaatgttgccatgtttcttttacctcattattattattattactattatttttaccaaatctctacacatttgggtttaaaacaacacggaagggtgtactgatcccagttccttacagaaagctgaaaggcaggtgggaaatgtcttggatttaattacattcatc

SEQ ID NO: 49457 - DNA, 1054 bp, Homo sapiens
aggattacaggcgtgagccaccgtgcccagccgaccttttctcttaaaaaaaaaaaaaaacagaaaagaaaacaaaaacaaacattgtccacataggtataggccaaactccaaaacctcactgatgataaactagcaaagtaataatcatactatctggaatgtttcaacgggaagtgatgaaaacagttaccacctctctttgcacatggttgctctggagccattcttgctctagccctctgctgtggtaggagcctaccagctgggcagctctgctcgtttgtccacttacaagtgcaagagttagctggtctctgcacatgagcaggtttggctccagcggtatacctgttgcaggatgtgtatgtcagttaagtgtatctgtgtgtgagcaagtttatatgtgtacacatgtttgcccatgtgtacttgtctttgtgtgtgtctgtatatgtacaatatgcaatttttatctttgtgtttgtttgcgtattgctaaagtgtatgagtgtgcctttgtgtgtgtgtgttggagctgttataagtctgttcatgggtgggagtgtatatgtgaatgggtgtgtgtgtgtacatataccaggatatacatatttgtgttggtgagcacacctaatctatgtgagagagtttgaatctgtctctttgtgttagagcatgtgtgtgtatatgtgggcagttttttacttgcctgcttttttctgggtgcatatatatctataggtctctgagggggattctatgtactatacctgtgtgtgtatgtgtgtgtgtatacacacacatggtagggttcaagtgcgtgtcagcctgctggcatatgtaagtaactttgagtgttaatatcgtgacagtgtttatctatgtgacaatattaatatacaactttgtgtatatctgtgttgtgtctgaatatgtgggaggatttgaatcatcagctatattgggtcaatgagtatatatatgtctgtgtgaatgaaagtatatgtgggtaagtttgcttgtgtgtacctatctgtcagtgtttgagatc

SEQ ID NO: 49458 - DNA, 1049 bp, Homo sapiens
tttgcacgcgtcttgagcctcagctgggcccgggctgcagctgccagtctgcggaggaaaaccctctcctcacttgtttgtaaaatgtcccgagctttcccagggttgtgtttgtttgctgctattgtttgggggggatgtggggggttttgttttatctttagcttttgttttcactgagactcagggctacgcattatccaccttctcggtcttagcgtggctctccgtgtctccctctctatctccatctttatttctgtctctctctctatctctctccagctaccctctcttatctctgccccaccccaccccgtctctatttttctttctttcctggcgttagccctctccctctccctgctctccttttctctctcttgctctctctctctctctctctctctatttctctcccttctctgtctggcatgctggtttctgtgtgtgcctctgtctcttttttctcactctcattttcacccttcttcccctttttgtctctctcttcctctctgtatgtaaggatctctctcccctttctctgtttctctctctgtctctttctccctcctgtgtctccgtctgtctctgtcacacacacctctctctccttctctctctctgtgtctctctggcctctctcttacattcagtctctgtctgtctctatccctttccctctgcctcccctcaaggtaaaggagagagaaagagaaagagagagagagaaagagagtaagtgtgtgtgtgtttacattcacccagctgcgggctgttccacagtctgagggggctgtcaggccttgaagggctgaaagggagcccaccaaccccatttctgctcagcccctgccctagcactttctaagtactagtttggcctcctgtcatgggctctgagatttcagggtgccattaaaaagcctggctcgggcgcagtggctcatacctgtaatcccaacaatttgggaggccaaggcgggcgaatcatttgaggttacaagttggagaccagcctggctagcatcacaaaaccctgtctc

SEQ ID NO: 49459 - DNA, 1038 bp, Homo sapiens
cctctcacttcctgtggggccggaatctgtatttatccatccccctttcccttctttatagaagtccctgtcctaaactccctccctagcccaagagagccccagaactggggaagcctgacccatacagaatggggagggcactctaggcaggagagacattaatgagcctggctgcagagtggccctggaaaggcaggccagagtggctgagaggctgggagtaggggagcctgttctctcagcgatagtgatgggggtgcctttccgagggggtggggtgggaagaccaagggggtggggggtagatagggtacatttaggagggttttcctccatttcttttttctaactgcctggattcaccattggattttgtaaatggaaaaactgaaatgaacaatgctatactggatgttttctctttctgactgtgtgtgtgtgtgtgcgtgcgtgcgtgcatgtgccctgtctgaccacatgtggagagacatgattgagtgatagtgtgtgtctgtgtgactttgtgtggggaggcactcctgaagaaaacttgcccggtgcacacacgtaaaatgcctgtatatggggacagatacagcacgtgcatgcatacacacacacacacacacaccacagttgagaggagacaaactagagtatgtgcccgtggtaggaagtcgagtggtcaagagatggatcttggaaactacataggtcggtagcaagagggtagactcccatctcacaagatgggcctcccttggcccaggccctgagcacgggagggctggggccgccagggaacttgaaaacctcatctcctcacaaagcctgtagccccatctcaaccccgtctcagtctccttcccaaactcaaacaaggtgttcctaaaattggaccaccatggagaatggggactgggaattgaggatcaaatgtgagggaaactgatgaggttaggaaatgccccccacaaagtaatggcttctggagggactgctcagtctgggatgggagcccttcctaggggccac

SEQ ID NO: 49460 - DNA, 1033 bp, Homo sapiens
ttcttgagtctttctttgtcttttatgattttgatcatttagaagactcctggacagttatttcatagaatttgggtttgtctcaagtttcactgtgattatattcaagttatgtaattttggtgagaataccgcagaagagaagttatgtcttcagtgcttcctatcaggaggcatgtgatgtcattttgtcctgataccagttttgttgactttgattccttgtttaaggtggtgtctgtcaggtttttccactatagttccccttttttctttcatgaaatatgttgggattatataaatatcaacaaccttgttgtaaatctcatatcatcagaatataccatcagctaccactctgtatcatcatatacagacatacacccatatctgcccatcattaccatttctaaatgaatttagctgtgatctcactgtcattctctttaacactggtccagtcctaattcttggtgattttaatatctttgtagctgatccttccaatattttcatctgtcagttctgtgatttgccaccctacaatgatcctgccttttaaccccacctcagctacctactccaatagtctgacccttgttttgtttgttttttttttttttttttgagatggagtcttactctgtcacccaggctggagtgcagtggtgcgatctcagctcactgcagcctccgcctcctgggttcaagtgattttcctgcctcagcctccagagtagctgagattacaggcgcctgccaccacgctcagctaatttttgtagagacagcgtttcaccatgttggccaggctggtctcgaactcctgacctcaagtgatctacccgcctgggcctcccaaagtgctgggattacaggtgtgacccactgtgccaagcctgacccttgtccttgtcagtacctgtgactgcattgttttcatattctcagtttcaggcatcctgttctctagccagtacctcctatttttctagctcacgcctactagtactccaactccagcaatccctca

SEQ ID NO: 49461 - DNA, 1033 bp, Homo sapiens
gcctgcttttttagttttgagatttgttttcttattcaatttttttcctccctatttttaaatttttttctattctttctgtggttatccttgatgttttccatatgtgtttaacttataaagtctaaagttaaacaatattttagcccccttcttaaagaatgcaggaagcttagaaaccttcaactctagtcattcctctcctgatcacatactgttgttttcaaatatgttagtttgttcctttttataaacctcacaattttacatcattgtcagtgttattttatatagacagtgtttgtttggacttacatgcatacattcttgtatcacacatcatcctttgggatcattttctttcattatgaatatagtgtttaagtgagttttttttttttttagtacaggtctcttgatgttaaattcttccagtctttcttatatgtaaatgtctttattttatcctcattcttaaaagatagtttgttacaggtatttttactcaacacttagaatatatggttccattctcttttggctttgagatgtctgttgctattaagaagtcgactatcagactaattgctggttttgtgtgtgtgtgtagtagtagtagtagtagtggtagtagtggtagtagtagtagtggaatgtgcagggggtcctgcagttttactctaacatgtttacatatgtatttttttttaattctactttgggaatgtcatgcttcgtggctcagtgaattcatgcttttcataatttctgggaaattctcaaccattatctcttcaaatattgcctttcattttttctagtttttctttcttggaatacagttagtcatattttggacctcctcattctatcttccgtatctcataacatctctgagattttctatctccttgtctttctgcacttcattctggataatttctttaggtatatctttcagcttactgattctcttttcaactatgtttaatctgctctaatctgcccattgagttttttatttcaaaagtta

SEQ ID NO: 49462 - DNA, 1027 bp, Homo sapiens
tgtctgttcccttggcctagtcacccactccccatggcatcatcctttagagtctgctcttcactgaggaggaaacagccacacctacactctgctaacctgaggccagaatgcccaggtgagcctggcgcagacggtctgtacttggctggttttgagtatgtgctggtgcggctcctgcacaccctctcaccagcactgcagctgcctggagcaggtgtggacatgcatttcaccacacagaagttgcctgctgtgatctactattgagggtgggggctggtcacagagtttggaagtgaagagttagagcggcccattccctgtcaaaccatatggtaaccagaccatatggtaactaatttctggtccacataacagccctgccagtgccctgactatgctgagacatgggtgtattttcctggcctcatttataaccgtaccctctgacttccccagaagcagctcttgtaaactcttagggaaactgaagccagactcactatgactgagagattctctccagcttatcctctcctggaactcttcacctaattgtagcaatactgctccttccataaccagcttagcttccataaccagcaaaacaaaacaataccttgttcagtgatacatacatgggaggtgaaattttctcaaaagcaggccaggcacagtgactcacgcctataatcccagcactttgggaggccgaggtgagtggatcacctgaggtcaggagttcgagaccagcctggccaacatggagaaatcccgtatctactaaaaatacaaaaattagccggacgtggtggcatgtgcctgtaatgtcagctgctcgggagactgaggcaggagaatcacttgaacccaggaggtgggggttgcaatgagctgagatcgtgccactgcactccagcctgggcaacaaaagtgaaactctgtctcaaaaaaaaaaaaaatttttccgcaaaaatcgaggaaatgagaacataaaggtcaaggtagtggtttcttctgggca

SEQ ID NO: 49463 - DNA, 1206 bp, Homo sapiens
ggagaatcgcttgaacccaggaggtggaggttgcggtgagctaagattgcgccattgcactccagcttgggcaacaagagcgaaattctgtcttaaaaaaaaaaaaaagaaatataaacaatgtgtcattggcacagaaacagacaagtagaccaatacaacagcatagatacagacacctgtatataaaaacctattgtataacaaatcaagggagaaaggacagttgcttagttaaaggtgttgagaaaactggctcatgacagagaacaataaaactggatcccttcctcatgacatgtacaaaaatggattctaggggccaggcacagtgtctcaacgcctgtaatctcagcgctttgggaggttgtggtgggcggatcacttgaggtcaggagttcaagactggcctggtcaaccagacatggtgaaacaccatgtctactaaaaatacaaaaaattagccgggtgtggtggtgtgtgcctgtagtcccagctactcaggaggctgaggcagaagaatcgcttgaactcggaaggcagaggttgcagtgagccaagatggtgccactgctctccagcctgggtgacagagcgagactccgtctcaaaaaaaaaaaaaaaaaaaaaaggaattctaggtagattgaggacctaaatgtgaaaataaaactgtaatgttaatagaaattgtagggagatgtctgtgacctaggggcttggacaaaacttcaagactataatccatatgctgaagagatgattggattatagcaaaattaaggatttgtgctcaatgaaagacactatggacaaaagtaagagataatgtgcagattgggagaggatatttgcaatgcataaaccaacaagggatttgatacctagaatataaaaagatttcctgtgaatcatcaagaagagaggttgggtgtagtgatttatacctgtaatcccagtactttgggaggctgaagcaggaggattgcttgaggccaggagtttgagaccagccagacaatacaacatgaccctgtctctagaaaaaataatttttttttaaattacctggttgtggtggcacatgccagtcatcctagctactttgggaggctaaggtgggaggatcacatgagcccagtagtttgaggttacagtgagctgtggtcatgccactgcactgcagcctgggtgacaagcaagacc

SEQ ID NO: 49464 - DNA, 1091 bp, Homo sapiens
ttagattcaatctgctcttttcacaattttttctggtaacatggaagctatatcttttattatcagaatcagcatctattattaggtgctgctttaaaggaacataactgatttcattttcttagttgttattcccccattgttttaccttccctccctcccttcctctttccttttttctttctctctgtccctcattctttcttgctctcactctccctctccagttgctccttctcccactctctattattggatttttttttaacggcagcacttttatttttccttacacaatgacgtgttgctggggcctaatgttctcacatgacggtagaaaaccaaaatttgttgtcatctctttaaagaatttagaattatgtagaaaaaaaccttacataaattaaaaggatgaatatatttacaggtgtaaatccaaaccgcttccaactcaaggcaagtaacagcccacggtgttctggcaggaaaacatcagctaagaaaggaaactgggtcctatggcttggactttccaactctgacagaccggcaggacagaaacaactggttcaggagcccttgccagcctctagagaaatcccagaacactcagccctgatgacacattaataccctgcacatattggagactgctgaccacgcatactcaccaagccacagacttgtcttccacaagcacgttcttacctcagccacaaagtgcccaagccacatgtactaaaggttgaaatcagagacatgtacagggtattaaacagataccaaggggaacagttaacttgaatatagcttgaatagaaagtcaaaatcagcaacaagtctacaatccagtgctgatatcagatacaagcttcaaggacaactttctgtgtatgtttttttttttttttttgagacgtagtctcgccctgttgcccaggctggagtgcagtggtgcaatctcggctcaccacaacctctgcctcccaggttcaagtgattctcctgcctcagcctccccagtagctgggattataggcgaatgccaccatgcctggctaatttttgtatttttagtagagacggggttt

SEQ ID NO: 49465 - DNA, 1034 bp, Homo sapiens
aatgttcctgccacccaggaacacccccaaagaaaccccagaataatgtttgactaaatatctgggtaccccaagacccagtcaagttgacacaattaaccatcacaaatccatgccttgtgaacttggcacccatatacacctccttaaaccacatttaatcttcaaatgaagaccataacaaggtcataattccatctaacatgatacaactgttctacctacaaccgaaaacgcactaaccttttccccagaaaaagaggtaaagtccttcactgatgttaactcttttctttgatatcctgtaacttaaatactatgatgtaaagttaacaattcttaaatactattatttaaagccaatacatcttatgttacatgataaggggataagagagggaagaaaacaaaagtatttgatacatacaaacaaatatattcataacaaaataagcaggaaatatgacaattacagcccttgtttctctaactggtcacatgataactgatatttataactaccttcttccactacccattccatattctgtttgccttcagcaagcaactcaactagtcatagttctttactggtagggtaacccaaagcttcattgttgtagaatctgggccattagtagtcctgcctgggttgggttgttgtcgttttccattgaccttaatcataagggatggtaacactaagagattctctagagtatttcctgtattctagaatactcttccttccctccattgtagagtagtattccagtttcctcttggtagacaggatcaatcactccaaccaacaccacaactcccttctttgccttaacttctagctcaatggaatcgttgtgtctcctggcggaagcattcctccctttggaactgaaacctctaggctagcagaccaaaagatctctgtaacaggaggagaaattttgctagtgggtcactagggttgatagggacccattgatttccacccattgattcatggatctgtgaatcctggctgtgggagaaac

SEQ ID NO: 49466 - DNA, 1026 bp, Homo sapiens
gttcagcatttgaataacaaaggtaacataagtacttaagatctcaaaggcccattacattctattaataatgacaaaacaacatatttactgaaaatagtcttttttctttgccttccagttttacactttttaaaaaacacaaaattggacaagatcaaataactaggtggtaaaacactgactttaaaaaattacatctttaaacccatgagaatcataattctaagtatggccattgggggcaacttataaacctttgaccctttcttaacactatgtgactgatttttcacaaagaaaacacaaatgccattaagaaagtgtatttttccttgacacactctgcaatcttggttaacagactctgaggctccaaacatgtaaacaatttatcctgtattatgaaagagcaaagttgtgatagcaatataatgaacaataaagtatagcttctcccaagaaagagctaaagattaagaagtgctgcattcttgaagtcggttcagttttacccaagcttattttaggtaatcaaaacctagagcaattagcttaggtaaaacttaattaaggaatactgaaagctagatttatttgctgcatttatcttcattgtggacaacacgattagaaatcccggaatcacagatgaaagcatagtttttcctgagatttgatactatgctggaaccccacccccatccccttgaaaaccaatatatcccatttcagccttcataggtagactaataaaaaagtctcataattcaggcacacactttggccaagtttagctttatcacatctaaaaaaaattcatgtataaaacaaatatcagttcaaaagtatagattactttttaagaagaacctgcagtttctttctgcagtttatatttctataaaaataattaaatctggtagaaaggaacctgcctgaaattgaggaggccgaggcaggcagatcatttgagctaaagagaccagcctgcctaatgtacattaggtacagctgttctccagg

SEQ ID NO: 49467 - DNA, 1034 bp, Homo sapiens
tcccaaaagctagagttaaggtttttgccaatttaaattccatgtcagatatacactcacagacaagcaagttcgcaccaagtgtttcacatcaaagggcaaaaaatgcatagcaccaaacacagattctagcaatcctaaggtgaatgggctttgtacgccattatttaccacactcacttttaattcctttaacaacttaaactctagtgtgtgttcatgaataacctgctgtggattatttggatcaggccttacagaaataggaaaagcgcaaggtcctaagggctctccagctatggcagcagagtgtaaaattctttgtattggggtttgtatttctgctactgaaggaggtggtacagatgtttctgcaattggaggaagtggtataggccaatttttatctccctctcctgttttttattttcagttggagctgtgggtgggacaacagattctttcagatttttagacttagcctgctgtccagcagaataatgaggagataatggcacaagtacagtatgaactaaactccaagtggagaaaacagaagaatcaactttaagaccttttggatgagcctgttttaatccttctcctgccctatcccaattttccacatcgagagtgcctgcctgtggaaaccgtgggttatgtgtaataaccttttgtggcttctgcaggaggttagtgtctgcgaattaacctgagctctagattgtctcagcagaactttaagcaactgcacataatgtttttctttaatagacgaattcttccccttgttaccctgattcagaaaacttcccgttcccagtacttctttaaagcactgctcccattacctctttagggcaccgaccttatatccactgccggcagactcgtcctggggtccccgtttgccttgtcaaattcagttcctctgctccagcagaccttcgttcacgtcctcgaagtccctgttctggggcgccactatgccgctgacctattggactgaacaaaggggggcaaacacgggaata

SEQ ID NO: 49468 - DNA, 1038 bp, Homo sapiens
gcccagcctccagtcctgggttccctcaggaattcgaagaccttggctaggtggtgagcttggaagagctgggctttgttttctgtctcctctaacctctttccttactccttatcccatcccatttgagttcaggggtgaggcttaagatcttaataaataataccttactgcttaatctgtggcttgacctgtgagtagtagccttagaatcagccttctgggagctcagcttcagagtttacaagggagcagtttctgggcccaccctagcagcctggtactttggacaaccaaacagatgaacgaacggagcacagcagtgctatgaaagttactgtaagcctgaaataaactgtatttttcttaaaaaaaaaaaaacacacaaaaaaacacaaaaaactgagtatccattgtcctcccccctgtttccctgtcctgcccgctggccctgccatgggtctggacgataaaatactgggtagccttggggccgggtagaagctgtaagccatgggagaggcaggagaggtctagttgccaccccacgtggagttgtacgtgtgaagacactggctgaggaggcagggctgggtcggggccccagggtcagtggcagagctggcacttgaatccaggtctcctacctctggtgctttgtggggaactgggtggaggcaggatctgtggtagggtattgagggatgagggagaaaaacgacctaattcaggtaggactggcaacggctcccaccctccctggggacagggattaataaaaattgacatcactgtaggaatatattttttaaaagcccacgttttgtgaaaagatgaattaaaaaacccaagacccagcattcgggattgaaagtgcccgtgatgggagttcaagtattgactgagctgggagggaaggggctagagcccccaatcagacatgggcaactagagtgtggggtgggggctcccagtttgtcccaaaccctctaggtcttgtctcgggtctggggggattcggggggttcagcagtggct

SEQ ID NO: 49469 - DNA, 1362 bp, Homo sapiens
ggaaccatgtgacaaggactggagtgccattggctgtggactgttcaggcagggaagtacaagaccactcttgtattcaggggcaaccaaaggagagaattacgtacttgttgagtacaaactgcaccaagccctggagacccattaccaccgttaaccctcaatacagctctgctagtaagggattcgtctccccaaatgaaaaaaaaaagtaatctcagaatgttggccgagcatggtggctcacacctgtaatcccagttatgcaggaggctgaggcaggagaatcacttgatctcaggaggcggaggttgcagtgagtcgacatcacaccactgcactccagcctgggggacagagtgagacttcgtctcggaaaaaaaaaaaaaaagttgacaggatggccagacccaagtgggcgtattaagtggtggtgctaggattggaacccaagcgtgattaaaaccctatgcaggccctttcctctatattgtactgcctccttaacaaaggaagattgattaagcccctactttgtgccagtctctgttatcaagtccgttaaatgcatttaacgttaaattttttcttttttggtttaaaaaactctagtttcttaaactactagtttttagtgtcttgctaaaactatgtgctcttgaataggctacaacttatttcacactatctcattgaactctcctggtatgtgatagtgttataatgaaaaattgcataccaggacagctaagtctattttgcaaccatacagcgtttcataatttagcatttaaaatacagacagtccccgacttttggtggtttgatgtgggatttttggtggaaaagcagtatacattcagaatgcacctctacttatgatggggctacttcctggtaaacccattgtaatgtgcaaattacgggtttatcaggaggtgaccccatcggtaatggagaagtgctgggaggtaaatattagaaatggaagtatctaaatgagtaagaaacagcatgggagcataatttggccaaaatcaaacagaactaaagtagtcatgtcggtaagaatttgggactgcaggccagttacgatagctctcacctgtaatcccagcattttgggaggccgaggcaggcggatcacttgaggtcaggagttcaagaccagcctaaacaatatggcgaaacctcatctctaccaaaaaaatacaaagattagctgggcatggtgtctcatgcctgtagtcccagctacctatggggctgaggcaggaggatctcttgagcccaggaggtcgatgctgcattgagccgagattgtgccactgctctccagcgtgggcaacagagtgagactgt

SEQ ID NO: 49470 - DNA, 1081 bp, Homo sapiens
taaaaaattagcacagactttgtggcttaaaacaacacaaatctatcatcttacacttctagaggtgagaggtcccaaatgagtttcactgggccaaaattggtgttgtcagggttacactctctccagagactctaggggagaatccatttccttgcctttttcagcttctagaggctgcttagattcctagaataatggcttctttcctcatcttcaaaataactatgtagtatcttttttttttttttttgagacggagtctcacacactgtcgcccaggctgttgtgcagtggcacgatctccgctcactgcaacctctgcctcctgggttcaagtgattctcctgcctcagcctcccaagtagctgggattagaggcatgcgccaccatgcccggctaatgttttgtatttttagtagagatggggtttcaccgtgttggccaggctggtcttgaactcctgacctcatgatccatctgcctgggcctcccaaggtgctgggattataggcgtgagccacgacgcctggccaacaatgtagtattttttctcttttctgaacctctcttccaatccttatatcttctctgactctgatcttcctgcctctcacttaaaaggactcttgtgattactttgcatgcattgggatcatctaggataatctccacatctcaatatgtttaagttaatcacatctggaaagttcctttaaccatgtaaagtaacatattcaaaagttttggagattaggatctgtagatctttgaggatgggaggcattattcagcctactgcagatgtaatttgataaatttttgcttggaatttttgcatctacataaggatattggtctgaagttttcttttgtttaatgtctttatctttggtatcggggtaatgctgacctcatagaatgggttgggaagtgtttcctgtttttggaagagtctgtgtacaattggtatcatttcttaaattttagagtttaccagtaagttttatttgtgggaaggtttaagactacaatttcaatttttaaaatatatatagggctattcaggttatatttctt

SEQ ID NO: 49471 - DNA, 1056 bp, Homo sapiens
tgctgggattacaggtataagccaccacgcctggcctaaacttttaatttttagatgcagttgtacaaaacaatactgagaaattccatgtaagctttacccagtttcccccaatggtaacatcttgtaaaactataataccatataactaacagaatattgatattgataaagtcaaaatacaaaacattttaattttattttagagacaggatttcactctgtaaccgaggctgaagtgctgaggcgctctcttggctcactgcagccttgaactcctgggctcaagtgatcctcccacctcagcctctggagtagctgggactacaggtgcatgccaccacacctggctaaaatttttaaattattttttgtagagatggggtcttgctgttgcttagactggtctcaaactcctggcctcaagtgatcctcttgcctcggactctcacagtgttgggatcacaggcatgagccactgtgccccatcaatgttgcccttttatagccacccacttctttgctgtcattacgccctctttaaaccctagcaactactaatctactatgcattttaattattttgtcatttcaagaatgttatattactagagtcatatagtaatcttttgtgataggatttttatagttagagtaattctttggagattcgtccaggttgttgcaacaaacaatagtttgttcctttttcttactgaatattattccatggtatagatgtacaagttagcttaaccattcatctgttgaaggacattaaggctgattccaattttttactgttatcaataaagctaggatgaacattttttttggtgcagattttggtatgaacatgttttagtttctctgggataagtgcccaagagtggaatttctgagttatgtaggagtagctttatatttattgattgaagaaactgccaaactgttttccagagtaggtgctgtcatttggatgtttgttctccaaaacatcatgttgaaatttgatccccagtgttggaggtggtgcctaatgagaggtgtttgggt

SEQ ID NO: 49472 - DNA, 1026 bp, Homo sapiens
agtgatgggatgtcactcccaccattaggttatattacataaaactcttgtcttgctggatggagactctagagacttttcttggcttgatgaaataggtggccatgttggaataggctgtgtaacaagatacttcaggtagtctctgcaggtggcttttaggaactgtgggagacctcttgttgctaacagccgagagctagcaagaagccagggccctcagtcctactgacacaagaaaacaaagtctgcctacaatcttagcaaactttgaggtggattcttccccagtcatgcctccagatgataaggcaggttggctgacatcttgatttcagtgttgttaaatcctaagcagaggactcagataaactgttcctggaatcctgacctatagaaattgtaagataataagtgtgtagtattttaagctgctaattttgtggtaattaatttgctatgcagcaataataaaatataagcctagaacatcttgctgtgtcagaaagtaagaagggactcaaataactgtaagctatgacaaaaggaccctgaagtaaatttgaaggtgctctcactagccatatctgggacaatatgagattcaaaataaataatagtattaatataactcattgaataaaatgggaaataattagttcacatttatataaataaataaccaatcaatcaatggaaagaagagagagctcttccttgctactataaggacaactaattagtatagaagaaataatataattagaaaatatttattttgcaaccatcatagtaatagttaattcaggcagaaacatcaataattgctaaaactaggggtgaaagtgggatgataaatgaatatttacatagcttcaaagtatctttccacaaactaattaattacaaaggtaaaagaataaatttacaggggaaaatctggaaggtatcaccaagaaatcaaacttaacgttagcagcaattggacatattgacatttgtacttctgatatgatgtactgtgaa

SEQ ID NO: 49473 - DNA, 1034 bp, Homo sapiens
gatgaagatttttctttctttcctttcctttcctttctttctttctttctttctttctttctttctttctttctttctttctttctttctttctttctttctttctttctctttctttcttctttctttctttctttctttctttctttctttctttctttctttctttctttctttgtctctctctctctctctttctttctttttgtatatttgcaaattcatacagctgttatttgtgcttggaacctacccaaagtcggaaatgtagtaggagaacccctgagcagaaaaaaaatgaaatttctaaagactgcaccttagtgtaaaggtaaaggagaaataaaccctgtcaagcagaagggcagaaagaaaaattgctcattttgactttgttgctgaattgaaagaaaaaatttccctattgtagcaatggggcacacctaggacccagatcttggattttaagtattatttctgactaaaaaggactcagaatgccttggaataatagctgattccagggctggatcagggaagttataaggctggaacatcttgtggtggcagaaagtaaggaaatgtcctccagatggtaggtgcatgtcacaaggacataggagtcaccttgaaggagtttgcactggccagatctgaggcaatttgatcatcataataaataaaaatgttaacagattataaccattgaataaaatagggatctatgagtctgctccaataaataaataaataaatgcaagtcacatgtagctggtggctaccttattggatagcacagctctagaggatctcacatatttacatgaggagtcatgtataaaaatgcctattgtaacattgtttgtaatagcagaaaattagaagcaatataaaagtacatcagaagtagaatgaataaataaaattgtggtttatttagacaatgaagcacatacagcagtgaaatgaataatttactgttacatgggccaacgtggatgaagctcagagacataatgttaactgaaaaagca

SEQ ID NO: 49474 - DNA, 1032 bp, Homo sapiens
tggatgacttgttgtagacagccttacactgtgcatttttcagttttaggctttgagagtaaggctactgctgaccctggctccttctccccaagtcaactggatagtgttagcctcagggcctggggggtatgaatgtgcacaattgcaaaaatattccataaatagtatgagcttgtaaggggtttgttactattgtgtttatttccatgtcagttaactttggtagagaggatgggaccaatttttgcttcaccagttagttgagaagtttcttatagaaatctgagttaattagcatagatttaatcccatgatattgtttccttttgtgtagtgggaagcaactggctaactggtccactacttaaactggcttgttatttgtgtgggaaaaggaaaaggtcattcttaaccaagaaggaggctgttctttagatttcaagtccatgtgccaagaatctggggaaagagaaaacttctgtgcttgtgcctggatcccatcctcttctgtttctttagctacttcaccaattatccctttcttttcagaagtttcaacttaccttctattagcattggaggatgttcaatatttttccattggaaaaaggaaacccacatccctttggctacttccccataagccttctccttcacacaaaacaatttcttgaatgagttgttcacacttacgtttcctcaccttttacccactcatcaacccactgtgatttggcttttccctctgccctctactataattgcatctaccaccatcaaccaactatctcttacttgttaaattcagtggcttttagctgtgttttctctctccttaatttgtcaccacatttatctctgttgacaattttccccccgctagaaacttactctggctttcagaaacttctctggttgctggggtctgaatgtgtactcccttcccgcaaattcatatgttgaaacctaacctccaaggtgatggaattaagaggtatagcctttgggaggtgattaaataatgaggag

SEQ ID NO: 49475 - DNA, 1061 bp, Homo sapiens
agtaccttttggctaaagaccagacgaagattcccatcaagcgctcgggtaaagtcctaccaatcctccctctgccctgagctctgccctccattgcccttacaccattgtgctggggatatcccctgctcttatgcttatgtctctgtcctcccaaagttctgatttggcagtgctagcatctctgttgataagcacagaaccgggttatgccacccttggtgtggttggcaaagagtctatagcttgggcatcagggccacctggcatctcttcagtcaggtgctcacaacactctccccttgcagacatgctgaaggacatcatcaaagaatacactgatgtgtaccccgaaatcattgaacgagcaggctattccttggagaaggtgaaggggcagccctgggggatgggcacagtggggaagccttgaattgaacaaaaatgtacaagtcccttctcgggaaccaaagagacctgctaatccagctccatcgctatgctgaggggcagacagtggcctagggaggggtgtagattagcgatgggtcacacagcaagtcaatggtaaaagtgcagctaggacccaagacacccaacttaatcctggcttctgtccgtccatggcagctcctgccatgtatttgagatttcacctctccctttcattccccattctctgtctccctagagtcccactcaccacaaagatgatgatgacaatagtacatttgcagcgtgtttaccgggtgccaggcacttagctatgtactttgtgcgtattatctcactgatttctcacacatgcgaaactcctaggtacatagggagctgcagcatgccccggaagctgaattttgtcatctcacaagctgttctccccatccacaggtatttgggattcaattgaaggaaattgataagaatgaccacttgtacattcttctcagcaccttagagcccactgatgcaggcatactgggaacgtaagctgggaaagggctgaggtgtggggggcttctgctttggccatgtgctgctactcctcctttgtcctactt

SEQ ID NO: 49476 - DNA, 1159 bp, Homo sapiens
tgtaccaggttgacagccattcttccatcttcttggcaacctgaggaagggagaatatgattttcccattttactgaataatagaccaaggcttgcaaggtctaagtgccttgcccagggtggcatagagctggaagcagagactgggcagaattctgtatctgaggaatctgggagaggttagcctggtgagctggctggtgtatcttttgcggatggctgctgaaacataaaccttctttctgtcctgttgaaacataaaccttctttctgtcctgttattcccttaggaccaaggacacacccaagctgggtctcctcatggtgattctgagtgtcatttttatgaatggcaacaaggccagtgagggtgagtggctgggcatgcagctgaatgggcggccatggtctggattccatgtgttcaatttctgtccctgtctcctcttgcctcccctcacagctgtcatctgggaggtgctgcgcaagttggggctgcgccctgggtatgactgggctctctcagcgcttgctgtccgtgttgtcctttggcaagagaggatggtcctaggattgcatcagtctggtggtctggtggagcgggtggggtgctggactgggtagagggcccagggttctgacctgggtggatgacgggcaaatggtcctgaactctctgctgtctctctccttaatgtcctctgtctgttctaagctgagatgttagatagaccttcagggatccctgacaaagaggcatctggtcttaactgcttgcttctagtggccatgtgctcattactttcttcacttcattgagactgccccatgtgctagagaggtctcttccatgttgggaaatgcctctgccctcatctgggcagttctgatctgtgttcatgggttatttttcccattgtcagggtgaggcattcactctttggggaagtgaggaagctcatcacagacgagtttgtgaagcagaagtaagtggtgtttggggctttgtctggccctgaagtgttctgggtatactgatctggttcagaaagtgcttagtcagtgcctttcttatactagctttagagggatgggcatcctgtgtcctagaactgatactgtctaaaattcccatgggcagacctttccaggactgggc

SEQ ID NO: 49477 - DNA, 1131 bp, Homo sapiens
ggaagcctcaatatgggagagggcctgtctgagctcttgggcccaggaaaaagtatatgggccaggactgctgcacccctttctaacaatcccacattgtgtttttcagccatgtgatcattctgggtgacctgaatacagcccaccgccccattgaccactgggatgcagtcaacctggtaaggctccctctaggtgcctggccccactcctgactgattctgtttgtccagccaaccaaccctgagtttttggcccagggacagcttcctttatgggaaagcggagcttggcttgcaatactattcttatagtactgaggattggtcattcattcaatagacaatactgactctgcccatggcctggccctgagccacatactgaggactcaggagtcagatccagcccttggctcctaggagctctccagcatggtggtgggctacagacacatggctagccaattataggatggtattctcagggcagaggcacagatggcatcccagaaagctacaggagctcagagatgggattcctaggtgagctcggacatcaggacaggcagctgaaaatggctgaatcttaacagatgagtagaacagagctttgaagtagaaagcattctagcatgggcaaaggtttcaaggtgagaatttgcattgtgtgcatggggaaccacaagtccctttcttcttagtgacacaggaagggaggtgagtggcagaaggtggggctggagagttgttgggggtcagatttcaaggactgtgaattccacattgccttggtcatttccttaatacactgtatttcttgtttatgaactttcagtacctccctgttacctctgtgatgcagagaaaacatggagacctagcattcaaggctctccttggtctgtgacctgtctcttatttccaccttcagtgtccctacacattttgtcctctctagacaggttgtctcctgtcggcccgttgtaaaagttattctcattctggcttttctcactgtgccctgaattggtggacatgaccccctccctgtctttttgttatatgaacctcttatctctaagttcccctaggcccatggttttcagcccctaactgcatattagaacaa

SEQ ID NO: 49478 - DNA, 1049 bp, Homo sapiens
gaaggagttacggacctcattctggaagtctgtgctggcggggcccttgcgcacacccctctgtgggggccacagggagccatgtgtgatgcgtactgtgaagaagccaggacccaacttgggccgccgcttctacatgtgtgccaggccccggggtcctcccactgacccctcctcccggtgcaacttcttcctctggagcaggcccagctgaaccaatggaggcctggggacatctggcatggtcacccctgcacatgatctgaggccagctccccttccctgagctgcctcctgcttctccctcaaagtctcctacccttctcttcctcttttaagccctctcttcctcgctttccttcctacctagctccttgttggtgagcttcttgtgccttaatcctgtgacccagccccttacaccactttccaccttcctgtccgaagtacacggacactagctgccccaggaagttgtgtgattttaaatcacttctgtctttgctggaaagtgtatttgtgcataaataaagtctgtgtatttgtttcagggttgcactttggacattgtggaggtactccataaagttgagtcagagaagctatctcaatacttggtttgccggctggctgtagcccaatgatgtaattcccagagaaaggggaggagggaggggggaggagggaatagtgaggcgtgagcagcagtgctcaccataaagggttctctgctcagttgtaggaatttcctgtacggctaaggtgaaatcagcaaggaaggtgggctgtgtagccttaaaccagagctttccagctagtgcgtcccacagctgccacagtgggttacagggttgaaagaaacggtcctcagccctcagagttgccaggcagggcctgggaccacacaagtttcagggacgattgcctccttagcaagtagtatcattagtacccctaagtgtgccatggaaatgtttcctgtatactgtgacctggaaagtgggagcattgctttgaacacagtgcttgctctagccaagcctcttctc

SEQ ID NO: 49479 - DNA, 1048 bp, Homo sapiens
gctatcagatttaatttttctaatatgaaaatccgactgagtcatctacatacttaagaacctttagtaacttctttaagcccatggaataaaatccaaatgatttcatggccctttaaaatctgttcctgaccaaaccctgtgccacacttatgcaccctatcacagccctacagaatttattgttctccagatttacaaattaatttgcactttgtgtaagccatatacacacaccatacaggcctctgtctgcacatttatttttaacctaactcaagtgttaccactataaggtcttattgagttcttcagatagaattggacacaccttcctttgtgctctcatagtactgtgccctacgttggggtttaggcagaattgctaagagtgcagctcaagctaatttcttaaccttttggggcttcagtttcctcatttgtaaaatggtagtaataatattaactgtatcgtaagattgttgtgacgtttaaattagtaaatgcctgtagaacacttagatcagtacctaacatgattagccttggtaagtctttcataggcaattgaaagaggtacactgtataaattaataaccgaaggaaatgtaccatatttagccttagcttcatctaataattcagttctgtaactacagtttgctaagagaatgttcttgatgagcctgtctgaagttgctttcattgagaatgcctaaaagtacagaaatttctacatgattaagaacaaaaattagcttgatttaatcattctgcattgtatacatatatcaaacattgcattgtacctcctaaatataaagagttattgtttttcaattaaaattttaaagtacaaaagcaaactttttgtagcaactttagactggctcagcagtggcatttccttagtgagataaagttatatagctacatttttagattaaatcaagtctgagtgtagtatattttcatcaatacttcttatattagtaattagaaatttgtataaaatatcttgggattgaaggtagaacataggttccct

SEQ ID NO: 49480 - DNA, 1564 bp, Homo sapiens
atatgtaatggttcccccgggattcagaaagctgtagtggatcagaccagcagcagaccaacaaacagtgactatgactttttttgtgcaagtttggctttgggaagtactttagagttcttcttagtccatcctctgagccagttgtcaccagttgtcatataaaatccactttttggtgcacatcccaatccaattgagagatcatttgttgttgcataggataagagaagacaacacttcaaaatgattttttttttttttttttgctcagctcgtgagcaaaccttttgagctttttcacctttccaatttgcttcaaatgctgaacaactgtagaatggtcgacgttgatttctttggcaacttctcatgtagttgtaagaggatcagctttgatgattgctctcaattgatcattgtcagcttctgatggctagccactatgctcttcatcttgaagtcttgtgtctcctttgcaaaacatcttgaaacaccactgcaccatacgttcgttagcagttcctgagccaaatgcgttgttgatgttgtgagttgtctccactgctttacgacccattttgaactcgaataagaaaatcgctcaaatttgctttttgtctaacatcatttccatattctaaaataaatataaaataaacagcaagtaataagtcattagcaaaaaaacataaagcgagaaatggacattaaaatgatgtctaacataaccacatttacttaagaatgtattccaaaatcaaatggcaaattgcaacaatacaaaaaccgcacctagttattttcttctatgtgtgtatcttagggttctccagggaagcagaactaactaatcatgtgtgtgtgtatgtgcgcgtgcatagaaagacaggaagagacacacacacgcagagagaggggtatttattttaaggcctccaactgattaaataagactcacttatattatagagggtaatctttacccagagtctcctggtttaaatgttaatctcatctgaaaactaccttcacagtgatatctggactgctgtttgactaaatgtcaggatactgtggcctagtcaagttaacacataaaactaaatattacagtcataccccttgtcaacttggcactcatacacatctactgaaaccatacctaatcttcaaataaaaacaataacaaggtcatacttccatttaacatgatacagtaatcctgcgtacaaccaaaaatgcaataatcattttcccagaagaggatgtaaagttattgactgtttactcttcttttacattataatgtaaagttaacaatacttaaatattatgatatatcatatgatatgttcatgataagggattaaaagggaaaaaacagacatttactttatatacatatatacatattcataacaaaatcaagatgaagtactcatgacaattgcaattctcatttgtataactggtcacgtgatttttaactggtctttataactgccttattcagttccagattacctttgcccacagcactcacctcagcttgttgtatatt

SEQ ID NO: 49481 - DNA, 1047 bp, Homo sapiens
aggtatatgttaaatatagcataattaggttctgatctttagagaaatctacactgttggacttaaatatttgtgactagattaggagctttttaacaaagtagatcatatttttcaacttttttcctaaggcaacatgatggcattaaatatttgtttgctttcaattatcaatggaaagaagtttctccagcattttacaaaagtgtttgaacttaaaaaaaattcaactcaagggtaaaaatcagatgctagcttcattttctcatttcatttgtgttatatcatatttaatgtcagtatttgtttgggactggattatcatcatattttgctgtccacatattatagtgtacttactaatttcaaaggtctgggactgactagctgttaataatagtacactgtgtttctgttctgttaggcttggtccagcatagtttatcagctgattcccaatgttcagcagctggaaatgaacctaaggaattttgctgaaattatcgaagctgatgaagtacttctttttgagagagctacttttctggtaagaactttctgctttgcagatgtacttcacactgtacgttctttgttttcagcaacagagaacagcatgtcactactttcaggaagaacctttttccctcttgtcaactttagcatgtacagacttatttataaaatagtattgtcagcaagtgacctgaaagaagccctttggtgtgtagctctttggaagttagtgaaacttagatttttccaggtatgtattattagagagttcagattgttggctgggcatgggggctcacgcctgtaatcccagcactttgggaggccgaggcgggtggatcacctgaggtcgggagttagagaccagcctgaccaacatggagaaaccccgtctctaccaaaaaatacaaaattagccaggtgtggtgacgcatgcctataatcccagctacttgggaggctgaggcaggagaatcgcttgaactcgggaggcggaggttggggtgagctgagatcatgccattgcactcc

SEQ ID NO: 49482 - DNA, 1060 bp, Homo sapiens
tagaccatatgtactgactgatagcagctggggaaactctggtagtaatccatgcctgaagtatatttaaagtctattcaggatgcaactggagaaggaatgcataaaaagtggagggaaaataggatttatgaggtccaggagtggttaattaggtgtaattccataacacctaatgagatgcaccttcattattctatcaagcagtattaaaacctttttcaagctggcagttgtctttaattttgtcctctaaggaaaaaatgaagcactgtgaactgtgagaaacggagtttgataacacaaagccctaacattttcagtttccatttgcaggaaaagagaagacagaaccatttagggaatctatagcacagtagacagtagactcatctcatttcttcttctgcatgtcattaaggaacttcttctaaaccactggtctctcaccttttctcatcttagtttaatagtcctagttgagggataagtagagttttcactgagcagcaaaaaacatgtttttttgctacgtgacctatgttatgtagactaaaactctcaacttgtaaaacaattttatgggaatatttctatcaacagctgtgttaatcttctgcagaaggagagatttaagtgttccagagtctttatcctattagcatctaggaaaatgaaaagagttcaggaaggtgaagagtcattgaacaggggtgtattctgtgactagtaatgagtcattatttggcatgttattattttcaatatctggggtgggatttagaagtgggattcacttctaaatcagacattcacactacttgaatgtgttctttataaggtggatagatattgatacatatagagacattaaattagatgagcccagaaaaatcataaggttatgtctttatcctatttgcccttagttcattcagtccttgctcagattatagttataacttggacatagatgttttgaaaggttagacaaatgaggttctgattagacttaatccttcttatggtgatggccagatagctgtctttgtcactgaag

SEQ ID NO: 49483 - DNA, 1979 bp, Homo sapiens
tgcctccatgacttaaaaaagtgaaattaggcaaacctggccagagaataagtaataccagacatattctcagactactttgtgaagcatggggcatgctgaacctgtaggtagaaactgaacctattcatttagaagagccatttgttgcctaatcttgttcttatgcagtttgtcattctcagttttggttctgtcctggtttttgtgttctgtcagatagtcagcttcaaaaaattatgtccaaaatcagaacaaaaaatgacacatggaagttgtcgaggcagggccctaggaatgcataaacatttgactgtgtgaggattggagggttactaaaagcaaggattatatggtttactcatggataacctcagcaaagtgactagaaaaactggaggcactttcgaagtacaggcggaaggcagagaatggactgagtacctgttagaaacagctgttgcaatggacagcagtcaggaaagggctggggccaggaaatgtgttgtgatagactgactctttatgtcttttggagtagatcatggcttactcttttttaaaaaaaagcaccaggatctctctatgttaacattactttgcatttcaaggcttccaactgatcttacagataagtagtcacctgttctgatctgggccttcttttggttctgtgctatccctttgggtttgctcagacagagggaggtgcttatggtcccagctcttggagattgtgcagtcctggacattctgaccaagtgctttgtgctttgtgaacccagaaaatctgagacaggtgtcaattaatttagaaagtttattttgccaaggttgaggatgcacccatgacacagcctcaggtagtcctgaggcatgtgcccaaggtggttgggacacagcttggttttctacattttagagagacatgagacattaatcaatatatgtaagaagtacattaatttggtctggaaaggcgggacatcttgaagcaacggtagaaagactggaagctgggagggtgcttccagatcacaggtgagacacaaatggttgcattcttttgagtttctgattagcctttccaaagaaggcaatcagatatgcatctatctcagtgagcagaggagtgactttggatagaatgggaggcaggtttgccctaagcagtttccagcttgaattttccttagtgatttggggggtgcaagatatatatcctttcacagcttccactgaagattgtcctttaagtcctttcagcatgaatggagaaaccttgcagccattcaagggacaggtaagtatcacctgagaacctaagaaaatgcatttctgtgtcagttcccaagctcaatgtgccatatggagggccaaggcatcatggtttcaaataccaacattgctacttatatgctgtgggattctgcctaaatctttagatctctctgcagttcagtaaaacacttttctataatatgtgaatatttttttctggatccctaatgaccatgttccactctcttttagatacttttcagtgtgtctggcaaggtatatagggatcaatatttggtgtgtatgtgtgtatctgcatgtaagagaggtctataatccctttagcaaatgcacacaaacacacacatacacacatgtttgtaataattgcatagtaattatagaattactatagtatgtttagtaatatcctgaggcaaagtgttttaaaaggctgtcatctaattgaccaaggaagtgacttcctctattccattcccactgtcttggaacaagggaccagcttctcactgccaaacaggaagatctagaaaagcaactggagtgtgggctgagagggtggtgatcagtcaagagtcagtgtgattgccacgtaacacttctcattccagacacaaattttatggattatgcgttatgtgtggagaatggtgatctggcctcagcctcactcccct

SEQ ID NO: 49484 - DNA, 1028 bp, Homo sapiens
atttaaaagcagacattacaattcatttcacagaaatccaaagaaacattacaggctaatataaacaattatacaccaataaattgtaaaatctataaaaaattgataaattcttagaaacatacaacgtatctacattgagaaaattcaaaacctgaacagaccagtaataagtaatgagatcaaagctgcatttaaaagtctccccacaaagaaaatctgatgactcaatgactgtgctgctgaattgtaccaaacatttaaagaagcactcatattatttctactgaaactattccagaaaataaaggatggaatactttcaaactcattctatgaggccagtattactctcatatcaaagccagacaaaaacacattaaaaaaactccaagtcaatttctctgatgaacattgaattgaaaatcctcaacaacattaactagcaaaccaaattcagtaatacgttaaaaagatcattcatcatgattaagtggatttattccaaggggtcaagactgttttaacatgtataaatcaatcaatgtgatacactatagcaaaagaatgaaggacaaaaaccatatgatcatctcaattgatgctgaaaaaaaaatttgataaaattcaacatcccttcattataaaaaccctcaacaaaatctgggtatagaacaaacagaccacaatgtaataaaagtcaaatacaacagattcacaaccagtatcataataagtagggaaaaaccaaaacctttaagatcagaaacacacggatacctgttttcaccactgttattcaacgtagtactgcaagtcctagctagagcagtcaggctggagaaatacagggcatccaaattggaaaggaagatgtcaaactgtttttgtttgcagatgatatgatcttatatttggaaaaacctaaagacaccacgaaaaaactattacaatgggtaaattcagcaaagttgtaagagatcaaatcaacatgcaatcatcagtaggacttctatatgccactagca

SEQ ID NO: 49485 - DNA, 1046 bp, Homo sapiens
tagtgtcagatgatcggttgtatttccctggtattagttgtaatgtttttatttttatttttgattataattatttgaatattctcttttttgtgaatctagctagttgcatataaattttgtttatcttttcaaagaagcaactattcattttactttttttttgtattgttctatctcaattgacaccttactttaaaaaaagacattgtttcctttgcatgtatgtatcagtcagtttctttggttgcaagccactgaaaccagctctgtctcacttaagcagatgaggaatttgtgaaaagggcagagtaattgctagaattgcttggaagcttagtgaaacagacagagtaaataggcaagaacaaagcaccacagccatatttacactagaggagccatctgatatatgggccttattgttgctatcactgatactggaatgctgcagtgggcactgatgctatctctggaaatggccaccgctattgggatcatcgaaactgctgtgcttagaaatcaggtgttgttgattccaacacctgtacaatgtgtacttttttcttgttgcttctctgcatactttcttccagaatcaaatgtccaggacatcacaatcatgtgatgagctgagttcaaatcatgtattcatcatgccttagcagcctaatggtgggaaaaagagaatatctgcatctgcacccattctttcctttttccatcttgttaatgatggaggacgaggccctctttctttctgtggccaatccttggactatgctttagaccctactcactggttctttcctggaaactttattatttctcccttttgcatcttcaatttctctatctgtatgtaatgttttctatcagtaaacaagctatactttcttccatcttaaaaataaaatcagtcttctttcccgtgggtaaacaagtaaatctatatattctcctcaaccagatttctcaaaagacttatatgcattcactgggtacattgcctcagttcccacttgctcttcaacctcatagtcatg

SEQ ID NO: 49486 - DNA, 1024 bp, Homo sapiens
atgagacaaacaaagacacaaacaggatgaaaaagctgtattttgaatatcatggccaaagtggctgtgctaacatcagaccaaacagaatttttgacaaaattgttcctagatgtaaataagggcattttataatgataaatgggtcaatgaatcaagatgatatgataaatataccttcacctaaactgaacccccaaatacaaagcttgttatatacactggtattcatactttttttttttaacacaaacactcctttgattgttgcaagagtttaatttttagagttctaaaaatgttgattttgagaattattaccagcattcttattgcttttatggaagaaaatatttttgcaggtctttactcccccttttcaaaaatctcaactcttagcagacttttcaatggatgtaaagaatgtcattctatcaacatgctctgatgcatttattcagtaatctactgatggacatttatttaggttgtttctagtattttgctagcacaaacagaactccagtgatatttttccacatataattttatacaactgtatgagaatagtcatacaagtagaattatttagatcagaggatatatacattttaatatttgatagatatatattagttttctctaaggaagctgtaacaaattacatgcccaccaatttatgagattgaatgtttccacacatttaattttttaaaaaatttattttacaacactgcgtactgacaatatttttaatctttatcaatctgatggtgaacaaaatgtctttttaatttctttttttttttttttggagttagagtctctctgtcatccaggctggagtgcagtagcgcgatcttggctcactgcaacctctgcctcccgagttcaagctattctcttgcctcagcttccgaaatagctggaattacaggctcgcaccaccacactggactaatttttgtattttttgtagagacagggttttgccatgttggccagcctggtctggaactcctgg

SEQ ID NO: 49487 - DNA, 1026 bp, Homo sapiens
cgatccagcaagatgtggtagtagggagggagctaatgccaggggcaaacccagcaggatgacttcaccctcaagacagctttcctcatttgcttttgtcctctgtttcaggtacgtgatatcatacatactttctctactcgtgtgggaggggaggggcagggggcatatacacaacttggaaacaaaacctgttggttcattaaaggggacttttgcatcaagttgagatctccatgctagttgagaaactaggatcaggagacacctgtatttgggtgtggacaagcttgccctctgagagaggacagcctgctccaaattatgttaatctgcagtgtcaaaataggaccaaattgactaattcctgttagggccaagcctagtgatcagggttgagatgtcaggaaagccatttggcctgtgtcttataattcaaaaagggattcaaattcagacttttgacactatcctaaatgaactgataactctagccacaaagccagactgacctgatgtaaatgtttgtcatacagcttaatttagtatatgtaaagaaattaaattatttggcaaatttgatattcctaattgagtattattaaaaaaatatactgaggccaggcacaggggctcgctcatgcctgtaatctcagtactttgggaggccaaggtgggcagatcacgtgaggtcaggagtttgagaccagcttggccaatgtggtgaaaccccatctctactaaaaatacaaaaaaaattaaccaggcgtggtgttgcacgcctgtaattccagctactcagaaggctgaggcacgagaatcacttgcacccatgaggcagagattgcagtgagctgagatcacaccattgcactccagcctgggtgacagaatgagacaatgcctcatagaattaaggacctattctcatgccaccattttcccagaattctgttagaagacttaggggaaaagcagttttctgtaaatagaaaggagaagcatgattcagcagatatcagactg

SEQ ID NO: 49488 - DNA, 1008 bp, Homo sapiens
actcagctctgatccaagcggacctaacagacatcaacagaactctccaccccaaatcaacagaatatacatttttttcagcagcatacgacacttattccaaaattgaccacatagttggaagtaaagctctcctcagcaaatgtaaaagatcagaaattataacaaactgtctctcagacgacagtgcaatcaaactagaactcaggaataagaaactcactcaaaacagctcacctacatggaaactgaacaacctgctcctgaatgactactgggtacataacgaaatgaagtcagaaataaagatgatctttcaaaccaatgagaacaaagacacaacataccagaatcgctgggacacattcaaagcagtgtgtagagggaaacttatagcactaaatgcccacaagagaaagcaggaaagatccaaaattgacaccctaacatcacaattaaaagaactagaaaagcgagagcaaacacactcaaaagctagcagaaggcaagaaataactaaaatcagagcagaactgaaggaaagaggacaaaaaacctttcaaaaaattaatgaatccagtagccggttttttgaaaggatcaacaaaattgatagaccgctatcaagacaaataaggaagaaaagagagaagaatcaaatagatgcaataaaaaatgattaaggggatatcaccatcgatcccacagaaatacaaactaccatcagagaatactacaaacacctctacacaaataaactagaaaatctagaagaaatggataaattccttgacacatacaccttcccaagactaaaccaggaagaagttgaatctctgaatagaccaataacaggttctgaaattgtggcaataatcaatatcttaccaaccaaaaagagtccaggaccagagggattcacagccaaattctaccagaggtacaaggaggaactggtaccattccttctcaaactattccaatcaatagaaaaagagggaatcctcc

SEQ ID NO: 49489 - DNA, 1035 bp, Homo sapiens
tattagtttatattctacatcaaggtagagctttttctccatttatttgtttattaattactttggacacatagatttttactttattttaaaaataccctattgttattatttattttaatacccaaattgtctcagatttagtgactggctgcccattcaagttggctcccctgtcttttgacatgtgtcatcattcttaaacacactttttacttactttaaaatttttttacttccttactttcaagcttgtcttgtacttcctaccccattaatcatttctctatagacctctgttatcttttatggagacagtatttagaaactaagtcattgtatatagctgttttttagcttaacattttgtcattgttttccatttaaaagacaatattgcttatgtgataatgattatttagtgtttgttgaaacttgctttatgtcctagagaacatgatcaactagtgttttatgtgtgcctggaaagattgtgtatctaatttttgcgtgtagtgttctgttcattaaatttaactgtgttgtttaaatcttctctattcctaagttttttgtttgctggacctatcagttaccaagagagttaaaatctcccactgtatttgtgtatttgtcaaattcttacacttttgacaatttttgctttgtatacttgaggcattgttagtatgtacatacaagtctagaatagatacatattttacaattttaggaactctttttatctttttgaatgtaaattttttttgtttgctgggtctttttaattttgtaaaatctttctgggtacctagtagttgtatacatttatggggtatatgagatgttttgatacatgcaaagtgtaataatcacatcatgtacaatggggtatccatcatttcaagcatttatcctttgtgttacagacaatttaattatacagttatattattattgactatagtcaccctgctgtcctatcaaataataggtcttattcattctttttgtatacccgttaaccatccccac

SEQ ID NO: 49490 - DNA, 1056 bp, Homo sapiens
gattatggactccagctccatccatattgctgcagaggacataatttcattgttttctgtggctgcatagtattccatggtgtacatgaaacacattttcttcatccagtctaccactaatgggcacctaggttgatttaatgtctttgctattgtgaatagtacagtagtgaacatacgagtgcttgtgtctttttggtataatgatctatttattatcagttatgtatacagtaatgggattgctggatcaattggtagctctgttttaaaaatttctttgagaaatctaaactgctttccacagtggctgaactaatttacattcacaccagcaatgtatacgtgttcccattgctccacagcctcaccagtagctattgttttttgactttttatagtagccatcctgattggtgtgagattttttttattgtggttttgatttgcacttcacaagactgtactcttttgtcagataggtttttatttgaagccttatcagtaccttagaactctgctgcaccctaatgatatctgtgaggaaagagatattgaaacagctcttgaggggatgctccaagaggaaggcaagacttcaacaactctttttatttttattttatttatttatttttttgagatggagtctcactctgttgcccactctggagtgcagtggcaagatctcagctcactgcaacctccacctcccaggttcaagtgattctcctgcctcagcctccgagtagctgggattacaggtgcacaccactatgcccagataatctcttgtatttttagtagagacgggggtttcaccatgatggccaagctggtttcgaactcctgacctcaagtgatccacctgcctcggcctcccaaagtgctaggattacaggcatgagccaccgtacccagccagcaactattgaatcataaaaatcagaaagcctatgattatttggatgggtgtcctcacagtgaaatagaatgtttatctaatgtgttatctacttgaaggcaaaatgaaatatccagaaatttgaagagact

SEQ ID NO: 49491 - DNA, 1032 bp, Homo sapiens
gaaaatgaggattcctgaaacctaagggaagaaactatctcaagaaagagggtgtggttaacagtgtcaaatatttttataagagaaggatttaaaagcatccattggtgatggggacagaagggaaggaaaaaaaaacattgagtctatcaaaggaggtcctgtattagtgactttggtaagagaagatttattggcatagaagggacagaaaaaagattgtagtggattgaagagtgcatggaggagtgtgaggaagtgggtgaagatagggaagacattgcttccaggaatttgagctgtgatgagtagcaaaaggggaagaaagttataataggaggggaacaaggttaaaggaaccatcttttaagatggaaaagacttaaacttgtttaaatgtcagtaggaaagatcaaataaagaggaatagctgaagagagaggaaaaagtgagtataatgaatagttcgaaggaagtgagattatatgggatccagagcagaggtggaagagtatgccttaggagaggaggagaattgaagggagaaataaacagttccacaataatagttggagacttaaataccttactttcaataatggataagacatgtaaacagaagatcaataaagcgatagtgaacttgaacagcactgtaaaccagtagatctaacagactgtaaagacctaacagcactgtcccatagacctaacaggcatgtatagaacacttcatctaacaacaggaatatacacatttttctcaagtgccatggaacattctccaggataggccatatattaggccacaaaacaagcttcaataaatttaaaaagatgaaagtcatacaatatcttctacaatgacaatggaaggaatctaaaaatcaataacagaggaaaactggaaaatcatataacatttttaataaatggttcaaagaagaaatcttaagggaaattagacaaaattgtgaaataaatgaaaatgaaaacatgccagaacttaagggacacagtaagatcagtgct

SEQ ID NO: 49492 - DNA, 1062 bp, Homo sapiens
tctcgaaaaaaaaaaaaaaaaagaaagaaaaaaagaaaggcagccaggtccaacaggcatctgcacattgttgacccatccagcagaacagggtcgagaaaggcatctgtcgggatggggcaggacaggacgagacagactattgtctgaggcatttggctacctctctgactggaacccaggcactcatatgtgcccaggaatgggtgggatattccggatgggttccacaggtggctctcctagagagacccacttggcatatttgatgatggagcatgcaggctccctggaacgtgatggctcactagttagtacccccggcatcttggtcattctgctgaagtgcatgggtagccaggcccccggcagtgctcagtttctcctgggcccctctgtgttcctgtggtgggtgtggaagtggaggttgaggctagagtgtctttgagggtggtggggcagctgtgccttgatttgatacagagctctctgggctcctcaagctaaactctggtgcttgccagatactcagctcagataatgaatgagacggtggaggacaaattattttgcccctttagggtctccaggcagacatgcaaaagcctggtgcagggccttcatacagagcccatgttgggtgcaaagccatgaccccgttgctctaaaggttgcatgtcctacccataccgcttggtacctggagagcagcatggaacacaatgctctcagaatattgaaaaggttttctgtgtctccactgagggatactcctgcctcaggccctgtggctgcctattgagccatcagcccattctggtgacctgcatgtgccaggacaatgtggtaatctcaaccaggagctccaggtttacataggcccccagtccttgggtaaatccttgtgtaagccagctgggtggctcccactttctcctggaatggcagccctatgatcccagtccacctgtggtgtcccagtggccatgattatgtgtcctttgtcattactttctgcactagaagcagccacaaaacctggagagggccaaaggaagggca

SEQ ID NO: 49493 - DNA, 1029 bp, Homo sapiens
ggttttgtcttgggagaaggtacatgtccaggaacttatccatttcttcaagattttctagtttatttgcatagaagtatttatagtattctctgatggtagtttgtatttctgtgggatcagtggtgatatcccctttatcattttttatcacatctatttgattcttctctcttttcttctttattaggctggctagaggtctatctattttgttgatcttttcaaaaaacgagctcctggattcattgatttttttgatgggtttttcttgtctctgtattcttcagttctgatttgatcctagttatttcttgccttctgctagattttgaatttgtttgcttctgcttctctatttcttttaaatgtgatattaggttgttgattttagatctctcctgctttctcttgtgggcatttagtgctataagtttccctctccacactgctttaaacgcatccctgagattctggtacgttgtgtctttgttctcattcattcaaggaacatatttatttctgcctttatttcgttatttacgcagtagtcattcagatgcaggctgttcagttttcatgtagctgtgcggttttgagtgagattcttaatcctgagttgtaatttgattgcactgtggtcttagagactgttataatttccgttcttttgcatttgctgaggagtgttttacttccaattatttggtcagttttagaataagtgcaatgtgctgctgagaagaatgtatattttgttgatttggggtggagagttctgtagatgtctattaggttcacttggtccagagctgagttcaagtcctggatatccttgttaattttctttctcgttgatctatctaatattgacagtggggtgttaaagtctcccactgtttttgtgtgggaatgtaagtctctttgtaggtctctaagaacttgctttatgaatctgtgtgctcctgtattgagtgcatatatattgaggatagttagctcttcttgttgcattgatttatttaccat

SEQ ID NO: 49494 - DNA, 1047 bp, Homo sapiens
agggagactccgtgggcgtaggaccctctgagccaggtgcgagatataatctcgtggtgcgccgttttttaagcccgtcagaaaagcacagtattcaggtgggagtgacccgattttccaggtgctgtccatcacccctttctttgacttggaaagggaactccctgaccccttgcacttctcaagtgaggcaatgcctcgccctgcttcggctcgcacacgatgcgtgcacccactgacctgcgcccactgtctggcactacctagtgagatgaacccggtacctcagatggaaatgcagaaatcacccgtcttctgcgttgctcacgctgggagctgtagaccagagctgtttctattcggccatcttggctcctcccttaatatgaatttcttaaccgatgtatggtcaaattaacaaatggaaaacaaaacaaatgctgtggaattctgatgatttcctggtaaatattaggtataataactatctgagcctgaaacttgtaggcaataggggctcaaaggacggtaatggcaagatgtgattgtcaatttaaggctaaataaggccagaagaaaacagaatctgaacaatatacctgactttaaaatctttaggatttggagaaggcacaaggttggatcagtaaaaacagttgggaaaaatagtccctcagtgatcagtgttttagggacatactgtgggtactgcatagtttctagatgtcatggtatgaggagataaactttgtaagacaacattaaagtccttcctgtaggtgcccaatgggcctattataaaattctttctgcatcaccttaattcccaaaaaaggtacatagattaggactccagattccaggtggagacagtgaccctcaacaaaatgcattcataaagctgttttagtagagaagatctctgtgggtttataagtacaatacgaactttgatgtgagggacatttaatgtgctagtatagccctggtagtcaccattatgggatgagaccatttaaaattgtgaatatgaaatgataagtgtaa

SEQ ID NO: 49495 - DNA, 1050 bp, Homo sapiens
agactgctagctggactcataaaaaggaagcagagaagattcaaatgaactaaattagaaatgactaaagaagtattaccaataaacactcagaaatattatggttatacaaataacaatcatattattatgaacacctctatgcacacaactaaaaaatcaagaagaaatggaagaattcctggacacatgcaatctcccaaggcaaaagcagaaataaattgaatccatgaacagaacaataaagagctccaaaattgaatcagtaataaatagcctgccaaccaaacaacaacaacaacaacagaaagcccaggatcagaagaatgcacagctgaattccaccagaggtaaaaagaagagctggtaccatttctactgaaaatcttccaaaatattaataaggaaggtctcctccccactgcattctatgaggccagcattatcctgacatcaaaacctagcagaaatacaataacaacaaaagagacaacttcaggccaatatccttcatgaacatcgttgcaaaaatcctgaataaaacaccgataaactaaatcctgcaacacatcaaaaaaatgaatctgccatgatcaagtcagctttttcaagattgcttcaacatatgcaagtcaataaacatgatttatcttataaacagaactaaagacaaaaaccagataatcatctcaatagatacagaaaaggtttttgataaaatttaatatccttcatgttaaaagctctcaacaaactagattttgaaggaacatacctcaaaataatgagagtcacgtatgaaaaactcactaccaacatcatactgaatggggaaaagctagaagcgttcaccttgaaaacccaaatatattggaagtcctggccagagcaatcaggcaagagaaagaaataaacagcatcaaaataagagaaaaggaagtgaaagtatttctgtttgcagaccacatgattctatatctagaaaaccctgtattccctgcccaaaagtttcataattgaaaacaacttcaacaaagctttagaatttga

SEQ ID NO: 49496 - DNA, 1049 bp, Homo sapiens
agtatctgggctggatagtgcagttcctcatggcttcctttggctgggaaagggaagcccctccacccgctccttgcactcccgggtgaggtaattctccaccctgcttctgctcaccctccttgggatgcatccattgcctaacctctctgaatgagataaacagtatacctttgttgggaatgcagaaatcacccaccttctatgttggtctcgctgggagctgcagacccgagctgttaatgttcggccatcctgcaatatcccccccacattttctttatacattcatttattgatggatatttaggttgcttccacattttggctgttgtgaacaatgctgcagtaaacatgggaatgcagatatctttttagtatactgatgtcctttctttggggatataaacccagccatgagattactggtttgtatggtaacctatttttagtattttaagaaatctccaaactgttctccatagtggttttactggtttacattcctatcaacagtgtatgagttctctcttctctccacattctcaccagcatttgttattgcctgtcttttgtatataagccattttaagtggagtgagatagtatctcattgtagttttgacttgcatttctctgaagattaatgatgcttgacatcttttcatatgcctgtttgccatttgtgtgtcttcttttgagaaatgtctattcaaatattttgctcatttaaaaattatattattatattctttcctatatgattgtttgagctccttatatattgtgattattaatcccttgtcagatgtgtaatttgcaaatattttccaccactctcagggttgtctcttcaattttttattttttttcgctgctgtgcagaagctttttaacttgatgtgatcccatttgtccatttttgttctggttggctatgcttgtagggtattacacaaatattttcatgcagaccaatgtcctggagaatttccccaaagttttcttctagtagttttatagtttgaggtctcattgaagtctttagt

SEQ ID NO: 49497 - DNA, 1053 bp, Homo sapiens
gttttccaagctttcagagttgttttcttcctcaggaataccgattattcttaggtttggttgtttaacataatccaaaacttcttggaggctttgtttatattttcttattcttttttctttgtctttgttggattgggttaattcaaagactttgtcttcaagctctgaatttctttcttctacttgttcaattctattgctgagactttccagagcatcacacatttctaaaagtgtgtccaatgtttcctgaatttttaattttttttttctttaagctatctatttcattggatatttctcccttcactttttgtattattttttggacttacttgcattgggctttgccttactttgatctctccctgattagcttaataactgacctcctgctttctttttcaggtaaatcagagatttcttcttggtttggatccattgctggtgaactcgggtcggggggtgttgaggagccttgttttgtcatattaccagggttggttttctgcttccttctcatttgggtagactctgtcagagggaaggtctagggctgaaggctgttgttcatattatattttcccacaggctgttccctttatgtagtactctcccccttttcgtgtggatgtggcttcctgtgaactgaactgcagtgattgttgtctctcttctgggtctagccacccagtgagtctacctggctctgggctggtactgggggttatctgcacagagtcctgtgatattaactgtctatgggtctctcagtcatggataccagtgcctgttccagtggaggtgacacaaggggcaatggactccatgggggtcctcagttttggtggtataatggcctatttttgtgctggttggcctcctaccaggaggtggcactttccagaaaacatcagctgtagtagtgtggagagggactggtggtggatagggccctacaactcccaaggttatatgtcctttgtctcctgccaccagggtgggtagggaaggaccattgggtgggggcagggccgtgtctgagctcag

SEQ ID NO: 49498 - DNA, 1045 bp, Homo sapiens
gatgtacaaattgttcacccaactattgagtatagtacctgatatgcatttttttaatcctcatcctccttccacccctcaccctcacgtaaactatggtgtctattgtttccttttttgtgtacacgtgtattcaatatttagttcccatttatatgcagtgttaggttttctgtttctgtgttaatttgtttaagataataacctccagttgtatccatttcactgaaaataaggttatttcattttctaaaaaaattacttccaaccatggtgatgggattattttgtttttctttatgcctgcatagtattccatggtgtataagtacaacattttctttatctagtacaccattgataggcatttaggttgattccatgtctttgctattgcaaatagtgctctattttttggaatagtttcagtggcaatggtaccaggtcttctttatattttggtagaattcggatgtgaatccatctgcaggaaagtctggtccagggctctttctggttggtaggtttttcattattgatttattactgatgttcattattgatcatatttctcatttgtttatgaagattagtttggccggatataaaattcttggttgaaattatctttaagaatgatgaatatgggctccaatctcttctgacttgtacagattctcctgaagaatttgcaagtttcttgatggggttttcttttgtgagcaacctgtcccttctctgcagctcttttatatatatatatatttcattgaccttggggaatctgatttctatgtgtcttggaaatggtcatcttgcaggggttctttgtattttctcaatttgaatgtgaacttttctagtatgcttcagaaaattttcatagacaatatgcttaaatatgttttccaagttgctttttgtctctgtgtctctttcaggaatgccaattctttgtaggtctggtctctacataattctatatttcttggaggtattgtttattttaaaaagaattaaaatttctttctgatagagttgattt

SEQ ID NO: 49499 - DNA, 1096 bp, Homo sapiens
atatatttgaaacaaaaatggaaatgcaatgtagtaaaacttgttggttacagcaaaaggagtgttaagagagaagtatatggtaataaaggcttacgtccaaaaaaagtacaaagattacaaagtaacaatttaatgatgcatattaagcaactagaaaagcctgaactaatcaagattacatttagcagaagaaaagaaatagcaaatattaaaacagagctaaatgaagttgaggctaaaaacataatacaaagaatcaatgaaatttgaagttggacagataaagaaaattgatcaactgtgagctaagctaacaaaaaaggaagaagacccaaataaacactgaaatgacaaaggaaacattgaaatttataccacagatataaaaaaagattattggagactattatgaaaactgtatgcttagaatctagaaaacctatcagaaacagatacatttctggaaacataaaatctattgagattgattcaggaagaaatagaaaatctgagcagacaacgaatgagtaatgagcctgaggctgctatagagtctcaaaacaaaaacaagccaagaatggattattcacagctgaattctaccaaataaataaagaactataccaatcatactgatattattccaaaaacttgaaaaggagtgaattaattccaacttcatcaaggccaggatcactctgataccaaaacaaaataaggaagcaaatatatgtgtgtgtgtatatatatatatatacatatatatatgtgtatatatatatatatacacatatatatatgtgtatatatatgcacatatatatatatgtgtatatatatgcacatatatatatatgtgtatatatatgcacatatatatacacatatatatatatgccaatatttttaatatagctagacacaaatatcttcaacaaaatactagcaaagttgaatctaacaacatgtcaaatagaccacatactatgattaagtgggtgttataccagggatgtaaaaatggttcgacataggcaaataagtaaatgtgatatatcacatcaacagaatcaagaacaaaaaccttgttatc

SEQ ID NO: 49500 - DNA, 1029 bp, Homo sapiens
agttattaagcttcagttttctagcttttaactgattataacaatgcacacacatacctgacacactgttaaattttcttctcttcctgtttcttatgttaaggaaagatactctgtgttttggcatatgttggtgaatttgtaccatttttatcctctcagtccttccttttataagacaataattggagtagtttaatcttattcatgtgcagataaaagaggtttatgaagtttagggtgaagtaggcaagggaatctgtttactccctcttccctctactgaataattttccctctactgaataattttccctctaagaattgctgtgggtaataccaggagtggggacattgcccacatgcataagagcgtatctctccattcgatcagtttgtcaccatctttgctctgttttgaaagtcaggcttctctgtgactgtgaagcctgctgttccctgaaaatctgataatggagcagtggaggtttttttctttctgtgctctgtagatctcattgtttgcacttgtaatttcccagagttgaaaggaaagattgaactggaatattgtgtaaactatctgtcttacattagtgtagcattttgcaatttggggaacatcttcacaatttgtgtctcgttgttcagaacaaccctgtgaagtagttttggcaatgtctgtgttacatttcatgtaatttagccaactcccattccaactaggctttggctaaatctgacaattttatatatagcttaaaacaaagaatatacattcttttcacccctcccagtctacccatccagccttcatgattcattcctgtgtcaaggttagtcgctgttttccatttgaattggtttcttttatggtcagtttactttcttccctctcccctccctttcctgcacatccccatccttgctatgcctttctgtcctcttttataatggatatatctttttcctgccattatccctcagacattctcctcatggcacattttcttcaaatgctaacattta

SEQ ID NO: 49501 - DNA, 1023 bp, Homo sapiens
agaggaagagagactgagtattcatgtaacagttttctcacagctgaacactgaatgcagaataggaattagtgaaatctatttgattcttagtaatctgtgctaacaggggagtataagcttagaaaaaaataaaaacttttgattttgaaagataattttatatttacatttgaatacaaatgtttctaatctagatagccctgaaactcagttaactaaaggctatggaatacaataacttggctcctgaattttctaattactaaggattaatttaagtatgtaatgaaactgaagcagaaatgctttgtgtaagatgtccaaaattttaggttgtactttacacataatttgtttgtgaaccactgacccagttgtgtgtgtcttgattaaggatttttggttgtacataataaaggtgtacttcaaactagcttaaagaaaaaaagagtttattttaagtataagaggaaaaagaaagtgcagaaagtgtagtctaggtgcatgagagacttcaactaggttgaccagctgtccatagctaagggaattttcctccctctttctcttctccttcaacacccctggggctatagggtcttctgtttatctttgtttctttcagtgtatctacttcattattctcacttaatcagcacacagccaaacctggtttattcaagagatcccaagtttacatattctaaattcaggcaatcagaagagactcaatatctacgaattccaattctcaattctgattgacataggttgggctatatgtccagccaggatctgattatccatggctagaggggcaagatcatgtcatataaatatggttattaggccccaaccctaagtgaagggacatacaattcccagagaagggaagattgtgggctaaacagaatctcaagtagtgtctaccacgaagtataaactgtggtgcatggaataaactatatgaagacacatgtatgtttcttaaaaaaaagcaaagtagagcacatttgccat

SEQ ID NO: 49502 - DNA, 1559 bp, Homo sapiens
aacagctgccccattttgtgcttgaaacccaggtttctggtggtgtaggcacccaaaggaatctcctggtctgcaggttgcaaaaaccgtgggaaaagtgtagtatctgggctggatagccccattcctcacagcacagtctcgcacagcttccgtttcctaggggagggagttcaccggcaccttgagcttcctgggtgatgtgagtccctactctacttccgcttgccctctgtgggctgcacccactgtctaaccagtcccagtgagatgaaccgtgtacctcagttggaaatgaagaaatcaccctccttctgtgttggtctcgctgggagctgcagactgcagctgttcctattcagccatcttgccagatcccatttctgattttatttatttgtattttcactctttctcttagtctggctaaaggtttttaaattttgtttaatttttcaaaaaaccaactttttgtttcattgatcttttttttttatttcaattgcattcatttctgctctgatcttcattatttcttttcttctactaatttgcatttggtttgcgcttgcttttgtagttctttatgatgcatcattggaatgttcatttgaagtttattctcttttttgatgtaggcattggaactatgaacttccctcttggtattgcttttgctgtatcccttgagttttggtatgttatattctattatcatttgtttcaagacatttttcaattttttttcttaatttcttcattgaccactggtcattcagtggccttgtttaatttccatctatttgtgtaatttccaaaatttctcttgttattgatttctagttttccattgtggtcagagaagatacttgatgttacttttttttttttttttttttagtgttttaaaacttgttttgtgaacagatcagtgtgtcttgcttttttcttttttattcattcagctaggttattttcattggagagttttgtccctttacattcaatgttattactgataagtaagaactcctgccattttgttgttttctggtcttctcttgcttctttgcttcctgtcttcgtttagtgaaggttcttttctctggtgatatgatttactttgttgctttttattttttgtgtatcctttgtgtgatttttggtttgaggttacaatgaggcttggaaatattgtcttataattcattattttaaccttataacttaacactctgcataaaaaaacaaacaagcaaaaaggaaactaacaaaaactctatgccttaactttgtccctctgctttttaactttatgctgcttctattgatatcttattgtactgtccgtgtcttaaaagttgttggagttattattttcgatttgttcatcgttcattctttctacttaatataagagtagtttacatatcactgtgacagtgttataatattctgtgtttttctgtgtacttaatattaccagcaaattttgtaccttcagttgattatgtattgctaattagcatctttttctttctggttgaagtgtgccgttt

SEQ ID NO: 49503 - DNA, 1035 bp, Homo sapiens
agaataaaaacagacacacagaccgatggaacagaatagagaacccagaattaaatccacaatcttacactgaactcattttcaacaaagatgctaagaacatacactggggaaaagacagtctcttccattaatggtgctgggaaaaccggatatccatatgcagaagaatgaaactagacccctactcttgccatatacaaaaatcaaattgaaatggatgaaagacttaaatctaagacctcaaaatatgaaattattacaagaaaacattggagaaaatctgcaggacattggtctgggcaaagattttttgagcagtactccacaagcacaggcagccaaagcgaaaacaaacaaatgatcacatcaaattaaaaagcttctgcactgcaaaggatacaaccaacaaagtgaagagacaatccacaggatgggagaaaatattttcaatgtatgaatctgacaagggattaataagcagaatatataaggagctcaaacaactctacagaaaaaaatataataatctgatcaaaaaatgggcaaaatattttaataggcatttcttaaaagaagacatacaaatggcaaagaggcatatgataagttgctcaacgtcattgatcatcagagaaatacaaataaaaactacaatgagatatcatctcaccccagttaaaatggcttatatttaaatgacagagaataactaatggtcgtgagggtgtgaagaaaaggcaacccttgtacactgttggtgggaacataagttattacaaccactatgcagaatagtttggaggctcctcacaaaactgaaaattgagctactatgcgatccagcagccccattgctgggtatatacccaaataatggaagtctgtatatttaagtgatagttgcactctcgtgtttcttgcagcattttgcacaataactaagagttggaagcaacctaagtgtccatcaatagatgaagggataaagaaaacatggtacttagatacaacggagtattattcagccataaa

SEQ ID NO: 49504 - DNA, 1101 bp, Homo sapiens
aataataacttaagtgtacatttaaaaataactaaaagagagtaattggactgtttgtaacacaaagaataaatacttgaggagatggatgccctattctctttgatgtgattacttgacattgcatgcctgtttcaaaacatctcatttatcccataaacatatatacctactatgtactcacaaaaattaaaaataaaaaaaaattcaaaaatgtgaaaccaaatcaccatggttttgtggtattttgtttttattcttaagatttagaggctgggtgtaatggctcacacctatattaccccagtttgtgtggccgaggctgaaggattacttgaggccaggggttgaagaccagcctgggcaacatggtaagaccccatctctacaaaaaataaaaaattagccaggcctggtttgaagcactggtaatcccagctactcggaagtataagatgggaggatctctagagcccaggtgttcaaagttacagtgagctatgattgtgccatttcacttcagtatgggctataccctgtctcgaaaaaagaaaaaaaaaaaagattttgaaagaatcacatatttagggatacgttggacatgtagtacaaagaactttttaaaactaccatttgagagtcagttgctgacctgattcattatcacccttgaatattttaatacatatttcccacaaacaaggacattctcctacatgatcacagagcatacagcaaagtaacaatgatatcagatattagatattagataacaatctaatcctcagatcttaattcacattctaccaattgtgctaataatgtcttttttttttttttttggaacacggatcacttcaaaatcatgtgttacatttatctgtcatgtctttttggtatccttcagttggtacagtttcctgctctttctttgccttctatgaccttggcacttttgaagattacacacacagtatttacatctatatttatttttatctataaatattaaaaaccatgaattctaaagccagtcctatatcacaggatttgttcttgttttctctttttctttgtaacaataagaaacctgacttctat

SEQ ID NO: 49505 - DNA, 1086 bp, Homo sapiens
taaagcatgtctgcagcatgaagacatatggtggttgccttgaggaaaaaacacttgtgtgtttgagttgcaagccaatgtagccattttacttatggaattgaacctaaaggaacaattaacagataaactagttatgcagacttaggcattttgcaggcatttttttctcaaaaatgaatgaagtgagcttttcatgtcaagacaaactgagaatatttattaccagtgataaaatttgagcttttaaatgaaaattacaattttgggaaactttaatctatcactatgagcttgacagcttctaaatacttaaaagctgttctgatgaaatcaatggtgatgttaagtcaaatgtttttattttgttagattacaaaatggatctgtattaggaaaatctgcatagctcagtggatcaatacagatgaccaaaccatgatgttacagaatcatgagtttaaaagatgcattcaaagtgtaagacaaacacttctgatttatggtctggcatgtaaagagcttggaagttgtaatttgatcctgacaatagataaaaagctgaacagactgaaaaacaacaactcttcatagatctgtcagataattgaggtcttgaggcaaattactggccccaaattggaaagagagagaggcaaattcagaggatcatgtcttaccagtacagaaacccacaagcagaaacctctgtaggaaccagtactgggtgaggaaaacctgaacaaagaactctgcttggttcttacaatgaagatcaaagagaaatacctgtgtgcttctagcagtgggaggagaaaagtaggtagccctttggaaatatgtcagagcattctgttattcttaacaagtgttctgaagagcaactgttttaccagagcctaacttattggggttttatgagtttaactggagggaaggacattacccaattccagtgccttctagccatcctgtttcacctaaggggaggatgaaattgtgcagcatttgcaaagttcacagtgcagggggccatgctcattaaaagactgagctctaaatcataggactgtagaattcttcccc

SEQ ID NO: 49506 - DNA, 1074 bp, Homo sapiens
ttgaagagacaaagcaagcatcagcaccatagttagatatggcagaaatattataattatcagaccagcaattaaaaataactgtgattgtgaatagtgttgcaataaacatacacgtgcatgtatctttgtaatcgaattatatatattacttgggcacagggagggaaacaacacacactggggcctgtcgggagatggggtggggggagggagagcattagaaaaatagctaatgcatgctgggcttaatacttaggtgatgggttaatgatgcagctaaccactatggcacacgtttacctatgtaacaaacctgcacgtcctgcacatgtaccccagaactaaaaataaaaacaaattaaaaaacgatgattaatatgctaaggattctaatggaaaaatagacaacatgtaagaatagattagtaatgtaagcagagacatggaaattctaagaatcaaaaagaaaggctggatagaaatgaagaatgcttttaatgggcctgttaatagactgggtattgttgagaaaagacattctgagcttgaggatatatcagtagaaaactgcaaaactgaaaagcaaaaagaagaaacattgaagaaaatggggcagagaatcattttttggccttttggctaagaaagatcaagttaaaatggaatagagtatccaagaattttgccacaactacacaagtgagacattgaagagatttgtaaaagtgtaaaacagtaccacttttctctctaaattttttttgtaaaaaataatcgtttttatattaacatgtaaagggcttattgttattgaaaatatattaataactaaaaattgatccattataatatggttactattggtagaattcacataaacaaaagttctgtggagtcctataaacttttcaagagtgtaaggggatcctgagaccaaaaagattgagaactattatactataccatgttgccttatgcatcctactagccatccaacccagatttggcaatcatgcctcctttgtccataagttgttaaaattttttagaagaaaaggacaaaagtggagc

SEQ ID NO: 49507 - DNA, 1050 bp, Homo sapiens
ttatgttatttcctgattttggcattagggtgatactggcttcctagaatgatttagggaggattccctctttctctgtgttttggaatagtgtcaataagattgttatcagttctccattgaatatctcatagaattcagctctgaatttgtctggtcctggacttttttttcttggcaatttttaaattaccatttcaatcttgctgcttgttattggcttgtttagagattctataccttcttagtttaatctaggagggttgtgtattttcagaaatttatccatatcctctggattttctagtatttgcatgtaaaggtgttaatagtagccttcaaaaatcttttatatttctgttgtatcagttttaatatctcccatttcatatcttattgaccttatttggattttctctcctcttttcttggttaatctcattaatggtctatcaatttttttatcttatcaaagaaccagctttttgtttcatttatcttttgtaatttttttgttttaatttcatttatttctgctctgatcttcattatttcttttcttctgctggctttgggtttggatttttcttgtttctccaattttttgaggtgtgaccttagattgtttgtttgtgctctttcagactttttgatgtaggcatttaatgctatgaactttcctcatagcaccacttttgctgtaacccagaggttttggtaagttgtgacactattatcattcagttcaaagaattttaaaatttttgtcttgatttcattgttaaaccaatgattgttcagaagcaggttatttaatttccatgtatttgctttatttgcatggttttggaagttccttttggagttgattttcaattttattccactgtgttctaagagagttcttgatattactttgattttcttaatgtactgagacttgtttatggactatcttatatcttgaagaatgttccatgtgctgatgaatagaatgtatatttgggtagaatgttctgtaattatctgttaagtccatttgttgtagag

SEQ ID NO: 49508 - DNA, 1023 bp, Homo sapiens
aaggaggctttgaactggggaaaaagggcagcaatgaggtgtggctgtagcctaggaatagtcagggaagcagataatttagttaaaatgtctctacctaataagggagctggacaggtggggataactaagaaggagtgcataaaacaatgttgtccaagttcgcatcagagttggggaggtttagaagcctggctgtcaatacccacaacagttatggaggcaagggaaacaggcccttgaaaagaaggtaatgtggagtggatagcctccgtagtgattaagaaggggacggacttaccctccactgtaagagttacccaaagtgtctgtgatggtctaggaggcttccgaggtgattgggcagcgtcagtcttcagccgttaagctgagaagatctgggaaggagtcagagagccttgggccagagttccaggggctctgggagtggctgccgggtgagttggacagtccgatttccagtggggtcctgtacagatgggacatggcttaggaagaattccaggctgtaggcattccttgtcccagtgccagatttctggcacttgaagcaagatcctcgggcaggcagtcctggaggaatgcgtggccactgtggttcaggcgtttggaagttcttgtgtgctggagatgtggctggggtttgtctcacagtggaggcaaggaattgcaactcagaaatacattgctacttggctgcctctactctattattgtacaccttgaaggtgaggctaattaagtcctgttgtggggtttgagggccggaatttaatttttggagctttttctaatgtcgggagtggattgggtaataaaatgcacaccgagaataagatggccttctggcccttctgggtctagggtggtaaagcgtctaagggttgttgccaaatgggccatgaactgggttgagtttttatatttgatgaaaaagagcctgaacactatctgatttgggagaggtcggataaagaaaaagggacatcgaccttggctatg

SEQ ID NO: 49509 - DNA, 1049 bp, Homo sapiens
agatgtagaaaaagcgtttgataaatttcaacatctctttatgctaaaaactctcaataaactaggtattgatggaacatatctcaaaataataagaggtatttatgtcaaatccatagccaatatcatactgaatggacaaaacctggaagcatttcttttgaaaactggcacaagacaataggaagagaggaattcaaattgtctctgtttgaagatgacatgattgtatatttagaaaaccccatcatctcagccgaaaatctccttaagctgataagaaacttcagcaaagtctcaggatacagaatcaatgtgcaaaaatcacaagcatttctatacaccaataatagacaaacagagagccaaatcatgagtaaactgccattcagaattgctacaaacagcataaaatactaggaatacaacttagaagttacgtgtaggacctcttcaagcagaactacaaaacactgctcaaggaaataagagaggacccaaagaagttgaaaaaaaatttaggaagaatcaagatcatgaaaatggacatagtaatcaaagtaatttatagattcaatgctgtttccatcaagctaccattgactttcttcacagaattaccagaaactacttcaaatttcatatggaaccaaaaaacgagtccatggagccaagacaatctcaagctaaaagaacaaaactggaggcaccacgctacctgacttcaaactatactacaaacctacagtaaccaaaacagcatggtactggtaccaaaacagacacataggccaatggaacataacagaggcctcagaaataacaccacacatctacaatgatttggtcttcgaaaaacctgacaaaaacaagcaatgggaaaaggattttctatttaattaatggtgctgggaaaactggctagctatatgcagaaaactgaaactggaccccctttttataccttatgcaaaaaattaactcaagatgatttaaatagttaaatataaatcctaaaattataaaatccctagaagaaaacctaggca

SEQ ID NO: 49510 - DNA, 1075 bp, Homo sapiens
gaaaaaaagctcaccatcactggtcattagagaaatgcaaatcaaaaccacaatgagataccatctcagaccagttagaatggtgatcattcaaaagttaggaaacaacagatgctggagaggatgtgaagaaatagtaatgcttttacactgttagtgggagtgtaaattacttcaaccattgtggaagacagtgtggcgattcctcaaggatctagaaccagaaataccatatgacccagcaatctcattactgtgtatatacccaaaggattataaatcgttctactataatgaaatatgtgcacgtatgtctattgcagcactgtgtacaatagcaaagacttggaaccaacccaaatgcccatctatgatagactggataaagaaaatgtggcacatgtaaaccatggaatactgtgcaaccatcaaaaagaatgagttcatgtcttttgcctggacatggatgaagctggaagtcattattctcaacaaagtaaaacaggaacagaaagccaaacactgctcagtctcactcattagtgggagttgaacaatgagaacacatggacacagggagggaaacatcacacactagtgcctgttgggaggtgggggcaaggggagggagagcattaggacaaatacctaatgcatgcgtggcttaaaacctagatgatgggttgataggtgtagcaaaccaccatagcacatgtttacctatgtaacaaacctgcacgttctgcacatgtatcccagaacttaaagtgaattaattaaaaaataaataaataaataaaaataaaatggcggtgcttgtccaaggtcatgatgctcctgctctgtcagtaccattctgtacataggccatggcaaagatttcatgatgaagacaccaaaagcaattgtaacaaaaaaattaagaaatatgatccaattaaactaaagagcttctgcacagcaaagaagctatcaatagatagacaacctacagaattgaagaaaatatttgcaatgtgtgcattcacaagggtctaatatccagaatctttaaggaactttgtcagtttcacaa

SEQ ID NO: 49511 - DNA, 1026 bp, Homo sapiens
ctctgtctttttaatggagagtttaatcaagttccatttgatgttattattgatgagtaagggtttacttctgctattttgttatttgttttctggttgatttgtggtcttctttcttttctttcttcctacctgtctccttttcagtggaggtgattttctgtggtgttatgctttaatttcttactttttacattttgcatatctttgtgggttttttgatttgaggtaaccatgaagcttgcaaatacctgtaacccattattttaaattgatgacaaattggcactgattgtataaaccaacaaacaagcgaagagaacactaataaaaactctacactttaacttcataccctgctttttaactttttgttgtttctatgtatatcttattgtactatctatgtatatcttattgtactatctatgtcttgaaaagatattgtattttgttaggattccatcaggctggtggaaaaaatattaaagatagttatagtaatagtcaaaagctctcttggaatgcctgagagtttgcatagcttcagattgcttggctgaaagcagccagggtctgtttgcaggagccagaaagattaggttgcaagtacaaaggaatgtgggaagtctaccttactaacatgtttacttatatgggcttaagactaacacctttgtcctactgagttactttactgcctcctactcagggagttggcagaagtttattgcccccaaatgctgtttgctttaggcctggaacctggcctttaatctttactctctagtggtgtttactcacaacttttgttaattagtcttactgaataaatgcaagcctcactttttgatgagggccaagtcgaactgtttacagaactcagcttggagcctgtaagtggctcagaccctcagctagactggcagagcagaatatctgtgtgtcagcggactttactcatccgtcgctgaatcaagggcctgcaggaacagccccttccccccaccccccgcagctagtgcc

SEQ ID NO: 49512 - DNA, 1125 bp, Homo sapiens
cccgcatagccaaagcaagactaagtaaaaagaacaaatctggaggtatcacagtacctgactttaagctgtagtataaggtcatagtcaccaaaacagcaaggtactggcataaaaataggcacataaaacaatggaacagaatagagaacacagaaataaagccaaacacttacagccaactgatctttgacaaagcaacaaaaacataaagtagggaaaggacaccctattcaacaaatggtgcttggataattggcaagccacatgtagaagaatgaaacggatcctcatctctcaccttatacaaaaaatcaattcaagatggattaaggatttaaatgtaagacctgaaactataaagattctagaaggtaacatcagaaaaatccttctggacattggcttaggcaaagacttcatgaccaagaacccaaaatcaaacacaacaaaaataaaataaatagataggacttaattaaactaaaaagcttctgcacagcaacagaaacaatcagcagagttaacagacaacccgcagagtgggaaaaaatctttgcaatctgtacatctgacaaaggactaatatctacaatctacaaggaactcaaagaaattaacaagaaaaacaatcccatcaaaaagtgggctaaggacatgaagagacaatttgcaaaagaagatatagcagtggccaacaaatacatgaagaaatactcaacaacactaattatcagggaaatgcaaatcaaaaccacagtatgataccaccttactcccgcaagaatggccataatcaaaaaatcaaaaaaaaaaataatattggtgtggatgtggtgaaaagggaacacttttacactgctggtgggaatgagaactaatacagccattatggaaatcagtatggggattccttcaagaactaaaagtagaactatcatttgatccagcaatctcactactgggtttctacttagaaaaaaagaagtcattatacaaaaaaggtacttgcacacacatgtttataggagcacatatatgtgtgtgtgtgtgtatatatacacacacacacacacacacacatacacacaccgtggtctactactcacccataaaaaggaataa

SEQ ID NO: 49513 - DNA, 1047 bp, Homo sapiens
ttttgtatccagcaaaactaaacttcataaatgaaggaaagatacagtccttttcaaaaaatgctgacagaattcaccattatgaagccagcactgcagaacctgctaaaaggagctctaaatttggaaacaaatcatcaaaatacaccaaaacagaatttccctaaagcataaatttcacagtacctataaaacaactacacaatgaaaaaaacccaaggtgctgagacagcaaatagcataatgaatagaataagacctcacatctcaatactaacattgaatgtaaatggcctaaatgcttcacttaaaagatacagaatggccgaatggataagaacccacaaaccaaatatctgctgtcttcaagagactcacctgacacataaggactcacataaatttaaagaggtggaaaagatattttatgcaaatggacaccaaaagggagcaggagtagctattcttatatcagacaaaacaaagttttaagcaacagcagataaaaaagacatagagggacattatgtattgataaaaggactagttcagcaggaaactatcacaatcctaaatatatatgcacctaacgctggaactcccaagtttataaaacaattactactagacataagaaatgtgatagacaacaacaaaataatagtgtgggtcttcagtatgccactgatagcagtagacaggttatcaagacagaaagtaaacaaaggaacaatagacttaaattataccctagaaaaaatggactaaacagatagtgcagaacattctacccaacaactgcagaatatacattctaatcatcagcacatggaacattctccaagacagaccatatgataggccacaaaacaagtttcagtacatttaaggaaaatgaaattatatcaagtactctttcagaccacagtggaataaaattgaaaatcaattccaaaaggaaccctcaataccatgcaaatacatggaaattaaataacctacccttgaatgatccttgggtcaacaataaaatcaagatggaaattt

SEQ ID NO: 49514 - DNA, 1667 bp, Homo sapiens
atcacattacctgacttcaaactatagtataaggttatagtcaccaaaacagcatggtactggtataaaaataggcacatagaccaatggaacagaatagagaacccagaaataaagccaaatacttacagccaactgatctttgacaaagcaaacataaacataaagtagggaaaggacaccctattcaacaaatggtattgggtaattggcaagccacaggtagaagaatgaaactgaatcctaatctctcaatttatacaaaaatcaacttggccaggcattatggatcactgcagatcactgcactccagcctatgtgatagagggagacgccgtcttaaaaaaaaaaaaaatcaactcaacacggctgaaggaattaaatctaagatctgaaactgtaaaaattctgggagataacatcagaaaaaccattttaggcattggcttaggcaaagacttcatgaccaagaacccaaaagtaaatgcaacaaagacagataaatagatgggacttaattaaattgaaaagcttcagcacagcaaaagaaataatcagcaaagttaatagacaacccacagagtgggagaaagtttttgtagtctatacatctaacaatcaatgctcagactctacaaagaactcaaacaaattagcaagaagtaaacaaacaatactatcaaaaagtgggctaaagacatgaagagacagttttcaaaagaagatatagaaatggccaacaaacatatgaagaaatgctcaacatcactaatgatcagggaaatgcaaatcaaaaccacaatgtgataccatcctattccttcaagatcggccataatcacaaaatcaaaaagtactagatgttattgtgacatggatatgatgatgagggaatgtaaactcatacaaccactatggaaaacagagtggaaattccttaaagaactaaaagtagatctaccatttgatccagcaatcccactcctgggtatcgaccgagaggaaaagaagtcattatatgaaaaagatatttgcacatgcatatttatagcagcacaattcacaattgcaaaaatatggaaccagaccaaatgcccatcagtcaatgaaggtgtaaagaaactgtggtatttatatacaatggaatattactctgccataaaaaggaatgaaagagtggaattcacagcatcctggatggaattgcagattattattttaagtgaagtaaatcaagaatggaaaaccaaacatcatatgttctcataagggagagctaagctatgaggatgcaaagacataggaatgatacaattgcctttgagtactcgggaaagggtctgaagatagggataaaaaactatgagttgggtacagtctacactgcttgggtgatgggttccccaaaatctctgaaatcgggggagggagccaagatggccgaataggaacaggtctggtctacagctcccagcatgagcaacgcagaagatgtgtgacttctgcatttccatctgaagtaccgggttcatctcactagggagtgccagacagtgggcgcaggacagtgggtgcagtgcaccgtgcatgagccaaagcagggcgaggcattgcctcactcgggaagcacaaggggtcggggagttccctttcctagtcaaagaaa

SEQ ID NO: 49515 - DNA, 1046 bp, Homo sapiens
catcatcaaagaccaacagtagataaaaccacaaagacggggaaaaaacagagcagaaaaactggaaactctaaaaagcagagcgtctctcctcctccaaaggaacgcagttcctcaccagcaatggagcaaagctggacggagaatgactttgacgagttgagagaagaaggcttcagacgatcaaactactccaagctacagaaggaaattcaaaccaaaggcaaagaagttaaaaactttgaaaaaaatttagacaaatgtataactagaataaccaatacagagaagtccttaaaggaggtgatggagctgaaagccaaggctcgagaactacatgaagaatgcagaagcctcaggagccgatgtgatcaactggaagaaagggtatcagtcatggaagatgaaatgaatgaaatgaagtgagaagggaagtttagagaaaaaagaacaaaaagaaacgaacaaagcctccaagaaatatgggactttgtgaaaagaccaaatctacgtctgattggtgtaactgaaagtgacgggtagaatggaaccaagttggaaaacactctgcaggatattatccaggagaacttccccaatctagcaaggaaggccaacattcagattcaggaaatacagagaacgccacaaagatgctcctcaagaagagcaactccaagacacataattgtcagattcaccaaagatgaaatgaaggaaaaaatgttaagggcagccagagagaaaggtcgggttacccacaaagggaagcccatcagactaagaggagatctctcggcagaaaatctacaagccagaagagagtgggggccaatattcaacattcttaaaagaattttcaacccagaatttcatatccagccaaactaagcttcataagtgaaggagaaataaaatcctttacagacaagcaaatgctgagagattttgtcaccaccaggcctgccctaaaagagcgcctgaaggaagcaataaacatggaaaggaacaaccggtaccagccactgcaaaatcatgccaaattg

SEQ ID NO: 49516 - DNA, 1048 bp, Homo sapiens
cagagcagaattttattgagcaacagaaggaaagctctcagctctgagagtggacctgaaagcatgcagtagtctttgaaggtgagtctagcatttttatgggtttagaatggaggaatgcctgctgattggtttatggttggactttggaaaaaacaccattttattttgtaaaaggtatctatcagaaggaaataaacaagagagagaggctaagacagggatagaagttttcactctgattgtgggctctatctggaacaggcagctcagatttcaggctttcaactctctttgatttgaaggtcaagtttcacgagggacctgttcctgtctgcctcagaatttctctgtttcctgtggctatcagtcactgatgtttagcttttttttcatatgtttcttagccacatgaatgttttattttgagaagggtttgtccatgttttttacccacttttaaatggggttgtttttttcttttatatttgtttaaattccttttagaatctagatattagactgttgtcagatggacagatagcaaaaattttctctttctctgtaggttgtctattcactctgatgatagtttcttttgctgtgcagaagctctttcacttaactaggtcccatttgtcaatttttgcttttattgcaattgcttttggcatttttataatgaaatctttgcccatgcctatttcctgaatggtatttcctagattttcttctggatttttatagttttgggttttacatttaagtctttactccatcttgagttaatttttgtataagatgttaggaaggcttacaatttcaattttctgcatatggctagccaattctcccaacactatttattaaataggggattgtcttcccattgctcattttcgtcaggtttgtcatagatcagatggttgtaggtgtgttgttttatttctgagttctctattatcttccattagtctatgtgtctgtttttgtaccagtaccatgttgttttgcttactgtagccttggagtatagtttgattttggg

SEQ ID NO: 49517 - DNA, 1039 bp, Homo sapiens
tatgatattggctgtgggtttgtcataaatagatcttattattttgagatacttcccatcagttcctaatttattgagagttgttagcatgaagggctgttgaattttgtcaaaggccttttctgcatctattgagataatcatgtggtttttgtctttggttctgtttatatgctggattacatttattgatttgtgtatgttgaaccagccttgcatcccagggatgaagcccacttgatcatggtggataagctttttgatgtgctgctggatttggtttgccagtattttattgaggatttttgcatcaatgttcatcagggatattgttctaaaattctctctttttgttgtgtctctgccagggccaggcactattctaagcattttatctgtattaaaaaattaatacacacaaaatccctgtgatgtaaatactattattaccccctttttacagatgaggaaaccaaagcacagaaaacttaagggaatttccaaaggtcaaacatcaagcaagtggtagggctgcatagtgaactcagactgtttctggagtttgcccttgtctctattgtagcctttcacctctccatttagcctctcaatataataccagtcaatttttaaattggccatttacattgatctaatacagatctttttggtcgctgtcttctcattattatacgttgtcagtgatttaaagtaccctgtagcattatgtgtttgtgttttaggagaaagttcagaaaagtactgtgagtatatgatcatttacataaattcccatgataaatttcctcaagaataaataaaattatattgtggttgacattattcttccattagaccttatttgctttgcctttaaattatacgttttttgggattatgttagaagttaggtgaacatgtagagcagcaataaattagtaaattgatttggaaattttaatttttgtagcaagaaactaatgaagtatttattatagccaatttatcccctcacataaaagtaaaattcattcttgag

SEQ ID NO: 49518 - DNA, 1045 bp, Homo sapiens
gttttttgaaaacatcaacagaattcgtagacagcaagactaataaagaaaaaaagagagaagaatcaaatagaggcaataaacaatgataaaggggatatcaccaccgatcccagagaaatacaaactaccatcagagaatgctataaacacctctacaaaaataaactagaaaatgtataagaaatggataaattctgggacacctacaccctcccaagactaaaccaggaagaagttgatttgcagaatagaccaatatcaggctctgaaattgaggcaataactaatagcctgccaacaaaaacaagtccaggacctgacggattcacagccgaattctaccagaggtacaaagaggagctgatactattccttctgaaactattccaatcaatagaaaaagagggaatcctccctaactcattttatgaggccagcatcatcctgataccaaagcctgacagagacacaacaaaaaaagagaattttagaccaatatcactgatgaacatcgatgcaaaaatcctcaataaaattctcgcaaaccgaatccagcatcacatcgaaaagcttatccaccaagatcaagctggcttcatccctgggatgcgaggctggttcaacatatgaaaatcaataaacgtaatccatcacataaacagaaccaaagacaaaaaccacgggattatctcaatagatgcagaaaaggccttcgacaaaattcaacagcccttcatgctgaaaactctcagtaaactaggtattgatggaacatatctcaaaataataagagctatttatgacaaacccacagccattatcatactgaatgggcaaaaactggaagcattctctttgaaaactggcacaagacagggatgccctctctcaccactcctattcaacatagtgttggaagttctggccagggcaatcaggcaagagaaagaaataaagggtaataaattaggaaaagaggaagtcaaattgttcctctttgcagatgacatgattatatatttagaaaaccccatcatctcag

SEQ ID NO: 49519 - DNA, 1421 bp, Homo sapiens
ttatcagcacatggaacattctttagggtagataatatttggggcacaaaacaagtctcaacatattttaaaaatttgaaattacatcaaatatcttttcagaccacaatggaataaaactggaaattcataccaagagaaattgggaagctatacaagcacagggaaattaaatgtgcttgagtataactattgagaaagaaatgaagatagaaattaagaaattccttgaggccaggtgtggtggctcacacctgtaatcccagcactttggggggccgaggcaggtctaggatgttgcttgtgtctaggagtttgagatcagcctgctcaacatagtgagaccccatctttacaaaaagaaattccttgaaacaaatgaaaatggaaatatttcaaaatctgtgagatacatcgaaagcagtggcaagaggaaagttaatagaaataaatgcctacatttaaaaactgcaaaaaaatgcaaattaacaatgtaacaatgcacctcaaggaactagacaaaacctaaccaagattagtagaagaaaagagataataagtatcagagcagaattaatgatggctaaaaaatacaaagtagcaatgaagcaaagagttggttcttcaaaaagataaacaaaattgacaatccactagctagactaaccaagatgagagaggaccctaataagcaaaatcagaagtgaaaaagagacattacagctgataccactgaaattttatatacatatatatatatatatatatcaccagagactattatgaacagctacatgctgacaactttgcacaccttgaggaaatggataaattcctggaaacatacaacctcccaatatttaacgaggaagataccgaaaatatgaacagaccaataacaagtagtgagatttacttaataataaaatgtcttccaacaaagaaaagccaagtaccaggtggattcacttaattctaccaaaatgtacaaagaacttataccaatcctcctgaagctatttcaaaaaagtgaagagaagggaattctccataactcattcaataaggccagcaattaccctgaggcaaaaaccagacaaggacacaagaaaaaaagaaaactgcaggccaatatccctgatgaataaagatgctaaaattctgagtaaagtactagcagaccaaataaaacagtgcatgaaaaagtaatacaccaaaatcagattggatttatgcaagggatgcagttatggtttaacgtgtataaaagaataaatgtgatacgtcacatgacagaataaaggacaaaaacaatatgactgtctcaatagatgcagaaaaagcacttaataaatttcaacaaaaagccatatatgataaatccacagctaatgtgatactgagtggggaaaagttgaaag

SEQ ID NO: 49520 - DNA, 1048 bp, Homo sapiens
catacttaatagtataatattgaaaattttaagaatacaacccaaaattactttgcatagaaagaaccagtaaaatttgacagattctcaagtgaaacaacaatcaacagatgccaactctgaaatgactcagatgatggaattaaaagacaaagactttaaatcagatattataaccatgctctgtgaggccaaggtgaatactcttgaaatgaattgaaacagcagtcctaagctaagaaatacaaactatttttgaaagatgagaatcttagaatttaagaaatacagaatctgatattttagaaaaactactggatgaaatcaatagcagaattgggatgatagaaggaactaccttggattttgaaaatagagcagtagaactaatgcattcagaagaacacagagaaaaaaaaattaaatctagatactcagggacatgtggaacaatatcacaaggtctaatgttggtattaattgagttcctggcagagagaagaaagagaggagtacaaaaaaaaatttgaagaaataaaagctgaaatttaccccaaattggtgaaatatgtaaatttacacatttaagaagcttaggagaaatacaaagaaaatcacacccggacacattacaatgaaaatgctgcaaaatcaaagataaatgaaacatgttgaaggcagaccgagaaaaatgacacattaagtacagcggacagtgatttaaattactactgatttttcaccagaaatcatgaagatcagaagatggaaacaacattgttaaagtgctgaataaatgaactatccatccagaattttatatccagagaaaatattcttcaggaatgaaagtgaaacagaaaacattctcagagaaaggaaatctaaaagaatttgcttccagcacaccttccataaaagatatgtcaaaaataatttttttaggttgaagggaaatgataccagaagaaaactgataattcagaaatgaagagcaacagaaatggtacatttctgggaaaaccttgtagagtaatttccttagtgt

SEQ ID NO: 49521 - DNA, 1556 bp, Homo sapiens
ctgaaatgacagaaatggaattctgaatatagataggagtgaagatcatccacatccagtaaaaagtcaaaacccaatccaatgaacttaaggagtaaaataagatcatacaggagctgaaaaatggtatggtcatttttaagaaagaaccaaactgatctgatagagctgaaaaactggcttcaagaatttaataatataattgcaagtaataacagcagaattgaccaagctgagtaaagaatctcagagctttaagaccaatactctgaaactactcagtcagacaaaaataaaaaaaggaaaagcaataaagaagaatggacaagacctccaaaaaagatgggattatgtaaacagaccaaagctacaacatatcagcattgaaatagagagagataaatcaagcaacttggaaaacatgtttgaggatagtgtacatgaaaactttcccaatctcactaaagaggccagcatttaaagtcaggaaaggaagagaacctctgtgaggtactataaaatagtcatcggattctgcaaagttgaaatgaaagcaaaattttaaaggcacctagagggttgagaaaggtgacctaaaagtttacagcattaggctaacagtggacctttcaacagaaacctaataagccagaagagattggggcctatattaagcatttgtaacaaaaaatttcaactaagaatttcatatccagccaaactaagcttcataagtgaaggaaaaaaaggttattttgagagaagtatatactaatgaaattcataaccaccaggactgccttaaataaagtccttgagagtgctaaacatggaaattaaagactgttaccaaccaccacaaaaatacacttaattacatagaccattgatgctataaagcaagtacacaataaaatctgcatgacaatcaggtaacaacacaatgacagaatcaaatccacatatatcaataataactttgaaagtaaaagggctaaataactgaattaaaaggcacagtgtggaaagtaggataaagaatcaagacccaaggttatactgtcttcaagagatccatctcacatgcaatgaaacccacaggctcaaagtaatgggatggagaaaaatctacagagcaaatggaaaacagaaaattgcaggggttgctattctaagttcagacaaagccgactttaaaccaacaacaatcaaaaaagacaaagaatggcattatataatggtaagggggtaaattaaacaagaaaaccgaactatcctaaatatatgtacccatcacaggagcacccagatttatatagcaagcttttagagacatacgaagagacttagccacaaaatagtagtagagcacatggcatatactctaaaattgaccaaaaaatcagacatcaaacaatcctcaaccaattaaaaaaaaaaaacaaatcatagcaaccacggtcttgggcaggagtgcaataaaaatttaaatcaatactaagataattgctgaactgcatacaattacatggaaattacacaacctactcttttaa

SEQ ID NO: 49522 - DNA, 1071 bp, Homo sapiens
attccatcttgagttgatttttgtatatggtgtaaggagagggtcctgtttcaattttctgcatatggctagccagttctcccagaacaattttttgtatagggaatcctttccccattgctttttttgtcaggtttgtcaaagatcagatggttgtacgtgtgtggtcttatttctgggttctctattctgtttcattgatctatgtgtcattgttgtaccagtaccatgctgttttggttactgtagccttgtagtatagtttgaagttgggtagtgtgatgaccccagctttgttcttttttcttatgattgtcttgtttttttgggctctattttggttccatatgaattttaacatagttgtttctaattcagtgaagaatgtcaatggtagtttaatgggaatagcattgactctataaaatgctttgggcagtattgccattttcatgatattgattctttctattcatgagcatagaatgttttttccatttgtttctgtcatctctgatttctttgagcagtggtttctagctctccttgaagagatccttcacttcctttgttagctctattcctaggtattttattcattttgtggcatttgtgaatgggaattcattcatgatttcgctctctgcttgcctgttgttgatgtatatgaatgctagtgatttttgcacatttattttgtatcctgaaactttgctgaagtttcttctcagcttaagaagcttttgggctgtgactatggggttttctagatatagggttatgtcatctgcaaacaaagacaatttgataccctctattcctttttgaatactctttatttttttttctcttgccctggccagaacttccaatactatattgaataggaatagtgaaagaggacatccttgtcttgtgcaagttttcaaggagaatgcttccagcttttgcccattccgtatgatattggctgtgggtttgtcatatatagctcttattattttgatgtatgttccttcaatacctagtttattgagagtttttaacacgaagggatgttgaattttatca

SEQ ID NO: 49523 - DNA, 1076 bp, Homo sapiens
ttgtggagacaattactgggggttctattcagccattttactctgtcttctgcctctcacttttgacaatttgattataatgcttttcagtatggacttccttaggacaacttttgttggagtactttgggcttcttaatttagatgtctatttggttcttcagaaccaattcttcagatttgggctgtttcagcaatcatttcttcaaataagcccccttcccaatctaatctccctcttctccttcttgcacttctataatatgtatattaacccacttgatggtggttcacaaattctgtagactgtcttcactctttttcttttctttttcctttttatctgactagataatgtcaaatgacctgtcttttaaatttgccattatttttctgtttgatcaagtctgttgtttgtctttgtgatttttttaatttaaaaattcaaggacatcccattttataaataatgctggcaaaactggatagagacatgtagaagaatgaaaccagatctctatctctgaacatctacaaaaatcaactcaagataaatccaagacttaaatctaagatctgaaactataaaaattctagaagaaaacctaggaaaaactcttctgaatgttggtgtaagcaaagaagttatgactaagaccccaaaagcaaatccaactataacaaaaatgaataaatgaaacctaattaaactaaaaagcttcttcacagcaaaagaaagaatcatcagagtaaacaaacaactcacagaatgggagaaaatatttgcaaactatgcatctgatgaaggactaatatccagaactacaaggaactcacacaaatcagcaagaaaaaataataataattccatcaaaaagtggacaaatgacatgaatagacatttctcaaaagaaaatgtacaaatggccaaaaaacatatgaaaagtgctcaacatcactaatcatgagggaaatgcaaattaaaaccacaatgagataccacacaatgagataccaccttatcccagccagaataaccattattgaaaagttaaaagggccgggcacggtggctc

SEQ ID NO: 49524 - DNA, 1041 bp, Homo sapiens
ggtacatgccaccacacccagctaatttttttgtatttttagtagagacagggtttcaccatgttggccaggctggtcttgaacttctgacctcaggtgatccacccacctcggcctcccaaagtgctgggatcacaggcatgagccaccacacccagcatgtaatatatttttaaatcaagatgtgtgatacctccatcgtagttcctcttgcccaaaatttctttggctattcagggtcttttatggtttcatatgatttatggagtgtattccatttctgtaaagaatgtcaatggattttgatagagattacgtttactctatagctcactttgggtagtatggacattttaacatttaacaatattaattctttcaatccaaaaatatgggatgtcttttcatttgtgtcttatttaattttcttcatcaatgttttataatttacagtgtataagtctttcacctacagagattatttaacttcttcctttctgactgggatgcctcttctttctttctgttgcctaattattctggctaggacttccagtaccatgttgagtagaagtgatgataatcttcatcctttccttgttatccttttcttgtttcccatagcatatatattgcagttattgctttctagtttttttcattatagtcagaaaatatacctggaatgacattgatcttattaaatttgttaaggcttgttttgtgacctaacatgtgatctatctggagaatgttccctgtgtactggagaaaaatgtgtattcttctgctgttgggtagaaagttccatatatgtctattagtttcatttgttttgtaatgtttttcaagccagatgtttcttcatttattttctgtctgaatgctgtatctgatattgtgaatggggtattgaagtcctctactattattgtattgtcaatgtctgtcttcagatctgttgatatttgctttatatatttaggttctcagatgttgggtgtgtatatatttataattgttttatcttcttgctgaatt

SEQ ID NO: 49525 - DNA, 1050 bp, Homo sapiens
ttagccaggatggtctcgatctcctgaccttgtgatccgcccgcctcggcctcccaaagtgctgggattacaggcatgagccactgtgcccggcccgcatgtgcttttcaggagtggattttagccttagcaagaaggatatggtgtgggatctggaaacacttcctggcagaaaggaagaaagagagtctttccatggaaatatatgtatgtatatatacatattcttgcaccttgttgaaatgtgatgtttcttgttctccaaattgttgtgataagcagataactttagctgttattttgtgtccatgtcgcagggtggggtacgggggcgacaggagcgggtggggggcgggaattacagcattattaccaccactgaaatttttatgtctagaattattatagaattagggactctttatctttaatgtaagttgagtgtaatcattgtaagaagaaaaaccaaatgccaaaaatcctgtagtttcttaagaagaaacctctgtattctaaaatgcttttcctaaagtttactaaatatgatgtggtatgtgtgtttatttgtagggactgataacatctgaacataccaaaccacacagtcaaactcttgcaccatcgctaccacgacattttactacaaaagaatgccactgcatgtggattccaagcaggctaaaaagaaaaagaactgattagacctcagacgacccactaaacgggatgacggccacagctgaggtagagacaccaaaaatggagaagagtgcctccaaggaagagaagcagcagcctaagcaggacagcacagagcagggcaatgctgattctgaagagtggatgagctctgagagtgaccctgaacagataagccttaagagtagcgacaacagcaagagctgccaacctagggatggtcagttgaagaaaaaggagatgcactccaagccacaccgccagctctgtcgatcaccctgcctagatcgtccaagtttctcccagagcagcattttacaggatggtaaacttgacttggagaaggaatac

SEQ ID NO: 49526 - DNA, 1088 bp, Homo sapiens
tcaagccagggctggactggtgccctttttctcaagtttgtcatggagcactttggccatgatgtgaatctggctaatctttggcctttttctaatcttcatccctcttaccacatcctggcctctttcccggcctcctgaataagtctatatttgcacctcaggattatatctgtctttttgtttttctcaaactcttctcagcctttctgcttctcttggaatatcctccactttcctttactgcctccttctcttcaacttgctgagtttgattaggatggaggtgccttacatggtctggttcatgatcctttgcaaagtgccttctgccttctgtctgacagttttcagggaaggtaactagtgccaaataccaaactaatcccagaagcaagtttgcttttcctctttctttcctcttctatccctcttctttccatcctttcaaactgagccacttctacttgccaggttttgtgttgggaactaagaaaacaaagaaatcagatggaatccctgccctcaatgagataagcacctccccaacctaggtctttgcctcttactaacaatgaattctttggcaatttgtttagcatttctgggctttgctccttaaataagtagaaatcggggctgaatatgagtactgtaagagaagccagagggaatgcaaaagagggagtgatcggttccatctctgaacaacagtgaaggcgccctagttcatttctgcttctataacaaaataccgcaggccaagataatttataaacaacatacatttatttttcatagttctagaggctaagaagttcaagatcaaggcactggcagattcagtgtctggtgaggactgctgtctgcatctgagatggctccttcttgcttcatcctcacatggtagaagagcaaaagggatgaacacagtgttctcacatggcagatgagataaaagtgccaggcagctatctgaagcctattttataaggacattaatctcattcacaagggcagagccctcatgacttaatcatttctcaaaagttcccaccttttaataccatcaccttggggtttaaggt

SEQ ID NO: 49527 - DNA, 1033 bp, Homo sapiens
ttggagactatttagtacaactctcttaaaaaaaaaaactaaaactaaaacaaaaatctaatgaggctattgagacctacagggaaagacctacctaagggcacatggtgactgagccaagattggggtccaggctttctgatgctcatctcattgaccctttattctgacccaatgattgagttcttgacatttgagttccctttcttgctccaaacaaattgcccactgttctcagacctttatggtcctcagataaaaggaaatgagtaatttgagcaaagtggccaaggttgacatttgtgtggtctcctggtaaggttcggtagtgtcaccaggtgccttctgttacttttcttattcctcataccaaggccaaggtgttcaggggcacaccctagttcactgaataccaaccagtaattttaattaaaaggggaaaaaatttccctttctctgctccattttcatttatgtgctttaggctatttctagcgtgtgacagatggagaaaggtagtggaaaatcaaactcgttcattcatattgcagcatgtctacaacctatctagggtcggtttcacttttatagctaattgtccctcctagtcagcccaacctcccctacatttgttaaaacacgccagccgggcgtggtggctccagccagtaatcccagcactttgggaggccgaggcaggcagatcatgaagtcaggagttcgagaccagcctgaccaacatggtgaaaccctgtctctactaaaattacaaaaattagctgggcgtggtggtgtgcgcctgtaatcccagctactcgggaagctgaggcaggagaatcgcttgaacctgggaggcggaggttgcagtgagccgagatcacgccactgcactccagcctgggtgacagagtgagactccatctcaaaaacaaaaaaagcaaaaaaacaaaaaaacatgcctcactacccaccgccacccttgccttcttgccattccttggactctgcttctggttgccagtttcctgagtct

SEQ ID NO: 49528 - DNA, 1046 bp, Homo sapiens
gtgctgggattacaagcgtgaggcactgcgcctggctgatccatttattttttcagattctcagcctggatgtttgatgaagctcaccaagagcctcttttatctgttgtaatttttaactgaggttgactaatctatggtatagagttggagggtgagggtcaaggtaacagtcaatctgggcatcattagttaagtcgtacaaatctttgctattttcaagggttttaagtgagctaaactcctctccaaacatccttgtagatacttgtgggagactgactaattcctttacaaagaagaaaagtcacataacttctttgccttttaattttctttttctccaacatgaaaatatcagcaatattagaaagaggcacatggagtttgcgtgtggtggctcatgcctgtaatcccagcactttgagaggctgaggcaggtggatcatttgaggtcaggaatttgagaccagcctggccaatatggtgaaaccttgtctctactaaaaatagaaaaaatagccgggcgtgttggcgggagcctgtaatcccagctacttgggaggctgaggcaggagaatcacttgaacctgggaggtggaggttacagtgagctgagatcacgccattgcactccagcctgggtgacaaagcaagactctgtctaaaaaaaaagaaaaaaaaaaagaaatatgtaaatggaaaagaacaaacccccctcccaggttccttattccccttggtgcctgggccattgtagatctagcatatgcttggtggggacatctgccatttgctttagggttacactacatctttctactttgagtgcttgaagagttgctccagcagggcctgatgtgggcctggtgaaaatctagcctagttgcctttctgtctgccatagcctgggcattttcctaaggttgggagtttttttccttctggtcttaggccagttgccagaggaaaccgatgactaaaggcttcctccctgcaacgtcaacttctggaacctttcctgatgattcctaccagtcaagtct

SEQ ID NO: 49529 - DNA, 1054 bp, Homo sapiens
caccatcccaggccaggcgtggtggctcacgcctgtaatcgcagcactttgggaggcaaaggcggtcgaatcacttaaggccaggagttcaagaccagcctggacaacagggtgaaaccccttctctactaaaaatacaaaaattagccagacatagtggtgggtgcctgtaattgcagctacttgggaggctgaagcaggggaattgcttgaacccgggagacgggggttgcagtgagccaagatcacgccattgcactccagcctgggtgacagagtgagactctgtctaaaacaaaacaaaacaaaacaaaacaaaaacagtttgtgatcttctggataccatctgagggagtttggaggtcccagtgggttgtgttgagggttgcagacttgtgtgtgttaatgggacataactggagaaaatggcaaggcagagtccagaataaggaaggaagatcaggcagcctttgaaaataataaggcagcataggtgctgtgttgtgctctgcctttccataggattctgcttcttggggaggaaatccccatctctctcaagagataaaatatttaaaataatgctggaatacatgtgtatttaactgttgtgcatggtttcacattgtcttgccaactagaaatgtaatcaccttttagttttccctgaaagtgagagtcctttatgctagaagggctctttagaggtcttcttgggcagcccctagccctctgtagtgaaacaggtttttgttttaaattattcctgacaggtaggatattcgtcataatatggctaaaaggggagggattagtaatcatcacattctacttatgatgtgtcaagtactttcatgtctattattattattatttttatttttattactgttcaattattttcttcctccagtgtcaaacatgtctgttatgttaacttaaatctcccaataaccctgtactgaggtcgatattattagacccgttttatagattaggaaactgaattttagaaagaggaaggtcaaaaaggctccaaagctcaaaatgctga

SEQ ID NO: 49530 - DNA, 1069 bp, Homo sapiens
atagtcccagctactcaggagattgtgccaggagggttgctcaagcccaggagttcaaggttacagtgagctatgatcacgccactgtactccagcctaggtgacagagcaagactctgtctctaaaaaaaaaaaaaaaaagtaaagaaaaataatctagaattgggagaattgggagatgggcttaatgatcctcagaatatctaacttcagatttaggtggaacttacttctctggagtttgttttgtgtttgttttactttgaatggcaaagtgtaatcattgatacttaattggtgaaaatacaaattagtctgaggaatatttaaatacaagtttactacaattaaagtgatgtgcttacattcacatagctcacaagtgattatggtgctagtctggaatgactaaatgcattctaattataattgtgctttgcattctctcttcacatggaggttatattggagaacttttaaagggacagcctagtgaagtcaaaagggcctggatagaaagtcatgaatcttgggctgtagggttggctctatcactaattcgctgtgatacaaacgtttcccttatttgggcctcagtttctcatctgtacaatgcctaacttgtttctcaaatctggttatctctcagaaaatttatctctggcatttatttgtgcattccatctctctttctctcccatttctgttcctagtattgggatttcagacaatccttttctgtaaaaaggagagaaatgcctcacctgagtatgatcagctgctggcatatgtgaggaggtagggctagctggcagggggatcatctcttccttgacaggctttttactgtctctaagacaaaagggaggaagtgtccatagaacacataggcttttgggccctttgctttagacagcagtatcattctgggtagcagctattagagagggaagcggttagtcagtgcagattttacagaccagctgggagccagaggctcctttgacatttacctatactccttccaagagccctgattctactaattccccatcccaaaccagatgac

SEQ ID NO: 49531 - DNA, 1050 bp, Homo sapiens
gaatttggggatagttggatatagtcagataaaagtggtttgaagatttctgatcatcagtcggtattaaggtaatttcaggaagaaattcccaacagaaagtgattacagacatgggattcagtccccagtgaaagtaatgtattatttttcttaattaccaggggagttgccacccagctgtctaagattatgcaaattgatgatctttcagtgttttctccccaccctacagccactccattacccttaaaacctattttttgagagtccataacccttactcttcccaggtgactgcccaggatgtgcggaaggaaagccccctgctctttaagttccgtgccaagttctaccctgaggatgtgtccgaggaattgattcaggacatcactcagcgcctgttctttctgcaagtgaaagagggcattctcaatgatgatatttactgcccgcctgagaccgctgtgctgctggcctcgtatgctgtccagtctaagtatggcgacttcaataaggaagtgcataagtctggctacctggccggagacaagttgctcccgcagaggtgaggtggttccctgccctcctttgccttggccataaggggctgcagcccacagctgaccaatccctgcctcacagggatgccagatctgttcttctccattggggtctgtctgaagactgtgttatgctgctcaagagacatttgcatatagtgtcagactctgttgttgtttttctggctttccaaataaaaagcctttttgttttccctctgtctacctggttacagaactttattaccctggaggcaggtgcttatatagaaccagagattgagtaatttctttcacccatccctggttccattttctcagttctttttactgatttagatctcttatatcagaagttcacaggggagagagagaaataagcaaaccgaggacatggggagctcaaatagtcttttaatattgacagctagtgtacagagctttccccttttgtaaacttcaaagtcaaaagctctaaaacactcat

SEQ ID NO: 49532 - DNA, 1032 bp, Homo sapiens
aggggaaattctacacttgttgcaaaaaaaaaaaaaaaaaaagcaaagggcctctaaagaatcagcctctttggtccctttgtgctgtcacctttttgccatgtttaacagcatcttggttggcactctagtcttaatcttgctccttaactttgaatatgcagtctaaaatgtcagtagtcaacatgtaattttcctttgaaattctgaatattccagtgctggaacttatccaaaaagaagacctcagaaacttagattggtagatctctagtgcatattatcatgtgggcaccttctcttagggtggaatgaggcagtctggatgcagcatagttaaaaggagctgtttaatattctctgtagtctggcctcttaactagaaagtaaagctaaatcagaagcctgtatttaaccatgtgaacagggagggatttagtgttctgatggctgattaatagaacagctagatacttagagcatgacgtgggatgggatgagtttacagctgctgccttttcatggtgagcttagcagttttctcattagatgtgtttttttgggttggggaatagcaatttattttattgattttagactttatcaagctaattagctcccctttagataagtacatgttgcacatgtgcacctacttgtaatctcagatatttatgcacacaagtgtgaaggtttttcagggagcagagcatctgggacaggctgattctgagctaaacagggctcctttaaggcaatatgaactgttgccttctataaattgcacattgaggaactctaatagacaaagattaggtgtcaggcagaaaacactcattgtaaatatactattagttgataaacataggactttcttattccccagtttttctttatcatataatttaaatatttattcattttgtatttaaagactacctacacatagatatatgattccaaagtcatactttctccatccccacattagccaagtgaatacagggccaaatgggttcttggaatgataat

SEQ ID NO: 49533 - DNA, 1032 bp, Homo sapiens
tccctccttgaacctcttttctctcccgcttccaccaccaccacacatatatacccctttttctcagtcttaagcatcaaacaatttctgcctctttctttttaattctcccagagggatggttaatgcatcacaatttaacttgtctattcaggtattaatagtcaagggatgcatctgtttgcttatagtaccagttatattcctaggaccttagagagcagtagtgtgagaatagaatgcctttctatttgggttaaactatgtgggaggaaaaagtaacagagtaaaggctttgccttaatgaagtcaagtgttctgcctggtgggaagtggccacacgctgcactgcgctgctcttgtttactctgttctttcagagcctttgtactttgccatcactgctagtaatttcttggtccttttcaatactccattttaatcttgatttttttctataaataataaatctgtgaaaaatctgtaaaaagatttgtgactattaaatgtgcaactaaaaacactggaaaaagaatttgtgtgtgcctattcttgtactgaaggcacagagatttgctacatactgatttcagatatattgtcatccgacaatattgaatgctttgtaaattgggcagggagcaagtaagaaagggaagtcacatttattgagcaaatgctgtataccatgccaggcactttattagttgctttacaaacagtatctctgattgacagcagccttttgagatcagaggcattatccttaaagttggatctggctgggtttcgaggctcacacctataatcccagtgctttgggagcccgaggaggcaggatctcttgagcctaggagttcaagaccagcctgggcaacatagggagactctttctttaaaaaaaaaaaaaaaagccagacttggtcttgtgtgcctgtagtcccagctactcgggaggctggggcgggaagattgcttgagctcaggagttcgaagatgctgtgaggtacaatggtgcaactccagcctggg

SEQ ID NO: 49534 - DNA, 1024 bp, Homo sapiens
tggagggtagtattatagaagtcattgctataaatgtaaatttgagcttacagatgtgatgaatattgagagaacactgtcccaggcacagtcttgatgacaaccacagtgctggatgatagacctatgaaaaggagccagaaagatgaggaggaagttatgaagctaacacttacctaccatggattttcacattgctatcttcatctaacactaaccctgtgagatcattccctccatttttttcagaagaggaagaagtttggattcaataccttgcccacagtaagtggctgaggtggaatgtgaatacaggtctgtctgaactccaaagccttggtgctttctgctctgctgttaccaccatgcccgattaatttttgtattttttgtagagatggggtttcgccatgttgcccatgccaatcttggactcctgagctcaagcgatccacccatctcagcctcccaaagtgctgggattacaggcatgagccaccacacagccaaatgttttatttatttaagtaaaaacatggaagtgttgatgaatgtgtgtgtcgtccttctgcaggggccatgctaatattctccctatcgttccaattttagtatatatgctgcctaagtaagcactccaaaagtattgataggtaggagatggaggctcctggtatttgttccttatttgtagattcagatcaggcacagaacattagagattaaaagaatgttatcgataattggttcaatttgctcattttaccaatgaaaaactgaggctcagagagggaaagtcatttacccaatgttgttcaaaggaaccagactaaaacttagtttttttcatttctggttcactgctttttctactatgtgagagtacagtagctaaaagggtgacaacctcatgcaggttaaaaaaacaaacaacaaacaaaaaaaaacaaatccacaattttttttttttttttgagatggagtcagaaatacaatccagggtagtggggctggtgctatagct

SEQ ID NO: 49535 - DNA, 1046 bp, Homo sapiens
tctgcatatgagatgggtttcctgaatacagcacactgatgtgtcttgactctttttccaatttgccagtctgtgtcttttaattggagcatttagtccatttacatttaaagttaatagtgttatgtgtgaatttgatcctgtcattatgatgttagctggttctttcgctggttagttgatgcagtttcttcctaatctcgatggtctttacattttggcatgattttgcagcggctggtactggttgttcctttccatgtttagcgcttccttcaggagctcttttagggcaggcctggtggtgacaaaatctctcagcatttccttgtctgtaaagtattttatttctccttcacttatgaagcttagtttggctggatatgaaattctgcattgaaaattcttttctttaagaatgttgaatattggcccccactctcttctggcttatagagtttctgctgagagatctgctgttagtctgatgggcttccctttgtgggtaacccgacctttctctctggctgtcttcaacattttttccttcatttcaactttggtgaatctgacaattatgtgtcttggtgttgctcttctcgaggagtatctttgtggctttctctgtatttcctgaatctgaatgttggcctgccttgctagattggggaagttctcctggataatatcctgcagagtgttttccaacttggttccattctccccgtcagtttcagggacaccaatcagacatagatttggtcttttcacatagtcccatgtttcttggaggctttgctcgtttctttttattcttttttctctaaacttcccttctcgcttaatttcattcatttcatcttccatcgctgataccctttcttccagttgatcacatcggctcctgaggcttctgcattcttcacgtagttctcgagccttggttttcagctccatcagctcctttaagcacttctctgtattggttattctagttatacattcttctaaatttttttcaaagttttcaacttctttgcctttgg

SEQ ID NO: 49536 - DNA, 1022 bp, Homo sapiens
taaggaataaacaataccaattcaacactaactcttccagaaaattgaggaagagagaatatttcccaactaattgttctgataccaagatattttctatggccagcactaccctgatacaaaaattttctgaacaaaatttcagcaaacagaattcaatattatataaaaaggatgataatgcactatgatgacatagggtttatcccaaaaatgcagggttgattttatatttgaaaattagtcaatgtaactcactatattaacaaactggaaagaaaaaattacatgatcatcttaaccagtgcaaaaaaagtacatgacaaaatttaacatctgtttctcatataaattctcagcaaagtaggaatcactggggacttcctcaacctgatgaaaaacagttacaaagaacctatagctagtatgatacttattagtgaaggatcaggaatagggaaaggaatgtccacttttactcttctattcaacattgcattggacattctagccagtgcaatcaggcaagacaaataaataaaagatatccagatcggaacggaagaagtaaaactgtatttattcacaaacatgataatttatctagaagtctgatggaatttttagaaaatctctttaaactattaagtgtgtttggcaagattgcaggatacaagatcagtacacaaaaattaattgtgtttctgtatactagcaatgaaaaatcaataattgaaataaataaaacaataccatttacaatagcaacaaaatacttagggatcttaatccaatacctaatccaaaatacttaaggatacacctgacaaaagatgtgaaagatctgtacagtgaaaactacagaaaattgctgggagaaactgaagaaaacccaaaatgattggggagatatattatatttgtgggtcagaagattcaacattattaaagtgtcaattctccccagattgatctatggatttaaatgcaatcccaatcaaaatccctgaaggcttgtagaa

SEQ ID NO: 49537 - DNA, 1096 bp, Homo sapiens
aactttgagagagatggagaaccattggaggagatggagcataagagtgatagactctgacttaatattttcacagaatgtctctgactacagggtagggaatagactgtaggatggccaggacaaaagcatggagaccctgtatacatttatagtaatccaggtgagagagcactggggtttggactaggatgatgacaggaaggtggtgagaagtggtcaggttctagatacattttaaaggcagaactgacagaacccactaacatatttgatgtggagtgttcaagaaatcgttcaaggatgatctcatagttttgggcttgtccgatgggaggttggcgttgccatttactgagatgcagaagaccaagggataagtacatttcgggggagaagaggtttgtttttggtcatgttaggtttgagatgtctattagacagttaagtgaaaatggagaggatcaagttgaatacaaaagcaacaagtcaggggaagttggtgagaacatataggtcctatctcaaactttaagtatgcagaagcagggccagggacttagtgaaggcaaattatgtagatgcttttctacatttctgccatgtccttgagtactgctacatgtttttcctctcatccttttttgatggaagtctcctacataacagggactaacatttactatgcatttattatatgccacacagtgatagcatctcaaggagttgagaaagtgccaccccataatatgccactttggacttcaaactgagggcatttggggaacagcaaattcagggagggatttctgaactttccttttctgtctaaagacagatcctccaaaaggaactcaattgttatgaatcccctccctggaaatctcatcaaccagggaagattaaacccgtattacaagagaggagactggaggttgacatcatgcccagataagctttatcacagggtgtcacctattcttctgaggtcccatttatctttccccaaaatcatttattcctcctagaggcctacttcccccctcccctcttccctatgaaaagggtctataagcttctagatctcactgggttg

SEQ ID NO: 49538 - DNA, 1033 bp, Homo sapiens
gcccggctggaacggcacggggcggggcgccaaggcttggcggccccgtggttgggcgtcccggcagccgcttgagggatggggcggggtcggccgggacctcctccttcattccctcggcgggccgagcctcccctctctcccgcccctcctcctccctttcccacccctcggagtagagctgcacatgcggctgctccctgctccgtcccgcccagccactgtcgcgcaggaacgggtccctgcagcccccagccgatggcaggacagtagccgcctgtcagaggtcgtgaacggctgaggcagacgcagcggctcccgggcctcaagagagtgggtgtctccggaggccatgggctacccggaggtggagcgcagggaactcctgcctgcagcagcgccgcgggagcgagggagccagggctgcgggtgtggcggggcccctgcccgggcgggcgaagggaacagctgcctgctcttcctgggtttctttggcctctcgctggccctccacctgctgacgttgtgctgctacctagagttgcgctcggagttgcggcgggaacgtggagccgagtcccgccttggcggctcgggcacccctggcacctctggcaccctaagcagcctcggtggcctcgaccctgacagccccatcaccagtcaccttgggcagccgtcacctaagcagcagccattggaaccgggagaagccgcactccactctgactcccaggacgggcaccaggtgagtcacctagtaggggcggcggcggccccctcccctcgcgggtagggcgagggccctccgccacaggggcctgggagcactcagcaacctcgagccaatttagagggcaggaccagggagggaccaggcgagcaagggagaagttgcccagggcaggttgtcttcggtccctggcccagctaatccagactccctggggaccccttgacttggaaagtctcgcgcgcgcccgcggcccctggctgcgggctgcctcgagaaaagttggcgacgctcccgtcg

SEQ ID NO: 49539 - DNA, 1029 bp, Homo sapiens
agagtagctttcaggagttctttcgactcaacccccactccattgagtccctatttggtatgagataatgctagtagggggattgtatcctcaagacagattcagctaacagaaccaatgaaggagcacaaacctacttcatccttaatgacattagacaaatcctttggtgcagcttgtttctgtttggattcccagctgacatctcaaatttagtaagctaaactgaacttatcttcattcttccccttcccaccacacacaccaaattttataaaagtaaaccctggtttcatgctctcaatcacttatgcataaaacttggaaggccttatatttttacttctcccttgtccttgctacctatatatagcaatcaattgttaagttgactcctactttgtgatgttgatttatattgttcatgatgtctcttgcatgactccctttctttctagtctcactgctatcactctggctgtatttggcttagatgatcttcaaggtgcctcccaacaatgaaaatctgtgactctttctcagctccttattacctcactcctacagtggttgtgtagctgagagttgctttgttctctgttccatatatatacctcagctagattatttttcttccagagttattttgttatgtcacttcctcctcagaaaccttgacatctccctactgcccgtagaataaagttcagacttcttaaactggcattctaagcccctttgcaattgggtttgaactactctgtcactcttctttttattctctgtttgaatcttgttttatccagactggtccactgacaggccgcgttctggcctttgtttgtttacctgttcccccgaagaagaatgttctttcctccaacctgtctcttggacccctccaggtccttcaaagctcaacttaaaccttaactcttgtgtgcattcttccttgcccatctatccatcccagcaccctaaattcctcattcagcactgtgctgtgttgtaggtgttcttgtttcctta

SEQ ID NO: 49540 - DNA, 1030 bp, Homo sapiens
ttccttcctcagttcctttccctccttcagatctttaaaagccttccacataacaagtattcatattccactttgacctgctgtatacctcttgatttcctcaatacagcaagtccttaccttcaaaatgctttcggaattcatttctccctgaatactgaaggtacctcaacttcttggctttcagattctaactcacgtgccaggtcacgagaggctccatacccaagtttcttttcaagtcacaaaccccatacacccccatcgtatatcaaagttccctaaccctcttgtttgtatttttaacagtaactcatttaaacgtgtaaatgtgggaaagcccttaaggtcaggactctctctgtttgtcttgtatagtgcaaaatatgccggtgttccaaataataaaggtttagggaaaagcccaggttgtggttatgtacgtgtctgtgtttgtctgtgtgagggagtcaaggaaggggagggggagaaaatggagggactgacttgtgtttctttgtgtttgcgtataagtattaaatgctagaattctagcatttaatttctaggagaaatgtgattcatagttcaggacataagaccaagtagtactactgtttcataaactacactcttacatttccagttaacccattttcttctcagcccctgactttacctattcattcagaaagtctggctcccacctgctaaaccagagtgcctcatgcttattttggtctgttttggatatctttcttatcctggaggttgtagaaagagtactggaataagttctggctcttaaccaactagcatatttcagtgtccttatttgtaaaatgggaaagacagtaccttccctgtctccttcgcactgtctttttgaggatcaaacacaaatatgtgtgaaaaatataaagtcttgtggttatttcttagaggactatttgataaatctgtctctttgtctcgttaattatgtaaaactttttttctaattactaccttatattttccatatagttgc

SEQ ID NO: 49541 - DNA, 1111 bp, Homo sapiens
acaagattaattgtgctctgtctgtcagacatcccacctcactttctccatcatgctccagtggggtgtggcaaggttgtagcattgtcacaagtgggacaaggattggaagggcaggacaagcaaaattttcaaccgcaatttttttagcattgccctgggaaatcacacaatagtagagctgaaaagaatttcaagagactgtcttatccaggccctctgccttcaagcaagtgaattttaaagcattcatgacaaatggtcactcaggagcccctaataatctcactaagaagaatattcaatggagatgggaagaaatacaaaagtgcaaaagttatgtatgccaagtagtccacaggtatacttcaatatagagaaggatatattaggaaatgactccggtgcaaatctatatatagatctgtgttttctcattgccttttattaacaaatgggaagtgtcattccccagagaactgagcacgttatctggtgtggagtcaaaaaaaagaaggaattagagatcaaagaaggactctgaaattgttcctggaatctgggctaatggaatgagccagctgccttgggaaagacctgtatcagatagatgagttatgctgcttcaggctgtttaattaatgagattgggttctgtaactgacctgtggatatgaaatctgcagactgaggacagaacatactattgtgaagaaattttgcattctaagtggaggattgtggagtggtactctacatggcagttagatacatggacttcatagcctgaagtcaggatttgaatcccagccctgccatttactacaagtctcccactagtcttctccatttcttcgtctataataaagataatatcgactctataaagttgttatgagaatcaaagaggcaatggatatgaaccttatagcaatagtgcttggcatatagtaagtcctcactaaatgttaactactactactactactgcttagtagtagtagtgttctaatcattactgtgctgtactaaagagacaatgagcaagcaaagggggaaatgcttggttagtcttagcaggaaattcatggttatttggtggtggtggtgg

SEQ ID NO: 49542 - DNA, 1044 bp, Homo sapiens
ctaaattatatgcctgtgcatttttataatttgcagtggcaaattataaaacgcaatagcaattatgctatttgtagtttgttacatttggcaagatatgtggtggggtgagtggttgggagagatgtgagggtgtgtatgtgtgtgtgcatatatacatatataatttgtgtatatacatacacacatgaaaatagtgggaaacacccaagtcagtaaaatggacaaacacattgaggaaaatggctttaaaggtttctaacaaaaataatgtaattcttgtgctaagtattagactagtatatttcactctacttctaagccatgccagtcatttttataaactcatactgttgtttgcaacataataaaggcagaaaatgcagttggttcatcaaagtcactccctttgtcataactttatatggagggatattacactattggtgccaactttatagaaggacaggctgttgcttggatgtttgcatgtatatgtataatggtgcagcaagaattatgttaggactctcatgggtacattctatttagactatgagaagacaagagctcggattatagagctaaactgcatggctttgaattgttgttctcacagtagctttgtgaccttgaataaactacatagggaaactgaggctcacagttgatgtgaaaagtggaaaaaataacaagctgtgtaattcatagggtggttatgagaataaaatacttgcgaagtatttagaaaagttcctggcttacagaaagtgttcaataagtgttagctgctgtgtttgttattgttgattactgttgttatttttactgccagaaataatagtagtagtagttggaggaggaggaggaagaggaggaggaggaggattataggtgtgtcacagactgaaaatgagtggggaggcaatgtcctatagtgcaaaattttagctttagaggctgaaaggcctgggtttgattactgcttttattatttatcagctgtgtgacttaaaacttaacctagttgttctttcatgagta

SEQ ID NO: 49543 - DNA, 1035 bp, Homo sapiens
gggctgtaccctgcaaagccacaggggtggagctgcccaaggccatgggagcccacctcttgcatcagcgttacctggatgtgagacatggaattcaaaggagataattttggagctctaagatttaactgccctgctagattttggacttgcatgaggcctgaagccccttcgttttggccatttcttctatttggaatgagtatatttacccaatgcctgtacccccactgtatctgggaagtaactaacttgcttttgattttacaggctcatatgcaaaagggacttgccttgtgtcaaatgagactttgatctgtggacttttgagttaatgctgaaatgagttaagactttaggggactgttgggaaagcatgattggttttgaaatgtgaggacatgagatttgggaagggccaacggtggaatgatatggtttggctgtgtcgccacccaaatctcatcttgaattgtagctcttataattcccacgtgtcatgggagggaccctgtaggaggtatttgaatcaaggggcgtgtcttttccacgctgttctcttgatagtaagtgagttttcgtgagatctgatgattttataaaggggagatcccctgcacatgccctctcttgcctgctgccatgtaagacatgtcttgcttgccctttgccttccaccatgattgtgaggcctcccctgccatgtggaactatgagtcaattaaacccttttcctttataaattactcgtccttatgtctttattagcagcatgagaacacctaatacatcatgcaatatttttctttctgtgtctggcttatttcacttagcataatgtcctccaggcttatccatgttgtggcaaatggcaagatctcatttctttttaggccaaataatatttcattgtgtgtgtgtgtgtgtgtgtgttacacactatagtttctttatccatttgtccattgatgaacatttaagttgtttccatatcttggctattgtgaacaatgctgcagcgaacatgagagtgca

SEQ ID NO: 49544 - DNA, 1060 bp, Homo sapiens
atgtattctttaaagaaatgtctattcaggtcttctgaccattttgtagttaggtgtttgtttttctgctattgagttgtatgagttctttatacattttggatgttaatctcttgtcagatatatgatttgcaaatattttctcccaatacatagactgccatttcattttgttgattgtttccttttctgtgcagaagctttttagtttgttgtagtctcatttatttaattttccttttgtggcttgagcttttagtgtgatatgtaaaaaatcattgtcaaggccaacatccaggagcttttctcttatattcccttcaaaaagttttataatctctggtcttacatttaggtcttttatccatttgaatttattatggtataagctaaagattcaattttattcttttgcacgtggaaatccagtttttctagcaccatttattgaagagactaccctttccccattgtgttctcttggtgccgttgtcacaaagtaattgactgtatatgtttggattttttcctgggcgctctattctgtttcactggtctatgtgtctgtttttatgccagaacaataccattttgattactataggtttgtaatataataaattatataatataatcaggaagtatgatgcctccaattttgttttcctttctcagaattgttttgtttattcaaggtcttttatgtttccatacaaattttaggatagtttttgctatttctgtgaacaatgccattgggattttgattgggattgcactgaatcagtatattattttggatagtatggacatttcatcaatattaatttttccaatcgatgagcatgggatatctttccatttattggtatctttttcagtttatttcatcagtgttttgcagttttgggtatacatatctttcacctcattggttaaatttattaagtatgttttcgatgctatcataaatgggattgtttatttctttttcagttaggtaattatttttgtataaaaatgttactttttttgtatgttgattttgtatcctgcaact

SEQ ID NO: 49545 - DNA, 1553 bp, Homo sapiens
attcatatttactttatgtatttaggtgctccaatgttagattcctatatatttataattgttatgttttcttgatgaattgacttctttatcattaaacaatgaccttctgtgtttcttgtaaaaatttttgactggaagtctgttttgtcagatataaagatataagcacagccactttgctctcttttggttaccatttgtgtagaatagcttttcccattcctttgctttcagcctatggccttaaagcttaagtgggtaccccatagacaccatatagttggaccttttttttttttaatccattcgactactctatgtcttttgattggagaagttaattcacttacattcaaggttattattaataggtaaagacttactactgccattttgtttattatttatggttgttttttagcttctttgttcctttctttctctgttgtctatctttgtgatttgatacttttcttagtgctgaactttgagtcctctctgtttatcatttgtatatctgctgtaggtttttgttttatgtttaccgtgatgcttacataaaacatcttatagttataataaactattttaagctaatttcaacttctatcacatgcagaaactagacttttaccttcgttttccacaatttatatttttgatgtaacaatttacatctttttatattgggtatttttaacaacattataattttagttattgttaaccatctttttttctttttctttttcttttcaacttttattttagattcacatggtacatgtgtaggtttgttaactgggaatattgcatgatgctgaggtttggggtatgaatgattctatcacccaagcactgagcatagtacctaatagttaatttttcaacccttgccccctaccccattcccttctctaattgttcccagtttctattgttgctatctttatgtctatgagttgttcactgttttgacttataaccatactagagttatgtatgatttacacaccattacaacagtattggaatattctggatttgagtatgtatttacctctaccagtaagttttagattttcatatgtgttcataatagtaattatcttctttatgtttcaacttgaagaacttccttaagcatttcttgtagggcaggtccagtggtgatgaattccttaaattttttcttgtctgggaaaaactgtctccttcatttctgaatgacagacttgctgggtatagtattcttggctgactgtttttttttttttttttttctttcaggactttgactacatcatttcattctcttatggcctacaaggtttctgctgagaaatccactgatattctaatggatattcctttgtatgtgacttgacatttttctcttgctggttttaaagttttctctttgacttttgacagtttgatgatagtgtaccttagagagggcccctttgggtagtaactgtttgcgaacttttgagctttgtgaatctggatgttgatatctctcccaagacttcggaagttgtcagcaa

SEQ ID NO: 49546 - DNA, 1031 bp, Homo sapiens
taaagtaataaaccctgaactagcaggacaactcgactaactccttcctgagttacaatcaagattttccttcattcaatatatacctttctgttcaagcctctctaactagaattgaaatgcaatggtaaggcaacatgaggcagtaaatctatgaaaatgaattgttcattcacactacatttataaaacaggaaatacgattataaaacagatgttgactgattgaaatgctgtatgctcaatcatgttagtgtttatttgataaggaatgccatttgtttagctttgcttatttattcagtgactgtggcctggaattttattagatgctgtatagctgtatatctctgcccaccagaatgctgagagaatcttagcttgaatgaaactggataagaagttggagctgtttagctttggtagtgaagatgagaagactttagttttgaaggttttccattttaaatgtctttgttttgttttatttcatttatatatgggtgccagaacatagaagtgactaatagtctggaagtattcattacttgtttaactttattctgaaaactttcatcttcctaaaagtctttcaatggctacccagggagagatcgagagccaagaaaatttcctgaaatggaatcatttataactgatatgtttctgaataatggagaaaacttaaatttaattttaaaagtactgtaatactaaacagctcttatatttgaaataaattattcaactaattttttgttctcccttggagccagttagcaaatatcttttgtgttgcagtgagattacagcaaatgatttcatgggaacatttatttagattttgtattttattttattagctgataatatctgggcctttatgatatagaaactagtacaataaatatttgaatgaatagatttaggaaccagataatttggaaggataatttcaaaacttgagtgaactatgacatttaaaaccagcatcttggatcatcatgtaacatattgtgtaatatacatta

SEQ ID NO: 49547 - DNA, 1909 bp, Homo sapiens
cttgcccttgttgcccaggctggagtgcagaggcacgaactcggctcactgcaacctccgcctcccaggttcaagcgattctcctacctcagcctcccgagtagctgggattacaggcatccgccaccatgcttggctaatttttatatttttaattgagacagggtttcaccatgttggccaaatcctgagctcaggtaatccgcccaccttggcctcccaaagtgttgggattataggcatgagccaccgcgcccagcctgaaatggcatttctttctctgaaaatgcatgatggtaaagaatacaatggccactaatataggttggtgtccctgccttaatccatgcaaggcaccaacagtttttgcaccactattttttaagataacagctttattaagatatagtttagataccatatacttcacccatttcaagtgctaattcattggtttttagtacattcacagagttgtgcaactattatcataatcaattttagagacacaaaaggaaaccctgtacctataagtagtcactacccatttttcctgaaccctctcctcttccagcccctaggaatcatatatctactttctgtctctatagatttgaccattctggacatttcatttaagtggaatcatataatgtataatcttttatgactggctttttcacttagcataatattttcaggattcatccatatgaatcctgtatttcattctttttatggttgaatgatattctattatatagttatattacatttatctattcatcaatggatggacattaggttgtttccattttttgcctgttgtgaataatgctgctctcaatatttgtgtacatgtttttgtgtaaacatttgttttcaattctcttgagtatatacctacaagtggaattgctgggtcatatggtaactctctgttgaactttttgaggaacttccagactgttttccaaagtggctgcaccatattacatttccacaagcaacatatgagggttccaattactcttcatccttgtctacacttgttattgtctattttttattatattcttcctagtgaatttgaagtgatatttcagttgtggttttgatttgtattttcctgaagactaatgattttttcatgtgctcattggctacttatacgtatcctttggagaaatgtatattcagatcctttgcccatttttcaattgagtagtttttttttttttttagttgtaagtgttctttatatattctggatatgagtctcttatcagatatttaacttgcaaatattgtctttcattctatgagttgtttcttcactcttatttgtgtgaaggaaaagaaagggagtattgccatcttaacaatattaagccctccagtctatgaacatgagatgtcttttcatttacttagatcttctttactttctttcaacagtgttttgtagttttcagcataagttctacccatcttttgttaagtttattcttaaacttttatgctgcaaagtttaatgtccaatttatctaattttccttttgtggcttctcctttaggtatcattttaaagaaagtattgcctaacccaaggtcacaaggatatacattaatgttttcttctaagagttttatagttttagcctttacatttaggtctgtgatccattttttattttattttatttttattttggcaagcctgtacaacctgcactgagggatgcattgatgcagtcaatatctgaagatgaactattaaaaagtaagtgtaaaacagtgtcttaggttagggtccctgagaaatacactctaagatggagttagaatataagcagtttgttggggaatgcactccgatcaactcctgtggggaagtgaaggaaagcat

SEQ ID NO: 49548 - DNA, 1033 bp, Homo sapiens
agactgcttccacagtgtaccaagtgtctggaatgccctctcctttgtctgccaaaccatttctctgctgtaagcttgagagtgctagaaatctcacctccttcgttaaactctgttgacctaagtgtcatagaagtgacagttccctgaggctcagatcatgtaaacacttctccctgtcagtttatgtagatgttcagtgttttatactcctattttaggtatctttgtgggatggttatctgtgttgtctggtatcttagatttttaaatccacaaaggggagaaatcctatcagacttactgagtattcagtcacgcaagtaactaggcatttaatgtactgttctttgatggcagtgtcattgaggaaaaaagtgaacaaattacttctgtgaaaaattaaaactcttgctgcttgttgaactttctaataaataactgagcttataggcttaggaaatgggattgggatgttcaacgtttcaattcttggccacatagtatctactataatgttttagaagttttatttctctttcctccatactagtcagataactcaaatatttgacttcatcgcttagtaatctttgtatgcattataatgctgcctttcagtttacatgccattaactagagaagtcttaaatttctattgttaaattctccacagatctgactgaacgtgtggtggatttctacctctgggaatgcgattatttattaactgccttgacaaaaacttttagacagagacaaaacccttcacaattagaactctgcctgtatttcctcctttatgtcctgccataccctatcactcatctagctccaacagtaccaaagtaatagtaatttcccatgcccacagccatacctttgtacacataatgttatcttctcctgaagtgcatttttctttctctaaccccttattcatctggcatattcttgacttatctaaaatttcttctattctgtgagcattttttgacacttgtactagacaaagttagttctattttcattc

SEQ ID NO: 49549 - DNA, 1895 bp, Homo sapiens
attttccagtgtaagtgatatgggtaaagagactgagaagccaaactgaaagtggtaactaagagacagataagatgagcaggggtttcagcggtctcacagggctgtagagataaaaagtgaagttcagctatatcctgacagtcagaacttgagggtctaagatgccagagaaaaggaaagtacagtgagtttagttcagtattttacactattttttcctttgaggaattggctgatttataagtggtacaaggcaaaaaagttgagaagttaagcagagagtggcagatacaatgcttagtagttaagcagagctttcatcaatttcacaatgctgaagagacagaaattagagttcagagcctgccaaagaggagggaccctggtaattattccaggttttcagtttggatccccaaagggctaaactctaggagtaaggatgaactagaaaataccatttttcacaaagactgaagtggagctttgaatcagctcaaccttagcaggattaatgtgatctgtccttcaccacctgccaaaagcaaaagtaaatctttggaggaagataatatcatccagtgctcctctaacttttaatatataatgtctggcattcaataaaaatattacttggcttaccaggtatgttagtttgctaaggctgttgtaacaaagtaccatagattgggtggcttaaacaatagaactttattgttttacagttctagaggctggaaagtccaagatcaaggttctagaagatttggagtctggtgaaggtgaaacgggagagttccctgactcccttgcaggacttgtgatgggtgtggctcacttgccacacgttcaaaccccttacaggagcgggagcacacggacaggcaggtgcacaagcctgggcgagtgcttttgggctctggccccatggtagcatccacgggtgtgttacaattaatgctcttttagcagttgccatctgcagacggctacgtgttaaaccagctcagtggagagtcagaatggcagtgttttacactctgtgctcttggtacctgggctcttttctggcgttcaagaagaatcaggtcacactgacttgatgaatggtgaatgcgggtattttattgagtggtggagtggctctcagcaggatggatggggagctgaaaaaggggtggggttagaagatgaacttcccccagagttcggctgtccgcagtgaactcctctcgacgactttcagatgctctttctcttttctccttctctgctgcactctgctgctcatctgctcatctgctcgtggagcctgaggtttggggtttatatgggtacaggatgggggttgtggagggccaaacggcaacatttgagcatgaaaacaggactacctattcccatttagggctgtggatttccaggcttgaggatggggcctttgccagggaactgccctctactacccagtatttccctgcctcctgtttggatcaaaggcataatttctttgatttatggttggccattctcctgctgtgttctcacatggcagaagggagaatggaaatctctggggtctctttataagggaactaattccatttatgagggctctgccctcatgacctaatcaccttccaaaggccctaacttcctaataccattgcattaggggttaggatttcaacatgtgaattttgaggggcacttgctgtactgtaccatctcctttcaggcctcatttcaccatccttgtctaaacttaaatctgcatctttaagattgctgaggttttctgttttgtgttgcttgttttttcctattcctaaagcatttaatagaaatagatcttgtttgggtgtgttaaagaatttgtattttgtgctttt

SEQ ID NO: 49550 - DNA, 1050 bp, Homo sapiens
aaatattcttggttgatggtgtttttttttgtttgtttcctttcattaccttgaaaatatcactctgttgccttttagcctccattgtctctaatgggaagtcagctgttaaacctattgggttcccttgtatgtgatgagttgtttttctctagttactttcaagattttaactttgtctttcagcatttctgctatgatgtgtttgggtgtagatctcattgcttttatcttacttggagtttgttgagctttttgtatttgtaggttaatatttttcaccaaatttaggatgttttttaacattattttttctaatagtttttctgcctctttctctcttgtctccctctagtactccattacatttattcagtgtatttaatggagtcctgcattgctctgaggctcttttaattattcttcattctttcttttctttcttatcttggattgcataatctgttgatctttcttcagattcactgattctttcctctgcctgtcaaatctactgttgaacccctctcatgaatttttcattttagttattatacttttcaactctacaacttccatatatatttttttctatttcatatatatagaaaatatatatgtaatatattatatgcaatttctgtgtattattgggattctgtatttgatgcggcattgttatcatagcttcctttacttctttagccatggtttcctttagttttttgaacatatttataatacttgccttgaagactttgtctaccaagtctaacacctgagcttccctaagacagtttctcttgcctactttttaaaaagctgtgtgtgagtcacactttacccattctttgcatgttttgtaattttttgttgaaaactgggaatttttgataatatagcaatctggataatatttaccaccaacacccccttccccagttcaagatttgttgttattgtttgctagttgtttagtgatttggatgtagtagttcagtgaagtctactttccctacactatgaagtctctgatgtcacctcagaagg

SEQ ID NO: 49551 - DNA, 1039 bp, Homo sapiens
gtatccctagatctctaacaacactaaactacatacaaataacacagataactttccgttgacataggactaataggattttagttccagaaaaatcactgtttttccgaagttcattatgaatcccaatgtgtcttttagaaactttttagaaacttcctctcactaaggttctttttttttttttttttttttttttttggttggggagagggggccatcgcttctgtcagaagaatagacaaaataaaacaagttagttttctttttcttttttttatgattatactttaagttctagggtacatgtgtacaacgtgcaggtttgttacatatgtatacatgtgccatgttggtgtgctgcacctgttaacttgtcatttacattaggtatatctcctaatgctatccctccccctccccctccccccaccccatgacaggccccggtgtatgatgttcccctccctatgtacaagtgttctcattgttcaattctcacctgtgagtgagaacatgcggtgtttggttttctgtcctcgcgatagtttgcccagaatgatggtttccagcttcatccatgtccctacaaagggcaggaactcatccttttttatggctgcatagtattccatggtgtatatgtgccacattttcttaatccagtctatcattgttggacatttgtgttggttccaagtctttgctattgtgaatagtgccgcagtaaacatacgtgtgcgtgtgtctttatagcagcatgatttataatcctttgggtgtatgcccagtagtgggacggctgggtcaaatggcatttctagttctagatccttgaggaatctccacactgtcttccacaatggttgaactagtttacagtcctaccaacagtgtaagagtgttcctatttctccacatcctctccagcacctgttgtttcctgactttttaatgatcgccattctaactagtgtgagatggtatctcattgtgattttgactcgcatttctctaatggccagtgatgatgagcatt

SEQ ID NO: 49552 - DNA, 1089 bp, Homo sapiens
tcatttagtgctatgaatttccctctacacactgctttaaatgtgtcccagagattctggtatgttgtgtctttgttcgcattggtttcaaagaacatctttatttctgtcttcatttcgttatgtacccagcagtcattcaggagcaggttgttcagtttccatgtagttgagcagttttgagtgagtttcttaatcctgagttctagtttgattgcactgtgatcagagagacagtttgttataatttctgttcttttacatttgctgaggagtgctttacttcccactatgtggtcaattttggaataagtgcaatgtggtgctgagaagaatgtatattctgttgatatggggtggagagttctatatatgtctattaggtctgcttggtgcagagctgaattcaattcctggatatccttgttaactttctgtctcgatctgtttaatgttgacagtgggatgttaaagtctcccattattattgtctgggtgtctaagtctctttgtaggtctctaaggtcttgctttatgaatctgggtgctcctgtcttgggtgcatatatatttaggatagttggctcttcttgttgaattaaaccctttaccattatataatagccttctttgtcttttttcatctttgttggtttaaagtctgttttatcagagactaggattgcaatccctgcttttttttttccatttgcttggtatatcttcctccatccctttattttgagcctatgtgtgtttctgcacgtgagatggatctcctgaatacagcacatggatgggtcttgactctttatccaatttgcgtctgtgtcttttaattggagcatttatcccatttacatctaaggttaatattgttatgtgtgaatttgatcctgtcattatgatgttagctggttattttgcttgttagttgatgcactttcttcctagcattgatggtctttacaatttgacatgcttttgcagtggctggtactggttgttcctttccatgtttagtgcttccttcaggagctcttgtaaggcaggcctggtggtgacaaaatcagcatttgtttgtctgta

SEQ ID NO: 49553 - DNA, 1052 bp, Homo sapiens
tatattgcccaggctgatctcaaactcctgggctgaagcaatcctctcaccttggcctcccaaagtgctgggattacagacgtgagctactgtacccagcctatcaagtacattttatgtgtcagttaatattatcatgatgttcttatttatcctgttgatatagtggattacattaaatgattttctaatgttgaaccagccttgcatacctggaataagacccatttataatgaatcattttatacaatgttagcttcaatttgttaaatttttattaaggtaaaatctacataatgtaaaattcaacattttattttatttttaataatttcaattttcattttagattcaggggtacatgtgcaggtttgttttacaggtatattgcatgtcgctgaggactggggtatgattgatcctatcctcattagtgagcaaagtatccaatagttattcaactcctgtgcccctccctccctccatttggtagtcaccagtgtctattattgctgtctttatgtccatgtgtacccaatgtttagctcccacttatgagtgagaaaatgtggtatttggtgttctgttcctccattaatttgcttaggataatggtctccagctgcatccatgctgctgcagagggcatgatttcattcttttttatggctgtgtattattccatagtgtatattgactacgttgtctttatccggtcccatagataggcatctaggttgattaaatttgccactttagactgtaccattcagtgattcctagtatattcacagtgctctgcaaccattgctactaattccagaatattttcatcacccccaaaaaaccctctatccattaagcagtcattccacacttcttccgttacacattaagccgtcatttcacacctattccatccctagcccctgataactactaatctacttcctatttcaataaatttgtcaatgatagacatttcatattaatggaatcatgatacacacctttacgattagcttctttcagttagcatgttttcaaggtt

SEQ ID NO: 49554 - DNA, 1067 bp, Homo sapiens
caagaagagtggttgaaagaaaaaaaaaaaccttgctttgagatataggcagagctcagactctgtaggacattgtaggccatagtagtagtaaagttttcggcctttagccactgaagggctttaagtaagggatattgtgatcagcttcacattaaaacaattttaaacattttatttggaaataatttagacccacgagaagtttcaaaattagtaaggaagttccagtgtacccttcactcatattcccccagtaataatatctgaaataatgttaggacaattattaaaaccaggaaacagacactgatacaacactattaactgaatgacagacactttttgtattttatcagttagctatgaatttctaaaagactcctctagctacaatataaacaatgttttggaggactagagtgaatgcgtggagaccagtgaagaggctattgcagtagataaggtgagatgttggtggctcagactaggatgttggcagtgaagattctgaatattagattcaatagatatttgggaggtaaaataaagtgaactaggtaattcattggatgggatgttgaaagagagaaagtcattatttctaggtttctggcttggataactgaatagaaggtgatgctatttactgaaataaggactaggtttgtgtgtatggaggggcagagatgagtagctcacccttggatggacaggtagatctgttgagtatgcaaatgaatttgaaactctggagctcaaaagaggggctacatagtattctatagcatgatgtacaatgacatatttatttattttttatttttaaattctttgtagagttggggtcttgctccgtcacccaggctgcagtgcagtggcacaatcatagctcactacaaaagcttgaactctcgggctcaagcaatctccctgcctcagcctcccaagtagcttaatgggaggctaatccaccccaccacacccagctaattttattttttgtagagacagagtctcgctatgttgcccaggctggcatcaaactcctggcctcaactgatcct

SEQ ID NO: 49555 - DNA, 1053 bp, Homo sapiens
ttactagatctaaacagagagataggcttaaatgcaataatagtgggggacctcaacattccactctcggtattagacagattatctaaatagaaaatcgacaaaaaaacattggatttaaactgaactctagaccaaatggacctaacagacatttacagaacagtttatctaacacctacagactatacattcttctcatcagcatgtggaacattctccaggatagaccatatgttaagccacaaaacaagtctcaacaaatttttaaaaattggaatcatacaaagtatcttctcagaccacaagagaataaaactagaaatcaataccaagaggaactttggaaactctacaaatacctggaaattaaacaacatgctcctggatgaccactgagccaatgaagaaattaaaatggaaatcaaaaaatttcttgaagaaaatgaaaacggaaacacaatataccaaaacctgtgggatacagcagaagcagtgccaagagggaagtttatggcagcaaatgcctacttcaaaaaagtagaacagaactagaaaaggaagaacaaaccaagccaaaattagcataaggaaagaaataaagaccagagcacacctacagaaaatagagactaaaaaaatacaaaggatcaataaataaaaagatggaaaataatcctaaaatttatatggaaccacaaaagacccagaatagccaaagctagcctgagcaaaaagagcaaaactggaagaatcacattacctgacttaaaattataccacagacctatagtaaccaaaacaacatggtactggcattaaaacagacacatagaccaagggaacagaatagagaacccagaaacaaatctatacagtaaattaattttcaacaagtgtgccaagaatatacattggggaaaggatggtcttcaatgaatgacactgggaaatctggataaatatatatgcagaatgaaactagaccccaatctctcatcatacacaaaaatcaaaatggattaaagacttaaatctaagacctcaaactat

SEQ ID NO: 49556 - DNA, 1347 bp, Homo sapiens
catatccagccaaaataagcttcataagcgaaggagaaataagatccttttcagacaggcgaatgctgggggaatttgttaccatcaggcctaccttgcaagagctcctgaagaaagcacagaatatggaaaggaaaaaccattaccagccactacaaaaacacactgaagtacacagaccagtgacactatgaagcaaccacataaacaagtctgcagaataaccagctagcatcataatgacaggattaaactcacacataacaataataaccttaaatgtaaatggactgaattccccaattaaaagacacagaaaggcaagctagataaaaagccaagacccattagtatgctgtcttcagcagacccatctcatgtgcaaagacacacataggctcaaaataaatggatggaagaaaatttaccaagcaaatggaaaacagaaaaaagcaaaggttgcaatactagtttctaacaaaacagattttaaaccaaccaagattttaaaaaagacaagggcattacataatagtaaaggattcaatgcaacaagaagagctatttaggtatcttaaatgtatatgtgcctaatacaggagcaatcagattcataaaacaagttcttagagacctacaaagagacttagactcctgcacaataatagtgggaagctttgacaccccactgacaatattagacaggtcattgagacagaaaatttcaaaaaaatattcaggacctgaaagtcagctctagatcaagtggacctgatagatatctacagaactctccacctcaaaacaacagagtatacattcttctcattgccacattgtacttactctaaaattgatcacataatcggaagtaaaacactcctcagcaaatgcaaaagaactaaaatcataacagtctcttagaccacagcactatcaaattagaactcaagattaagaatttcactcaaaaccacacaaccacctggaaattgaacaacctgctgctgaatgactcttgggtaaataatgaaattaaagcagaagtcaagaagttctttgaaactaatgagaacaaagagacagtgaacctgattctctgggatgcagctaaagcagtgttaagagggaaatttataccactaaatgcccacatcagaaattcagaaagatctcaagttagcaacctaacatctcaactaaaagaactagagaaccaagagcaatccaaccccaaacctagcagaagacaagaaataacgaagatcagagctgaactaaaggagatagagacatgaaaaaccctttgaaagctcaacaaatccaggagctggttttttgaaaata

SEQ ID NO: 49557 - DNA, 1028 bp, Homo sapiens
gcctgtaatcccagctactcaggaggctgaggcaggagaatcacgtgaacccgggaggcagaggttgtggtgacctgagattgtgccattgcactccagcctgggcaaaaagagcgaaactctgcctcaagaagaaaaaaaaaggaaaagaaaaaaaagtaagtcaattaatgtgatacaccacataaacagaattaaaaacaaaaatcacacgatcatctcaatagatgcagaaaaagcatttgacaaaatccatcatccctttatgtttaaaaccctcagcaaaatcagcatacaagggacataccttaagataataaaggctatctatgacatacccacagccaacattatactgaatggggaaaagttgaaagtgttcttcctgagaactgaaacaagacgaggatgcccactttcaccatttctattcaacatagtactggaagtcctagccagagcaatcagacaagagaaagaaagaaagggcatccagattcgtagagaggatgtcactgtttactgattatatggtcatatacctagaaaaccctaaagactcatccaaaaacctcctagaactggtaaattaattcagcaaagtttcagaatacaaaattaatgtacacaaatcagtaggtctgctatacaccaacagcagccaagctgagaatctaatcaagaactcaacccctttcacaatagctgcaaaaaaataaaatacttaggaatataactaaccaagcaaatgaaagacctctatgaggaaaactacaaaacactgctgaatgaaacaataaatggcacaaacaaatggtaacacattccatgctcatggatgggtagaattaatattacgaaaataaccatactgccaaaagcaatctacaagttcaattctcatcacaataccatcatcattcttcatataactagaaaaaacaatcctaaaattcatatggaagcaaaaaagagcccacacagccaaagcaagatgaagcaaaaagaacaaatctggaggcctcaca

SEQ ID NO: 49558 - DNA, 1091 bp, Homo sapiens
ggcagaagctaagaggagtatggttgcagctctgcatgaagaagtgatgtgtatataaaatactgaaaaagaagagaggcagagggagaaatacaagttagcatgttataatagtactttaaataggaagaagtgataaaaaatgaagttatagctatcagagatactacttttgcaagaatagtttacatggttagaaaacaaattactcagatccttatttactttccagaagtcccccaacccatgcctttagatactgaggccatcttacataaaacagctgaatggtatgtcctctgtctcaaaacctgtttcttcatgtatgtcctctatttcccatatttgaggagtatgagtctgcttgagtaacagcacctccatccttttgagagaaatagagaagtggacgctgggtaagtaatgagtctagttttggatttactgaatttaggtcctaaagtgacaactggatagtcatttccatagacacatttacttgaaatgtgcaagtaaaatttatgagactgttttgtgactgatgtgaaaaatttaggaggcctgtgctttcgttggtgtagatgagtttgccaaggaaaaacatgtagacagaaaaaaagtcaaggataaaactttggggcaagttaagggagaaggaagaggaaggaaagagcaatcagaaactcagtaaggtggctgggtgcggtctctcacacctgtaatcccagcactttgggagactgaggtgggtagatcacaaggtcaggagttcaagaccagcctggccaaggtggcgaaaccccgtctgtactaaaaatacaaaaaaatttagctgggcctggtggtaggcacctgtaatcccagctactcgggaggctgtggcaggagaatcgcttgaacccgggaggtggaggttgccatgagccaagattgcgccactgcactctagcctgggcgacagagcaagaccctgttgcaaaaaaaaaaaagaaactcagtaaggtacaggtacttaaaggagcctggaaaagagaaaacaaatgttatgtcctccttgaagcctttccctaattatcttccctcccagatac

SEQ ID NO: 49559 - DNA, 1094 bp, Homo sapiens
tgaatgtgaaaaaacccatggacaatatttataatgaaaataggtggcagtgtatccccatgaacctcacaataaaaacaggtaagggcaaattacccatagccacaagatccagcagttattggcatctgtgcaggagaaaaccagagttgacaggccatctgaaaaacttgacaaacagaattccaaaacagtgtattccctagaaagaatggcagtccaatttaagaactgcagttgaaactgggagggatgagtatgagggtccaatagtcagaaggtctgaaagcgatagagtagtctagtccttagtgaactcttgaagttgatccaccggtctcccttccaggacagggactcacactgaggagaaattgctgagagtagaattgaaattaagcaggacaggaatagaaaaagaaagaaaaggtccagatgaaattaggagagaggaccagaaccaggaactccaatcaagcaagtaatcatatttctttaattcacatgaaaacagcagaaagggagcccttatgaagttagaaaagctactctgaaccatgcttctttctacaagtttaggaaaacatttcacgtaaaaatgaacaacagattgtggtgatggttgcacaactctgaatataaaacactgaactgttggctcacacctgtaatcccagcactttgggaggcggatcacaaggtcaggagtttgagaccagcctggccaagatggtgaaaccccgtctctactaaaaatacaaaaaaaaaagaaaaattagccgggcatggtggtacgtgcctgtagtcccagctacttgggaggctgaggcaggagaattggcttgaacctgggaggcagaggttgcagtgagtcgagatcgtgccactgcactccagcctggcaacagagtgagactttgtctcaaaaaataaaaaaacaaaaagaaacactgaaatgtatacttttaagtgggtagattttatggattgtgaaatacagcacaaagctgagaaaaagggaacagaaaattatcaaagtcaaaccctacacaaagttattagaagagaaaaacactacagaaagacacgctcaa

SEQ ID NO: 49560 - DNA, 1080 bp, Homo sapiens
atagtggtgactctggaccctggaagctctatgaggccgggtgcagtggcaacacagccccaggaatggtagggcatagctgtggcttgggctccagggggtgggatgcagtgcaatgttggctttgctccccaggaaggtgggacacctcagtggctcagaccccggagggctggtccagatccagggaggtgggggtgctattgccgtttggcccagagagcagtgtgtacagattagccaaggctgtgtttccctggggggtccagggacctggtgccatgcaggctaaggcaccagggtcccagctgcccccctgggccaaagctccagttccctggggctgagacactgcaccaaagaggcacaactgctgcccggcaccaggcccagcttctccatggggcctaagctcctggtcctggagggctcgagcgccacggtcacttgataggaaaaatcacaccatgttcctgggaaaggacccagaatgaccaacaagacatagtctaataaaatttccgaactttaaagaaaaaaaagccacagacatctcagtaaaaatagtaagtgatttataaaggaaagcaacttaggttaccctcagattttttgagatctatactttatgccagaagaaagaagaaaatggaatagcaggtatttaagaaactcagagggaaaaaaatgtgagccaaggaacattatacctggtaaaactgactttcaagtataaagagtacagatatttatcaacatgcaggaattcaagaaatattgttccaccatcccatgaatttgctagagaatgagcttcagacagccaaagtgttgagagacattgaaataaggacaggtagcaagcgttaaatgtacagttacttgtagaattaagatgaaatgaggattaaaagggagatagagtatgtaatgcctatgtgcccagataatgtagataactttttaaaaatggagaaatggggaaatcatgcaaaattttaacagttctcagtaattatattggtggagtgtcaaagttagtgttattattccaagactatgtataatgtgagataatat

SEQ ID NO: 49561 - DNA, 1053 bp, Homo sapiens
ggtatgcatcaagctgataacagtgcttacttctggagggggactggaattttggcagggttgaggcagtcaaggagacttgacctttacaagtattatctatttttttatataaatatatttatatgttacttctataagtaaaaatatagaatatatttttctataagtatagataaatatagaatatatgtaatatagaatatatgatatactatatatagaatatatgtaatatagaatatatcatatatattctgtatgtatagaatatagaataaatgtagaatatatcaaataaagaatatatgaatatacacatacatacatacacacccatgttattagtggttttaaatatgcagggtagtttgggcgtggtggctcatgcctataatcccaatactttgggaggccaagggaggtggatcacttaagctcaggagttcgagaccagcctggccaacatggtgaaaccctgtctctactaaaaatacaaaaattagccaagtgtggtggcaggtgcctgtaatctcagctacttgggagactggggcacaagaatcttttgaacctgggagacagaggttgcagtaagccgagatcacaccactgcactccagcctatgtgacagagcaagactctgtctcaaaaaaaaaaaaaaaaaagcaaggtaactataaagattgattttcattggttatactgaagtgactgagtacattgcttggaaaacagctctaggctatttagaaagcttctctgatatagccccacctaatctgcctctgcttattcgtgtcagtctaatactggtctagggcgtgcatataatcttcttggctgccaactactcatccagtcagttttcgccaatcttttttggttatgagaataggatggaatttgggttttccactgtcaaacttcagtttctagacttcgttttctttttttttttttccatttaaccctgagtggacacagcacatgtttcagagagcacagggttgggggtaaggtcacagatcaacaggataagaatttttctt

SEQ ID NO: 49562 - DNA, 1035 bp, Homo sapiens
ttagcagtttatcaaaaggctaaataaaaacgtagaggtaccatatgatccagcaattccactcttagttttgtctacccaggagatacgaaaacatgtcatatatgcaaaaccttgtacccagatgttcatgcagcagtagtcataatagccaaaaagtggaaaaacccaacatgtccatcaactgatgaatgggtaaataaaatgtggtctatccatacagtggagtattattcagccatacaaaggaatgaagtactgatacatgctacaacatggatgaggcttgaaagcattttgcttagtgaaagaagccaatcacaaaagaccatgtatgataggattccatttatatgaaatatccagagtaggacattaaaatctgtagagacaaaaagtagattagtggttctctagggctttggggtggggtgatggggttgtagggtgatcactaaacagtatatttctttttgtggtaatgaaaatgttctaaaattaagtgtggtgatgtttacatcaactgtgtgaatgtgccaaaagccattgaatcatgtactttaaatgagtgaattgtatggtatgtgaattatatctcaataaaactgttaagaaaaacaaaagaagaaaggagacatctctataaagtgatgacaactttacattctacaggaatatatattccacattgacaaggatctttgttttgctcacttctgcatttccaatggctagaacagtggctggcaagtagtgggcactcaataatgtttagtgaatgattttaatcataattaatgcaaaatatacctttcaaaaaatgaaggaagtagggcaacaaaaagtaccgcgggcttttcagtgactgtaaagtcagaggaaacagctagtttgaagagacaaagttggttttaggagaataatctttgggatggagagacctagaaaatattggataatgttggcctagagttcaagggagaagttgggctggactttgcaattaagagttgtctttgtgaggccaaggtgggt

SEQ ID NO: 49563 - DNA, 1050 bp, Homo sapiens
gtgtgagccaccatgcccagcctaatttttgtatttttagtagagataggggtttgccatgttgcctaggctggtcttgaactcctgagctcaagcagtccacccaccttggcctctcaaagtgctgggatcaccgctcccggcctagaacattttccttacccctcttcttttaatacataaaaggtgtgcaagcattagaaagatgatgggtttaggacaattgcttcctaatgttcctcctctggatacttagaggctggtggcaacttgagaatgctctaactgtgagattctttttttatttgttaatttatttgtagaaacagggtctcactatattgcccaggctggcctcgaactcctggcccaagtgatcctcccacctcgacctcccaaagcactgggattacaggcgtgagccataatgcccagccaagattctttcaaatacctggtttgcttaatgtgggtttaacccataatgaagtataggaactgtgtctttctatttgaactttgtattgtgcccagcatgggtgctttacaggtgtttttatgatgaggctttggaaaatattaaaatagaaatagaaatgctaaatgataagataccacagtaagagatactatttagtggtttcactcctgattgctctaaacggttatggacacagcaatcctacctattagctaaaaatagcatgatgttcttggacatgtataatactgcttaaaattcaattgaaaatttaaacaactggctcttggcaaaggctctcttaaaatctattctaaaatgaaaaatatttttctgtgacttgtggaattgtcccaccaagggaaggatgggttatgtgttagaacattttgagatctcctacattttccccgtagtgactttatatcagcctctgtttataaactgatctagtatttttcttgaaagcccttttgtttttagagtagaaactgatctcaaaaacaggaggtgagccagaaattggtcattaaggtagcttaactgggaaatgatcctttatgaccagt

SEQ ID NO: 49564 - DNA, 1035 bp, Homo sapiens
caagtgaaatggagttgtatttgtcattcattttttatgaccttacgattcattcatttaagagtatacttaagcggtttttagaatgttcacagagttgtgcagccatcaccacaattgattttagaattttaatcacccctgtacgctttagctgtcacccttcatctccccatccccctcatgtctaagcaaccactaatctattatactttttgtctctatggatttgcccaatctggacattgcatataactagattcatataatatgtgactggcttctctcacttagcataatattgtcaaggttcatctgtgttgtacatgtatcaatacttcattcctttttatagctgaatatatatcattatatggatataccacgtattgtttatcggttgatggacatttgggttgttttcacttttttgctattatgaataatgctctgtgaacatctgtgtgcaagtttttgcatggacatgtttatatttctcttgagtatacatacctgtgagtggaactgctggatcatttgacaactctgacctttggtggaatggccaggctgctttccacatttaggctgcaacattttacattcccaccagtagtatgtaagggttccaatttctccacatcatccccaacacttgttattgtaagtccttttgattctagccatcctggtaggtgtgaagtggtatctaattgcggttttgatttgaattttcccccatggctaatgttgcacatttttcatgtgcttattgtttgctattcacttttgttttgcttcgtcccctgatttgattctcttgattctctctctgtttccaaattgacttgagaccagagcaagccaactatgttattaggcaactagaaagaaccaggaagataactacttctcactgctttgtgtgctcggggggtttaaggctttgggcgtagataattttagcttaggaatgctgatctgataaaaatgatagggcccccccttttttttttttttgagacagagtctcac

SEQ ID NO: 49565 - DNA, 1052 bp, Homo sapiens
gtgtacccaccacctggagaacagggaaaaggtacaaatctgtctttattctcatgttttttggatgaggtattttgttttggtggtctttatgtatactttggcttatgggttgcaagagccaaagactctgttaatctttcatttgaatatgctatatgaaattgctttaagatatagagaaggccctattgaggcttttaccctgagctgctgggtgatccggaataggtgagaaggcaagatcctgtgaatactttttcttagtttgatgtgagatcaaggcatttttcattccagtcattttagaccaggtagatttttttttgtttgtttgtttcatttttgtttatgagatggagtctcactctgtcgcccaggctggagtgcagcggcgcgatctcggctcactgcaacctctgcctcctgagttcaagcgattcttgtgcttcagcctcctgagtagctgggattacaggtgcccgccaccatgcccaactaatttttgtatttctagtagagatgggttttcaccatgttggccagactggtctcaaactcctgacctccggtgatccgcccgcttcggcctcccaaagtgctgggattacaggagtgagccacgcggcacctggcctagtatagcattttcactcagtagctcttcttgcatcctcactaagctctttgggggacaaaaacatccagtcaatagggataaactggaaatttttatggcatgctgatccggcatgttttgttttctgttttcttctcagtatccttcaggatggtatccagaaccctggctatgtgtgtgtatggccgaggaagcatacacagtgacagtgcagggaccagaataaggacacccagctttctgggttagtcatagttccaaaattattctaaaagtagaactgaaattatttttcctcaagcaatatttgcccattgaagcctatttgccatatttctgccctctcacatagccttgagaaatatttttggtaatttatgtttattgatttggtattgtttttacccaaaga

SEQ ID NO: 49566 - DNA, 1081 bp, Homo sapiens
ctcaaacaaatatacagtgcaggccgggcatggtggctcatgcctgtaatcctagcactttgggaggctgaggcaggtggattccttgaggtcaggagttcgagaccagcctggcaacatagtgagacccccatctctacaaaaaataaaatataaaaaacaaaaaaaaacccacaaatacacaatgcagcattgattgtaatattaagaattgtaaacaacttaaatgtgtatcaattgaaatatgactgaataaattatggtctgtccatagtatggaatcctatgcagctattaaaatgaagtctgtgtactgacatggatgattttttgtttgtttgtttgtttgagacagagtcttgctctgtcacccaggctggagtgcagtggcgcgatctcggctcactgcaaccctcgcctcccaggttcaagcgattctcctgcctcagcctcactagtagctgggactacaggcgtgtggccaccacacctggctgatttttgtagagacggggtttcaccatgttggccacactggtcttgaactcctgacctcagatgagtcaccatgcctggccaacatggatgagttttcatgatgtatcagaaaatgaaaaaagcttgcgtgtgaattgtgagtacatgtatataagccatatatgcatggaagtaagtctggaaggacacatactaaaaataccaacagtggtatcttctggggagtgggatggagaagtgatacagaatttttaaaaagtgtaaactcagcagctttctttgcaggcacataagactgtggcatctttagggctttcctttcctgaaggatttgcaattgtattaccaagttttatttttgagagcttatccactctctggccccacctttcttttcagagacactgcaggatccaattctgtaagttaagaccagcagctccaaactttatcagaatcacactgatgcttgttaaaatgcagattcctgggcccctgctcagtagattctgattctgtgtatctgggatggggtgccaaatcctgatcttttagaggcaccccaacttgtcagtgactgggg

SEQ ID NO: 49567 - DNA, 1050 bp, Homo sapiens
ttgccttgcccactggaagagtccacagaaataaacctctcttgaacttcttgcttagggttgggatgggtaggtgtttaactcagaccattctgatgtgaaggcagtacaaagacactgagtaagttagagttccagggatgaccttgttctatacttgtatttaatttaatttaatttaatttaatttattgaatgagtaaagcaaagacccttgtgctccaaaggttgccaagaggctcaagagtacagttgtagaaatagcttttgaaagtccgttcgggctagcctggctgcattctttgcagccataggatggcattcaggtagtttgggagtcctggcctcctgactggccatctgccatctcagtcgtcttaggaaggaaatcatgttagagcatctgtagtcttgattcaagaaacaatgtcagacatattggcttgttcattaaagaaggctggagaatgctcattcctgtcaacaagcagacattaattgtgcaactactctgctttgcccagggtggtgcttggtggagcctgacttggtcttgcttgttaatgagtttcaatagtgtattaagatgccaatggggaaatattggcaggcttcactagctgatagaatttgggggtggggataatatgtattttaaaaagcaacaataatgtatgtaagtgttcagggctaccagagggtggggcagagcttcctgcatcagtgatttctagaactacctattcccaaacactagtcctgggcttgcactcataatccctcagctcatcctatcatctgcaagtgctgtgagccccaaacagtcgctcattgcgggctaattggtccttgaatgcctctccaacatcataattgccataaggcctgacactttgagacagacaaaggaggaaggtgctcttaacctgctctccatgcacctttcttcaagatacaccagggaggcccgatcactccttttgtgttgacccacactgtgcctgtctgagtgctcgggtttgtgctgttaggctgctcttcagaggctgc

SEQ ID NO: 49568 - DNA, 1030 bp, Homo sapiens
actaaatgaatgtcaaactccttagctggacagtgcaggctgtccacagtcaggccccaacctgccattctctgaggcccagccagacttggatgcacggctgatccctgaaaataaccctgtgcttcttgcctccagacctttgcttacactgttctctttagctggaaggacctctccccagctctaccttttgaaatcctaaatcttcattgagaaccaattcaaaaagcagtatctccttgtagcttccccaaactagatgtgatctgtactccctgtgaatccttctaggccttggtttgtcctccttttgggcttcttgctacaacatccttagtatactacaccctctgtcacctagtaagctccacaagacaataaactttgttcttgtatctcccatgtatctaacacatactccgtataaagaagactaagtagtttttctttgagacagagttttgctcttgtcgcccaggctggagtgcaatggcgcgatctcggtttaccgcaacctctgcctcctgggttcaagcgattctcctgcctcagcctcccgagtagctgggattacaggcatgcaccaccatacccagctaatttgtattttttagtagagacagggtttctccatgttgatcaggctggtctcgaactcccaacctcaggtgatccgcccgcctcagcctcccaaagtgctaagattacaggtgtgaaccaccgcacccaaccagactaagtatttaaatagtggaagaatggtatttttccacatgtagctgagtgaagaattagcttttttttctttttctgagatggagtctcgctctgtcaccaggctggagtgcagtggtgtgatctcggctcactgcaccctctgcctcctgggttcaagcgattctcctgcctcagcctcccgagtaactgggactacaggcatgcaccaccacgcccagctaatttttgtatttgtaacagagatggggtttcaccatgttgaccaggatggtctccatctcctgacctt

SEQ ID NO: 49569 - DNA, 1450 bp, Homo sapiens
cccaacagtgctgctgaccaaagccatagcacatctgcatactcccagcgccttgacgaagctatctgtctccttcatacaactcaccccagagcattacccaacagggaatagggggccctggacagatgtggccttttctgggtaataggagcaaaaagtagggcctgtctacttcagagatcgaatttcttaggccactttgggtggccctcgtgcccctcccctcacccccacccccggccaaggtggatgtttagaatgtcactggatttctgcttgggacttggtgaatagggagtggctgggctgttacaatctctgctttttcagggcaagcactgcatcttagatgtttccggcaatgctatcaagagactgcagcaagcacaactttaccccattgccattttcatcaagcccaagtccattgaagcccttatgtaagtgttgaactgagaactcagacacaccaagctaagatcgggtctggaagggaaatggagaagaaagtgatttgctgggcagaaacttgaaagaaactctgtgccccagctctggtcactgggcgctcctgttttgagggcttgtgcatatgttcatggttggacttttgaacgcaggtttgaggagttagctacgggccactgctgctctgagagggcagcttagcagatttttagggatcctggaataatcctttatggttaatcagaacataagatctggttcagaactatttttcttctgtctttggcagggaaatgaaccgaaggcagacatatgaacaagcaaataagatctatgacaaagccatgaaactggagcaggaatttggagagtactttacaggtaagactcctgctgccctgcggggggttctggggaactagccaggtacctgtttctataagtgtctcaaagaggtgtagacagaatgtagaaaccttgcacggagtttccagttgcttttaagtttttgagcacaaacctttccaaagcacacaagttccccgtgtccagccatagcagttcagccagtttatagcataaaccactcaccaaatgcttccttgaattgttggtttgttcattttgtcttgtccttactagattgtaggctccctgtattactctgtctccctccgtttcagctccactccccctcccccagtactttgctttgcatgtttaggtgctgaataaacgtttgttgatgatgatgattcctcggtgtgctgttcaagttgtctgttggggtgtctgtctgtctgtctgtgtgtgtgtgtgtgtgtgtgtgtgtgtaaggtcagttcctgaaacattgggaaggtttctatgtaatacgttcttcaccttttgaagtacagtgacatatatatacataaatatatgcaaggcagtgccgaatccattctagctggtggtgacactaggttaactgtgtaaa

SEQ ID NO: 49570 - DNA, 1191 bp, Homo sapiens
gagttctaaatgaagatgtctgattgaagatgtctgattaaagatatgtgcttatctccctcccttttgacatcccattaaaatggtaataaaagaataagcccttaagagtgaagaaaatgggcttaacaaatttttggaagattggaagtgtgtcaactgatgaaacagaatggaacaagccaacgtgcctggcagaatcccagagaggttcctgtttcagagctaggaagtgctcaaggtcaaaataagaagggagtccgaaaactagggggtgaactgaaaacctgtgaaagaagtgccccccagccctaaaggccaacccttttggaggtgcttatcatgcaaaaggaatcgtgctggaaaaagtaggagttgaagccaaacagccaaattctgccattaggaagtgtgtaagggtccagctgatcaagaatggcaagaaaatcacagcctttgtacccaacgacggttgcttaaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaaccctgtagtaataaattttcatatgccaaaaaaaaaaaaaaaagaagtgcccccattggctccttatgatccccccacccatcatccccatatttagcatagttagcccaatctttatctcctagccaaaaaaaaaggagggaagggaagggaagggaagggagaaaagaaaaggaaagaagagaaaagaaagaaaagaaaaggaaagaaaggaaaggaaaggaaactggaggactcaacagaaatagaataagctgcctaaagaaaactaaggatcatgtaggtgctagtgccacagagcaaaataaaattcttcctaatttggcatttgagggcctccagcctaaaggcagcttccctaacctaagtctaaaagagaaagtcatatgtagaaagctgaaactggatcccttccttacaccttatacaaaaattaattcaagatggatcaaagacttacatgttagacctaaaaccataaaaaccctagaagaaaacctaggcattaccattcaggacataggcatgggcaaggac

SEQ ID NO: 49571 - DNA, 1051 bp, Homo sapiens
cttgtgctgctcctctaacaatggcacttgtggtttcaacgatctcctctgcaatgttgatgtgagacttggggtggggttttgctagtggggcagtgaccagggcagggggctggttgtgatcctctgaccagggacagagttccgtagagtggaggcacaccgctttgagtgggcctccacactgagtcatggtgtctgtctgttttttcctccaggtcagtgacctatcttttcatgactcgctggctacttttgttgccatcctcatcgctcggcagtgtttgctcctggaagatctgattcgctgtgctgccatcccttcactccttaatgctggtgaactaccaatctgtaacccctagcatttctagacctcaaatttcaatacacactggacggccatcctctcattgttcactgtgggagaccttgctgcggctccctggccttcctcagaaggccagtcctttggtatgctgaaggctagaagaaacctgttttttagccctggatttgcagccctgacctttccaatttctgacccttcaactgcgtaacagttctctgctctacctcgctttcaatattatcttgctttttctcctttcactttacctcatcttctctcccatgcccctgccatacacttgcatgcatgcaggcacgcacacacataaacccacatacagtttaacttcatcccttccagatctgttttgtcttccttttagcttgtagtgaacaggactctgagccaggggcccggcttacctgccgcatcctccttcaccttttcaagacaccgcagctcaatccttgccagtctgatggaagtaagtgaccctgatctgaaccagccaacagtagaaagtgtggttcccctgcctccgtggattctacttttgcttcccctgacttcatcgccttccccagacaagcctacagtaggaatccgctcctcctgcgaccgccacctgctggctgcctcccagaaccgcatcgtggatggagccgtgtttgctgttctcaaggctgtgtttgtacttgg

SEQ ID NO: 49572 - DNA, 1077 bp, Homo sapiens
tcactctctccccgcataactctcttccgcatgtatatgtgtatccatgtctgtctgtctgcttcttaccatctctcctgaatctgcctatgactttctttctacccattcctacaaatgcttgcagtcttctgttttctaagtcccaacagcttattgtttttcattttctggagcagggtctacaggtttccaccaaacagaagatctcgccctgggatctttttgaggggttgaagccgtcagcaccactctcttggggctggtttggaacagtccgagtggaccggcgagtggctcgaggagaggagcagcagcggttgctgctctaccacacacacctgaggccccggccccgcgcctattacctggagccactgccactgcccccagaagatgaggagccgcctgctcctaccctgctagagcctgagaaaaaggctccagagccccccaaaactgacaaaccgggggctgctccacccagtactgaggaacgcaagaagaagtccaccaagggcaagaaacgcagccagccagctaccaagacagaggtgagcgcctcccccgtgacagttctcccacagcctctcacttcatgacgctccggtttctggtttgtgggaggggtgggggcgcataaggaaggggtgccattagaatcataataaaaattaaccatatacgaattcagctcctctttacctcattctcccccagctccccgaccccattcagctacaacccactcaccctcttcctctgccactcacacaggactatggaatgggcccgggtcggagcggcccttatggtgtgacagtgcctccggacctcctgcaccacccaaaccctggttctataacacaccttaactacaggcaaggctccataggcctgtacacccagaaccagccactacctgcaggtgagtgccagccactaggaatgctggagggacctacctgtacactccccctgcccaaaggatgatgccattcccctgaggagctatggatgtcaaggacactgagcaagagacagagggatgaggagcctagaggtcagcccactctc

SEQ ID NO: 49573 - DNA, 1048 bp, Homo sapiens
tatgaaattgatgatcacctaagtgttattgacttctagaactacatgtgatttattgcaaggccatcagaagcaaactagggtggccaaagagctgaagcacacagttaagttctttcacttctgtttctttgtatggttgtttagtttttccggggagatattgaactatactgctttagactgttgatggctgctaaggtgttctttgtcaaactgagttattctgattttcctctgcttcctaggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacgtaagtgagggtcattttcagacgtagaccttagattgctaattccttccatggtctggagagttagcctctagtaaccacttttctatgtttaaagacttttggtcagcctggcatggtggctgactcctgtaatcccagcactttgggaggccggggcaggcggatcacctgaggtcaggagttggagaccagcctgaccaacatggtgaaaccctgtctctactaaaaatacaaaaaattagccaaacatggtggcgtgtgcctgtattcccagctacttgggaggctgaggcaggagaatcgcttgaacccaggaggcagaggttgcagcgagctgagatcacgccactgcactccagcctgggcaacagagtgaaactgcctcaaaaaaataaataaaagactgggcaaaacagcggctcacgcctgtaatcccagcaatttgggaggccgaggcgggcagatcatgagttgaggagatcaagaccatcctgg

SEQ ID NO: 49574 - DNA, 1923 bp, Homo sapiens
ccctagctaattcattgtgccagtgacatgtgtagagaagaagcctggtggggtatgatttgattaacactgaactttgttctttcttccagatttcctcgtcctgtgactgtggagcccatggaccagttagatgatgaagagggacttccagagaagctggttataaaaaaccagcaatttcacaagtatgcagtcttgatagatttccctattaggtgtttccttcttaagaaagcttataaagggatatgtaaaagaggcaggtctttgctgcacatgttcactggcagccattatcttggtcctcacaaggaatgcaattcttagctggggtaattctggacaaagttagtaacctaggaaccttgcctatagggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacagggtgagtctaggcctgtaagtcttaaagctgaaaggacaaaatgacatttttaaatgggtttctttgtatcaattaacagaagggcctacatctctgcttttatacttagtttgcgttgattttggtagataaataggcttggagatgtggcagagatactggattctgtggagaaggaaatgataggtataacttcattttggaatctggacaccacaggtggttccaaaggaattagatcctctttgctttctggatctttatttgaagaaagtcattagatctatatgaagacaatgaggaatattcttagtctgttgtttttttagatttgatgaggcgccaagaagaacttcggaggatggaagagctgcacaaccaagaggtgcaaaaacgaaagcaactggagctcaggtaacttttctcgaacactttttccctaacaactctaaaaggtaatgtctcactcctctttcctactgccatgctacctcgtgtatttataaatgtgttggcaaatatttcctggctgcttctcaggttctttctttggattggagatgttttagctgcccatggtcctagaagttacctgctaaaaagaaagcagctgaatgctggtctcatgaggtttctttgggggttgcctcagggctgggcacacttaacagtgagtttcctggtgaactgatagttttcagtaggccagtctccttggttgagtctcctgttaatctgctcaagttctgaaatgcctctgtcttaaatacattggtgactctctgtaggcaggaggaagagcgcaggcgccgtgaagaagagatgcggcggcagcaagaagaaatgatgcggcgacagcaggaaggattcaagggaaccttccctgatgcggtatatctcccatgtgcccgtgatgtaccagaccagtcctgataaactcaccatgaattgtctgctaggttaccggttatgaccaattttcccgtgttgtgaaataaccctttagaaaaaagaattcataagaaggagaggtaaggtttgaagaggagatcttgcctcacaagcaatataggatgaaaaactgggtctgctgtattctgtttagactcagtgactataggaagagatatgcaaccttggctagtcctctgctgtccttgcaattgtacaagttggagcttcagaagcaatctcttccccctttcacctctctgttgctaataggaggctctggcttacgtcctagtagctctgtgaccttgaatttgttgcacaactagcaagggttgtgctcctcagctttctcagtgctgtttggacgtgttatcactctatctacttcccttag

SEQ ID NO: 49575 - DNA, 1222 bp, Homo sapiens
tagcctccagtggagggactacagatgggtgggaagcttccaacaatggctctgttacagtgttgctctctttttctctttaagaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggttttttttttttttgtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtg

SEQ ID NO: 49576 - DNA, 1032 bp, Homo sapiens
acatgaacctgtgataaaatctagaatgatagaggtgagcaacactggtatgtaagaaaggaatcaatgtactcaggtcctattacttttactaactttactctttaattggggagatactgggtggtagggtttctttggtgggagattgaggtgtctcagccttttatttggtatggtgtatcaccctggtagctaggtcctattctaaggattctgtttgtgaaatgaatgctgtgccagactaggagtgggaagaggcaaatattcctccgttatcaggtggttgtttcaagtaaaggaccacttacaatgtgtctgatgtatctttaatgtggaatttggagtggaaaccttgaccagtgaccaatcaaggatgtgttttttcttccctacttacacaggaatttaggaaacttgaggaaaacaatggcactgatcttctggctgatgaaaacttcctgatggtgacacagctgcattgggaggatgatatcatctgggatggggaggatgtcaaacacaaagggacaaaacctcagcgtgcaagcctggcaggctggcttccttctagcatgactaggaatgcgatggcttacaatgttcagcaaggtgtgcttctgtgccagctgtgtctagcagatactgcccttaatcttagtcaccataagtgggctcagctgtgatttttttttttttttttttttttcggtgagacagagtttcgctcttgttgcccaggatggagtgcaatggtgcagtctcggctcactgcaacctccgcctccccagttcaagcggttcttctgcctcagcctctggagtggctaggattacaggcgtgcaccacgatgtctgactaatttttgtatttttagtagagatggggtttctccatgttggtcaggcaggtctcgaactcccgacctcaggtgatcacccgcctcagcctcccaaagtgctgggattacaggtgtgagccaccacgcccggctggctgtgatgttctgagctgccaagagatagtgaaat

SEQ ID NO: 49577 - DNA, 1114 bp, Homo sapiens
atcgcaccactgcactccagcctgggcaacaagagtgaaactcagtctcaaaaaaaaaaaaaaaatttagccaggcatggtggcgcacgcctatggtcccagctactctggaggctgaggcaggaaaatcactggagcccgggaggcagaggttgcagtgagctgagatcaaggcactgcactctactctgggtgacagagcgagactccgtctcagaaaaagtaggctgtgtgggtttgggagcacatcgggaaagatgaaaatacattagagcttagcaaaggaagaggccctagtgaggacttttatccttttctttgccaaataaaatacacttggtttgttgggcaggtttttatttaccgccttttctggaaaagtaaagatcggccacggaggatacgaatggaagatataaaaaaagcctttccttcccattcagaaagcagcatccggaagaggctaaagctctgcgctgacttcaaacgcacaggtcgtctgttgtgactagttatttgtctgcctttttccaagaaaagaattttgatggctttgagttaaaggataagcatatagttaataaaatagaaattgatggctgttgaaaggaggtagcagatcttctaacactctggttgcttttttgaatttggctgccaggaagtttaatgtgattgttggatatcttctatgagttgtaggaaacttagcagctggggttttcttggccagtcatgccaactgtggctaggcctgttacagttttggtttgctgtccctgttgctgtcaataaatatcagggcctttggaattcagaatggtctcattctctatgtatatgtcttttccagggatggactcaaactggtgggtgcttaagtctgattttcgtttaccaacggaagaagagatcagagctatggtgtcaccagagcagtgctgtgcttattatagcatgatagctgcagagcaacgactgaaggtgaacaccttcctcttagacaccacttatgcctgtggttttttgtttttttttttcttccccccagagagatgagagagaagattctttctctgactggcttagggaggatggtttactagattattac

SEQ ID NO: 49578 - DNA, 1047 bp, Homo sapiens
aacagcttgtctcctgcatatttaatattttcatagtttacaacttaaattgggagtggaaatcttctctttattcttcttacctgatttttaaagcaatgtttagtctctggatttcattttttttctatgtgtcatttccatacatgcagatttgtctagtggcttctggttgatcagtgcataacaattctattagagcaaaagttctgaagctgactttgtttttcccatcttgtatgtacagttgagctttgaacaacataggtttgaactgcatggttccacttatgcgtggatcgtggtacgtggagcctgtgtatatggagggctggctttttgtatatatgggcttcactatgtgtggattttggtatacttgggggtcctggaaccaatcccctgcatatactgagggatgactttatttcttacctgcttatctctgatatgtgtttcagcctacttacctctgacgtgtttgatacttttccttttgcagctgaaatgtggggcatgtggtgccattggacacatgaggactaacaaattctgccccctctattatcaaacaaatgcgccaccttccaaccctgttgccatgacagaagaacaggaggaggagttggaaaagacagtcattcataatgataatgaagaacttatcaaggttgaagggaccaaaattgtcttggggaaacagctaattgagaggtaagagataccaggcaggaagtgctatgggacagatttatttgaggttggttatattggtggctggcaggggtagatgtgatgtgttctctgaagtggaactgaaggaacaggaattttgatggcgtttcctcagttattgttgccagtaatgaaaattatagcgctgattaggttgtaccacttgttttggagcatgctgcctaacttctgagtctgtttccttagttacaaaataaaaccacctttaccaggatagttaagaagataaaatgagacagactacaaagcatacagtacagtgcctgacatatagtagatgtcagttatctc

SEQ ID NO: 49579 - DNA, 1044 bp, Homo sapiens
aaccaagcagcaagtgctagaagttttaatttttaaatgataatctatctatattccctcttcttactgaaaacaattaatggtactttataaacctacaaaagtgtaagtatgaagtagacatttcacaaaagaggacaactagccagtaaacacggaaagattctcaacttgattgattattgaggagatgcaaatttaaaccacgatgtcactacatacccactgcaaaggctaaaattaaaaagactgacaatactaaatgttgatgaggatttggagcaataggaatacaaactttttcctactagagtctaaaatgaatttattgggttaggtcccattacgcaaaagtcactaatcagtaataatgtttagtgtttccagcagtagttttacagcaaaaacagagagcatgatcttaaagcctaaattgctaaagatgtttttttgtgtgtgtggggagctatgatgttgacactcagggaagtataaattttggtgaaccagaagaatagaatgtagagtacctaaagaagttgttgacacatcctttttgacccttttactggaattttttttttttttttttgagacagggtctggctctgtcacctgggctggagtgcagtgggatgaccttggctcactgcaacctccgcctcctgggtttaagtgattcttggcctcccgagtagctgggaccacaggcgtgtgccaccacgcccagctaatttttttttttttttgtattcttagtagagatggggttttgccatgttggccaggctggtctcgagttcctggcctcatatgatccacctgctcggcctcccagattgctgggattacaggtgtgagccactgtgcccagcctggaatatcatttatcttgactttttgtcattccataggcaattcaaagttacactttctggggcaagggtaatagatagctagctgaacttaaattatccttaatttattttttatttatttattttttttgagatagagcttcgctctgtccacccaggctggagt

SEQ ID NO: 49580 - DNA, 1034 bp, Homo sapiens
atgatggcagttccagatgtaagctgtctctgtgccaaatactgtgaggatcgtgcaggggaaaggaaaaatgtttagggtgtacacgtgtgtgtattttggagagtctgagtggtggtgtatgtcagttgtgactggtatgtgattttaaatattgacctttttgctatatgggtacattatcttttttttttaagagtacattatcattgaaatcaaagaggccaggaatctttggatgtagggaggtttttgcttcctgttgttgacattcagtatatgaatgctcctgaatagccctgtagagagaggatgctagcgaatgtgaggcttttgatttagaggtgcttctaagcaaatgatgctttgataattagacaccattggttgtcttttatttcatttttatattgttacagtgatcctccccaggaattctcaacagagtttccttttgtactataggaatgtgttctatatgtgtaatgctataaaacttctcgttgggactagggaataaggaattttaattatgactatacagcaagtgtttttatcctatcatggcatagaaatccttaaaggaatctatgaaccccttacattataaacagaagttttgtatgattatgtgtttttctaggaaaagagtccatagctttttttaggaatatttgtaacccaacaaaggtggtgaaattctcgtatgaagagtggtttccatttaatttcttatgctttctatttactagtcttggccatttcatcacccagttaataagaaatttgttccagattattacaaagtgattgtcaatccaatggatttagagaccatacgtaaggtgagtgagtgatttgatctaaatgcctttttgtaatcaagtgactgtgtgtgtgtgtatctgagtgcctgattcttttcatcacagaacatctccaagcacaagtatcagagtcgggagagctttctggatgatgtaaaccttattctggccaacagtgttaagtataatggtgggtatttctcatta

SEQ ID NO: 49581 - DNA, 1023 bp, Homo sapiens
gataagtgtttgcaagttaattgattttcaaggaatggtggataatgggtcttaatctgtaaaatctgtaatataaaatagtttgaaacaagatgccactatatggaatgatgtgaaaattaggctacaaaatttcttcctcaatatcctattctcttctctttcaatgtaattagaagtcatagaatttagatgatactacttatactgggcttttgattagtttaaaaattttttttgtctaagttgcagatgtgttctgggaacaagtaaggctcagctggcagaccttaaattcatactgtgtttaggatctccgaaagatacaaaaacataagactttccctcagaacttatgatgtagttagagaaagtagatgtaaacttaagaggtaaatgatagtggggttatagaaatctagaaaaagttcccaagttacattgtcaacattcagttttgtaaccaacctggaaatggctaatagtttattttagctaccgtttactgaaagtctgtgtggtcagacactctactgacagctttaaatgattggtcttagttaatcctcacaataattcttcaaaatagatgatattatttctgatttttatcaattaaaaaaaaaccatggactcagggttatgtggctttcatggggacaaagctagtaatgaagtattaatagatattaaaacctgagtctgaatatcctcaaagcaaatgttgaagtgaaaagaaataaaagtgggatgatgtgcccagagggcactcacccatcaaagcagcccttgagcacagttaaaaaaccattgatcatattttgctgtcccttattttttggttaggaaactgaaactaaatttagtagtttgttcaaagatccgaagtcacttctcatgatgatatctattaacaatttttgtagttaattttgagagtttaaacgtgtcctttttagaaaatccattgctttaaaaaacatttttttttaagagatggagtcttgctatgttgcccaggct

SEQ ID NO: 49582 - DNA, 1530 bp, Homo sapiens
aaccctcaaatgagtttttggaactttttgggatttggaattgtggatgaggggttgtggtcctgcactgaagtttgtcaggcagtatctttagttgatagaataaaatggcagggagctagatgcttaaaagtgatttcaagatatttttaattgacaaagcagagtataattaatgacagcgtctctgggtttctaggatttgtactgtgttcgcagtgacctggggaacctgctcaaagccctgggtcgcttggaagaagccaaggtaggtgtttgatagaacacatttaaacatcagtattatgaaaacttgtactttttgccaagtcttcaactcttcattgagctatcttcacaaaacagtcctttgaaactgaggaaaactgacggcacgaatcgcctcagaatagagcagggccaggctttggcatatctgttctaaatctgggggtaaagcaagaacctgaacattttggagcctttctgctgagctagaccatctttataacactgggctccgtcatgatcttatgtgggaataaataacattccttcaaatctgaggcttgcctgctggtgacaagcagagcgcctgtgatttggctcaagactcctatatgatgcaggtgccattgaaaatgctgctcttctaagtcctttgtggcttgtaagtggagaagaatttcatccaaatgttaccctgtaatactggcatttaaaattcttatttaaccttcctcccttcatcttcctcaccctttttacagtggaagaaaggctgttaaaatgattacaaattaataattggaacatcctgtcccttgtccccactcccttcccaagttcctttttcctcttttccaatcctagttgtctaccttcttttcttcctcatttccttcttttattcctccccaccccaaccccttaaaaaaaaggtcagaaggacaaagctggtttgtttgggaaatggactgatcgaaagaaaacttgccaaagtggaaaggtggcttttagcattctgtgtttccaaataatgaatttgaacaccaggttgggttaattaaagcttttggtataatttaaaattaaatttataaatgcagttgtcttgttacaagccaccttacgcaaccgcgctgcaggggtgaggagtggggagaaaccagaatgcttctgaaactcccacctgttgctctgagccccacgcgcatgctaatgcgtggagtgtatgcgcagagtagctgtctgtttgactgcttcatccagggagggagaaggcttttcagcaccatctaatgttttaaaaggcactagttttaagtgcacagctcataaattctgctgacattttggattaaccttatgtaggttgccagctaatgaattgtaattgatttcaatcttagctgataaatctaattggtaatttatagaacaaatatttgataagctcctattaattgtcaccccaccaagcggacagctaacatgaattgcacttcactgcagctttagagatcggtt

SEQ ID NO: 49583 - DNA, 1049 bp, Homo sapiens
atacaactgaggtatatatttaccttttcagtaagagtttgctgcctcttttgccactatttttcagaagagttagactggttaattgtgaataaaatagggccaatcattagaagtgttcagtttaatgaaattggagcaggcccaatatttaatttttctcttcaggacccattttgctcatgagaacatgaggcatgagaagttattttgataatgttgaggtttgtaaaaataatgagaagacactaaataaataattggtttattaaaatgaaatgtaattgaaagtctgcaaggaccttggagtaaaaaaattgtaattgggaagttgatctggtgaaatcctaacttgctctgagtaactaactgtcttgaaatttttaggctgtcacccttgacccaaactttctggatgcttatatcaatttaggaaatgtcttgaaagaggcacgcatttttgacaggtgagagaatgttctgtttaataaattttcttgaatctttgttgtattgacacttgacagtttggaccgaaatgatgacaatagtccattgaagcatatttgccttttctagcacgttgttctctgcccatgtcctgtgttgccttttatttatagatgttgttcgttgcctgactttttgttgttggctttcctcaaagccgttatccttctcattgggagtttagttgaaatttttttattgttaaaatggttgaaatgattctttcttagactaaattattcctttgacctgattttagaaagcaaagtaaatccagacttttaaattttttgttgttgtcaaaggaaagcctattttttatgtgggagtagaaaacttcccagtgtaaagacacattttataaaggtgtgattttggtttgaggttaaaatataatacagcatgaattatgtaattaattacaattacttgatatattttgatatagtacagcttgaatgagttgtaacaaaccatccattaagcatgagttacattttgtgtgtgtgtgtgtgtgtgtgtgtgtgtgtgtgtgtgtg

SEQ ID NO: 49584 - DNA, 1041 bp, Homo sapiens
cgagaccagcctaggcaacatgacgaaaccctgtctctacaagaaatacaaaaattagccgggcatggtggcacacacctgtagtcccagctccttgggaggccgaggtgggaggatcgattgagtcctgggaggttgaggctgcagtgggccatgattgtgccacagcactccagcctgggcaacagagcacgagactctgtctcaaaaaaatcacaaaaaccaaaaaacagcaaaaaaggaaagtcttttgtacaagtattgagatggtatattggtttactttagagttttggttgagggtaagaataccaaaaaatatcaattttctgtagcattaccagccattaggcttaattaaacaattattagaacagtatcagtggaggctttatgattctgtacagtttttgaagactttgttttgttttctaggttgctgaagcagaagattgttataatacagctctccgtctgtgtcccacccatgcagactctctgaataacctagccaatatcaaacgagaacagggaaacattgaagaggcagttcgcttgtatcgtaaagcattagaagtatgtgagggtggtgtagctgggcatttagcatgatagtagagggaaagcagttaagtttaccatcatccacctcttttgtaaaaatagtggttgaatcatttacaagaggattattcattgaagtaacaattgagtacctaaggtatgatgtgaggccctatgtgacattccagaaaatccctgcattcagagttcattattctgtggataagatctgtacaaaaaaattaaacattaacccacagttcaagagaagttacttataagtatataatcttagtgcctgatggctgtatggtagtggttagtagatgtggtaggagtttagcagagagagatttcagtggtgttggagtggtcaggataaactaagaggagaagaggtgtacctcattatgtttgaaacaagaagaggtataaaatagaggaagaggtagaatttgagaatgaatagacttggaa

SEQ ID NO: 49585 - DNA, 1068 bp, Homo sapiens
cgaccagatggtgcataggtctggaaggtctgatctcccttggtcttccatgggatggttagtgtggaggggagatatagattgtccggccgctttgtgattccatggattgattcagtcttctggatttttttttctttatattttgggtactggagcttttaaaaatgtttggtttcaggtatttttattcatgtgaagtgtatatgattctcttgagataaggttttaagctaaaatgttactccctgttttagtttctgaactctgacagattgacagggactttgctggtgtagtctttttataggttttataaaccacttgagcctatatcagtcgttttagtgtctgacctaatatttggagctatcagtgctttgttgatttagatgatgactcaagattttttctggtccatttcccatttccttttcttccctgacccccataccctcacccttaaaattctcctgtaactcaactaacaaaatcaagcctgattcaaaacatcctagggtgttttaaacacaccatctggtgccaaatgaagatttttaggagtgattactaattatcaagggcacagttgtggtactgtcattgataataatatagtttttttttttttcctaattttgacctgtttcaccagtgttttacccttgactgccccttctatgctgcttccaaaagtgatagtgtgtgtaagatttttaccttcctttctaaagttttttttttttttttttaagtgagtcctgttcttcctatttctttcagcagaaatgaaatcccaggtaagtataagtattcaagtatttgatcagtaagtcacagttatctccagtgcattaaataaccttcatcaagaaataggttataggtaaaatctctgaaggatcatctatgtattcaagtaattattttttagataataactgtcttctggacttggtcttgaagtctgtacagattcagcctcagtagtagcgaactgcactgctgtttggtttggagtacaaattagacttatagtcctcctggaacttgagttattaaaatcat

SEQ ID NO: 49586 - DNA, 1091 bp, Homo sapiens
aggcactcctgatagagggtgggctggaggcttggccaggctctgtaccaggcacctcacctatgcactctcacctcaccctcccaactccaggaactcggtgtgattatcccacttgacacacaggagaccagcgctagacaggagggaagccttgtctacagtcaccagcatgtaagtgcggagctgggacacacatccaggtctgtccgaccagagtccattttgtaaccactgcagctctctgtctcctctggaaggtgactgccagcccttaaatggagttccctcaaaaacaaatgacccatttagggcaaaggacacctgagtggaaactaagtgacaccatttttttcagccccagtgcacatttccagacctggggtgtggaatgagggctcttccaggtatgaagggaacgtcttagagcagtactcggtttgatgcttggcagccagggcatagtggttgatggccagctgcatgcctgagttcaaatcccagctatgccacttgctgtttgtgtactcttggacccattgcttaacctcttgatgcctcagtttcctcaatgtaaaatgaagttactgataatatctcctaaggtggtcctgaggattcagtgaagtaatacacataaagcacttggcactgtgccttgagctgtggtgtgaaccagtgccattattttctcctaagagagtaatgcatgaaggagactcagggctcctggaagacctttgacgtctattaaccctttgtcccttccccgtctgttatcagggtctcccctgcccgattccctgatgtatagacagcaggaacctttaaatccaatgttcccatctgtggctgcacattaatatcacctggggagcttttgaaatggcgctgcccaggcctcatcccagactattggaatctgactctagggatggggatggagttggagtattttttctgcagctcctcaggagattctaaagtggagacaaagctgagaaccatggcctcagaaggaaaagggcctgtgtgctgctctttggggacaacaaggaaggaagaagaaactcagagatcatgccctgctc

SEQ ID NO: 49587 - DNA, 1049 bp, Homo sapiens
tggtgatctcaccccagcctctactgcttcagccccctcctgaggctggccaaagcgtagaagccctgctgattaagcctcttccctgaatgttggcagcctaggctctgcactaacttagcacctagtgcagagcctgtcacgtgcatgggagctacccagtagcattctcttggacggataaatgcatgggtgaattaacatgctttggatattgtctttgttgtacctcctcagggctcccaaagccttaaaactagaacttgtcacctcatcactttagaaccttctatttgcaggcatctatgcacctgctgatctctcccactaagaaaaggtgacaagagaaaccagccaggggattcctgagggtagtctaggagtctcgaagccttgcagtggtcttccaggctgaatcatcctacctcgagaaccaagagcatgagagttggcatcagacagacttagttcaagtctcaaccctgctatttcctgtatatataatcttagtcaaaagtcatttcaccactcttaagatttagtactctactctgtaaaatggggctaaaaatacctacccagcattatggtgaggaataaatgagaaaatgtgttaggttgaatcctatgaaactgtccaaagcatttaaatgccagcaaatttgtatggttcaacctaatatataaagtagcctttataaactataaagtataataaatagccctatataagtattcattattcttaacagatataatttgtaagtcacagaatattgtttcttgcagtattagtaatccctttcatcagaatacaggtcaaactaacagaagaagccacttatctgacaatcgtgggctgcaggcatttcctggagcattttggcctgggaaatagggagcaggtatttttaggaaactagactggttcatggaaagcaatggaggtgaacaccagggtgactcgtgacagctcctacctggaaatgattaacccgcaaaagcacagtaggagttggcacattctcttgccccagatgggagtaccc

SEQ ID NO: 49588 - DNA, 1043 bp, Homo sapiens
tcccttgagcctcaccggcccttggtttccttgtctaaggatttcaagacttcagggtagggttgactccggcaggggaccttggaagtaccctatgcctactctgtacccatctatgcttgctcaataacaaagaggcacaatctttacacaccctttatatttttattgaggagagaaagctttagcatacagagcagcttcttatcttcacaacacagtaatgcaacaataacacatgtattccaaaagggtttcctcccgagcctctgggagaccttgggctgccttcatacccctgcatgcatcccctccccccacccctctttcaacccaagaaagctcccaaagcccacagttcctcttacagctcttatggctgttacatcacaacaaatattgaagatctgggaaaggaaggaagagggtcaaagggaagcccaagcccctcctgccccagagggtggaaaccagctcactgctcatctgctctatccctggctgtagctctgagggttcagggtgagaagcaccatgggaacaggcaggacctgtgctgaagggtccctggaagtgtgggtttaaggcacccgtccttcacacttctccacagggacatggggcagcagggccagagtgttgaccatcagcaaacagggtccactgcctcgaagaatagcaggtcccctcgaagaatagcaggtccccttctggaatgcactcttgaggaaatcagataaaatcagctgaaaaacagacaaaattttctttacaaagttgtttactcctgccctggtggggatggggaaaaccagacaattgaaaggtccaacaaattaggagaatgcttaaatgaattattcagtatgcatgactgcacaggtggcagccattttaaatcctgctgatcaagaactggcagggtgatctcagctttgacaagacatagcaagaacacactagaaaggaaagcagcaaagtgttaatagtgcttgcctctgtgtggtgggactctgaatggctggggggtttttgtcctcata

SEQ ID NO: 49589 - DNA, 1132 bp, Homo sapiens
cttattatttataattttctctcaaggtaagaaagcaaagtaaaaatgacaaataataaaataagataaaaattctccatcctccacagaagaaacacagaagtagggatcattcctttgttcaaccattggttgtagcgatattttggtttaaagatctcaaaagcagaaatgtccaacttgtaaatagtagaataagggtcatctatgtcaaaacctatgcatgaccaaacttgcacggctaacttcaaagtccagcagtgttgagagtacttatgtgttcagtctagttagacttcttctacctatttgtccttattgagcctattcctgtattgctcttaggaatatacctcgtaaccttagcaaaatgttgggaaattctctcaagctacagtagaactgttccctcttctgggccacttgatatcacttatcttttgggtttttcagggtgacttgggttggatgaccagagggtccatggtgggaccatttcaagaagcagcatttgccttgcctgtaagtgggatggataagcctgtgtttacagacccaccggttaagacaaaatttggatatcatattattatggtcgaaggaagaaaataaaatcatatgaaagactgaataagttttatacattttgtttctttaaaaggtattacatattcttttgagctggagctgcaaggaaatacaaaaatttttaaaaagaaaagatattggatgctccttgtattctgtgaaagctctaagtatgggtttgtaggtgtaagagagggtggggctaagtgaatgtcaactgtagtaggtattcagtcagtctttctcaaagagaagtcaagcagactccctttaacctgtattctctttcctcccagaactatatctgactctcagtctgtcccataaattaattcagaaaccatcttcaggggaagcagatatcaactcacactattcacacaactgaaaatattgggcatcaaatagattagtgtgtgagaatcataaaataagttcctagacaacatttgttttacatgttagtcaactctgatcttccaggacaggtggtattagctccactgtcttaacatagtacgtggcacgttatgcctttcagtgt

SEQ ID NO: 49590 - DNA, 1225 bp, Homo sapiens
tgacagggtataaaggacctaaaagagcaagaagaaccttgggtctcttttgagccatatagtttggtccaaatagttcttgtctgaggaatccaaagccaataaccagataataaatattacagaaagccttacgcttttttcagtgattgctcttgtaggtgaaatagagtacggagctgacagtgtcaagccccaaaccaaaacttgtgtaggctcctatcctaagaggcccaggccaccattaaattgaatattcatgttttatacattttatttatgcatatattgtgaaatatacatatcttatatttcacaataaaagttttaaagaatgttacttgcccaccctagtggccaggggataagaccattaccagaaggtggacatgaaagcttactgagcagaaaaaaaaataaaaaaaaacacaaaaagaacaaaatacaacagcaaccattattccctacacataagcaagtgcctgaaatatgggcactccatgctgttccaggaaagaacagtgtagaactcttgcttctattccattgatctatatctatacttatgcaagtaccacactgtcttgactactgtagctttgtcgtaagttttgaatttgggaactatgagtcctctaactttgttcctttaaaaattttctttaaataatagagatgggggccgggcgcggtggctcatgcctgtaatcccagcactttggaaggccaaggcaggcggatcaggaggtcaggagatcgagaccatcctgactaacacggtgaaaccctgtctctactaaaaatacaaaaaattagctgggcatggtggtgggcgcctgtagtcccagctactcaggaggctgaggcaggagaatggtgggaacctgggaggcggagcttgcagtgagtcaagatcgcaccactgcactccagcctgggcgacagagcgagactctgtctcaaaaaaaaaaaaaaaattaataatagagatggggtattgccatgttgcccaggctggtctcaaactggccttaagtgatcctcctgtctcagtcacctgagtagctgggattacagatgtgaggcaccacggtcggctaaactactctttttcaagattgttttggctattctgggtcccctgtatttctatatggcttttataatagtttgtcaatttctttctcttttttttttttttggaaacaagagtctcgctctgtca

SEQ ID NO: 49591 - DNA, 1046 bp, Homo sapiens
gtccaagcaaacattaggtcatagcctgttcctcttccttatttgaaggtgtttttacctttctcagcattccacaagttacttcctccttcctttgttctcctctgtctttgcctcttttaaaaagttctaagttgctagccaatcgggacaaatacagaatgtgaggtcccgttccagccaatggaaactggacacagcagtagggtggaagcgtcagtttataaatgaccctgtctcctttgttcggtgtactctcatggcaaaactgctggcgagggtgctctttctgcagaaagtaaaaatggccttgctgaggaaattaattttatgttcaagtgctatttctttatggcaccagggaacaaacatttctaacaaagggaccttaccaaatcattcttaccatacccacagcagcaaaactccagggactccccaactggtttcattatacttctctcaagaaaacagacttccctttgccacatacccaaacaaccaaatccaaaaccccttcagccttctcttgtgtctccacaggacccacttccctttgcctcacccgaatcttggaagaaaaggaagagaaattcacctaaaccacttatgtctctttctctcccaaactttcactgcttcctaatcaaccttgttacagtccttcagcggtacccttacgaaactcccattatatatcctgatcagctctttactgttctatgggacctatggcttcaaggaactttccaggactttactcttacccaaataacctttttcgctttttgcttgtttttttttcaatacaaataccctaagtacatcaacctcaccaatacaaccacttctcactgctctcaagctcgaactataaaccttacacaatccctcttgctgcgaactaactcttcctttgctcctgaatgctggatgtgcttatcgctgtcttcctcagcctacacagcccttcctgcatcccttcatgaccttttagcagggagcataaccctaatttatacactccaaaagggagcttcctttct

SEQ ID NO: 49592 - DNA, 1081 bp, Homo sapiens
atgtgtttcatggagaagtgattaacttcgtcaagtactactggtcgaggtagatgaagattgagaattgactgttggatttagttatatgaatgtcattggtgactttgataaaagcagtttgtgtaaagtgatggggtgaaaacctgattgggacgagttcaacagaagttaggagaaaagaaataggaaatgacaagtgtagacaatgatatgacacctggaattttgctgtaaaggaaagagaagaaatggagcaataactggaaatgaaaataggatcaagagaggatttttttttttaacaatgaaagaattggtgggctgaagtccttataccagtgagtgacaagggatgagatcttttgcacaaatggaggggttgtgccttagctagaagcatggagagttcatccatactaacaggacagaaggcaaagaacacagagggaataatgctgggaagtaggttgatatggaagaagcttctggaaactgtcttctgattgcttctatcaacccagtgaaattggaagcaagagagatgagggtgagatgttgagggtctgaaaagcaagaaggcatgaaacaggcatctagtacaatggatgagtgaatacattagagaaatgtactatgattgccaggcagcatgaagggcctgcttgacatcgatattgatggatttcaagtaagaccagtcacatgattgtttcttcaaccatgttcatctgagagggccagagttggatttagcaaaatgtattagtttcctattgctgccgttacaaatcatcacaaatgttaaaacaacacaaagtattatcttttatcttacaggttatatcttgcaggttatataggttagaagtctgacacaggtctcactgggctaaaattaaggttgcagcaaggctgtgttcctttctggaggctctagggggagaatgtgcttcttgcttttccagcttccagaggccatacacattccttggttcatagccccttcccccatctaccgagccaggtaggataggttgaatccttctcacactgagtcactatgacctcctcttctgcc

SEQ ID NO: 49593 - DNA, 1051 bp, Homo sapiens
taggtacaaaggccctcaggctctggcatgttggaggaatagcaactagtccagggtagctggaacagagcaagggagagaataggaaagagctgggaacagatcatctaggctatataggctgacattaaggacttagactacaaatgaaacaagagtcactgaaggactttgaggtagaaaagtgacatgatagctgggtgttgtggctcacgcctgtaatcccagcactttgggaggccgaggtgggtggatcacgaggtcaggagatcgagaccatcctggctaacacggtgaaaccccgtctctactaaaaatacaaaaaaattagccgggcgtggtggcatgtgcctgtaatcccagctactctggaggctgaggcaggagaatggtttgaatccaggaagcggaggttgcagtgagccgagatcgtgccactgtactccagcctgagtgacagagcgagattctgtctcgaaaaaagaaaagaaaagaaaagaaaagtgacgtgatttgacttgtgttgtaacagaatccctctggcttctgtgtggtgaatagactgtgtggggccggggggagggcgtgatgggcaggggcaaagtcattaggagcactgctaggagcaaaggagcagtagagtaccattgctgtaacccagatgaaagctgattggaacttagaccagggtggcagctagggagatgatgataagtggtggattctggatatattttgaaggtggagccaagagtatttgctgatggattggacatggggtgggaagaaaaacaaaaggagttgaagatgatcaaggaggaaggtgtcttggggcaggcagtgtggtgtgaaacagagagttcaagttcatagggactcgggagttaagttgggctatacccctgcccttcttagctgtatgaccttgggcaagttgctttccatttctgaacctgagattcctcttctgtaggagtacacagggctgttgtgaagatttaatgaggtgattatgtaaaaccccagttccacggctggcacagactaggtg

SEQ ID NO: 49594 - DNA, 1030 bp, Homo sapiens
actccgtctcaaaaaaaacaaaaaaaaacaaaaattcaaaaaaaaaaccccacaaaaaacatatatatgtaagttttgacagagcgagactgtctcaaaaaaaaaaggtaataaatactaaaatctcatcacttcctcattattttactacattttactactctctatgatgcccttgaagttattcacacctgctgtatctgcatggtggaaatgctatgtaatggtgtgctacgttcatctcctcccaactccttgttcagtgacatgttggtagcctcaaatcagccatggaaatgggcaaacactacaaatcagaacttggctaattgttttggtgattgtctagtgttaaggaagtgatggagaaaatgtttaaaaatgcaggttaaacttagaagtgtgctgtcactgtagccattacattgtgaattgtacaaaaaaattgccaagggtgatggcatgtgcctgtagtcccaggggtatcacttaagcccaggagttcaaggctgcagggtgttgtgattgtgcctgtgagtagcagggtgcactcccacctgggcaacagagtgagaccttgtctctaaaaattaaaaaaaaagttaaaaattaaggaaatattctttcagtattcaagaactattctccaagtcagcaaagaagctgctcacatcattgacagatgagttgaagttccaacatatatgtctttgttgtttcacttttgtcttatttgttaatgcaaacaaaaatatcaaccaatactctcatgggagctaacattcttttgtcgattgcaaccataaccataggttggctatggatatgagtttggcaaaagtcaataaaagcattctatgagaatcaactggctacatggacttcacaataaagagtttttttaaatttaataatattttatttatttttgagacagagtctcgctttgtcacccaggctggagtacagtggcacgatcttggctcactgcaacctttgcttcctgggttcaagcgattcttgtgcctca

SEQ ID NO: 49595 - DNA, 1054 bp, Homo sapiens
ctccaattgaaagacacagactggcaaattggataaagagtcaagatgcattggtgtgctgtattcaggagacccatctcacgtgcagagacacacataggctcaaaataaagggatggaggaagatctaccaagcaaatggaaagcaaaaaaaagcaggggtggcaatcctagtctctgataaaacagactttaaaccaacaaagatcaaaagagacaaagaaggccattacacaatggtaaagggatcaattcaacaagaagagctaactaggttcctggcccacgccatcgggtctgagctgcgccaactgctctgagggttcgtggcccaccgctccttcatggttcctgctgccactgtccacgcttagcgctgtagagaagatggtgggtcggaacagtgccatcgccgccggtgcatgcgggaccctttttattgcgtactgcatctactttgaccacaaaagatgaagtgaccccaacttcaagaacaggcttcgagaatgaagaaagaaacagaagcttgccaaggagagagctgggctttccaagttacctgaccttaaagatgctgaagctgttcagaagttcttctttgaagaaatacagcttggtgaagagttactagctcaaggtgaatatgagaagggtgtagaccatctgacaaatgcaattgctgtgtgtggacagccacagcagttactgcaggtcttacagcaaactcttccaccaccagtgttccagatgcttctgactaagatcccaacaattagtcagagaattgtaagtactcacagcttggctgaagatgatgtggaatgagaaacaaatgtcaacataataaaatctcagttaaaaatattttaaaaattcttggtagttgagcagctctgggggaataagggcaaatatgcttgttatgaactacactgaaatctaccaaagttaatgtttactttgtgtagatccatttgtccattttatttatttttcccagtgaaaagtgtaatttgatagagaacttttcattctataaatacactatgggtta

SEQ ID NO: 49596 - DNA, 1129 bp, Homo sapiens
cactgctttagttgtgtcccagagattctggtatgttgtgtctttgttgtcattggtttcaaagaacttatgtatttctgctttaatttagttatttacctagtagtcattcgggagctggttgttcagtttccatgtagttgtgctgttttgagtgagtttgttaatcctaagttctaatttgattgtactgtggtctgaaagatggtttgttttgatttctgttcttttgcagaggaatgttttacttccaattatgtggtcaattttagaataattgtgatgtggtgctgagaaaaatatatattctgttgacttggggtggagagttgtgtagatgtctattagttctgcttgatctagagctgagttcaagtcttgaatatcgttcttaattttctgtctcgttgatttgtctaatattgacagtggggtgttaaagtctcccactattatcgtgtaggagtctgagtctctttataggtctctgagaacttgctttattaatctgggtgctcctgtattgggtgcatatatatttaggatggttagctcttgtcgttgcattgaaccctttaccatttgtaatgcccttctttgtcttttttgatctttgtcagtttaaagtctgttctatcagagaataggattgcaactcctgctttttttggccttctatttgcttggtaaatatttctgcatccctttattttgagactatgtgtgtacttgagatgggtcttctgaatacagcacatggatgggtccttactctttatctaatttgccagtctgtgtcttttaattgagccatttagcccatttacatttaaggttaatattgttatatgtgaatttgcttctgtcattatcatgctagctggttattttccctgttagttgatgcagtttcttcatagtgtcgatggtctttaaaatttgatatgtttttgcagtagctgttactgatttttcgtttccatgtttagtgcttccttcaggagctcttgtaaggcaggcctggtgatgacagaatctctcggcatttacttgtctgtagaggattttatttctccttcacttatgatgcttagtttggctggacatgaaattctgggttgaaaattcc

SEQ ID NO: 49597 - DNA, 1034 bp, Homo sapiens
tgctctcactcataagtgggagttgaacaataagaacacatggacacagggaggggaacaacacactctggggtctgttggggggtgtgggatgaggggagggaacctagaggacgggtcaatagatgccgcaaaccaccatggtacacgtatacctatgtaacaaacctgcacgttcagcacatgtatcctggaactttaagtaaaataacaagaaaatcagttggctgtaaaatatgtggatttacttcagggtcttctgttctgtcctggtgtatgtgtctgttttttatgccagtttcatgctgctttggttactgtagcttagtagtatattttgaaattattttagtgcctacagctttgttctttttgtgcaagattgctttgcttattcagggtgttgtgtatttccattcacattttataattattttctctttctatgaagaatgtaatttgtattgtgattgggaatgcattgaatttgtatattgcttcgggtagtgtggacattttaacaatgttaattcttctaacctattagcatgggctgtctttccgtgtttttgtgtgtgtgccctttttaatttctttcatcaatgttttatgattttcattacagaaatcttttacctctttgagtaaatctattcctaaaaaattttttgtatctattgtaaatgggatttttcgaaatttctttttcagattgtttattgttggcatatagatatgctactgacattcatgtgttgattttgcatcctgcaactttactgaatttgaaagattggtgacatctttaggctttcctaattatatatgatcatgtcatctgcaaataggacaattttagttctttcttcctttgttgctttatatttcttccttttgccttattgctgtggctaaaacttctagtaaaattttggtcaaaatagtgaaagtggacatcctggttttgttccagatcttaaaggaaacactttcaatttttccctatttagtataatgttagctgtggttttatc

SEQ ID NO: 49598 - DNA, 1514 bp, Homo sapiens
cctcccaaagtattgggattacaggcgtgagccactgtgcccagccttatctgactattactgtaacagtggccaatcaaaattccttcttttctttttttttttccttgagcctagaaatttcttaattgaggggagaatctagcaagcagttgagtcaaagggtgtagattatactacagtggtaaagaaagtaagcagctggcagtgaaagcaatctcaagcaaataatgaatgttccatgaacaagatgcctgaattgaaaaacagaacaaaaccaactaaccaaacaaaaaacaatccgtggatcctaactcaaatccaaggtgatttgagcctgcacttgtaattagacaaaatctatgaacttcagttgccttggaggcatctgagggaaatgaggttgcatgtagatgaatcagttgtttctggcatcatgttagtgtgattacatttagctgctgtgtgcaaaacattttagcaatcatttaggtccaggacgtggaatttattagtgcaacaaccctgtaaacagtggttagaacattaataattttattttatttatgttttatttattttttgagacggatttttgctcttgttgcccaggttggagtgcaatggcgcgatctcggctgactgcaacctccacctcctggattcaagctattctcctgcctcagcctgccgagtagctgggattacaggcatgtgccaccgcacccagctaattttgtattttttagtagagatggggtttctccatgttggtcaggctggtcttgaactcctgacctcaggtgatccgcccacctcagcctcccaaagtgctgggattacaggcgtgagccaccgcgcccggccagaacattagttttaaacttcctaacccttgggagaaggcaaaacacttgatgaaatctacataaagactaaaacattttaccaattttgcattgtttgtttgaaattgcattgacgactggtatgttaattttgtatatatttttatgagaacaatgttggacatcatttaatttttttaggtttttttaattgattattgattggttcatttgcaggaactgactattagtaatcaaggatacaaattgttaagagaatatgttacagagaaaaacttgacaagctagacttagatttttgtcgttaaagataatttgtgggatatgatttttataaggagttgcattaaatagaatgtcttacacagatttaagaggttaataattataaaattaagatgagttcttataaaatattcttgaggtataataaaattatacttgtggagtatatctttgaataacatttaaaagcaaactaatactttccaggtaaaataattatcaacataactttttaaaaataattcatagtacttcaggttatttctatgtttgacacattaacttaaaagaaaaaaggaaaatggtgattagttaatgccatacacactggacagaaaagaaacttagctcttatggatt

SEQ ID NO: 49599 - DNA, 1078 bp, Homo sapiens
ataacatcttcaacattcatccatactgtagcatataatttgtacttaattcctttttatgattgaataatctatatatgaatgtaccaccttttgttcatcagttgatgaatgtatttacatgcatttaaataaaatttttttttttgggttttttttttgagacggattctcacccaggctggagtgcagtggcacgatctcggctcactgcgacctccgcctcccaggttcaagcgattcttctgcctcagcctcccgagtagctgggattacaggcacacgccaccatgcccggctaattttttttgtatttttagtagagacggggttttaccatgttggtcaggctggtctggaactcctgacctcgtgatccgccctcctcggcctcgcaaagtgctgggattatagtcgttagccaccgcacacagccaagaaaatgtatttaaagaaaatatggggctgggcatggtggctcacacctatacttccagcagtgtaggaggccgaggccggcagaacggttaagcccaggagttcgagactaacctgggcagcatgatgaaaccccatctctccaaaaaatacaaaaattagctgggtataatggcctgcacctgtagtcccagctacttgggaggctgaagtgggaggatcgcttgagcctgggaggtagaggttgcagtgaactgaaatcacgccactgcactccagcctgggcaactgggtgagggtctgtctcaaaaaaagaaaaaagtaagacaatatggtataaattggggatggtgaagggacataaagaaaagttagtttctaaactggacttgaattaatgttgacagccgtagaatgtaataagtaatgtatatatataatgtgaagcaaccactaaaaatgccatgcatatatgcaaaaactctagagaggaatcagaattttataaaatgttcagctaactcacagaaaggcagataaaaacagacaaatagaaaactaagaacaaaggaaaaataaatcgcagacttaaaccctaacatatgaacaattacattagatttaaatcgtttaaatgtac

SEQ ID NO: 49600 - DNA, 1066 bp, Homo sapiens
atgagttagtaacaccacaggctaaaagatctacacacaaaaatgaatgaatcacgttgcttttttttttttttgagatggagtctcgttctgttgccaggctggagtgcagtggcctgatctcggctcactgcaatctcggctcactgcaatttctgcctcccgggttcaagtgattcccctgcctcagcctcctgagtagctgggaatacaggcatgcaccaccatgcccggctaattttttgtgttttagtaaagatggggtttcaccatgttggccaggctggtctcgatctcctgacctcatgatctgcccgccttagcctcccaaagtgctgggattacaggtatgagccactgcgcccggaatgaatcacatttctatatactagcaatttaatatgtggaaacggaaattatatacaaagtaccatttacaagcactgcaaagaaacacaacatttagacataagtaaacatgtacaggacttgtattttgtaaattacaaaatgctggtgaaagaaactcaggaagtcctatataattgaaaagacttatcatgttcatgacttgggaaactcaacatagtaatgatgtcaattctccacaaattgataggtttaatggaatttccatttaaatcctagtatgtttttgtagatatagaaaagcttattttaaaatgtatgtggaaaggcacaggccttaaaatagctaaaaccatcttgaaaaatagtacattggtagaatcattaacttgacattaatgcctactatattcctatattaagacagtgttgtattggtggaggatagacacataaatcagtgtaacataattgagaactgagaaatagacatatacaattaggcccgactgaattttgtcaaacgtggaatagcagttcagtaatgaaagaaagcctttttaacaatggtgcttgaccaattgtccatctgtaggcaaaaagatgaacctgagtctcatatctaatacaaaaatgtactcaaaatgaattagagacttaaatgtaaaacttaaaactataaaacttttagaagaaa

SEQ ID NO: 49601 - DNA, 1514 bp, Homo sapiens
aagagaatatggattacttatccactgctgattggaatgtaaaatggcatagcccctctgggaaactgtttggtagtttcttattaaaataaacctgcaggccaggtggggtggctcactcctgtaatcccagcactttgggaggcagaggtgggctgatcacctggaggtcaggagtttgagaccagcctgaccaacgtgaagaaaccccgtctctactgagaatacaaaaattggctgggcgtggtggctcacgcctgtaatcccagcactttgggaggccgaggtgggcggatcatgaggtcaggagatcaagaccatcctagctaagatgaggaaaccccgtctttactaaaaatacaaaaaataagccgggcatggtggtgggcgcctgtagtcctagctactcgggaggctgaggcaggagaatggcgtgaacccgggaggcagaatttgtggtgagcagagatcgcgccactgcactccagcctgggcgacagagactctgtctcaaaacaaagcaaaaattaactgggtgtggtggtgcatgcctgtaatctcagctactcgggaggctgaggcaggagaattgcttgaacctgggaagcggatgttgcggtgagccgagattgtgccattgcactccagcctgggcaacgagcgaaactccgtctcaaaaaaacaaaaccaaaacaaaaaaccacaaacctgcaactaccatatgacccagcattttcattcttgagtgtttatcccagagaaatgaaaacttaacgttcttgcaaaaatttgtgtatgaatgttcatggcatctttgttcatgatagtaacaacacagaagtgcccagatgtcctttaatgggtgaatggctaaacaaatggtggtgcattcataacataataccacacaggaatgaaaaacaaagctgatgcacaaaacaacctggatgaattcccagagaattatgctgaatgaaaaaagccaatctctgacgtatagttacatactatattatactatttacataatattctttttttttctttttttttttgagatggagtctcactctgtcgccaaggctggagtgcagtggcacgatctcggctcactgcatcctccacctcctgggtacaagtgattctctgcctcagcctccagagtagctgggtttacaggcgccagccaccatgctcggctaatttttgttttagtgattctcctgcctcagcctcccgagtagctgggactacaggcgcgcgccaccatgcccgtttaatttttgtatttttagtagagatggggttttactatgttggccaggctggtcttgaactcctgacttcctgatctgcccaccttggcctcccaaagtgctaggattacaggcgtgagccaccgtgcccagcctgataccttgttttctacaagaatgttaggttaactgatagggaagttgtcactgagtagacatcagataatgtttttgggatagggcaataagccataaggt

SEQ ID NO: 49602 - DNA, 1050 bp, Homo sapiens
ctggccaacatggtgaaaccctggctctactaaaaatacaaacaattagccaggcgtggtggcaggcacctataatcccagctactcgggaggctgaggcaggagaattgcttgaacccgggaggtggaggttgcagtgagccgagatcacgccactgcactccagcctgggtgacagggtgagactccatctcaaaaagaaaaaaaacacaaaacaaaaaaccaaggagtatgactgccggttcatatggtaagagtatatttagttttgtgagaaaccacgaaactgtcttccaaaattgctgtactgttgatgcattcccaccagccatgaatgagagttcctgttgctccacaatctcaacagcatttggtgttaccagtgttttggattttcaccattctaataggtgtgcaatgggactgtttaatttgcaactccctaatgacatacaaagttgagcatgttttcatgttcttatttaccatctgtatatgttctctggcgagatttctgttgacatcttttgtccattttaaaaattgggctatttattgagttttaagtgctgtctgtatgttttaggtaacagtcctttatcagttatgtgttttgcagattttttttgacttatcgtttcatattttaatggtgtcttttgtggagtaatttttttttaattttaataacatttagcttgtcaatgatttcttttatggattatgcttttggtattgtatctagaaagtaattgccatacccagtgatgtctagattttctcaaatgttggagttctatttacagttttgcattttacatttaggtctggcatccattttgaattaatatttgtgaagggtgtaaagtttgtattagattcattttttggcatttggatattcagctattccaacactatttgttgctccattgtattgcctttgcttctttctcaacgattagttgactatatttatgtctctatctgggctctttattctgttccattgatccatttatccattccttcaccaatttcacactgtct

SEQ ID NO: 49603 - DNA, 2556 bp, Homo sapiens
tgacctcaagtgatctgcccgtcttggcctcccaaagtgctgggattacaggcgtgagccactgtgcctggcgcagtgactttattatttccccttcaatattgtgatggatattttgagtcttttggctctccatataaaattcacaatcagtttgctgatatccacaaatatgctgggagtttggaattgcatgaaatctgtagatgaagttgggaagaagtgacatcttgacagtattgtctttgtatccacaaacatagaatatctctccatttgtgtaatttttttttctttcattagacttttgtagtttttttttttcatatagatcttgtatgtattttggtagatttatacctaaatatttcatttttggggctgctagtgtatatgctattttgtttttaattccacctgttcattgctggtatattgggaagcaattcgctactgtatgtgtgtgtgtgtgtgtgtgtatatatattttgagacggagtttcactcttattgcccaggctggagtgcaatggcgcgatctcggcgccccacaacctccgcctcccaggttcaagtgattctcctgcctcagcctccctagtagctgggattacaggcatgtgccaccacgcctggctaattttgtatttttagtagagacagggtttctccatgttggtcaggctggtctcgaattcctgacctcaggtgatccccccgcctaggcctcccaaagtgctgggattacaggcatgagccaccgcgcccggccttgctactgaatatgaaccttggttttttttggttgattgttttggaatgtctacatagatgatcatgttatctgtgaacaaagacagtgtgagttcttccctcccagtgtgtgtaccttttatttcctttttttttgtcttatttcattaggtaggacttccagtacaatattggaaaggagcggtgagaggagacatgcttgccttgttcttgatcttaatggaaaggtgttcagtttcttaccttttttttttttcttttttttgagatggagtctcactcttgttatccaggctggagtgcaatggcacgatcttggctcactgcaacctctgcctcccgggttcaagcgattctcttgcctcagcctccctagtagctgggattacaggtgcctgccaccacacccagctcatttttaaatttttaatagagacagggtttcactatgttggccagacttgtctcgaactcctgacctcaggtgatccgcctgcctctgtgtcccaaagtgctgggattacaggcgtgagctactgcgcccagccagtttcttacctttaagtatgttgttagttgttaagttctttataaagttgaggaagttcccctctattccaagtttgctgagttgtttttactatgaatgggagttgggttttgtgaaatgctttttctccatccatttaaatgatcatgtggtttttcttctttagcctgctgatattatggattgcattagtagattttcaaatgttgaaccagtcttgtatacctgatataaaccccacttgttcatagtgtatattattttctccttctctgtgagttttggcaccttgtttctttcaaggtattggtctatttggtctattttaccttttttagtggttgccctagagcttgcaatatatatttacaagtccattttgaagtaacactgcattacttcattgatagtgcaagtactttttaataacaaaatagttctaattcctcttttttctcccttgtgtctttgctatcattcatttcatatgtacataaactataatcattgaatatattgttagtattcttactttgaacaaacttaactgattaattaagaataaaataataaaagtttttataatagctttacttattccttttctgatcaagaagaaattcttcttcctttctttatgtagatctgagtttctgagctgtatagttttccttttccctgaagaactttttttgaaaaacgtttctgacaagctagatctacttacaacaaattccttcaatttgtttttgtctgagaaagagtatttctcctttagttttgaaggatgattttgcaggtacagaattctaggtttttttttttcctctctctctaaaaactcttaagtatttcagtcttcttgcttgcatgttttctgagatgtcagatataattatctttactcctctatggtaaggtgtttttttctccactgggcggtttctttgaagattttttcctgtatctttgattttctgcaggctgagtaggatatgcctaggtgtagttttgtttgtttgttttggcatttatattgtttggtgttctcttagcttcctgaatttgtagtttggtgtctgacattaatttggggaaaattctccatcattattgcttcaaatactacttttccattttttctcctctgttattccagttacatgcatgttacaccttttatggttgcacggttcttcaatattctgttctttttttttttttttttgaga

SEQ ID NO: 49604 - DNA, 1072 bp, Homo sapiens
tttgtgctatgtctcagagaatgtttccacattattgtttctttctcagtagtggtcctcttggtgttgctatatgacatttttagcctggtcactggttggcaggagtgtgccctatctgttgttttattaattaaggcttagttttaggcaccagtgtcctggggtctcgtggttgtgttatactcagtactcctgcctcttcctcctgctgtaattttggacccattgtgtatttctgctctttcttcatagctaattttttttttctctctatttcattctcccagggtcacagtttttacaactatcctaatggccacagtgtttgttgcccttcctcccactgagtaaggactttgttttgtagatggagtaggatctgaacagatttctttgaccttcccaaaacagattttgttcccctctcccaggtgtgtaccttgagggtagtttctcaagactgtcatcaatcttttgtgtgatctcttgaatgggttagtggagaaaatacctgaatagtctgcagacctctcaattctgtgctgccccaccctgggcttcatacttacttgccagttaacacttaccctttgccaattgaccaaccattttagttgatctcttactgatgtctggttgcatctactttcacaggtaagccgggggtgtgtctcatcattcctttggggcaccacaacttagattttggttggccccagtaagactcctgtctctgggggattcaaggaaagttgtgaacttctttcctattctcctaccctctttatttgtaagggtgaaagtgatgctctctctagctctctacctaccagaaccagatgatgttttctagtctagtctggtactgtctttcacttactgtgaagccccattatatttactgtgattttcttcatattgttggatttatatctctaatttaaaaaaatgatttggtttggaatggttttttcataatgcaatccaaagtatcatagtccccatggtttcttagtctttccctgtttctcatgaccttgacagatttaaaaagtgtactggttaggta

SEQ ID NO: 49605 - DNA, 1151 bp, Homo sapiens
tctaaaaatgctcaagtgttttcacattattccttgtagatgtcatatagtttatctttttacctttaggtccatgatccattttaattaatatttgaatgagcgaggtaatatgttgtcactttttttggtatgtggtcctctagttgtttcagcaccttttgttaaagagattgcaggccatgcacagtagctcacgcctgcaatcccagcactttgggaggccgaggccggcggatcacgaagtcaggagttcgagaccagcttggccaatatggtgaaaccccgtctctactaaaaatacaaaaatcagccaagtgtggtggcaggcgcctgtagtcccagctactcgggagtctgaggcaggagaatcgcttgaactcgggaagcggaggttgaagtaagtcgagatggtgccactgcactccagcctgggcgacagagcgagacttggtctcaaaaagagcttatctttcctatattgtatggtttttgcatttgtgttgaaaataactagatttgcatggtatttttccggactgcttattcttttccattgatatttgtatttattgtttctccaataccacatggtattactaagtatttattttaagtctataaatgaggtagtatgaactttcaaccttttttatttttcatgattgttttcgctaatttctttgctttttaacttaaatttttgaataaatttggcaatagctacaagaagacgttgctgaaattttggttggtatgttattgaatctattagatgaaattggagagcatttgtacctcactgagtctcctgattcatgaacctagtatttcctatttatccagatcttttttcatttatttcatcaatgttttgtagttttcagcctataaatcctgacatattttgttagatttaacaaatgatgtaagaacttcattttgggggtgctgtgattaaaattgtgttgtttgtatttttttcatttcaaattccagttatttatagctgctgttatgtgaacatgattgatttttgtttattggccttgtgttctgcaaccttgttcaactcaccatttttgttctaaaaggttttttgtttttttttgtttttgttttttgagatggagtctcgcgctgttgcccag

SEQ ID NO: 49606 - DNA, 1030 bp, Homo sapiens
caccacgcccagctatttttttgtatttttagtagagacggaatctcactatgttggccaggctggtcttgaactcctgaccttgtgatctgcccccccccccccccccccgcctcccaaagtgctggattacaggcgtgaaccaccgtgcccagcctaaaaggtttttttaaatatagattatttgatattttccagacacacaattgttttctgcaagtaagagtctttttttatttcttcctttgcaatgtatgtgccctataattgtttttctggctttataggccttctaatacaatgttgaatagggcagggtgggagggcatactttactagtagttttccactctgcatgttacctgtaggtctttcatagatgccctttattaggttaagcacctccattctatttttagttttctgggagtttttattttgaaaatatgttgaatttgccaaatgcgttttcctgtattgacatgattgtgcggtcttcattaaattattgatactgaattttatttattgattgtttttaaatgttgaaccaactttgcattccttgtatgaaacccagctgattgtgatgtattattattttttttttttttgagacggaatcttgctctgtcacccaggctggagtgcagtggcactatctcgctcactgcaagctccgcctcctgggttcacgccattctcctgcctcagcctcccgagtagctgggactacaggtgcccgccaccatgcccggctaattattttttgtatttttagtgagatggggtttcaccgtgtcagccaggatggtctcgatctcctgacctcgtgatccacccgccttggcctcccaaagtgctgggattacaggcatgagccaccatgcctggcctatcatttttttatattgctggatttgatttgtaaatattttgttgacaagtttctatttatgcccattagattgacttgtagtttcctatttaaattttttttaaacactgtgtatattatatatttggggca

SEQ ID NO: 49607 - DNA, 1020 bp, Homo sapiens
taccctgggcaacatggcgaaaccctgtctctacaaaaaaaaaatatatagtagccaggcatggtggcatgcgcctgtagtcccagctgccagggaggctgaggtgggaggattacttgagtctgggaagtcaaggctgcagtgagccatgattgtgccactgcactccagcctgggcaacagagaccccgtctcaaagaaaaacaaacaactccccccccaccacacacaaaaggagtggtgagaatgggaatctatgtcttattcccatcttctggagaaagtaaagcattaagtctttctccattaagaatgacgttagttataggtttttgttattgttgtcttataggtttcttttgttagattaagtaagttctttttcattctcacttttaggagagttttaaagccttgaatgggttttcagtttagtcaaatgctatttttatgtccatcgaggtgataatatatatattttaaatgtaatatattgaactgcattgattgaattttgagttatgaaacaggcctacattttatgataaaccctactttctcatgatataatttatccaatttgcatattgttggattagatttcctaatattttgttaagaattgttgcatttgagtcaacttaggtacccaaatggttggctagataaaatgtggtatatttatatcatgtaatactatacagccataaaaaatgaaaccatgtcctttgcagcaacatggatatagctggagacctttatcctaagcatattaatgcaggaacggaaaagcaaataccccatgttctcccttattcatgagaactaaacatgagtacacatgttcacataaatgtctaatgtgaacaatagacaccagggcctactcaagagagggtggtggaaggagggtgaagatcaaaaaactacctattgggtactatgctcactacctgggtgattaaataatttgtacaccaaaccccagtgacacagaatttacccatgtaacaaaactgc

SEQ ID NO: 49608 - DNA, 1871 bp, Homo sapiens
ggtgtgatcgcggctcactgcaacctccacctccggggttcaagtgattcttgagtctcagcctcccaaagtacctgggactataggtgcgcaccaccacacccggctaatttttgtatttttagtagccacagtgtttcaccatgttggccaggctggtctcaaactcctaacttcaggtgatcagcccgcctcagcttcccaaagtgttgggattataggtctgagccactgtgcccagccaggttatatattttttgaacgagctttggtagtttgtatctttttttttttttttttttttggagacagggtctcactctcttgctcagactggagtgcagtggcacgatctcggctcaccagcaccctccacctggagcgatcttggcttactggcaccctccacctcccaggctcaaatgattctcctacctcagcctcccgagtacctgggattacaagtgcacaccattaccacccagctaatttttgtatttttagtagagacagagttttgctatgttgaccaggctggtcttgaactcctgacctcaaatgatctacctgcctcggcctcccaaagtgctgggattacaggtgtgagccaccgcacccggcctctatattctttggtagtttgtatcttaaggaattaaaagataaaaggtggataagaaaagattactaaggaagttatttcatcgatttttggtttggtgtttattattttcttattttctgcttgctttttgtttaatttgttctttttctagtttcttaactccaagtcactgaattgaggtttttctttttcaaattggcattttgtgctgtttttttctacatacgttttttggtgtcaccccacatattctgacattttcattttgattctgttcaatatactttctgatttccctcttgatttctttttggtcctggaatgtgctatttagtttatgtatatttagggatatttcagagatgtttctgtgactgttacctattttaattctcatatggtcaaagaatatactttgtatgaattacattttttaaaaattggttcaagattgttttatgacccagaatgtggtatgtcttggtaaatgttcagtgtcttctttaaaaaatgtgtgttctgccattgttgactgaagagttataaaatatcagctaggtcaagtaagtcatttgagttttcaagtcttttatatccttagtgatttttctatccacttctgtcatttatggagaaagatatattgaagtctttcaatctaattgtgaattagtctgtttttccttgaaattctagtaattcttgcttaatttattttgaagctctgcatagacttttaacactgttaagtctatcttaacttctttgtcattatgaaatggtcttcatccatggtagtattctttgttcagaaatctgctttgtctgcccaaggggtctttggtctgtaggaaattaacccatgaaggaaagaaaacttggaaaaataatttaaaaaatgattgttttttaaacataaatcatttttaaattattgattccaagggattgctgataataaatttgttcaggctgtgttaagacttgcatcttttttttttttttttttttttgagacagagtttcgctcttactacccaggctggagtgcaatggcgcatctcggctcactgcaacctccgcctcctgggctcaagtgattctcctgcctcagcctcctgagtagcagggattacaggcatgtgccaccacacctggctaattttgtatttttagtagagacgaggtttctccatgttggtcaggctggtctcaaacttccgacctcaggtgatccacccacctc

SEQ ID NO: 49609 - DNA, 1031 bp, Homo sapiens
atttttaaatttttagtagagatggatttcttcatgttggccaggctggtctcgaactccaagtctcaagtgatccacacgccttggccccccaaagtgctaggattactggcgcgaccccacagcacctggcctagaatggtatattgactttatctgtggcatatgggttatgttaggtggagagcagtaggtgatgcaataggaaaagcagtttgagtctagagtgtacagaacctagagtaccttccttgataacttggactttattctgtgtaaaatagcaagcttagcgtctaaagtttttaaaggagttttttaaatgaaatatttcaaacagaaaatacatagaatgacatactgaacacttattaccgctaccctgctttaacaaatcttataccttactatatttgtttcagattttaagaaattaatacatcatagatacaattgaagctttgtacctttccatctcataccaccatgaagttctattctgaagtcatatatccttaccatgcatttttaaaatacttttactgtatagctatatactaataaaaaggtggcattctccatgttattaaagtttcttaaaaatgctatctatattttacttattctgcaacttgtttttctcacttattattatttttgacttatgggatattccggaagtttggactggtgtaaccacagtagttatttacggccagtgtcctttcttctttcttttttgagttaaccaggatacatttattaaatatatccaggataaatattcccaaaaacaaatatttggtaaatatggcaaacttattctttggcaaattagcttttagcatgttggactgctttccatccctattaggagtattataaggattaaatgaagtattaccaacaaaaaggtacttagcaaaattctcagtaaacattggttataatccctccaacattcagacttaagttctgcctattctctttcctcagtattctttattcctgtccatataaccattgtcctt

SEQ ID NO: 49610 - DNA, 1417 bp, Homo sapiens
attactgacaatgtttaattttcaacaacaaaaataattgagagataaagagaagtaagaaaacgtgaccttatggggaagaagactggcaaaacatctcaactttgaaggcataagatgtgttactaagcagacaaatatttcaaattggccattataaatatcttaaaagaactagaggacaccatacctcaggaggcaatgatataattacaataattttgcaactagagaatataaataaataggtaagaattatagaaaagaaccatatggaaatctggagttgtaaagtataataacagaaattacaattcattagagaggtttaatactagattttaactggtagaataaacaatcattgaatttgaagatagattgatagaaatcacccagtttaaaaaatacagaataaagaagtaagtaaaatgcagtttcagagaaatggcagaagccattgagaataccaacatatgtgcagtggtagtgccagaacataaggacaacgagctgagagaaaaaatatttaaagaaataatacctgaaaattttctatattatgaaaaaaaaatccaagaagtgtaaagaatttgaagtataataattgcaaatatattcccccttagacacatcaaagtaaaattatgaaagtaaaaaaacatcttggaagcatgaagagaataatggctgatatacaaggaaactctaataatacagtaataattaaggccacagtggaggtgtatgacatattaatagtgtagaagaagtaaattcaaaattttacctgaagcacgactgacattcttaaatcaaagtaaagacattgctagataaacaaaaactgggaatgtgttcttagcagacccaccttgtaagaaaagctagtttttgagaatgaagaatactgaccccaaactgtaattgaaattcctatgaaaaatcagagtaccagtcataattatgtaataattatagaggctagtataaatgcatattttttatgtattagctggcatatatgcctatacactgtatacttataaatattcatatatgtgtattgtgtgcagtatttccatatttgtatttgtgagcttacaacatatagaaatgagatctatttaataatatcacaaagtatgtggttgagaacaaaactgttgtaataaggaaatgaatcttttttttttggagacagagtttcgctcttattgcccaggctggagtgcaatggcacgatcttggctcaccacaacctccacctctcaggttcaagcgattctcctgcctcagcctcccaagtagctgggattacaggcatgagccaccacacccggctaattttttgtatttttagtagagacaggttttctccatgttggtcaggctggtctcaaactcccaacctcag

SEQ ID NO: 49611 - DNA, 1052 bp, Homo sapiens
gtaatcccagcactttgggaggccggggagggtggatcacttgaagtcaggagttggagaccagcctggccaacatggtgaaaccctgtctctactaaaaatacagaaaattagccagatgtggtggtgtgcgcctgtagtcccagctactcgggtggctgaggcactagaatcacttgagcctaggaggcagaggtggcagtgagccgagatcacaccactgcactgcagcctgggcgacaaagactgtcaaaaaaaaaaaaaaaaaaaaaaagttacgtaaccaacaagtcaaaggagaatttataaggaaatcagaaaatactttgaggtgaatgaaaatacagaaacaacatatcaaattctgtgagatgtgtgaaagcaacgcttacagtgaaattaatagctatgaacattgtaatgaaatgagaagtacttcaaattactaacctaactttccaactttagaaaatacagtaaaaaaagaacaaattaaaatcaaagcagaaaggatataaagtttagtgtggaaatagagaattaaaaataattgagaaacacagcacttcgttgacttattcataaaataaagctttattaaaatgagaaatgtaaaacgtgatgttcctaatgaccttattccatacaagggattagtattttgacaaatatctttgtggaagtagacaaattcctagaaagacactgactaccacaactcattcaagaacaaagtgaagacaataaattggtaatttaaaaactctcacccctgcccctgacacacatgtaaattcccagttcaaatgtattcttttgtatattataccaaacacatgaaaattaccaattcgataaaaatgtcttaaaaacttggaagagcatgtaatattttttactggttctatgatgctattgttatctagataccaaagtgaaacatcatacacagggaaaactctgataatatcgcttatgagtggatctgtgaaatttcctagtaaattttggcaaaccaaatacagtaacatataaacaggaatgtacaccag

SEQ ID NO: 49612 - DNA, 1032 bp, Homo sapiens
ttaggtgaaaaggtgtgaatagagacaaaaaagtattatgtagtaaatacttatgaagggtcaattcaggaagagggtataaaaatcgtaaatatgtatgcatcctgcagcagaacaccaaaatatataaagcaaactgtaagcgacctaaagcgagagaaactgcaatacagtaatagtaggggactttagtaacccttcctcaactcttgtcacctgagtacacagaggcttattccaactgggggaacgaaatagaagacagtgggataatttgcctagtaacccaggcagttctaccctggtattccccaagtccaccagtgctgtgtatgtgccaggctttaagcctggctgtgttcctggtcctagggcgccctctagtgatgaaatggttgcagtgaccacattcttagataaaacaacacaatcacatttaatttttgggacgccctgtgaagaagggcagctacgaagtagcagactacaaagattggaataaatacctaactcttaaatgcctggacactggagaacttccacaagcataagaccatccaggagacatgacatctccaaaaggactatgggatctagttttggagcgatgtagttatgttgcctctcatacaggaaactcaaaatagctaggaactatgatctaaaatatacaaaggaagtagccactgaccgaccctaatgagatggtgatgtgtgtgatgtcagggtaagaattcaggagaaacgttttgggaaaatagcaaacaccatgataatgcaggaaagcaattcagtaatttattaaatgtaacaaatactgaaacaatagataaccaaactgaaatactggaactgagaaataatgactgaatggacaaatgcaccagaaggtctcaacagcagcactgatccagcagaacaagaatcagtattattaaagacaggctatatgaaaatgcacagtgagtgcagaaagaagcaaaaagaacaaaaaagtatgaagcatgcgtacaaggtgaagaaaataatctt

SEQ ID NO: 49613 - DNA, 1069 bp, Homo sapiens
atatcaaattcagcaaaatattcttcaaacttgaaaaataaatactttaccagacacacaacagctgaggaatttttgtcaacatcagacttgtcttaaatgctagaaagagtaattcagtctgaaaggacattaatgagcaaaaagaaaacatccgaatgtttacaactcatagaaaaaggaggtacataaatatagaataatactgtgattgtggtatgtaaacatatttttagcaggaagaagactaaaaggtaattctattaaaattataactacaaaaatattagagatagataaacataacaaagataagatcatagcatgtagggtggagattaagtgtggagttctttggttttctctttgcttgtcattccttgtgactacagataccttgtcattaatttaaaattattggttatatgatggtttttgcaagccgcatgacaacaaccatgcaaaaacctcagaaaataaaagcaaggaattaaaatatactatcagaaaaaaattagttaatggaatacagggaggaaagaagaatggacgagaggaccaactaagcaaaatttgaaagaatggaaaaggagcaaacactttcagtttcattctacaaggccagtgtttccccgataactaaaggaaaaggtctaaaaacccccaaacaacaataaaccccagaagacaaatatgtctgattcacacagatggaacaatccagaagaaaatgctagtaaactgtattcaacaacacactaaaaatataattcatacttatcaaggtggattaatcttaggaatgcatggattgttcaagctatgcaaatcaattagttttatgtcgtataacaaagtcaacaaccataatgttgtaatggatgtccaaaaagtattttataaattaaatattttattaaaaattatctcaaaattgggtatagagttaagatatctcaacagactggcagttgaacttacactgtccttgtgagcaaggaaaactgacaagcatactgctagatttggaagacattaaaaatgcccatgttcagcactttagttcacc

SEQ ID NO: 49614 - DNA, 1031 bp, Homo sapiens
ttctcacaggattcccaagtcttcacttactaggttttagggtcaggatccgactcggttggttcggccgccgccgccgaggctgctccgcacctccctggccgccgctctcaagcccgcctccaatgagtagctggttgagacccgcctctagcccagcgcctgctcggagacgttgctcaggcagccattatcttccccattgttaccaagcagcgacaggaaacgactgcccacaacaggaagtgatgatgccgcgtcccggcaccgcagccccactcccagcctattagccaatcccagtcgattcctcgaaaaggctccgcgggaggaggagggggacggcagacgacgcggcaaggcgggcggcggtttggaaaaggaaagctgttatgacgcccaccatgtgacaggccccaccctcctccgccattttgaattgtggcgagaaatttgcgttctgagaattgtgggaaccttcgctttcccattttgaaaactgaaggacgtcacggtctgactgcttgaagacattttcagagagagagaaatgtgatattagtctaccctgacatcacatcagttcacacaatccgtgcagaccagttcaaaaagtagcctgcgttttattcaacatgtatttacacagtgccaactgcatgtcaagcaccattgtagctgcttaggaaattaaaatagaccaaaattaagaaagaaaacaggccacgttcggtggctcacgcctgtaatcccagcactttgggaagccgaagcgggcggatcacctgaggtcaggagttcgagaccagcctggccaacatggtgaaacccagtctctactaaaaatacgaaaattagccgggcgtggtggcgggcgcctgtaatctctgctaatcgggaggctgaggcaggagaatagctgaacccaggaggcgaagattgcagtgagccgggatctcgccactgcactctagcctgggtgacagagcaaggctgtgtctcaaaaaaaaaaaaaaaaaaaaaaagaaaac

SEQ ID NO: 49615 - DNA, 1045 bp, Homo sapiens
ttcatgaatattcattatgaactgtgaagagctgttcacatttaaggaatttcaagcctcatgtttggatttgtgcatgcttctaattgcattcataagtgctgtcttcttgatttgtcagaagacagtaaaatgaatttaactctatgtggaattcacttttttatcttgaaaatgaatactgggatattgtagataatttttatcttgttttgatatagtatggaaagacccaccacaatttttagtaatgtattgctgcttatttaggctggggacattgtttttagttttgtttttgttaaccaaattagaggctttatattccctttatctttaaaaaattgtcatcctctctcacaagacctgttttagcccctctaggaggctggtttaaggtgcctatggtaagaggagctatatttacataggtctagttatggaaggtgccatcagttatcataccctgttctctttggggcttattctcttctctattttgatgtgacagcataaatgtgcactgtggaactgtccgataatagaagccactggagtacatattttttcttttattgtttctggtccttagcatctatatagtgaagggattgctttgtgaattgactttggtatggggaaatcgggattgagccagcaggactgcatgttgttgtatatatgtgaaacaggcaagattgagaacattgtctgtattgatttaaaatgtctttttagattttgaaatgtgcaatatttgaaacataatatgttggttgtattattgaatttcaaggaaataaatttctctctttgaaagtgcagtaaacactgagtagattatttgctcagccatacgtatgtgggttgctggtgaacttgggataagaaaaaatttcttcatttatgtcgttttgttgttgttgcaatggattaaaccacacatccttctcttctgcctcctttatatactaaactcagcaaaatctgagtaatgtgcttttcctgtgaatatagttcatgacctcatatttaaaggcaatgc

SEQ ID NO: 49616 - DNA, 1043 bp, Homo sapiens
ttaatttaatttatcttttcaaagaaccagctttttgtttcatttatcttatatttttttttttgcttcaatttcacttagttctgctctgatcttggttatttcctttcttctgctggatttgggtttggtttgttcttgtttctctagttccttgaggtgtgaccttagaatgtcagtttgtgttctttcagtctttttgatgtaggtgtttagggctgtgaacttccctcttagcactgcctttgctgtatgccagaggttttgggaggttgtgtcattatttgggaggtatgtgtcattcagtttgaagaatttttaaatttccatcttgattttgtttttgacccagtgatcattcaggaacaggttatttaatttcatgtatttgcatgattttgaaggttacttttggagttgatttccagttttattccactgcggtctgagagagtgcttgatataatttcagttttcttaaatttattcaggcttgttttatggcctatcatatggtatgtcttggagaaagttccatgcactgttgaatagaatatgtattctgcagttgttggacgaaatgttctgtatgtatctgttaagtcaatttgttccgaggtatagtttaaatccattgtttctttgttgaccttctgtcttgatgacctgtctagtgctgtcagtggagtactgaagtcccccactgttattgtgttgttgtctaactcatttcttaggtctgttagtaattgttttataaatttgggaggtcctatgttaggtgcatatatgtttaagattgtgatagttttccattggacaaggcttttcaccattatataatgtccctctttgtctttgttaactgctgttgctttcaagtttgtttcttctgatataacaacagctactccagctcggttttggtgtccatttgcatgaagtgtctctttccacttctttaccttacgtttgtgtgagtcctcatgtgttaggtgagtctcctgaaggcagcagataattggttggtgagttcttatcca

SEQ ID NO: 49617 - DNA, 1033 bp, Homo sapiens
tttttctgtttttaaattttctacagagaatacaccttttttatagcctgcactcagtgtggacaattctcattacccaactttgctacatcattattgttttcacaaatttgtcattcagataaatagtatcataactgattgttcaaaaataaaggcatgtatgtatgttatgtaaacggtcattttgccatgcctaaatgtttctatctctagaattgtgaaaacattacgactgtcaatacgttgttggtttcctgaattacactgctgccacttgactatataactggctagtttttgaaatgttttaaattttggattcagggaacacatgtgcaggtttgttacctgggtatattgcatgatgctcaagtttggagtatagatggtcccatcacccagatagtgagcatagtacccaataggtagtttttcagcacataacctcctcctttactctccccctctagtagtccccagtgtctgttgttctcatctttatgtatatttgttttcaatgtttagctcctacttacgagtgagaccatgttgctgcaaaggacatgatttcattcttttttatggctgtgtagtatttcatggttcatggtgtatatgtgccacattttccttatccctgacaccattgatgggcatctgggttaattttacatctttgctattgtgaatagtgctgctatgaacatatgaatgcatatggctctttgatagaatgatttatttttttgagacaagagtcttactctgtcgcccaggctggagtgcagtggcatgatctcggcttactgccatcttcgccttacaggttcaagtgattctcatgcctcagcctcctgagtagttgagattataggcatgcaccacaatgcccgactgatttttgtattttcagtacaaatgggatttcaccatgttggccaggctggtctcgaattcctggcctcaagtgatccacccacctttgcctcccaaagtgctgggattacaggtgtgatggcctagaacaatt

SEQ ID NO: 49618 - DNA, 1052 bp, Homo sapiens
atctcagctaattgcaacctccgcctcacaggttcaagtgattctcctgcctcagcctcccgagtagctcagattacaggcccataggtagaccataagtatatttaaacttattatgattggcaattggttgaaagagttattattagtagaaagaaatgtctgattatgataaggggttgtggagacctaggttttatcatgtagatgaagcctccaagtagcaggctttagagagaatagactgtaaatgtttttaatcagactaaaggcttgtgttaatgttaatgctggaagggtgtaatgagacatgtccaaccttcattttcccacatggtccaaaccagtctttcactttgaaagtgccagagtagagtgtgcaacccaagcatgtccagaattgctgtgaagagattttgaatcattatttccagaagtggctaatagcaaactaatgattctgactataacaccacaaaaccaagaatgatatgatagtttgacatgaagaagtagaaattgaaagagaaacgctcttggaaaagtttatcaatagtgctaaagaaatttgctatgcacttcaagctgaggatagtgggctgaattaattggtttggcattttttggaccatgtataaacaaccctctttttaaaacagatgaaagctactaacatttaggattatctgttgatgatcttggataatgtgaagcgatttatcatagtctctggggcaccgatgtatttgtcggaagtatgttcactaatgcaacaccagacagccatattatagagaaattaaggggaaattagcagtaatattaattcattagctgtactatttttatgtaaccttggggttaatatataggcactgtcaaactaaagtctctaaaagatacttatttgtaagtatttatttcaacatttatgaatttacaacattgacaagtaataatgggattttaaaatttcaaatgttcattattcatattatcattgactacatgttgagcacaaccacattgtataggatgtggtaattagcttg

SEQ ID NO: 49619 - DNA, 1050 bp, Homo sapiens
ctatcagtcacctgttgtataattataacaatgtttggatttgtggattattattttagtatataacattggattttatgtatgttacctgaagaagagcaatatctgtaccacatatttctttgtttttcttttttgagatgaagtctcactctgttgcccaggctggagtgcagtggtgtgatcttgacacactgcaacctttgcctcccggattcaagtgattctcctgtctcagcctccctagtaactggaattacaggcgcctgccaccatgcctggctaatttttgtatttttagtagagatggggtttcaccatgttggccaacctggtcttgaactcctgacctcaggcgatccacccacctcagcctcccaaagtgctaggcttacaggcatgagacaccgcgcccggcttatatatcattactttcttggctgagagctgtagtctgtggtagttgttttgttttgttttttgttttttttttgtagttttcttgatcgtgatcaattaagcagaaagtagaatttcagtcaggtaacctgtctatattagctaaattatcttttgcttattacatagagtgctagaagtatgctgtcatggcatatgtcctagtttctcatcaaatggaccaaagtcagtgattttatttgaagaggaaaaattgaacgtcattgtaaattaagttgcaagtttagtaaccatattgtaccactgtttgataaatttgaacgctttatggtatttcatatttagaatgttcaaaatagtactgaagtattcaaatacatacaaccctgagcgatattgaagtaaaataaacatgtatttaaggaagtgtcaaccttcaattatatacctttttgtcactgaattaacacttatttctcacgacgtggaagcagtttcagtatggtttgtactaagctaagtgatagttgtcatctgtatgacaatttagaatgttttctgtgtccatttgtgatcaaaattatatgttgctttgtgtgataaaacctggtggtggtagtaactttgaac

SEQ ID NO: 49620 - DNA, 1055 bp, Homo sapiens
aaaaagaaaaaaattaaaaaaaatttaaaaaagtcaaattcagcgatttctagtatgttcacagacttgtgcaactatcatcactatctaattacagaatatttttattaatacaaaaagaaattccatgtatatgtttttgcagtttgtttacatggtggtttttgccacacaaaattttaaaatttcatttaattacattttaatctcttttcctttacagtttctgttttggcttatgcttagaaatgctttccccacccaatgttttgttgttgttaggtaatgcttatttttatattttcctagtattttttactttttatttttacatcttgttctttaacttggaattaatttatagattgtaagatggtttctaaaaatgttcacaattattaaatggttagcgtattatcccagcactacttactgattttctcagtgatgtgaattgctgcccttgttatatactgaattcttatatacacacatatgtacgtttctggaactttctgttctgttgcaaggatctttctattctgacatcagcacaagacctttttttttttttttgagatggagtctcgctctgtcacccaggctggagtgccatggtgcaatcttggctcactgcaccctctgcctcccaggttcaagtgattctcctgcctcagccttccaagtagcttggactacaagcatgcaccaccatgcccagctaatttttgtatttttttagtagagacgggtttcgccatgttggccaggctggtctcaaactcctgacctcaggtgatccgcctgccttggcctcccgaagtgctgggattataggcgtgagtcactgtgcctggccaatactttttttaatagacaattttttagagtaattttaggtccacagcaaaattgaacagaaggtacagtatgtagccttttcagattggcttctttcacttagtaatgcacatataagtttcctccaagtttttttatgaatagctcatctttaatgtgtgtgctgaataatatttgattgccttgctgcacca

SEQ ID NO: 49621 - DNA, 1053 bp, Homo sapiens
cccatctcgacctcccaaagtgctgggattacaggcgtgagccaccatgtctagcctgttttttcaacttattctacataagtggttaaatactgacagttattttcgttttcataggcatttaatgttttcgcatttgttggttttggcactattttgtcttagaagtaaatttgtcttagaagaaagcaataacattacaggcagttcttgatttagacatagattgtgtctgacaagttgaatcagatgatttaaaaataaattttcttaatatttttatattcgggggtacatgtgcttgtttgttacatgggtattacatgtgtaatcaggtgattgttttgatgagggagaggaggcattccaatcaccaaatagccttcatagactcaaagattcctgcaccaagaccatatttaacacataacattgttgaaaagtagctgactcatttgtaatttcaagtagttgaattctacttccccctaccttcctgagataatgatagctgccttgcaagaaaagttccacacacactaaaaacatgtttctaccttttgtctattattgacatggcagcaattgcttagcccctgttggaaaggcacatatatacttgaggcatatttctcacttttggggaacctgtctctacctgtgtttattgcagggtattggtatttttcaagcattctctccacaccactctcacctttggctggttttactttatgacttttgcacacattgccctgttaagttaatccttttgaggttattgttagctttggactccagcctgaattggctgtatgaacatagacaagtctcagctttagcttccttaattttaaaaggaggttatgattctatttacgtagcaggattggtgtgagacacatgcagtgctataggaatctgaagcatctgtattgttatcataggacaacttatttgtagagatgctatgactactctaggagtcacaaaaatgaccagtgaagtacattgccttttaatttgaatgttctgttcttttttgaccttatt

SEQ ID NO: 49622 - DNA, 1065 bp, Homo sapiens
ttgcactagtgaacagcatgactgccataaaatgaactcctttttttggttaacaagttgcgtgggactttttttctaggaataagagctttttagattactgtgtgccagacactaaaacctgataatttaaataaatgactattatttgataatattataatgtgtatgttggtatattattggattctttgctacaattatgatttcataagtgcatgagttcctttctctatttttttttttttgagacaggatcctactctgtcacacatggtgcattgcagtggcatgaacactgcttactgcagcctccacctcccagggtcaagtgatcttcccacctcagcttcctgagtaactgagaccacaggcatgcaccaccatgcccagctaatttttgtattttttttttttttttttgtagagacagggttttgccatattgcccaggctggtgtcgaactcctggactcaagcgatctgccctcctcggcctcccgaagttctgggattgcaggcatgagccgtcatgcccagccgagtccctttctctagtactctgtcttattaatttctaaaaatgctttatatttacaagatacagtctcaagcaatttcaattcataggcctaatttgcatccaagtcaaacaaaaaactgttgaactagtaaacagttataagacaattttaaaaatgtgaatactgcctggatatttgatgatattgaagaattattttaggtgtgaaaatggtattatggttttttaaaaagagtctattttttagagatacatatttaaatatttacacatgaaatgatgtgatgtctgggacttgcttcagcataatccaggtagagagcagcgagtggagggtgtaggaatgtatatgaaataagattagccaagtattatgaagcaaggtgataggtacgtcaagtttattatgttcttatacacacacacacacacacacacacacacacacacacacacacacataattgaaaatttccataataaaaagtttaagaaaaatcaggctatgttttggaatagtt

SEQ ID NO: 49623 - DNA, 1030 bp, Homo sapiens
atgttggtaattgtagggctttttgtggagtttcaggaagaggttgctctttctcaccttagatattttgtacagagttatccttttatgaacgttataagatcagactctcatgctgtcagtaggaagcaaattgaggaatcctcttctgctatcatcaaccggccaattacttactgtgatttgccctttggcctgcctgaagagtgttaactgggtatcttaaattctacctaagttcattacttttttactctttccctttgaccttgcactattagttaaaaatcttatcttgtacctaagtgttttttgttgcaatgtagggatgaaaaccatgatttcttgcagtccagaagtagaaatattttagtgataaggagctggcctctaggactaggaggaatgatagggattgactagaatctgaatgtctttgatcttttctagctccatggtaggagtcaatctgccacagaaggctggtgggtttttgatgaagaaggagctgaactactttgcaaaggccttggagagcccagagcgacccttcctggccatcctgggcgggtatgaagaactctttaagatcatgctttaagtattgtttgcctggtagtaggccataacttgggtggtttattgtcatatagctcagtcacactgggtaactgaggagaatttaataaaggaactacaggctgggcatggtggctcacacctgtaatcccagcacattgggagggcccaggcaggaagattgcttgagcccaggagtttgagatgggcccagacaacaaagtgagatctcatgtctacaaaaaaaaattagctgggcggtggtggtatgcacctgtggtcccagttaccagagaggctgaggtgggaggatcacttgagcctgggaggtagaggctgcagtgcactgtgatcacgccactgcactccagcctgggtgacagagcaagaccgtttctaaataaataaataaataaataaataaacaaacaaacgaacgaactacatacag

SEQ ID NO: 49624 - DNA, 1051 bp, Homo sapiens
tacacacacacgtatatgtatatgtttgtacaggtgtgtgtgtctacacagacacccacacacacacacctcaaagcctcagtaaaattggggataataatacttacctggctgttataaagtttaaatgagataatatgcttagcacagtgcttaaaacagtaactgttctatagctatattttatatatgttttattattattacaggtataccttattaaactcatattgtccctaaaatattttactatgcatagcatctaatgcaagttatttaattctctctgaaatttagatcataaataggggtaatagtattacatacacatcacagaatagttgtgatgactaaacaagatgaagttctcaatgtagatcttgggatacagtaacggttcaataaataaataaatagtagtgaattagtgatgatgatgatgatgatgatgatgatgatgatgataaggaagatgatatcacctgtcctctggaaaagaaatgtaggctaactactagtttttctgaatagcaagattttactacttagttgatgctctcccagaattgtttttgttactaaattcaaacttttaacatgcctatcctgctctcctttctcatgccttctctctcactctctctctctcactcttgcatgccaaatcaagctgtttctttgtgaaagcaccaatgacataggttagcttactatttttgaggtccagctgtacattttaataaacacttttcgtattgtggaataatgacctagtctttccttcttaaaacatgcagggtgaaatcctcactatttttatgaaacagcatctgatcttgaacttttatgactcacctcagtcacttcacctgtattttggccctgtcagatcatgtctttatttaaacttttgatattttattctttatatgtttttgcattagtttttatttttaaaactttttctaagtatttttatcttgactactgtggttttggtgccttcttaaattttatgctagagatgactactgcctcattcttctcactg

SEQ ID NO: 49625 - DNA, 1026 bp, Homo sapiens
aatctccagattcagtgcagtccatatcaacatagcaatggcattcttcacaaacatagaaacaacaatctgtacagttatagggaaccacagaagacacagaatagttaaagctatcttaaacaaaaaagaacaaaactggaggaatcacattacctgacttcaaattgatggtggtggtggtgtgtctggagcagcctctgtggggatgccagctacagtgggggagatgcagcttgggctacacactccgcagagccagtgggggctggtaacaagtgggagccccatcccctactgagttggcagggtgggagccccatgctcctgtgtgcagctgaaaatgcccagccaaggttgtgaacccaggcatccttgccctctcaggggcctggaaatccatccctgcttctgcaggctcagaagtgccttttccctctctctggcctcttcccgctcctggtgcctgctcttgggtggagcaaagttgtggccttgtctgggtgttgtagcaacccaactgggtgtgtgcatgattggggcggtgctgacacagcagaccctgctgcctcagcttcctctagactttgtgcactgaggagcatgagagggatactgaggaggctgagggttgcttggcacgggcctgcatgcaccccttggcacaaacagcctgggtgccatggatggcagaaggcagacagtctccggggtggaaaggggtaggtttcaggtgaaaccccaccttcaagacagataaagtctgaaatctgggggccaggctgccagttccaagtggagtccatggcccagagtgatagcttatggtactttttcttggcccacccatggctccccatggaccaatcaataatcatttcctccctgtgagcccataaaaaccccagactcagccagactctggcagacattgggattatcagctgcaggaaggagctacccacttttggtctcctgagtgttctgtcactcaatgaagctcatctcctggctgaaacatgcacc

SEQ ID NO: 49626 - DNA, 1086 bp, Homo sapiens
aaaagtagaagtatcaaataaaaagggcaacttttaaaatattaagcctgaagacttctaaaaagacaagaaacatggcctaaataaccaacatagatttacatagtaagtttcacactaccttattaccaaaagcaaacacctcttactttaaactacattatcatgtatatctattgtatgctggtctttactttttgccaaaatcaacatataatgaagagatgcctttgtttcatgagattcaaacttgatgctatgctttaaaataaactcagtacttttagaaacataacttatgtgttcttggagtttatataatagtaattttagatgagtaatatctttttttagagggttgggaatgcaaaaagagaaaatagtagaaagaaaaagctttgaatgcaattcaaggttttcgttttctatgttttctttttagggcttttaatctcacaatacacatgaggtcaaatgaacaattttattgggtttacaaaaatacggcataaagaactctagagaaaacagggtgctttgtaatacactggaaacgcaaaaaaagttttttagtcaatattttctcctaagctttattaaatgttgctgatgatacttgcaatattttatgtggtcattttcacttttattttaatgtcaaataagttaacactgccaaaatgggcattctttaaaaatagatgtattttttgccatgtttatataacttaaaattaacatagtatattaaagtaaaaggttgaattgagtcttcctaaactgaaatattttattttgtcagctgagaaatatgttttgtagatacaaaaatgcaagtgaaattctgaatatgaaggtgagttttatttaaaaaaatctccaaaatatttggccggaaaatataatctttgccacttgttatattacattcagattgtttctgtttgtaaatcagacttgtttatttgttatgttcagttattgagctggtttgttcttgggaatatttgactctcaggaagattttcattttcaccaaacaatgcaaattggacgtcgattgcattgttaaatgtcaacatttct

SEQ ID NO: 49627 - DNA, 1119 bp, Homo sapiens
gcttgcataggcctgtgtgggggttgagggaggtggttctcaggccaatggggttatgttccagaggggattatggctgcctctgctgtgcagtatagttctccagggatttggagtatagccagtagtgaaaggactcacccagctcccatgcatttggcgaggccgatcttgattctgcagtgccctgctaacagtttagatccaggcagcctgtgcacagagctcagacctgccctgggccataagttgccttgctaagaacacaagcgcggctttcaggccctcttccctctctgtgtgctcacagtgtcagtgattcctatgctcgtatttgcagcagttcccgttcacaccccctatattctgctcaagaatgtttgtgcccagtcaaaattattacaaaattcagttggaagtttctttcaccctttgaccgctccctaattctgctggctgtcttctctgagggcccctgtgagatatagttagggatggcttccctgggcttgagctggagactctgagtgcctacgaggtccttccccactgctgcttttaactttatatttcatgcggctcctgaaatctattccagctctaggcaaggttaaatccttctcccatgatctggatttttagattccccagtggaatgtgtgtttggaggcaggttttcaccctctctcactttgggaactcacccatctcatggaatttgcagcagcgctccactaccatcaaaggatctgtgaattcttttggttttcctggtatgttcctgcagtggttcttggaacaaaagttcatggtatgagtctccacacactgttctgtctgtccaagtgggagatgcttgttagccctgcttcctatttgctattttcctcccatccatgaatgagtcttttaatgtgctgttgaatttagattgctagtattttgttgaggactttagcatctatgttgcattagaccatttttgcattgctataaaggaatacctgaagctagctaatttgtgaaaagaggttttatttttggcttacagtactgcaggctgtacaggaagcatggtgctgacatgtttatggtgagagcctcaggaagctaactatc

SEQ ID NO: 49628 - DNA, 1067 bp, Homo sapiens
ccactccagcagacccagggtccattctcaccccaatactgggacagagcctatggactgagatgctaagacaacccagacccaggttccaggcccatcccagtggtcccaggtgccaagcctctctcagcaccaggccagttcctgtggatttaggctccaggttccaaatataaaacctaatgttacacctcaagaagctaggaaaaacaaacaaacaaacaaaaactaagcccaaagttagcagaaagaaggaaataataaagatcagagcacaaataaatgaaatagaaaccagaaaaacaatataaaagatcagtgaaagtaagagttgatttttgcgaaaagataacatagataaacctttagctagactcagttctaaaaaagagagaagacaaatcagaaatgagggaagagacattacgaatgataccacagaaatactaaaattcgtgagactactgtgaacaattatatgccaacaaactggataacctagaaaaaaactgataaattgctagacacatacaacttaccaagactgaattacaaagaaatagaaaatctgaacagagcgctaatgaataaggagattgagtcacttgtaaaaagtctgtcaaagaaaagccgaggacacgatggcttcactgctgaattctaccaaacatttaaaaaaggagtaataccagttcttctcaaactcttcaaaaactgaacagcagacaatactttcaaatgtattttacaaggccagcattaccatgatacaaaagccagacaaggatacaacaagaaaagaaaattacaggtcagtattcctgatgaacttagatgcaaaagtcttcaacaaaatactagtaaactgaactcaacagcacattaaaataatcgtttaccctgatcagtgggatttatccaagggatggaaggatggttcaaaatatgcagatcaataaatgtgacatatgacattaacaaaaggaaggacaaaagccatatgatcatgtcaatagatgcagaaaaggcatttgacaaaattcaacatcctttcatgataaaaactt

SEQ ID NO: 49629 - DNA, 1050 bp, Homo sapiens
cggggaattgggaaagatgagagttgccagtctgctggtgagctctttgaaatagctctttcaaaacagagctctgaatgggtatgggtacagaccattgttgtaaactgaactgtgttaggccatttgtgcattgctataaagaaatacctgagactgggtaatttataagcaaaagaggtttaattggctcacgattgtttaggctttacaggaagcatggtggcatctgcttctggggaggcctcacaaagcctccaatcatggcagactacaaaaggaggagcaggcatctcccatgacaagagaaagggcaagagagagagacagagagtatgtggggaggggaggttccacacagttttaaatgaccaggtctcgcaacagctcactcactgtcatgaagacaacaccaagccataagggatctgcccccataatgcaaacacctcccactaggtctcgcattcagcattggggattgtgattcaacatgagatttgggcagggacaaatatccaaattacatcattccacctctggcgcctcctaaatctcatgtccttcccacattgcaaaatacaatcgtactttcccaacagtccccaaaagtcttaactccttccagtgttaactcaaaattgcaaagtccaaagtcttatctgagacaaggcaagtcccttccacctataagcctgtcaaataaaagacaggttttttatttgttgggtataggcattaggtaaacattctctttccaaaagggagaaatcagctaaaataaatgggctacatgccccatgtacattcaacacccagcagggcagtcattaaatcttaaagctccaaaataatctcttttgactctacgttccatatccagggcacactgctgcaaagggtgggcttccaaggccttgggcagctccacccctgtgtctttgcaggattcatcccccagggctgctcttatggattggatttgaatgactgtagcgtttctaggtgcagggtgcaagcagctggtgaatctaccattctggggtctgg

SEQ ID NO: 49630 - DNA, 1082 bp, Homo sapiens
aaataacgttgcccactctgacaccagtacatccacatatacctctcctttctaggggagagaggaaacttgcctatttgcagtgcacctgctttttatatataaaacgcatctttaataagatatgcatctctcaccttcctaattatacatagttgccaatgtggtgaatttaagcattagtccagaaagataaaacactaactctttaatcctggtatgggtagtaaagagtcatttaatggtaaaacaagacttttctgacttactactggaaaagctttaccaaactcacactgtcttatgttttatttattttttaactttagataaaaaaactgacataaaattgtatgcatttaccttgtacagcatgatgctttgaagtatatatacattgtggaatgactaaatctgtctaatttacatatgtattaccttgaatagttatcatttttgtgttgaggacattttatacccactcttagcatttttcaagaaaacaatatagtgttaactatagtttcatgtttgttgttggtagaggagcaaatccaaagtcattaatcatctagttcccttgatgttgatttgtaaacttgattcttcccagttctatcttcctcaaacaccaggcttcataggaggatttataccctaaatataaaagcaaaaaaaaaaaaaaaatttttttttaaaggaagtaagtccctacctggttaagtttttcattgttcttttgtgtatgtttgtttttattaaatactaattagaatcaaaaggctgttcaaaatatgaaaggtatgaataataatatgatgatgataatgatgtacaaccgtatacctagcacccaatttaaaggaaaacaaaatcctctgtgtttccatttcattccattcagaggttaccattaccctgaatttttactattattcccctcctttactttttaattttaccttatatgtctgtattgctaagcaatgttttttttaagtaaccttatattcctgaaattcatccaaatttttccatgttgctgtaatttttatatttaccccctaatttctaatatttct

SEQ ID NO: 49631 - DNA, 1037 bp, Homo sapiens
tgtgattttactgtgatcaaaaagaaggtgacaaagtgtttaataccattttgacaatgtattcatattgatttgcataggtttatctatatagatacctatatagatatctatataattacaatgtgaattataaaacccgctaagttgtcttattgcaaaggaaggtggctaattcagcggttggggaataataataatatgcaccctttatcgagcacatactgtgatgcagagagctagaagtatattatgttattcagcccttacccacaaagcaaaacaaaaacctctgctggatcggtaattattcccattttatgatgaagagactgagactcagggagctaaaataagttgccccaaatcatatagcttgtgagtagcagagttctgtttatggcctagatcttcttgacatcaaagtctaagttctttccattgtctatagattatctaatttaaaactggaagttagtctctaatttcagcctcctcctctcacttaatcttcataaaaactgtcattgaataacaaacatgatatgagttttactattttcctctgtcctctctcttttctaatcaagaggagctatacagtttttagactctgaataatctaccagtgaccatattctcacaagaatataatgtatggtcatttttccacatgccttttaattccagagtatctttatgaagatgaaacatactacagcttaacagtgggaccaaaacctttccaagctaatgtcttttcctcacacatctagattctggaaccctttatttgcctgtcttgggtgatgtggtatatgaaaagcattctatggagacaatgcagagggagaaagagatgccagtgctacttactcattcttatcatagatgtcttggtcagtttgagctgctgtaaaaaataccatagactgggtggcttataaacaacagaaatttatttctcacagttctagagactgaaattctgagatcagggtgccaacatggtcaggttctggtgaagaccctcttct

SEQ ID NO: 49632 - DNA, 1046 bp, Homo sapiens
agaaacggggtttcaccgtgttagccaagatggtcttgatctcctgacctcgtgatccgcccgtctcggcctcccaaagtgctaggattacaggcgtgagccaccgcgcccggccgagtgatctttttaaaaacatagcatcattcactcctctactcaaaattgtccagtagcttctcatctcacttaaagccaaaatctttaccatggccctgtgtgacctagctttccattgtctttttgatcacatctcctatcatctcactgccttgccgccacccctacatacaccacatttgtctactgtgtttcaaccatattggttcctcagacatacctcaggtccattacacttgccgtctgctcatcctggaaggcattgcctgctggtatctatagggtgcacaccctcacctccttcagttctcggctcatgtatcacctttccagaaggctttccctggctgccctatttaaaattacaaatcacctaagcactccatatatccttccttgtttcattttttcacatagcacttaaccaccatctgatatatatttaattagtttgtctgtctcacctaactcaaatgttaggtctgtgtcactagagatttttatctggtttgttcgctgctgtcttcccagtatcaaaaataaatttgttaagtgactaatttttcttttcattttaatactttatcaggtgcaacccagtttatgcctgaccccaagctcatggatcacgggcagtcccacccagaagatatagatatgtacagcactagaagctgaagtagactgcatgcagagactacacagaaaactacaagatgtgtggcgttgcaaataatgatgaaaataaatcatgtaatgggtaactgatacatagagtattacctaaaccaagtttctcccttacatttccaaatatgccatttgataaattacataagtggttaacacacaaactgtgaatgcagtgtaaacaatattaaatgattgatgaggagacttaggtagaagtattagcttgcatttgatga

SEQ ID NO: 49633 - DNA, 1025 bp, Homo sapiens
atatttatacatatatgtataaatacatacatatttatacatatatgtataaatacatacatatttatacatatatgtataaatacatacatatttatacatatatatgtataaatacatacatatttatacatataaacatatatttctgctctagctttcccagattaatgctagttaaattagaatggtgtatggaaaggtgtgtttccctctgtttttttttttttttttttttttttttttcccatttcctagagctggaataaaatatccatgttttatgggacttgagcttggctttgtcccttggttttgttaatgttaattcctcttaaatatctaaaaacatctctacctatttgagagggccatatgctacacaggcttcctaatactgcttagcaatccttctactggttcctaagtggtttactattgtgttccctggaagaggtattacaaacgttttattcttctcaagcctcttagaactgtcaaagttgactgtgcctcctatttcatagagaaaaaactaaattattagatatgaccattcccaaaacttcttcccatctaccttcaagacttacctcttttcagccatgcatcccccttttctaagacatgcttctctttgtgttcttgacctcattccttcccatctaagaccatattccaccctgtttaatttctagtcttcggtttctctttttacagtgagcaaattagaagaataggttagaagaatagggtagtagatactgtagtttctttcctccacctctacatagctgcaggtcttctctgtcttaaatcaacaataacaaaacaagacaaaaacctttccttaacttggcctcttcccttgaactattttttctctctccttcctataattgttatacttctttaaaaagtaattgttactttttgacaaaagtaaatattgtcccttttttccctactttcaagtcctctctgtcttgtgacattctggcctccatacctgcttaatttttttt

SEQ ID NO: 49634 - DNA, 1046 bp, Homo sapiens
acccccatatctctctagtgctgtagacctttatttctacttactagttatattcacctaacatcccatagatatgccaatgtcaatgtgcctaaaacaaaattgtctctacctcccgctccttcaaatctattctgtcttctctaatcctataattactctccctcaagtcatcatcatcacttttctgggttactgtaatagccttcaggctaatttgctcactgtcaatcttgctgtctctcatttcagaatatgttctgcttgcaggtgacagtaaactagttaaacaaatatttaatattagcttaagcaaaaaaaaaaaaaaaggcctatcctatttatagcctagaattaggcagtatagggttgggacagtggctcattggtgctatcaaggacgtagactttttctctttccactctgtcctctacagcatgctggtttgtcacctcatggtcacaagatgtctgctgtacctccagggagcagatacacattcaaagtaggaaatagcagataaaaatgtacacaagatgcgtctgactcccttttaccagaaaagtaaatgctttcttagaatctcctcagaagacctctgtgtatatctcaaccagtacttgtcatatagccacacacttagctcaaggaagatagggaatagggaaatcatgtttcttttcccctgtggtgaggaaggcaaggggtaaggggttgggaacaggtgctgaattaaagctaacatacagtatctactaccctattcttctaacccatttgtctattatgatatagttgtcttgacaactataatgaatagctgtctttctgaaatctttagtggctcatcattgcctgcagaatcaaaactccttagtctgatatacaaggcccttcatatctgattccagcttaccttctaatcctatcttccctctccttacccaccctactgctaatgtgtattatattgtctttatgacataccatttgtttcttgaacatgctttgctcattattgcctctttctctgcctgtgctagtg

SEQ ID NO: 49635 - DNA, 1346 bp, Homo sapiens
gctcagcccccgcctcaagccggcggggtctcgcactaacctagcgcgggcgcctcgatctcccgcgcgcgcgcgtgcgcgagacccccctttggccccctaccctgcagcaagggtagcgtgacgtaatgcaacctcagcatgtcagcagcaatataaaggagaatgaggcggcgcgcctcccagacgcagagtagattgtgattggctcgggctgcggaacctcggaaacccgaatgtgaggaccttaagggatccacagctgccgccccccgcagccatccagagcgcggtcacagtccgactggcggcacggaggcggcggcggcggcggcggcggcagcggcggcggcagcggcggcggcagctgtagctgcagcagcaggtaaggagactcctgacgagaaactagagggacgtggatccaccgcgttcagtgtttcttgtctgaggggaggagaggctcacacccagcgtgtagcgtagggcgaagggaacaatggaagtggcgtccagtccctgagctttcctcccgcctcgggcggagttttcctcttcagccgcagccgggggctggaggaattgagggaagtaagggttttcccccttagccaacctcctctttccctaggccagagccccagggagctagagccgtcgttgagaccgtcggtggtttagggtgacggtaaaatggcggaaaacaaaacggtgaagtgaagaatgcagcgtccccctggcagtttctctcagctctccctccaccccatattcttttcactggcgccccagtcgcctcgcccccgccccctgaccgagctaatagtaacctttggaatgcgcgagggatggcggcgtgtgcgaggaagtggcaccgaatcggcattttaggggattgggagccgtcagagcctgggagttggggggagggggggggcgtgtgcgacaactgtcgcctacactaaaacaccaccattttggttcccaaccgtctcccacgtagcggggcagaggaagctggaggaggctgaggggctgggcagcacggcgtgggtagcagcggtggcgaccgctgcaccaagtgagaggagggaggaggggaaagggtattcttgtctcatcggtctcttcctttctgctgcgaaggttctcttgttaggtttaagatctagtcagatgggtaatacctcagagggcacgtgtgtgcattctgctcgaaatgattgaaacttggcatggtcgtgggaaaaggagacttatgcgggaagagggctgcgtccaaagctgcaatactgctacttgccagggctcctttgtctcccatctctgcaaatactactttcgca

SEQ ID NO: 49636 - DNA, 5731 bp, Homo sapiens
atacttttataatagttgcactatgtgttgtaatttttacacttcattgagtgctagtgcagacttttcagtatggatttggcaaggataaagcttgcccttgattctctttcactttctaaaataaggtgttgtttgtgatttttaagatgtgctttagagaagattttggtttaatcaagtggtagcattctaagtataataacgttgctaatgtagtgagtagttgtttttgttggaatccgttgggttgcttttaacattactacagatttgagcatatgaacccttcccagcctcactatgcaagttcaggtgtaaagaaaaatattaagttgtgtaagaaacttagtttaaaatattttaaagtatctgattttgaatgtatttttataataggtaaagagagcgttttcccaaagaaaataacatagcacagaaggaaaaataaaaagaaattgctgcagattttactttatgtgagaaaatctacaatttcttcgagacactcatataaaggtgactaacaaattacttattgttttatcttatttaacagttaaataaaattaagtttttaaaaacattttcagacatttgtagttgttctattagttatgtggtaaagaaagtaattactctaattaaaatccaaatagtacactgttttaaatgttaagaacatgtccctttcagatttattttgttaacacacaggtagtttattgtgaactctcttggccttggacctcattttgcataatagcaaagcagaaaacaatggcatttgaaaaaagatacacaactaagaatttctaaaattgtgaagtttgctcatacataaagtaattctgtctgaatcgtttgttatacagaaatgtcacctacttctgtagcatatttatgtatatacctgaaatggtgataggggttcctctgagactctcctgcctcctgaataccaatttagccatcctcctttatttaagaatatattaagttgtattacgtgtcacctttctgaaactttcattaaggttgcagctttatctgttgtgcaatatggtacaatttattaagcagtcctacgtgaaaaggagataagtgccttataaaattgacaggtttttgttgatttacttagaatcttatgtttgaagagaaaatgcacatatatgtgtctaagaaatacattgagtgacagcatctgactttatgttccatactatcaaatggtcgtaaatataggataagtcatttgaaatgaaatagattgagcccttgctttcaaaaccaccttgaagctagcataattttattaatcactaataaaaagtcagttgtacaattacaagtaaatgaaatgctgagataaataatttgctaaatgtttgtatgtgatcgatcttatttttaccatatttaggaagcagtcatgtttcatgagtcctcaaaactgagacaagagaatgtagtagagtgaggccagaagtccttactggttcaaagaactccggggaaactgggatagaacattttacattataagtagaaccctgggagccagaggtgaatacaagtttatctgcagagctccgctgcagggctgatctgggtctggaagaaatggatgagagccagtggatgaaattcactaatactagacatctgagtcctctagtaatgtataaatatcctaactattgtttgttgtcatctcgttcttcttttataacctatgttttaactggaacttttagcactgcagttttgttgttttgctttcttctaccacttccctatggctcatcagcttgactgtgcctttgtctccattatttttggtttacttccacttggcacttcttttatttatggttgtcacataaagcatctaaccatggtttttctttgttttgctttcttttgtaataagctttccacacttggttgaaaggcatattgtcaattgcatttttttctcaaaacaactaactttggactaaatatattaaactattttaaaagccatttcttttgcagatattggtgaatgaactttgctaagtatggattcaggcggtggaagtcttggattgcacacgccagactctagaatggcccataccatgattatgcaagattttggtaaagcattttctttgttgtatttttttcttttttagaagtaaggggataataaaaatcaaaaataagttgaggaaggggagaattacaatgaaaacttgttcttttactaggaaaatatatttgtagagcttattctcataaagctgtgtgtcagtggtctacttaacatcacttttacaatttaggggaaggttgtgttagggacacttgaaatatggtggtaatatgttactggaaatgaaaaactcaatttacataaataactgcataattatatcacattctgttctgatagtatatatcagctctcacgtgtaggaaatgttaaactgactttctaaaacacattttaagttgcattgttaataaaattggaaaaagaagtgcttacatcaactaaaaaaaagatgcttatatagtgatatgcagaatcatgcactaggtgattattattgtgatgctatttcctcagaaagttgttaccattagaatacatttttctttctcttttttttttttaaaaaaaaaaaagaggccgggcttcgtggctcatgcctgtaatcccagcactttgggaggcaaaggcgggcggatcacgaggtcaagagattgaaatcattctggccagcatggtgaaaccccgtctctactaaaagtacaaaagattagctgagcgtggtggagcacgcctgtagtcccagctactcaggaggctgaggcaggagaattgcttgagcccatgaggcggaggttgcaacgagctgagctgagatggtgccactgcactccagcctggtgacagaatgagactcagtctcaaaaaaaaaaaaaaaaaaaaaaaaagactccttactcttgtggccaggtttgtaagtagcctcttgacagtagtcattttgatgaggatgccaagactccattgacattcaacaaataaactgaatttggccagggatgatctgaattacagaggagatagagctatttgaagtataaaaggcagggatgagatcaaaagaattgaagataagattggagtgaaagcagaaaagacaaatggtgaactgcgataaaagaacagggaacgaggtaatatggaattgttgaagctgaaattagtgatgagggaatagaactgtgatactttgctaagttaagaaaatgctactattgttcgttgataatatggttgaatgtatcatttggtcccctgtagtaaatcccacagtaacggaagtcagtaaagccgtattctagtcatggcagtgctgttaactagctgtgtaaacttggataaattactgaattcccttttataatgattgcactagataacatttaaggtcctctccagttatagaattctttgacgtttctttctgatgaataaagttgagtagtacaatattggatgtgagttaattgatgaaatataaagaaatcgtggatgtattcttctgaaagctaagtgaattgtgttgactatggatgatttagaaatgactttgggtgaaaaaaactcatcaataaattctagaggaaggataatagggccaaagagtaagagattaaagatattcccatgaattctttagtagagagttgatagtttttagaataatggaacactggaatttcagtatggtaaataaattttggttgaaatgtcaactttaattttttaccttttaaaataagatatttttaaaatggaagtattatagtagtttctccatttaatacaaaatattacctctcctatagcatttgataaagtgccaaaactcacttcattcctgaagaggttggctattagctagtaaagtgtgattcctttcaaaagatgaaaaaaaaatctgattggtgctggtgaatatttacataatgttccttttaaccttcctttccattgtttatcctcaatgtctttagaattaattactcctttattacatctactactttttttcttttagttgttaggggaatagaatatgcatattgaaatatttaacatatatgttttttcttctttactttttattcagatacattcacataccattccattcatccatttttataaagtatacaattcaatggtttttagcatattcacaaaattgtataaccatcactagtacctagttttagaacattttcatatcctaaaaaaagacacctcatacccattagcagtcattccccattctgcctctccccaccagccctaggcagccactaatctttgtctgtggatttaattattctgaacattttatataagtggaatcatatatggtcgttgtgtctggcttctttcacttagcatgtttttaagtgtcatccatgttatagcatgtatcagtacatacttcattcgttttcactgccaatgatattccattgtatgagtacaccacatttggtttatttgtttatcagttgatagatatttgggttgttgaaatatttttaatccactagaaatattatgtgtttgacaaaataagctttgcatcttagattgaagtatgagtgcctttggaggcgtgtgacagtatgccaaggcatacctgaaaccacagaataaatagcagagcctcttggaatttttttttcatttgaattgaggagaatatatatacacacatatacctatacacaattatagctgcataaatatgtagaaagtaagattttcgttcactatcccctccctttttagaaataataaaattgaaaggtttgtgaactacttctaatttttaattagtattttcatattatcatttaaagccctctctaaaatgaatttaattgagtaaactgatttgtatcagaaaaatgtttaaaggcacttattgttgtttttgttgttatatacctgtttatgatttaactggtagtattttgagttagtggttttttcaaatgatgcattctttttaaatttcatttttatgctctcttaaatcaaggtatataaatcaatggcagttaaattacttttgcatttttggtgagactgtttttctgaatttgctattagatcaagagtaactaatatgggtaatgctcactcatttgtgcctagggataatgttgacttgaaatatgttaagtttccatttgtccttggtaaattctgaactcgtaaaaggcagtaactcactctatttttgatatgcagttcccagcacaatttcatttataggcattttcatttttgtatgatattttgtgaaatgcaaaggttgtcaaacagacctaaacctaaaaagacctttattaggggacttctggaaattttagccctgataacttagatttcttctgaaagcagcccccccatgcttattttacctccctgttaaaatttctaaattctaaaatttcattagaaattagatacattctctttaaattctgttagcgtcaaaacttagatatttgcagccccataaattattgacatttgtgaaacttagagtttaacatacacagagctaaccaaataagaacactgtggcacaagatctccaaattctgtaaggttcttggttgatacaatacagaa

SEQ ID NO: 49637 - DNA, 2197 bp, Homo sapiens
ctggtgatgttccaagtattcatatttaaatggaataactttaataaaatgggaaatactggaaatcaggacatgtttcttactgttgcctgattatttaattttatactttttaaatgattttttcttattgtttataattttctaagctagtaagatgaattattaacgcaatttaatgctgtttacgaaatgatttaaaatttaaatgagctaccacgtgataggccattttactgtttatctcaagctgttcctctagctgtgcctcacttagttaatcttacacctctctttaaaaaacagtatctagggtaaatatactctaacctcttcccaggcaagtagaaaaaaggcagtctggagtcaaacagtgagttcagtttccagctaggaccttgtggcaaccttatataacatctgtaaaccatagttcctccttatttaaaatgaggataatcgcactcaccttatacagttgttctgaggattaaatgagatgatacttgtattagcaggttgcttgttggatagtcagtgcttaataaatatagctaatctatagctaagtgactttgtttagaaagtcagtggaatctaacagatgaactggtaagaagaacaagcaaaatttaataagagatatcttggatcttggtctaagtaatctgctgctaccctgtgagggacttaccaattcttggtctaggatccttgagagcatttggttcaggataaacaaacatatttggatttatttatttagttttttagatctgatctattttgacttgtaagttcctgctagaggctaagtgaactagcactgttccttcagtctatcctcttagaatccacccaaccaggttgatctgaaaccaagtccccactagcattattctacccttctttccttccctatggtctactttcaagaaccagactaatcttcagcagtgttctaaaataaatggaatttcccatattttaaatctttggtttgtgaaaagatttttgtgaattagtaattttattgtttagatatatagaattccagtacagttaattttacaggattaatattttaattttttccttgctaaaaaaccacatttctagtctgattaaatgctaaatttgaacccccacctcctccccatttctgaaatgcccagtggagtaacaactgaattaaaaatacttgttttatacatactcccttcgtgtaccagacttccaggattgtggctgtgtccttttggggtaatttagtggtttgggtgagagtttgagcggtgagaaggatttaaaagggttgaaagtaaagtatcccaaaaacgctgttgaaagctcagctttcccttttcaccttgttctttgatgtgttagtgtccattggtctccatcctaacttggtaactaacttccataatgaattgattaaaaataatgaacactatgtgacaaataacactctttcaggtactactttatagaaagtgatcaaaaggttttgtactggatgatttcttgtagataatttattataaccagatccacaagccctcttaatttgtttttgtaccacctcagggagcagaacttagcagaattcctcatgaagggattttacacttgtacaatatttacagggcaggtaggagttggtgtttaccatgccgctcaagaaaaacattaaagctttattcctacagatttactattatcaaaccaaatattagtctaagatgagtacagagtttttccccctaaatcaggtgttgaaagatgccttccaattttggatacagtaattattataagttaaagaagttcagacactttcatgttcatgatgtatattttataatagaatattttattaactcacttaacatattagtatccttttacgtttttgtgcctttttattttaattttttgaaacaattatagactcacaagcaatagagcaaaggagtacatacagtccatgtaccctttacttaccttcctgtgatggtggcatcttacataactgtagtataatacaaaaaccaggaaattgacattcacacattactgttaactagactacagacctaattcagttttcaccatttttaacatatattcgtgtgtgtgtatgtgaatgtatatattctatgcagttttatcccacatatagatttgtgta

SEQ ID NO: 49638 - DNA, 1153 bp, Homo sapiens
accaataacgtttgagaaatccagtttctccacatcctcaccagcctatggtgctatcactgttttttgtgttaactgttttaattggaatgtagtgatatctcattatggcttttatgttttacttgaaaataaagtatattattttaaggtcttcatgtagattttactaacatcgttttcacccaactctaacccaattcctggttgttggtgattttaattgcagttaaattgtcaatgattttaaaaaatgatttatttggccaagattacttaatatttaagaaatatttatagcatttgatttattaaatacagtactctaaattaataaaataactttaccttttttggataattgtttgtattatagtggctggaatggctggtactgcacatatcgatggagaccatattgttgtttcagttcctgaagctgttttagtttctgatgttgtcacagatgatgggataactcttgatcatggccttgcagctgaagttgtccatggacctgatatcatcacagagactgatgtagtaacagaaggtgtgattgttcctgaagcggtacttgaagctgatgttgccattgaagaggatttagaggaagatgatggtgatcacatcttgacttctgaactaattacagaaaccgttagggtaccagagcaggttttcgtggctgaccttgttactggtcctaatggacacttagaacatgtggtccaagattgtgtttcaggagtcgactctcccacaatggtatcagaggaggttcttgtaactaattcagatacagaaactgtgattcaagcagctggaggtgttcctggttctacagttactataaaaaccgaagatgatgatgatgatgatgtcaagagcacttctgaagactacttaatgatatcttgtaagtgaaacataaagcccataattactcaggagattgatttatataatctggaaaagttttctgggatgagggatatattcaataaaagttataggggaatctttttgaaaaataattttttgaagcagtgtcattaagatgctgttttgagtttactgatgtttttaatttattcaatgaaaattcatacctgaaatgaagtaaaataatgcagtttattagtatcttaaa

SEQ ID NO: 49639 - DNA, 1940 bp, Homo sapiens
actgaaattgtcaattaagtttttcttaggaacttaagcagaatatgttaagaaatgtattgatttttaaattaaatacttgaaaagtaaatcataaactcagataatgtcctacagttctccctgtgtttatattgcttatgcctaaatatgtgtgtgtatattttatgcaaagctatttaacatgtttattttagactgctttgcaagattcttaaaacattctatccgaagcgggaagatagaaatattttgttctcattttaaatgatgggtttatgagagcagcaacaaaaataaaaaatatcttgataagttattgatggagcttaaagaagtaggtatattagttattaaatttgaagggatcatgctacaagtagttaagattagacaattttttttgacttatccagggaagatttttattctttttaaaatacaaaaatggttgactgggaagtttatcaccaggtagagtgtgtgtgtgtatgtgtgtataaagtgatcgtatgtatatgtgtattagtgaatttaaaactgaaaataaactaaatttatttaatttgtgaatttaattgtaaagtttagcataacttttttcttctataagcacttttgaaggtgaatttttacattgtttttaagaaaataatgtaagccactaaaagactgcaaatattgttacctatttttaaatagatatagattactaaagcaactccatatttacatcttaacgtggcattttttaaaagatctatagtatggttatcatgtaaaatgatgtggcaaaagttggtagtctacactaaaattcagtatgtcttcaaaagagtattcattaatttaaactgatattaaagtagtgcaaaatttagatgtcatgtattgtgaacagtcataccttgtgttatcttctatgatttaattctgcaaaagttttttaaaaaagtttctggaatattctaagttagaataattattttgataactacctcatatatcaaatacaaggactcctttgaggaatataattttattttttgttgatttgtttggtttcaacttttattttaggatttgtacgggtatgaatgatcccatctcctaggtactgagcatagtacccaacagttagttttttggtcctcgccccactccctccctcccacctctagtaatccccaatgtctgttgttgccatctttatgtccatgaggaccccatgtttagacttctcttataagtgagaacatgcagtatttggttttctgttcttgcattaatttgcttagaataatgacccacagcagcatccatattactacaaaggacgtgatttcttcttttcttacggctgtgtagtattctgtggtgtatatgtaccacatttcctttatccagtccactgttgatgggcacctaggttgattccctgtctttgctattgtaaataatgctgtgatgaacacacaactgtgtgtgtcttcatggtagaatgattgttttccattggatgtatacccagagtgggactgctgagttgaatggtagttctgttttaaattctctgataaatttccaaactgctttccacagtggctgaactaatttacatcccaccaacagtgtttaagtgtccccttttctccacagcctcaccaacatctgttgtttttttgacattttagtaatggccattctggccataataaaaaaatagtagatgttggcatggatgcagtgaaaagggaacacttttacactgttggtgggaatgtaaactagtacaaccactatggaaaacagtgtggagatcccttaaggaactaaaactagatctactgtttgatccagcaatcccactactaggtatctacccagaggaaaataagtcattatacaaaaaagatactttcacatgcatgttcatagca

SEQ ID NO: 49640 - DNA, 1936 bp, Homo sapiens
gatgcaaagcataagaatgatacattagactttggggactcgggagaaagggttgtgggtggtgaaggatacaagagtaaacattgggtacagtgtacgctgctcaggttatgggtgcactaaaatctcataaatcaccgctaaagaacttattcatgtaaccaaacactacctattccccaaaaagctattgaaataaaaacattttaaaaaatagcttgtcagtatgaacaagcaaaataataataataataataataatgataatggtcattctcactggtgtgaggtgatgtctctgtggttttgatttgcatttctctgatgattagtgatgtggaacatttttttcctatgtttgttgaccacttgtatgttttcttttgagaagtgtctgttcatgccttttccccgtttttattggagttacttgttttctgcttgctgatttaagttctttgtagattctggatattatacctttgtccgatgcatagtttgtgaatatttttctcccattctgtaggttgtctgtttactccgttgatagtttcttttgctgtgcagaagctctttagtttaattagttctgacttgtcaatttttgcttttgttgcaattggttttggggacttagtcataaattctttcccgaggccaatgtccagaatagtgtttactaggttttcttctaggattcttatgtctagaggttttatctttaaactttggtccatcttggctaaattttgtatggtgaaacataggggtccagtttcattcttctggatatggcttcccagctatcccagcaccatttattgaatagggagtcctttcccattgcttacttctgttgattttgccaaagattagatggttgtagttatgtggctttgtttatgggttctcttttctgttcctttggtctatgtgtttgtttttgtactagtaacatgctgtttatgttactgtagccttgtagtgtagtttcaagttggataattgatgtctctggctttgttctttttgcttagggttattttggctatttctttcttggttccttatgaattttagtgtagttttttccaattctgtgaaaatgacgttagtagtttgataggaatagcattgaatctgtagattgctttgggcagtatgtccattttaatgatattgattcttccaatccttgagcatggaatgtttttccatttgtttgtgtcatctgtgatttcatttattagtgttttatagtactcctcgtagaggtttttcacctccttggttaaatatattcctgggtatttttttgaggctgttgtacatgtaattgcattcttgatttggctctcagcttggatgttgttggtgtgtagaaatgctactgatttttgtacattgattttgtatcctgaagccttaataaaattgtttatcagttctaatagcctttggcagagtccttagggttttctaagtatagaatcatatcatcagcaaagagagatagtttgacttattttactgtttggatgtcttttatttctttctcttgcctgattgctctggttaggatttccagtactatgctgaataggagtgatgagagtaggcatccttgtcttattccagttctcaagaagaatgcttccagtttttgctcattcagttcgatattggctttgggtttgtcataaatggctgttattattttgagatatgttcctttgatgcctagtttcttgagggtttttatcatgaagggctaatacattctgattttatcaaaagcttttcccatatctactgcaatgatcacatggtttttgcttgtaattctgtttatgtggtgaatcacatttattgatatgcatatgttgaaccaccctttcatccttggaatgaaacctagttgatcatggtgttttaa

SEQ ID NO: 49641 - DNA, 2670 bp, Homo sapiens
gcttgaatttaaggtattttgagtattatctgcatttagaagggcctttggagatttatttctaaagtcagttgattgcctattaagtctttgttaatttcgtactttccataacgaaggatatagaataaatcttggtcaagttgatggtttacctcttaaaactgcgtgccaatatctttaataattttatcattttctgtgaacttaaaatacagaataagttcagttagtacatttcaaaattgctcattctgaggaatctaagtaaaaattaatggatgcattaaatttaaaagtatgaaccttaagaaaaggtagaaatggaatcagagagaatagtattagtaatttcatacttattgctaaaattatggtacaaaactattaagaagtggtgaaaaaaatgtgactttcatttcatgaactttaattttgtgaattatagttttaactcagcttatcccagaaggaactgtgatcgctttaaactattcatgtataataaagtagaatttataaaatgagagtatttttattattttattaatttaccataagttatttcagcctaaaagtttgtattttggacactttttgaagtttttttatattctgtttttaattaatgagaatatagtttttttctaaaaacttactcatgattttttctatgtcatttttattcaacattattttataagagaagctattaagccagtaatatcaaatacttaatctttttttattttaatttgtaccattgtcaaaaatgttgccaaaagtttagtaatataattaggagctctgatggaatgaaaatatgtagactttattttgatcatttggatgctatctttcatagacagtaagctattaaaatttggaagtaggatagaatcatttgtatttaatcacaaagttaaagtagctctgcaatgtaaaaataatttttaatatgtgttgttttccactattttgaaaggcctaaggaatatttttcaagttgtatgtatcaagtttgaaactaaagtaaggaaaatctagactttgacccatttagatcttgctaaaattgtttttaggagtgctgaattaatagctttttaatgtcactttattctgtttttaatggttctagaattgttagatgtatgtaggggcttcaaaatttgatgtttcatatttagtactgttacatatatataataaggaggagtagattttcaatttagattacatttgtgtttttataggaacagcattaaaagaataaattataggcatataatatttaggaggcatatattgtttgaatattatttatggtcagaggacagagtttattaatctattcattgcatagttcatgcatagtattcatgtgaacttaaatgttatcctaaaagactatacagtggagaatcaaaaattttaagtgtatttaaaatgtaagcaataggtccaaatactgttgccttatctttatatatgattttcttttaataaggaaaaagagggggaaatacccatttatttcccttacatataattttgaaataaagcatacattgcaaaatctagatatatacaaaattcatggcttgaagttgtcttccattgaccctgcagaaattagagtatttactaagattttatttccatgatgtatgaaaacctgtttttatagtcacttaggtgttctctgtgtttctttttttaatcctagatcttgtatgctaatttgttttagaaacaaccactatttaatttgggaactgtagtttatgtgaactcattttatgagtaatatatgttttatgttcttaatttttctgttattaaatttagtgttaggatttaccttaaaatattgaaagtgatagaatttgaagccgttttaattaaagctatatggttaagtattttgtatctattaattgaaatctgtaaatagatttttatataattgcgattatgtaatataactgatcttgtgtactgtttttccatgaaccttgatgcttttttaaattttaaaaataattttattgttgcagatttatgttgcacaggtacaggtttattacatggatgtaatattgtgtagtggtggggtttgggcttctagtgtacctatcacctgaatagtgaacattgtatccaatagataaattttcaaacctcataatctcctctccccccacctttttgaagtccctaatgtctattattcatgaatcataacacttttaatggcttcataataggttattaagtgaatacagtgggtaggtggttaacattatttcacgttacacttcagcttaacacccactaaatagtggtaatttttcttgttttgttgttttttgtcaatggtattttttgactgaaataattttgtttatattttatagtggatgatgttggagaaaaattagagcatatggggaatacaccattaaaaattggcagtgatggttcacaagaagatgctaaagaagatgggtttggttctgaagttataaaagtgtatatatttaaagcggaggctgaagatgatgttgaaataggtacaaacactaattttaatttattgctccaataggagttataatttattatattttctggggactagtctaaaaatgttctcaaagcatgggt

SEQ ID NO: 49642 - DNA, 9114 bp, Homo sapiens
agaaactataatgagtgtttacaagcatggattctagaggcaggctgcttgggttttaaataggtcctgtcacttagctgagtgacctttgataaattacttaacccccttctgtctgtttcctcatccataaaattctcataataataaaagctacctatagggctgttgtgagggttaaaggggtaaatatgtataaaagacttatatactgcttggcatataagcttgatgtaaggattaacaattgtcatttctcagtgatagctgaaaatttaaagtataatttatatgaaaatgttcttggcactttgaaatttattttggaatttattttttttctaagaaatatttctatatattcttcttattaatttaggtggttattccatgatacttctctattttaatgcgtgttttaatttttaaggtggaacagaaattgtcacagagagtgagtacaccagtggacattcagtagctggagtgcttgaccagagccgaatgcagcgggagaagatggtttacatggcagttaaagattcttctcaagaagaagatgatatcagtaagaaaataagggcactgtagtgacttatcagtagccatcatgcattatttttaaaaaatctcagagatacaagcactgtataggaacaaagttcaataaaataagcctgatcctttgaccctttgctgtaaataatttaaaagtgaagggtccttttgaccattcatttgtacatgtattgttcaaatcaccaaacattaaataatatatcttagtatactatactagaaatacagagatgaacaacatacagctcctgacatcagtgaagctcaaaaatatgtaattactgagtacctactttctgtgcgttactgaatatgttgcaagatactatctcatttaattcttacaactcatatctgaggtaggtggtatttttcctgtcttatggaaggaaaaaaaaagattcagggaaaataatttatccaagatcattccaatattaagtgtgaagggcaggattttaatggttatctaactccactgccaatgttctttccacatggcagtgggcactgttggcttctctctggatttagcaattgaagggctgatggtttgttctcctgtcactaaagggttatcttatgtaagtattcttccaagccaagctgccaggagtttgatttcctatgctgttgatggtctccaagcagttgctgcttaaggttttgtggggctaagtaccacaggacgatcaaacctcctcaggtttcctttcctgccataccgcaggtttccttatgaagacattttgctctctgcctactttctcctcacctcagtataggaatgcagccctttcctaaggctattcctgtcttcttactatgctgagaaaaacacaatattgccttgccctagaaggctaagagcctccatttcactgcattaacttgacaatattgggctttacctgtgctgcactctgatacctactccaagtttccttccctagaagttgtagggtgctgaattccacccccaaacagctgaaaatatcaaaacaaatgagtggagaagattctgatggataggaaaagagtttaatcaaataatttctatttgatctctaaattctttatttttttatttattggtaaggaaaggggcacagtaggaaatggaagattgaggtttaagttaacttatgccagaattctatgggaatgtgggaaacttagaccagtgtctctttttggttaatagagagaagacaaacttgggagaagagggatacttttttcccatgtttttccccacatttcttctgtagtcatccaggatcccagtatgtgaatcaaaggaaaagcaaaaattcaagacaattttctatttaacaagttaaatgtaaacagattattttatataaagtatattgtggctctctaggtttaaatattttttttttcttaccgcaatattgttttgttcaatgaagctcatttaatgctttctctcctcagtagaatctcttaaaatctggcctattgaagagtgtccacatattcttgatcactagcattatatacatatataatttttatttttattttaaatttttttcaattacaagtatttttggtgatttttattacatgtatagtactgcatttcatttataatacagtatacgagatagtatggaccactttctagtattatttctatgagaaatattttctgagtcccaaaagactgtcaggcaaataaatgtataatgcctgatagaatgtaagatcattcagtatatttcaagcgcacatgtttttataaaatttttaaaagccatttccatagaacttggttctaagaggagaataagagttttggtaaatgattgtctcctagtggcactagcctccaaaagtgcctaatataaattgaaattaaatttataaatttttaaattaaccaaactgaaatttgaaagttgaaagatttacattgtttggaatttttacccacttattaaatatttggggttataaacaagcaattatttctaaaatttaggttgcgctgaaatagcagatgaagtttacatggaagtcattgtaggggaagaggaaggaacttctctccctgagattcagcttgaggactctgatgttaataaaacagttgtccctgttgtctgggctgcggcatatggtaggatactggcattttttcacctgataagtacataatatgtatttactcagcctttaggccattaaataagctttgtgaatgccaccatgaattggctaatataataaaatgttttacactgtggactgattcatctctagttactttagatgatttttctaccacataccttgtactatttaaaatgaaccttgcttaatgcattatgtttttcagtatgatctattttaaatcctacctgtataagtgagtgccataaaaaattttatttttctaaaataggaatatcctttgaaaatcgatccttcctcttttggaaaaacttatttcatttattaactctacagatgataaagttttggggttttgaaaaagaaacagaaacccaggtatgctcttttagaaagcatataatgaaaggtaaatttatcaacttatttttccctttcagtcttattttatttcattcctatgtaacgtacaagatggtccaggtatactctttactttgaaaaattttgatgttcaaatgcattaatttatctaaacttggttcttccaaaggttcattcattcagttatttattgagcatcttcaaagttaggggtacactgcagaaatatctacccagttttcatttaaaaagtaaaattgttctagatgttaacaattccaaggatgctgaacagcagcccttattttcagtatgtgacattatctaacctataggagtggaagaacacaacaattttttttaacccaaggaatggtgggcaaagtaagattttgtagattaagatgtgatccactagtagtcattataattagcatatcagtttgtaattggtctttttttttttttttttttttttaggagatgaaagaagagtttcccgaaggtatgaagattgtcaagcatcaggtaagagagcattgtatatgagatgtgagttaaagttctggctttattttattttactgcttggtaagtaacaagtttgtgtctacagacacatttgttggactcttacttgcttagtcatacctaatctagttagttaggagtttcttctttgaggaattaatttatgtgtggacataatgtgtgttaatctgtaaatgcagttccatttagatttccctcaaactttaagcatcaggcagtttatcaaatggaccataacaggttgctatggaaaaaatgaaataagaaattatttggacagaaaagtaaaaattattcatgatatcaaccccttgttaatgttctttttggggcagaactgttttcttaatttctatggcaaccagtgcatttatatataactgttatataaaacccatgtgtcagcttaattttttttagttttaatacactctatatggtgttgttctctagttgatcttcttgttaagttttcttaagcaaggagatattttcttatgataatgtgtcattgttctgtttctacccttgggaagtatttgactctctaaacttaggtgttgatttcgagaaattgatgagaagtatagatcacagcatgtaagttaacctgacagttttgtaggtctacattttttagctaaattgcataaaaccacaatggatttttgataactaggattttattaagtactttttaatgtatgcactgatcacactgaaattgcaataaattgcctaccatatgttaacccgtaaaatcaatcttaatatgtagtactctttatatcaagtacactattctgaagcatatctgcaagagatctgtttcgttttttatgcattacacttagtcaccataactataatggttcagtaatatgtctacatttctttttcaattaatttcatcagccttcattggtaaaaaaaaattggtctgatgccaagattttgtttcaaattcagtttcttttctttcttttttttctttttctttctttctttcttttttctttttttttttcaagagacagggtcttcttgctctgttaccgagactggtgtgcagtagcacaatcatagctcactgcaaccttgaactcctgggctcaagcaatcctcccatctcaggctcctgagtagctgggactacaggtgcatgccaccatgcctgaccaatttgttttttgtagagacaggatcttattatgttgcctagggtggactgaaactcctgacctcaagcagtcctgcctcagcctcccaaagtgctgggattacaggtgtgggccatcatgcccaccccaaatccactttcttatattacattcatcttatcagtttattcctgataaaatagagatattttaaatttaattgatgatcaaattgagatattttaaagttaatttcacatgatatcctattcaaagtatttacaaatacatgtctttacttgtgagtgagagagaacaagagtgagagagagaaagagaatcataagatggatatactttgtgaaatttactaccagagtggtaacttggtgtcatgtcatctgtagtaactcattcaacagaaccaaaaaagtataaatgtatgtgatttaatgatgtttcaatttttttttccaggaaatactttggactcagcattagaaagcagaagtagtacagcagcacagtaccttcaaatttgtgacggcattaatacaaataaagtacttaaacaaaaagccaaaaagaggagaaggggagaaaccaggcagtggcaaacaggtaaatactttgctttatgaatattataattatttgagatgtggaagtattttttgtcaccaaagaaaaatatcgatggtttacttggcagttctactctccatgtacctgtttgtgtatgctatagataattgtttttttttttttttactttgtgtgactggtacttaataaaactatgcttgtttgctctttattccaaagatacttttacagagaattttcaggttggtttaacaataaagggtacctgtttttggtattcaaagtatatatgatattgcattttggcatgtgagtggttcatagtagagtgctgctcattactttttagtgagctactttgccataaattgcttttattatgtattttttatattacaggatttcattcaactagtattgttttcacatagtgaatgccaactagttttggcacctttgttataaaatcctttaaaacagtctgaccaaatgtcacaactttctcttttctttatctagctgttataataggtcctgatggacagcccctcacagtgtacccttgccatatttgcacaaaaaagtttaaatccaggggattcttaaaaagacacatgaagaatcatcctgatcatttaatgagaaaaaaatatcagtgtacagattgtgactttacaactaacaagaaagtgagtttccataaccacttagaaagccataagctcataaacaaagtcgacaaaacccatgaatttacagaatacacacgaagatacagagaggctagtccactgagttccaataaacttattttaagagacaaggagccgaagatgcacaagtgcaaatactgtgactatgaaactgcagaacaaggactgttaaacaggcatttgttggccgttcacagcaagaattttcctcatgtttgtgttgagtgtgggaagggttttcgacatccttctgaactcaagaaacatatgagaacccatactggtgagaagccatatcagtgtcagtattgtattttcaggtgtgcagatcaatcaaatctgaaaactcacattaagtctaaacatggtaacaatttgccatataaatgtgagcattgtccccaagcatttggtgatgagagggagcttcaacgccatctggatttgtttcaaggacataagacacaccagtgtcctcattgtgaccataagagcaccaattcaagtgaccttaagcggcacatcatatctgtccatactaaggattttcctcacaaatgtgaggtctgtgataaaggttttcatcgtccttctgagctcaaaaagcatagtgatatccataagggtaggaagattcatcagtgcaggcactgtgactttaaaacatccgatccatttattcttagtggccatatcctttcagttcatactaaagatcagccattgaaatgtaaaaggtgcaagagaggattcagacaacaaaatgagctaaaaaaacatatgaagacccatactggaaggaagatttaccaatgtgagtattgtgaatacagcactacagatgcatctggctttaaacgacatgtgatatcaatacatacaaaagactatccacacaggtgtgaattctgcaagaagggattccgaagaccatcagaaaaaaatcagcatattatgaggcaccacaaagaggctcttatgtaataagatcaatataaagaaagaagctatttaggagatatgatatgctacttgggagaaaactctcactaactgtctcaccgggtttcaaagcttgatactaaaccatgactttacattctttgtattaaagatcttaaaatatttgaattcacaggggatcccatagccctttgaaaattacttaaagaatttaagaagcactatagaatggttacagaaaaacttcttaagtatctgtgtaatagtattatatgcatacttaaactacagaggggaaaagcaaagacaaatactttatttggctgattatgttagatacaaatgtttctgagaagagaatacataattgagtttagtgatgctttgctatagcaagcaaacccacttttatgcaattttagaaatggggcagggaaacaaaatgtggtcattcatcagtcacttagtcattgagccttttatattgtacctggaaattaaattccagcaatgacaaaagttttgtgtattcattaaaagaaaactaactggaaaacaggttagattaattcagtactattaaaaaagaattcagagctgttaatattttatcacaggataggatacttaaaatatagcattctgtgctgagatctaaggtgaagtctataaagattaaagttcccttttttctgatgttcaagttgattgttgttcagtatggcatatatgacaaaagtatatttgagtcaaatgtggctttctaaaatggatgcaacattagcgttgcaaacaaaatcagcactatatttcttaatgatctaaagattaatttgagagaacacagttttcttaaatattataatgtctagagtttttttaggacagtcttagcaagtatgattgttctagtcttacttgctctaatgtttaaaggtgcaattttatgccattattgaaattgatttttaaaatctatataccatatgattaacatgcattttcaatatgaggcagtgtttatgcagtatttaacagagcaatctgctgccaatagagtttggaggtggatatttagtttacagtgtataaacttaaaatatgcatccctttaacaacgctttgtgttagcatgctgcaaatcaaaatggcacttaatattaaaagctggtttagggaaattttatgaaaatcctgttcataaatgtaatgcatatgatatgtacttttaagttttagttgcttcatgtttacattcagctgttcaacataattaaaatgtaattttacttcatgctatattgtggctttgtgtttcaaataatgttcacctttctgtttttgcaccagataagaatcagttccttgagaataaattttttatctttcttaacttcagaatattaaatttggaatatctactaaaattgtgtgttatgtggctgtaaatgatgtacacgctgtaaaataagatcgctactgttatgtgggattattatttctaaatgttactcattgaaatgagcatacaataaaaagcatttattgcacttaatggttttataagtttatttaaagtttccatattttttattaaaagacttcacttcagagttacttaggcagattggtcctttctttaatgtcttgttgaattttgttcatgaacaacaacatgaactaggaatttaaacagttacgatgactatgtaatgcatatttcttaagaatgtatgttatttgctaaaatcataatgaaatactataaataaaagtgtccattttaagatcttagatttcatattagagagaaaactaaaagttcttaacttgcttaaatgacacaatcctgagcagtgaatacatctaattatgttcccaatatacattcaaaaggaaaagtattgttgtgtgtatttggcaaagatttctgcaaatgagcataaaaataactttctatgttcaaaccagtgagcatttcatataattctata

SEQ ID NO: 49643 - DNA, 1027 bp, Homo sapiens
tgtgtctatgccagattttggtatcaggataatgctggcttcatagaatgagttaaggaggactccttcctcctctatttttggaatagctatggtaggattgatagcaattcttccttgtatgtctggtagtatttacctgtgaatccttctggtcctgggctttttttgttgttgtcttgtaggagttttttaattactaattcaattttagaattcattatttgtcagttcaagttttcactttcttcctggttcaatcttggaagggtatgtgtttttatgaatttatccatttcctctagatcttccaatttgtgttatagaggttttcataatagtctgaggaccttttgtatttctgtgggattggttgtaaagccatcttttttatttctgattatgcttagttgaaacttatctttttctttgttaatctagctagtgttcaattggtcttttttattctttcgaagtaccaacttttggtttcattgatctttggtatgaactttgcatctcaatttcattcagtttttttctaattttagttatttattttcatctgctatctttggatttggtttgttcttgtttttctagttccattaggtgcaatgcaatattagattgttaacttgagatctttctaacttttgttgtaggtgttgagtgatgtaaacttcctcttaacactgctttggatgcatcccaaaatattttgatatgttatttctctattttcattaatttcaaagaaattattttttatttctttcttgattttgttgttcacccaaaagtcatttgggagcaagttgtttaatttccatgtaattgtgcagttttgagatatcttcttggtactgatttctatttttattgcactgtggtctgagcatatgcttggtataattttgattttttaaaatttattgaggcttactttatggtcaagcatatgctcaatattagaatatgttctgtgtgcagtggaagtctgttttgtggttgttgggtggatgat

SEQ ID NO: 49644 - DNA, 1070 bp, Homo sapiens
ggaaaatattcattttcatcgtagtgagtttaaaaggctctttttccatctgtggattctttgatacttcaacaacttttgatgctggtgacttttaactcatcatctatatgaattttatttatttatatatcattttgagacagggtctccctctactgcccaggctagagtgcagtggcgcaatcatggctcactgcagcctcgacctccctggctcaagccatcctcccacctcagcctcctgagtagctgggactacaggcacatgccatcatgctcagctaatttttgtatttttcatagagatgtggtttcgccatgttgcccaggctggtcttgaacccctgggttcaagcgatccacccgtctcagcctcccaaagtgattacaggcctgagccatgcatctggcctgaattttagattctatggtacagtcttctctgacaacttctgcctcttgatttgctgactgctaaagtgccagctttgtttgccttccatctcaaaacttctcactgttatctgttcttctccacatacaattgcaggcaatcatatgcctcttcaaataccacctggatgcagatgcagatgcagatgatgccaaacttttctatctactttgacatctaagtttgatactttgtcatcatttgctgagaggcatctcctgactgtgttgcagttctactaaaaactgcataacacctcaaatacttcatagtggtgtttttaatatttttcctttttacaggaaaaataaaaattaacttgatgctctcaacacacatacatacacatacacagacacacatggacacacacacactgtttatcaggtttaccttttcaagctaaggtttacttgcttcacttatcaccagactgtattattctgttgttagtcactgactgacctttatgatttctggtccagttgaatgaaggttaacttccctatttgaccagtgaaagtcagtgactccttctcattcaactcatcaggtcccactgtatttttacatttagggctactattaggcacctaattgtatcttcttcctt

SEQ ID NO: 49645 - DNA, 1048 bp, Homo sapiens
ccctggtatgttgagtcaaaatattgcctggcctttttctcccccttgctactgatgttgccttgggaatttgagacccagtcacatcagagtactctttgtttatttctttctcagtgaccttcataaatgtgatagtgctgggaacaatcttctgaagcatctctcttacttgccctaccatatgatttttttgccaaaaaggttggggctgataggagcttttactctgctactggtctctcctccatttttgcttagtagtgtggagcacattttcccatgaacattattcctgtatttgatatgtattgtagtatagttcagtttcctaatatgtttagtgcttaaagatataggtcatgagatacaggtacttgttatcaaggaatttacaatattataaggaaaacagctgtatataacctcagtattcggtaagttccatatgaatgattcagatttaggaacaggaaagattaataatttggattaaaatagactaggaactgagtcactgggaacttctcttcctccctccacgtacttactccaagggaagaatgcattcagagttcaaaacagagggttttttttttttttttttttgaggtggagtcttgctctgttgcccaggctggagtgcagtggtgcgatcttggttcactacaacctccacctcccaggtacaagcaattctcctgcctcagcctcttgagtagctgggattacaggcacatgccactacgcccggctaatttttgtatttttagtcgagacagggtttcaccatgttggtcaggctggtcttgaactgacctcatgatccgcccgcctcggccttccaaagtgctgggattacaggcgtgagccactgtgcctggccaaaaccgagttttgaggctgcagtgagctatgatcgtgccactgcattccagcctgggctacatagtgagacctcaactctaaaaaataaaaattaaaagaaaaaagaagtttgtggcataggtatttcttgttttaagaaaatatatcagcaggaaatttg

SEQ ID NO: 49646 - DNA, 1823 bp, Homo sapiens
tgaagattatccctaatcttccatctaaatatgaaaatatttgcattttaagctgcataaccatggtatccttttcttcttttcttttcttttctttctgtgtttttgagacagagtctcactctgtcacccaggctggagtgcagtggcgcaatccctgctcactgcaccctctgcctcctgggttcaagtgattctcttgtgtcagcctcctgagtagctgggactacaggtgtgcgccaccacacctggctaatttttgtatttttagtagagacggggtttcaccatatcggccaggctggtctcgaactcctgacctcaagtgatccgcctgccttggcctcccaacgtgctgggattacaggtgtgagtcaccatgcctggctgcttttcttatttcatttgaactcttttctccaggtatattatatatactgtataaatattattaaattaaatattattatatatagtatataaatttggggtttaatgactgtttctaaactaagatcacatgaactcagaaatggtaaagtagtactttgagatttgtggtagtaaagaatttgactttttttcctcctaagtttactaaatatttcaatacaaaagcccatatttccttaaaagatatgatgtaaaccaactatgcaatttaaagcaaatcatttttcaagtttgctattctcattataagaagagttcaatacattttagaaaatgtgagaatgcagttaaggagaaggaatcaaaacaattgcctataaactttacataaactattgttagtaatttggtatgtttatatttaatcgtttgtcagctgtgtagttaaacttttagaattctttctaccactttttgtagctatacttccctttcagaaatgaattcctattttattataaggtacactgatacagataattttggtagatgatagcttctaatagcaaagtagtattttaataaatcctggcaccctcacttcatttaattatagtctggttactggaaattcagtatctagaagcattttatgccttgaatagttgtggcataattttatctttagtcatgtttgagtatgtcagtagtcataggccatttttatgtgttttgctggatagctttaaaaacctaatgaaaaatgtttatgatttatccctttatcggattaaaattatacacaatttgctatcaagatgtaaaacaacagaatctcagttttctcagattagtaattataatgatacatttttcttatttttgagatgggaataatttggaaaaaatctagaggtgtagagtggatatgtagtactagaaacatatcaacaagtttcaggaaatcttgtaaacctctattttcattattttgggatgggggggttctattgaattaccattgcaaatgaagcaagatcttcatttggaaaatttacttgtattaaacagatgactgggctgaaatggctgctaaaacaatttcatgcttttgtttttaatgtagtccagttataaaatgtcacatcagattgtgtgtgagtacacaaatgcataattttaattttatttctgagttatcacattttaggaagttgattaaaatcacccagaattttttctaagctttttatatataacaaattaactatttgaaatgagttaaaacaagattgatattttggcagtaatacctttattaaagaaattgatcaattcttcagtagttacccattttgtccttttttaaattttattattattatactttaagttttagggtacatgtgcacagtgtgcaggtttgttac

SEQ ID NO: 49647 - DNA, 1031 bp, Homo sapiens
tttttgaaacaccattattatatacacattgaagattatgtcttctttattaaatgatcattacataatcatagattgtacttctttatctttggtcatattcgttgtcctgactctgttgtgtaattatttacctactctagcttttttattattatgatttgtgtgatatatcattttgtatccttttacatttaacccatttttatctttatattaaagtgagtcaggtagacagcatatatttgggtaattttttaatgctttgtgaaaatgtctgccttttaattgatatggttaatgcatttacatttcatgcagtgggccctttgtgtctgcagttttcacatctggagacacaaccaacggagaaatagtggatgcagaacctgtggatatggagggctgaccatgagggacttgagcatgtgtggattttggtatccaagaggggtcctggaacaaagcccccatggatacctagggataactgtataattattaatatgactgtatttatttctaatttcctttttttgttttttatttttttatttttagttttgttttgttttgttttgttttgagacggagtctcactgtatcactcaggctggagtgcagtggcgtgatctcagctcactgtatcctctgtctcccgggttcaagtgattcccctgcctcagcctcccgagtagctgggattacaggtgcatgccactgcacctggctaatttttgtatttttagtagagacggggttgcaccatgttggctggaatggtctcaaactcctgacctcaggtgatccacctgcctgggcctcccaaagtgctgggattacaggcgtgagccaccacgctggcctcttatttgttttctatcctatctgtcctttgttcctttaactctttttttgccacatttggattgtgtgtcattttaactattccacttgatctcatgtattggcatattagatatggctctttgtttagttttcagtggttactatagaatttatattatgca

SEQ ID NO: 49648 - DNA, 1029 bp, Homo sapiens
gtatatatttaatacaaggaatagagacattctagccaaaatagtggtgaagtaaaattcacgtgtaaaatatccctttccttgcatgcttcaaagtaaagtggtgtcactggaaagatatacactggtgttttagatattagtttttaaaaatcatttaattattaggtaagggtgttttattttgtgaaatatggataaaaatctgaaatataagtcatattaggtaatgaccagttcccaaaggaaccttataaagagcttcatggatgaatgagtttacatctaataagatataaactcgctgataagtggctttctctctctctttctctgtctctctgtctgcctccttccctccctcccttcctccctccctctctctctctctctctctctctctctctgtgtgtgtgtgtgtgtgtgtgtgtgtgtgtgtagtactagtagtagtagagagcatagtcaaggaaataactacaagatgagatagtgaaaccttttgtttgatcaaaaaaagcaactctttgagcaattcagctccactggggcaggaactatgttttctttattcctccctctgtgcctagaattggtagatatttaaaagttttgattgtatcattgtaagtaaaagggggacttggattttggttataaaaacgtttatgccactttcaggaacagatatattgtatcataatgcgataattcttaattgaaatggcggcctttttgaactcttgtgggcacatcagaactattttactatatttagattgttcatgtgtggcttttggaacttatttcccatcgtgtaaatacagtgtattcatctgttgatcccctacttattaggcaccatgccgctactcttatagatgtcatcttatttaccagatatcttcagtatgtgtctgaaagcagatattttaatctcagtttttcaaattgggagatcgtgactcagaatttaagaatgctgcccagtaagttgcttggcagtaagctcttgggcttacatttgaa

SEQ ID NO: 49649 - DNA, 1030 bp, Homo sapiens
tgtgattcagacctcttgttcccaatataagcttcctggcttcctttttagtctccagatataatcttggctgctggttcactcaaacattaatcttcctgactggtctattgtttttgtttgggtggttcatttgttccacttggtctcctgacatgtgaccacaaatgtcaacttggatgtgtagcatgttaagacagttctttaacttaggtaacttataacacaaaatcaccaatatgttaataccttaaaaagtgagatcgtggacttacatagcccatccaaaaagaaatagtataagctacattttggccctattctttctgataaactaccttacctaaatgttgactgaaaattttagctgaagtctccagttatctgtccttaacagtattttgtagatttcttatgatgctcaggactttacttatcctatctaaataaatgaactaagctgttaaataatgaaacgtatgtttgtctgtctaggcatagatatgtagatataaaccgttctgtaacaccactaattcttcttaagcaaggtattagagctattagctagatgttatagaaaattgtgtaccggtcctcttttagtaatttctaaggatgtggttgaaataagcatgtgcttaagagtcagatatggatttgaggcctagaactgctacttacttgttgagtgatgtttgggaagtcacttaactactttgcttctcagtttctttacctagaaacaattttcagaatggctaaacttaaaaagactgacaaggatttggggcaattagaactgtgatattttgctgaaggagtgccaaatagccactttggaaagcagtttttaaaccgttaaacatctacttaccataagacccagctgttccactcctagatatttttttaacagaaatgaaagcatgcttacacagataacttacatgtcaatgtttgtatcagctctattcataatcatcaaaacctggggacaactgaaatactcatcaaataattaatagat

SEQ ID NO: 49650 - DNA, 1073 bp, Homo sapiens
aggttagcgttaatttgatagccctgtgtagacacaacttactaaatgcctcctttagaaaatgacaaaactcactatctttacctagatggtttcaggaaatgatccattttatgaatagctctgttcttgagggatgagaatgcatatttattggctgaacttatggtatgaagtcctgcactaaacattttaatttgcatatattatttgatttaattctcacaacaacctagatatgaaggtattgctatagtatctttgttttgcttatgggacgaataagttgaatgagattaaataactggtctaacgtgacacagtttttaagtgtcacagtcggaatttgattccaggtttttggtctctgctaatctctcttttagacaatgcataccatttaatgtaccatggaaaattctctgaatttttttttagttctcatattgttgttcaacaaagagaaggtagtttccacatttaattttatcaagctacttagcatcgaatgtttaactcttcaaatttcttgcttgatgtgaaacaaacacaattaattttttatgtattatgaagtattttttgtattatgtattttatgtattatgaagtatttgtatttttgtttgccagagtttgaaacggcatcagatagatgaattggcttgtctaaagagaatctgtaatgttacaaaattgtaatacctctccaaatgttgaaggatctttgttaatcatgacttctactccaactatattgaaaattttggatcaacttttatggtgtacttttatgtcaaatgtattatttatttatttatttatttatttatttatttattaagatggagtctcactctgttgctcaggctggagtgcgatggacgtgatctcagcttgcggcaacctctgcctcccaaagcaattctccctgcctcagcctcccaagtagctgggattacaggcatgcaccaccaagcctggctaatttttttatttttagtagagatggggttttgccatgttggccaggctagttttgaacttctgacctcaggtcatccgcccacttt

SEQ ID NO: 49651 - DNA, 1027 bp, Homo sapiens
gttgattcatcatgtaagagaaaataatgtaagagaacactaaagtctcagaatttttcatgaaattgaaataagattggtcccatagtcttaaatagtctttcctgtcatgcttgtattacttatcaatttggattcctaggaaatgttatagtttttgctataattagatattttctattaatatcaaaatccagtaccttataagtattgtttactgatttgataatagagtgctttgtttatgattagatcctttatttatttgcttgtgaatttcacagatgattttgttactatacaggtagcttctcaatctcataatagatcgttatggttcattaatttttggtattttatttcaacatgattatttcactaattattgtagaagtgatagtttagttgaggatattactttttgtctgaatgagtccttgcagttgaaaaatggaaataatccatactctcatgcccttggaattagcacctttatcattcatttgtctgatttgtcacattatgccttagaatatgagaatataaattttggaagatagagaggtgtgaaaattagtttcttttttttagattatgtacactggagattgttgtgctgtatttgttgttctttgtaaattgaagttcatatgcacacacaaatctggggtgattagactattctgaagaattttgacatttaaaaaaagttactactattaggcctacctttcttttttctcatttgatatcgcagacctcacatttaaagaatttttcaatgattcaagtgattgccatttattataatcactgtttaacgttaaaaaattgcttgtagcaaagtgttcatgcttatagcaaattattcatatagtaaaataaggtagtttaacaaatgtaaatctcccttcaatctcagacttacagcattttgcccagataaaatcattaattctaatttttcacattttctcctagaaatagtctatgcctctcaacacatatgtgcatttatcattttttg

SEQ ID NO: 49652 - DNA, 1049 bp, Homo sapiens
tttatcttgtttatgcattcaaagaatcaacttttggtttagttaattctttgtgtggatttttgggtatcaatgtcattccgttcttctctggttttattcatttcctatgctagcttttgcattgatttgctcttgtttttctgcttcctctaggtgtgaagctagatctttaatttgagatttttctaactttttcaggtaggcctatagtgctattaacttcccttttaatactgcttttgctgcatcctcaagattttggtatgttgtgtctcttttcatttattccaaaaaaatttttattttctgtaaaggcataaaatttctttttctgtaaacttccccctccatttctttgcatattttctattgagcatttacgcttttgattatggacttatttgaattgaatgctacaagaatcatagattttataaaattttagagttagtctggatcttagaagttattaaacacagactctttgttttaccaatgaagaaactgaagtaagagacaatgaggtaagtgtaaaacccattaaagatagcgtggtatagtaggaaaagccagaggaaataaattcacacatacttgcattccagctgtgatacttgtaacctcggagactgaattttctcatacataaaatgaataggctaatgtttacctggtagtattgtgagaattaaacaaggttatatatttaaagcactcagcacattggtatccctttcatttaacttgatgctctgtgtgtgtgtgtatgtgtgtgtgtgtgggtgtgggtgtatgtgtgtgtgtgtcttagttattgatgcttcagtacaactgttaattcagcaaaatttactgctcttcttttcagcacttggtagagctaatcagtcagaattgaagcaattcttactgcagctgccaaaacctaatcaaaccaaatcaaaaccaaacaaaattcatacaaaacctctcatgtatgtattgctgagaatgctttattttcattcctcttaacgttgattctttgaattttctctttcacgcta

SEQ ID NO: 49653 - DNA, 1052 bp, Homo sapiens
tcattctattttattcttttttcttttgtctcctttgtgtatttttaaatagcctgtttttaagcttactaattgtttcttcagctttatcatttctgctcttaagagactgatgcattcttcagtatgacattgcattttctaacttcagaatttctgctcgattatttgtaattatttatgtctctttgttaaatttttctgctgggattccaaattccttctctgtgttatcttgaatttcattggatttcctcaaaacaggtattttgaattctccatctgaaaggtcacatacatattttcctctccaggtttggtccccgatgccttaattcatttattgaggatatgttttccttaatggtcttgattcttatggatattccttggtgtccgggtgttgattaattaaatatttattgtagtcttggcactcggggcttgtttgtacccatccttcttgggaagacttttcaggtatttgaagggacctgactattgtgatctaagtttttggtcactgcagtcgtatcttcactaggggcatcccaagcccactaatgctgtggcttttgcagacttgtaggggaactgccttggtggtattggataatatctggaagaattctctgtattgtcaggcagagactcttgttcttcttccttactgtctcctaaacagtctctattctgtgtgctgagctacctggagctggggaaggggtgatgtaaatgctcctgtggcgaccaccactgggactgcgctgggtcagacctgaaggcagcagaacactggttctcatacaaggcgtatggtaaacactgccaggctattgcctgtgtttgctcaaggccctagggttctacggttagcatgtgccaaagccagccagggttgtcttcttcccttcagggcagtgagtaccctttggccttgggctgatccaaagatgccatctgggacccagggcctggagttggtaaccttagaaatctgcctagtgcttttttctgagagccgagctgggtcccaagccacaagacaaagt

SEQ ID NO: 49654 - DNA, 1031 bp, Homo sapiens
gtatgaatttacactatagttcccattcaggaaacagtgactaagcacttcctttgtgcggagtactttcccttgttctggggttacaaagaggaaattatatgattattgtcatcaggaatcttatagtataatagatcatcgtgcctataaagaaacagtctaataaaacagttgttataatggaagcatttgctaagtgtcaaagcaatgggaataacagggaaagaaaacctaagtctgcattactggaggtgaagctgtgaactactgatagagagtaggatctattactggactgggaatcagaagaccaatttataatcccagctctgtactttctagccctgacatcaagcaagtcaatttacttctctgaacctttttccttcaatgtaaagtaaggataataatattaggtctatctagttttaggattatattcaggataatgagtaactgtgaaaatggttagcctataaaatgctatgtgcatttgcatataagctgctttcactgttgacagtgtgtggtgttgtccaacctgaccacctttgtttggaagatggcgtggtactatttttcttctggtaggtggaatagtaaaagttcagctgtgaaggttaatttttggggaagaagacctgcattaattctccaggtagatgtctatacacaaatgtaagctttttatttacaatgtaagttatttacattgttagctttttctctgaaaatgtttcaaaactattgatgagcattttatttttagtaaagttatttcattataaaattaatacttagttgtggaaaatctggaaatatcattggcaaatttggaaaaaaaaattgtatacatcaaaaaattattgtcatctggaattctgacatcccaagataattatttttaacttttaaataatattctcaaaattcatctcatcagagagatttatgttccttaaaatgttagtatgttgctgggcatggtggttcacacctgtaattccagtgctttgggaggctgaggt

SEQ ID NO: 49655 - DNA, 1047 bp, Homo sapiens
ctaatggctgtgctttgaaaattttcatattaaatgtagaactataatcctctttctgtgtagattgtgaagctagtactttattttctttctctcaggcttctgatttatgttttcattgagtgaatatcagaccattgctaatgtcataaaataaaatccagaaaatagatgagtcactcattgaaaataaaatctgatcagaaatcctttgactgtgttacattttaagataatgaatgcttggtttttgagttttactatcataccaacttttcccatgtgtgcatgtgtgtatacatgtgtatgcatatcagaaaaactgaaatactatttctgctcaattctattttgtgaagtcaatccaacttttatagtcccataaatatcaaataaatgaaataattattgtcactaaagtggagaaactattgcttcttcttatcttgtttattttgtttgctacttaaattgacattgaggcaaattttaagtgagtttatgttgtgaaaccctgctaaaatttagaactcactgtagtttgttaaaatatgtaaaaatccattttaagtaagtatgaaatccattgaagatacttttattttttaagcaaccttggagtgtagattttaaagaatacttgtctggcaatatccatagcttaaaatatgtagacatgaataccgatagttgaaaattaacttatttaaccatttgaaaatgagatttattttgttttatccagtgaaaaatacaaaaccaagtagacattgttttttggttaaaaaggtcacaaatttatgactgtatatgttactgggattagaagtgttttccctattggtagtttatcaagtgagtgaatacctttctgtgaatgtgaacaagcttcaccaattttagcagttcaattttagagaagctgtgatgagttattttgcacaaaaggctttatctttcaaactgctttgctatctttgcttgacagagagaggatttgatgactttttcaaaactcccctttactgcttcacctgagtaatgttt

SEQ ID NO: 49656 - DNA, 1045 bp, Homo sapiens
ctaattaccattgagaaattaaacatttgaagaataacatctatgcggttaggttaaattaactgcagttgtttatttggagaacaggacgggaatgagaagggaactttcactctgtgagaggttgttacgtacagcatagtgaccagttattttcagttcccactgaggacaaagcaagaagaaataggcttacatctcatcagaagggaaaattacctacagaaggggtccttcacagaaagattgaatgtgactgacgtaggtcattaaaatgttgtctgaggctctctggctgtgtgctggtttctgtgtactcaaacagcccaatttcaaagacatggcaagactgaaggttttgaagcttgaatgaggatatttggaataaagaaatttcttatgtgtcaattagttattgagaaattttgctatatacctaactaaattttggagatgtacttgaacatataaaatatatgtagtatctttcataatataacgtttgtgtgtactaggaaaaagaaatgatcaaaatcagctgtagaaacacgtgtcctattaaaggtattttgtattcatgtaccattttagaaagttattaaagattaggtagatagaattcaattaaattcagttattaatctttatgtgtaacatttattggtcagatgattaaattaaaattgctgtatatggtttattaactgatgattgcacctgatcagttaatacagtgactcactcttgtcttattttcattatcatccagtgataactgcgcttattaaaataatataaaacttattttagctttttcaaatatttcccatttctagaactgctgtttgtgttattgtttgaagatatataaaagaagattgtagagtgaccattttgttcatccttttgcatcttataaaaataagtcatatatgtctctccctacctgtcatggctggagagaggaaaaacacatacagggatgcaaaaaggcactttgcttctggctagagcaaaccttgaaatgcatacaatataaccacca

SEQ ID NO: 49657 - DNA, 1039 bp, Homo sapiens
ggaaaaacacatcatttttacattaaaacagatatgtattatggagtagaattcaaaatccacattaattttaaaaataaaacagatgacttcaaagaaatttcccacttgtagcagatccctacaggattattttcagtcttctcttccattaggggtactttggtgggaaaagtttatgaagcattgcctgaagaattagagagcagttttgttttgggttaagtttacgtatttatttatttagtttgttattcagttagttagtgactattgcagggaaaagggaggaaagtaggcaaggtgagggaagagagagtatatcacttccttttaaacattgtcataggccgtatgaagttcagaagcaaattgtataatgtaactttattaccagtaaagttaataaaataacattgctcttgtcattttattcttggttaaattataaatctgtgggtcatttcattcaagattggcataccaattagtctttagagaaagaaaatggttgttacagagactttgatgcctttaaaacattgaattttttttttcttttggtgaaccacaattatttttttccccaatgattaattttaaagtttatatatatgtatgtatatgtacatatgtaaacttatatctaatagatatatattgtataaaacattgctggtttactagacatatttgatgtctttttttccccctgtggctatcactttaattttcagctttaaggattttttactgtttgatttaaaaccactcctgttttataggttgactccaggttttaaaccaaatggttagtaaagtttaattaaagctattttattcaaaagggggaaattatattaatgtatttgaaggtattatttatcctgaggtttgcataaatccaaaatgggtttcacttcagttaaattggtgccatcctacaagataaaagctagttaagtttcttctgaacagtgctaacttttttatgaattaaataaattattataattttaacaatcaactataccttttg

SEQ ID NO: 49658 - DNA, 1043 bp, Homo sapiens
aattaagttatttgctcaccatcagccatgtcattattgaagatgaaagctaaggagataaatcctccactcagttttctgtcatttatccaataggtcttcatatgcccctttagccatgagactgcaaggtggtgtgggaacctccgtactttatattaaagtctgttagagaaataatgggagtttggctacttgtttgtgccattaagacactgctaccctctgctgcctaagttaattacattccagtagtgggaaaaaaatgcatttgcctatatagacaccaatggaaataaacatatcgttcatacacttacagagaatgtacgtgtactgttgagagtgaggaaaaattgtagtttatagctgacatactttaaaatgctttgtttctaaagatgcaagtgcgaaattgatccaatatgttcagcagtcaaatattgagatcaaaattgctctatttcctttattcgtgtgtccgttaacaaccctttctgataatgtcagagacttattcaccggcctcaactgccgaaagaattttaaactaacagccgatgtatcagtctaaggactggtagatttacttgagaaatgttatgtatggtgtttcttagctataaaaaactatgtatcctgttatgtaaatacagatactattgaggcctttgaggcctcaattaatgaatcttctgtgggaaacatcttttaaaatgatggtgactgttgaagatatttcttatacaaaggagtgtcatatggattatacgtaaaattgttaactcatactacacattttcttcgtttttattcttcattatttttgagacagtgtctctgtctgttgcccaggctggagtacagtggtgtgatcacagctcactgtagcctcaacctcctggactcaagggatcctcccacctcaacctcctgagtagctaggaccagagatgtgcaccaccatgcctggctaatttttttttttttttgtagaaactgggtctccctatgttgcccaggctggtctcgagttcctgggc

SEQ ID NO: 49659 - DNA, 1033 bp, Homo sapiens
ggcccccagagtagcttcagggggcagggccattggtggtggtgaggttgtggggagggtttgtggtatgtagggataaccttcctggcccctttctgtaagctgtcaccagatctggaatgttcaaatcttgctgtatcactgctctttttcatacagacctatcattaccattcaggaagaatttctgcaatctatatacgttctcatttaatgggatatttacaaattctgagccttccttatctctgaaccaaattcagcattaccaatactgccaggtatcctggaacaacatctcgttttccatttccttgcaatccgtttatcattttccttcttctccacatgccaatacactctctaatttctttgtatctgggtggttatgatactgccctgtttttggagggccacagtaacaaattcatttcctcgtgagtatttgttcttacttatccaaattagccttatggaagcacttgtaacagataaacatttgctttggaactttgtgctcttaccttaaaggaactagctttaagctttgaatctgaagtaggaatagagataagaaaaaaagactttccacactaaagagacagttaacaaaggctgagaagtgggaaactctgaaaggtaaggggcaccgaattgttacatttaattggattattggatagataatgaattgtgaatggggcagtttaagataagacagaaatgtctattgagaccagacccctctgggtcttgagtacctaaggaagaagctcttattatatgtataaataaggtttttgagtagaaccccactgaaaggctgcttgctgacttgaataaaaagccactgttgaatcaccaggatgatcttgccagttacaaaacccttgccttgtgaaactaaaagtttattcctataaagtagaaatagtcatagctgactctgtatgggaaaaaatgaaatgagcatttatgcaaaagcttgaagcatgcacctgcctttcaggtttaatccttgtgtctcatttgg

SEQ ID NO: 49660 - DNA, 1265 bp, Homo sapiens
aattggacacttctgagctagtcagctttagtttaccgaagtctaaattcaggcagcttttggctgggcgcggtggctcacacctgtaatcccagcacttcgggaggctgaggtgggcggatcacgaggtcaggagatcgagaccatcctgtctaacatggtgaaatcctgtctctactaaaaatataagaaaaaaaaatttagccgggcgtggtggcgggtgcctgtagtcccagctactggggaggttgaggtaggagaatggcgtgaacccgggaggcagagtttgcagtgatccgagatcgcgccactgcactccagcctgggagacagagtgagactccgtctcaaaataaaataaaataataaattcaggcagcttttttgttgctgtatactagtggtcacaagtgaacactggataatatgcacaattcattgtagatccatccacattgctggcaaaaataatcaagctttcctgttacactgattgatactgggtctgtgtggtcatcttcttataagaaatatggtcatcttcatagaaaaataactttatatcttttatataacatggtttgaaaaatgtgatttcaactttgtcatcgtgctgcttctttcaacttttattgtctaagctcattttcttcattttattatattctttcatgacttcctctcactctaaatcagttaagattcagctagaatatatgttggtacatacaatttggaaagattgtctttatgttctgtgatcaaatgtgaaaaatagaaccatggagtcaaaacagagtaaggctttactgtttttttttgagacagagtctccctctctcgccccggctggagtgcagtggtgtgatctcggctcactgcaacatccacctcccgggttcaagcgatttttctgtctcagcttcccaagtagctgggattacaggagtccaccaccatgcccggctaattttttgtatttttagtagagacaggttttcaccatgttggctaggctggtatcgaactcctgacctcaagtgatccacccgcctcggcttcccaaagtgctaggattacaggcatgagccaccgtgcccggcctggctttactgttttgtaaaactgctttcaggaagtaattaaggtagatacacacaagcccaagttgaacaacattatatctcacttactttgaatggcctagtcaggaatattgtatatatccataaacgtgaaagtaaaacatttgacgatgtattttc

SEQ ID NO: 49661 - DNA, 1023 bp, Homo sapiens
tttagtttttcatcttaatgttattttattttattttattttattttattttattttattttattttattttgagatggagtctcactctgtcgcccaggctggagtgcagtggtgtgatctcggctcactgcaagctccgcgtcccgggttcacaccattctcctgcctcagcctcccgagtagctgggactacaggcgcccgccaccgcgcccagctaattttttgtatgtttagtagagacggggtttcactgtgttcgccaggatggtctcgatctcctgacctcgtgattcacctgccttggcctcccaaagtgctgggattacaggcgtgagccaccacgcccggcctaatgttattttaggtattttaggtgtggtgcctagttttcaactcttgttaaatatttcttaatgcataattctaagaggtttcatttaaacttgatctactttatttaatctaaggcatttgcagtattgtttctgttctttaatttagtaaaaggaaagttaattattgtattctttggagtaggaagtctttgtgaatttaaatatttgtcgtatagaagtctaacaaaaaatattctttttaaaatatggtcaaatacaaattgaaagcaactatatctgtagaaaatttttcataaaaatcattgactgaaggaacaaaagcatgtcattgtatataccaacccttctttatgcattatccactaaaatgacatttcaaaagattcacagtgggtagcatatggaatactccataaacactgattagatttaataatgtttgtatcactgtttgggaacatgtacaaggaatgcgaccgccatatattattaacatcaaaataactcagaagaaaagctcctaattaaagcagggttggtttagagacttagcaaaattgcagccagaaataaccacctacccacctgcccgggacttggggcttgctttcatgcatgcaaaacagacttgattcttagagcttcaagatagctgctatgaaaa

SEQ ID NO: 49662 - DNA, 1042 bp, Homo sapiens
atctcaggttgaattttaagtccatactgttagtatattactaaggaatataatctagaaattcatatatagtcacacaaaaacatgagtgataaaagctttaagagaattctatatagtgcataaataccccagtaattctgatcactgcttccctagatgagattccctagataaaaatgctttgtgggctgggtgcagtggctcactcctgtaatcccagcactgagaggcctgggtgggcaaatcacttgaggtcaggaaggagttcgagactaacctaaccaacatgatgaaaccccatctctactaaaaataaagaaattagctgggcatggtgctggccacctgtaatcccggctacatgggaggctgagacaagagaatcacttgaacctgtgaggcagaggttgcagcgagccgagatcacgccactgccctccagcatgggagatagagtgagattctatctcaaaagaaaaaaaaaggaaataaaaatgcgttgtgggacttatgataaatgttttataaattaactttccagattcatgactgagaccaaactgatttcaaattaataacattttcaaaacattagcattttaccttgcagtgttttaaaatgctgcacacattttagtttataaaccccacaaagaacacttctgttagggagaagatgatgtgattttagcttacagttatcttaaataacttcatgcttgaaaaatcagaaatatttgtctttgtagaacaaggaatttgaaaggggactagtaaaaggaaaattgcattgaatttcttattttcctctcatacttgccaagtttatatgtattagatatgtcccacttcactgccataaggttatatttattttaggttataaattactctgaattaccttcatcttggaaggtccattgttttcccagagttcttctctttaaatatttcaaggacttccaaagttgcttaaacagatgggaagaggtcactctacattttgatcctggaatagtctaatcatcctccccagagt

SEQ ID NO: 49663 - DNA, 1046 bp, Homo sapiens
gtctgacttgcctggtgttaatttaggccagtggttctcacccaagagcgattttgcctcccaagggacatttggcaagatctagagacatttttgtttatcacaactaagtaggatctgcaactggcatcaagtggctgaaaccaggaacactgttaaccatcctacaatggacaggagagcctcccacaataaataaatattcagcccaaaatgtcagtaatgttgagattgagaaaccctgtttcaggattacctgcaaaagattttttaaaaaaaattataaaaaatcagtggaaaacaatgtgcaatagtccaaattaataagcaaaatctactagataagttaatattatatctatcatattgatgtaatattttaataatttcaaatgttaatttgatcactgtattgttacagttactacttttttctatagctttgaaacatcccagtttatatggcttgtaaaattttttaattaccaatcatgcatgtaaattgtagaaaaattagaaaatataaataccaaaaagaaaaaaaactgtcgactgcaattccactatccagagttaattaatattaatacctcggtacatatccttccaggcattttcctatgcatgtacataagtatttagattgtgaatttgtttttcttaaaataataataaaaagacttctgaaaatttaagttttaaatttatattttcttgtaaaaaggctagtggatcatgcttatatggatatgtccatccacattcagtgtatagtgccgttggttatgtcttcagttgtgattaaacatgttaattggctcacttcatgatgcccttttacaaacacctggtctttggcaccatgctaacaatcatgactactgtaagccatctgtaaagagatcggtagaatcttgatttctctttttgttttctacataataccctcattaaacttccctgtgtcaaggggccttaaatcagtaattggtgactgtccagttaggctattcacactagtgtttcttaagcactttgctgttgtt

SEQ ID NO: 49664 - DNA, 1064 bp, Homo sapiens
gcctgtaatcccaactggcaagaggaatacttgagccctggaatttgagaccagcctgggcaacatagtgagaccctctctttaaaaaaaaaaaaaaagaaaaaaaaaagtagtacctggaagaccaagagtagagagaatttcagaatggagaattagtcaacatggtcacatcctatagaaaagctaggcagaatgacaactgataattgaccaatgggtttttcaactagcagattacacctgaccttttcccatgtactttcaatgtaattttgagggccaagaggcagcttcttgttttttttttttgtttgtttgttttttttttttttttttttttttgagacagggtctgactctgtcacccaggctgtagtgcagtggtgcgatcaccactccctgcagcctcaaactcccaagctcagatgatcctcccacctcagccttctgtgtaactgggatgacaggtgcatgccaccacgcccagctatttttacttatttatttattttttttgtagagatggggttttgtcatgctgcccgggctggtcttgaacttttgggcccaagccatctgcccgcctcagcctatcaaattgctgggattacaggcataagccaccacgccacaccaagagccaggatataatgcattaaataatgaagaatatattttataccttgaatgctgagatttgagggaaagaaaagtagttagaagacaatgaaaagataaattgtgtctcttttagagattctgacaggaaacgctagacacaccaaagatcttgaatggaattgtcaatcactaataattatgccaaattttactttcaaatatgtgatgccccctgcttaattcagttgcatttgttgagcatatactgtgtgatttagctaaactaccttagcatgcctagtgatttgtagttgtgtgatatgtaattcatagcctccaatgtagagttttactctcataagttaaaatgaagaacatttatggctcatacaaagagggactggattgagggtagaggagagatattcttgagttaacag

SEQ ID NO: 49665 - DNA, 1025 bp, Homo sapiens
tagccaggggtggggtgcggtggttcacacctgtaatcccagcactttgggaggccgaggcagggggatcacaaggtcaggagttcgagaccagcctggccaacatagtgaaaccacatctctactaaaaatacaaaaattagctgggcgtggtggcacgcgcctgtaatcccagctacttgggctgaggcaggagaatcgcttgaacccaggaggcagaggttgcagtgagccgagatcgtgccattgcactccagcctgagcgacagggcgagactccgtctcaaaaaaaaaaaaagaaaagaaaagaaaattagccaggtgtggtggtacacacctgtagtccgagctactcaggaggctgtggtgggagaatcacttgagtccaggaggttgaggctgcagtgagctgtgatcgtgccactgcactccagcccaggtgacagagccagactctgtctcaaaataaaagaggggcggggggtgggtggggccaccttaagaaaatctttgtcaacttcagaattaactggtttgcaaagggtgaaagtcaggagcaggtgggtggtagtacatatgtaattctcttgatgggagggaagcaggtggtcgaataggggcaaatcagatatccttatgctagccacttagttttctcagcagcatgagtccaggagtctcggagaaatgataaacatccaggtgatagttaataacatgagggtgggtcagataatctctggagaatgagtagagcagtgatcctaagacagaaccctggagaaaagaaacatttatggcagtgattctcagctctggccacacactggtattactttgaggtacttctaggaaatacccacgtccagttcctctctgaagcaatcaaattgaaatctataggattggagcacagatgatagcatgttcaaaaattatttagccaattttaatgtgcttccaaagttgagaaccaccaatttatgggactagctcggaatttggagcctatgaaagacagcatg

SEQ ID NO: 49666 - DNA, 1033 bp, Homo sapiens
atttagtttaattggagctttgtgttgttagaacccaacacattaatattaacatttgagacaaatttcctatcatctgagtctttcattctaagtgaaatgtccatattttctcattaatttgggtctatttaaagatcagtcacatcacagtaacataaagattggaaaagtaatgttcacattttagttaaagtcatgaaatatatacctataattgactatggtgttttgatttggttataaagtatagctgtaccttccacacggagttaagagaagtcctggcttaacacattagtggtagaaagtgtaagtttacacttaagccactccccagccaaggatttgcataaaaaatgagtgaagttcagcttgggtttatgttagcaaaatggcaaatgtagaggcacgctaaaggtcctttctgccacccttgtatacaatacatgtctgcatcttgcctaatcttaattaaatgtctttattaaatctttattaaattaataaaatgtcttctgggtctgaggactgaaattctgaaatgtaaccaatatttaagagcttaaacagtgcttctgtatagaacttgtagtatgaaatatgacttcaaaaaagcctgagctgtagaattaattttttcaattgaatgagtaatactgctttaaaaaatatacatggccgggcgccgtggctcatgcctgtaatcccagcactttgggaggccgaggtagggagttcgagaccaacctgaccaacatgcagaaaccctgtctctacttaaaaaaatacaaaattagccaggtgtggtggcacatgcctgtaatcccagctactcaggaggctgaggcaggagaatcgcttgaagccgggaggtggaggttgtggtgagccgagattgcgccattgcactccagcctgggcaacaagagcaaaactctgtctcaaaaaaaaaaaaaaaaaaaaaaaaatatatatatatatatacacacacacacacacacacacacacacacacacacacacatacaca

SEQ ID NO: 49667 - DNA, 1027 bp, Homo sapiens
ttccttaacaatgaatgaactctctgttctcctttctatatcagggtatctgcttatttatggtttctactgccatgtggcttttaacatcctctctctcttagcttctgcttctgcctaacatacatatccgtttctgcatgtgtctcattaagttaccccaagaaaaatttggtttgtttggttcagagcagagattttctgctggaaaaatctctcatggcaatctatagatagttttctttggtacgtactcattatctaatctcttatgattggggtcatacgaaaccaaacattgtgacctatatgtaaagtacctctttagcaggagactctaaggtatctcagaagagagtagtacaacagagatattatttacagaatattctgtatattgagcccttacatcaggagacttgaggtactagatgtttacttttactatatatcattgaatcaaagatagtatcaatcataagatattacattaatttatttaccattgagaaaggaaaagatgctgccaatgaaatcacagcacaccaatgattgttagatgcatctcagtctcagagatgttaaaatgtgaaaaaagtacatttttaaaagatgtaatgtggtgtcagtagcatatctgagattgtctgaggatcaaagcaggtatagtgaacccccagagaagttccctgaggactgactcctagagtggggtaaatgctaaaggttacaggttggattactaatctgacagaccagagggtagtgtctagagactagatagccagctatctgtctgcaagtggagaggaggccagtcactggtccagagtgtggtttgcctcagggacttggcagatatcagaaggtagatccaaggagaaggtgaattattcctgtattgatttaaatgacatgaatatattgggaatttctgtttctcttaattcctcatttgtgttctgggatcaattcagttgtgtctcttatcttctagaatatctccttgtttattacttgtacatta

SEQ ID NO: 49668 - DNA, 1031 bp, Homo sapiens
tattttagagtaccatttgaaagggacatgacaaagtagttcagaatactttttaaacatctttcactacattcatcgtcattctcccttaaatgttgtatgtgtggaaatacataggaacctgttttaaaaattatattaaataacattgatattttttgtagtcactgatgagacttgcagatctttaggtaaataccagtgccaaagtatttatttgcaccaaagttaaggaaaatctaacacgtgtcagatcagtctgagaactaacatttgagagtacctacacattttgtatttagtttcagtggtatatttcctttgttaagaggtctgaagaaatacaatggaattgggattggagaacactattttgagtcttatatttgatgatataagtttactttctcactaaagatctatgttataaactcagaattttaatgttacctattttcttccttagtggggaacattccttatgaagctactgaagagcagttgaaggacatcttttctgaggttggacctgttgttagtttcaggtgagatccccttttccttcatggtgggagcttcttaaaaatcaccacagatttggctcttagtaataatggcaggttttctttactggtgacttttcacatacattttgttcttgtaacagctttattgagatataattgatacactatacaattgacatttattcttacctaaaatatgtttttttcgttaaaaatgttttttaggcagggcatagtgactcaagcctgtaatcccagcactttgggaggccgaggcaggcggatcacctggggtcaggagttcgagaccagcctgaccaatgtggtgaaaccttgtctctactaaaaatacaaaaattagccgccgtggtggcccatgcctgtagtcccagctactcaggaggctgagacaggagaattgcttgaacccgggaggcagagatagcagtgagccaagatcatgccactgcactccagcctgggcaacagagcaagactccatct

SEQ ID NO: 49669 - DNA, 1024 bp, Homo sapiens
tggaccagcatacattttctctagactctgttggctttcatttgtatttccagtgagcactagtttccagggtgttctcagttttcactgtgcttatttggctgaattttgattaattcagtggtatccagttgtgctgtgtaatatttgttgatgatgctggaggtgttgtaagcaagtatgtcgaacttgctagttgatctctggctaaaccctgccttctgctattgctaacagtagaaaatgatcttcagagtcattgatttgctttttttactcatatctgtatagagatcataatttgtcacattattactgaattcaggttacctatacattaaaaatgccaaaaatctctcttttctctttgtacacataggtcccagtcatgcagggaacaggaatgcaaggagcaagtatacagggtggaagccagcctggcggctttagtcccgggcagaaccaagtcactccacaggatcatgagaaggtaagcaacactgtctgactgcctccttatgcacaattctagcctttttgattcctcttttcacagttaccatgtgacgatcctgggtcttcaaagtccctttggaggtgatgtttattctaacttagaactcttttatgatcttgttacctgaaaatttgtgagtctggtcctgaagttcctaatggatgtgaagttcttaagtggatgtaaatggcagcttattttatatttcacactcatctgccaatagcaggtttttcttgttcaggccagattgacctgaaaatccacaccctttttccttccctttctactttatccctaaaaacaatagtagattccccatgattatatctttctgtttttatatttgaccattgtggggagcttatgtctgatggaaaggctaaaatttgtgaaaaagagagactttcaaaacaggattaaaacttgaaggatttccagggctcacagataccatcttagtctccaggaactttgagttcatgaagttgtctgttttgaatcgtc

SEQ ID NO: 49670 - DNA, 1337 bp, Homo sapiens
actgcagccttcacctcctgggttcaagtgattctcctgcctcagcctcccgagtagctgggattacaggtgtgtgccaccatgcccaactagtttttgtattttttagcagagacggggtttcctcatattggccaggctggtctcaaactcctgtacgcctgacctcaagtcaggcccacctcggcctcccagagtgctgggattacaggtgtgagccaccacgcccggccgagatggattagttttggacccacttatatgacatagccattctaagagagaacttgcatatgttgcctgtactcttactggttttttccactagaaagctagttcagctgatgaatgttaccttgtcaggttgtttctatttctatttagggcaaggactttctgagaaagtcaacctctagactttgtttcctggattgttgtcaacttatttattgtatgcctgttgtatgctagctattgtatactaaatactggaaacacaccctgtctctgtggagaaaaaaggactgtttggctgattaatgataacttaacacttgtttctgtgtagaacatatgcagtaatgtcacctcaaaagagagttaagaacgtccaggcacaaaacaggacttcacaaggtagtagtagttttcagaccacgctttcagcctggaaagtaaaacaggatccaagcaactcgaagaacatctcaaaacatggacaaaacaatccagtgggagattatgaacatgctgatgatcaagctgaagaagatgctttgcaaatggcagtgggatattttgagaaaggtaaaggtggattgttttccttatgaaactcctatttctgtaaaaatattctagtctttttttcttaagaatttttaaaggaaagcataattttgctcattcatgcttttgtttatttaatagacattgagcaattactatatatcagtatgctaggcactagggacacaacaacaaaacttactagcagagtggttcccaaacggctgcatattgggatcacttgagaacctttttttctttttttttttcctccctctctacccctttggctctgagaatctttaacaaacaaactgatgtcaggcatctactcttagactttctgattttattggtatgggatgcaacctggcatagggattttttttaaaggcttcctaggtggttccaatgtatggtaaagtttgggaaccactgtcctaatattgaaacaggttgtagtctaagttcagtgcttttagtttagaataggaatgtcagggcataatccagctttcctcactgaagttgctatcgctgttaaatat

SEQ ID NO: 49671 - DNA, 1050 bp, Homo sapiens
agagatagggtttctccatgttggtcgggctggtcttgaactcccaacttcaggtgatctgcccaccatggcctcccaaagtgctgggattacaggcatgagctgccgcgcccagcctaatgtgagatttttagatccaagagtgaataatagtaaaagaacaatcgagacactaaaatgtagtttaatttagcttgtctcctttccaggaaatgctgtaaacacacggatattgaagtgcatgatcccagcaacagtaatatcagaagattctgtggttaaggcagtctcctggctttgtgttggcaagtgttctggtagcaccaaggtaatctttttaaacactttgatgataagtccttcagaaccacttaagggctggcaaggaagagccacttatgaagtaatggcattggccttttgtgcaaagcctgtagttttggaacaatatatcttgatgcaaggactatgttcaaacagaaatttttactgagaaataaaatctattattctactttgtgcctgaagcttctaaaatagccctggtggcgggggacggggggcggaattaaactcttctgtaccagttatatttctttaaagataagtattttgtctcttcaataggtacttttttatcgttggctggttgcaatgtttgacttcattgatcgtaaggagcaaattaacttgctctatggcttcttttttgcttcattgcaagatgatgcactggtaagtaaaaattggacagcattaggcatcaatcaaatagtacatgtgtgtatattgatgcaccatatatgcttcagtgtgctacacaatatgtttttccttattttaaaaatatatcaaacatatagaaatgtaccaagataacgtagacatatcaaatatacagaaaagggcaaataataacattctattttgcacctgtctctcagattaacaaatagaaaatttttatcgtatttactttatgtcttcttttaaggaaataaaaatgttacagataaagttgattccacgttggagtcttgtttgctgatc

SEQ ID NO: 49672 - DNA, 1049 bp, Homo sapiens
atcctcccagatgactatgttaatattctcaaaacagaattctcctgtttcctgtcttatgtggttgcacggttgtacatatagaatcaagtgtgtgtgtgtgtgtgtgtgtgtgtgtgtgtgtgtgtgtgtgtgtatttataatattatagggaattggctcatttgatttttttatggtggctggtaagtccaaaatctaccggatgggccagcaggctggagacccaggagggccaatgttccagtttgagttaagtggcagtctactatagaaccaggaagaactgctgttgcaaataaagtctgaaggcagtctgttggacattttcttcttcttctgggacctcttctattcaggctgtcaactgattggatgagacctatccacattgcggagggcagtcaatttgctttattcaaagtctactgatttaaatgttaaacatatctaaaaaaccctcacagaaacacccaaaataatgtttctccaaatatctgggcagcctgtggaccagccaaatcaacacttaaaattaaccatctgatatggtttggctgtgtctccacccaaatctcatcttgaattataattcccataatccccacatgtcgtgggagggacccaatgggaggtagttgaatcatgggggcggtttcccccatgctattcttgtgatagtgagtgagttctcacgagatctgatggttttataaggggcttccccttcgcccagctctaattcttttccttcctgccatcgtgtgaagaaggatgtgtttgcttccccttccgccatgtttgtaagtttcctgaggccaccctagccacgtggaactgtgagtcagttaaacctctttcctttataaatgacccagtcttgggcagttctttatagcagtgttagagtgggctaatacatcatcacagggtgtaaacctggctactggcactctgagacctgagcactagaaaggggtgagaaatggtcttggtatcctcccttggctgtgcctggtatccgagtccagcttcattttcagagtaa

SEQ ID NO: 49673 - DNA, 1018 bp, Homo sapiens
cattcttcttttatttatttattggagatggagtctcactccatcacctaggctggagtacagtgatgcgatctcagctcactgctacctctgcctcccaggttcaagccattctcctgcctcagcttcccgagtagctgggactacaggtgtgcaccatcacagccggcctaatttttgtatttttagtagagatggggtttcaccatgttggccaggctggtctcaaacttctgacctcaagtgatacacccacttcggccttccaaagtgctgggattacaggcatgagctaccgtgcccagccacctttttcattcttttactgtcttttaaatggggctttgggagaacccagaattaatcatatgttcgatatgccatttttaactggaaatctcccccttaccttttttagtattaactttttaacaaaaaagatagttttaattaactagactataagttctaaaggcctcagcacaactaagtattctctaaaaagcattctagctcaaaacaaacactctgatactcattaataatgggtgtacagaggttaggagatattttcaacatagataaactgggtcattttggttttgttttaataaatttaatttcaagaagctgttataaaatggaaatattgtatttctaagcctcatttgctgcctttgtgcagtattcgattcaataaaattttagtataataaaacaatttggttacttccttagaattcattttagtggtgtgttttctctggatagccagatgtataaaacaggtatctagcagtaatcacatctttcgttgtgaaattagtgcttttgttaagacttgtttcagttatatcaaagctgcttgattatggcataccaattgtaatttcctagataattttccaagaattataataatcaggtattagcttctcttctggtcctgtctccttgaggtctaaatcaaggatgagtaaactttgagtcctgagtatgctaccagtgagaataagct

SEQ ID NO: 49674 - DNA, 1041 bp, Homo sapiens
aaaaatatattgctcagtctggcctcaaactcctaggctcaagtgatcctcctgcctcagcctcccaaagtgttgggattataggcatgagccaccatgcccagcctatttttgttatatattttctatatgacgattcccttatccacttttcagatacttaactgttgatcggttgttctgtcattgcagctgccttctcagatgggctcagtgctaaacaactctctgctgcttcactacattaactgtgtcagagatgagccagtcttgctgaggttttattactggttgagtcaaacattacaagaaggtaagaattgagtgaggatggaccaagatagttaacaaatgggtttcttttataagggtgccaaattctagacagcaggagccttcatatgctgtaattatgtctgtggtaatcttatatttagagcatgaatgtttctgttgtaattttaaggcagtaagaaggtagagggattttgttaaggaaacactgctagatggccaccaaaactcactgggtggctccactttgatgactatcacaatccaaggattcttcatctttgtatgttcagaaacttgctgttagggccccagaatcatcctgttaatggtaacgaaactcagaagagacaaatgtacaagccagaatgtcagcttattataaaattaattatttctggtaagcgaaatgctcatatctgccaactagagtatcccctctgctatcagcatatatgggagccaaatttgtcattagaagatttcttaattatagaattaaaggaaagggcagtgagaagtctttcatccaagccatagtaaagcctgagcatttcattcctccaatggtgggggtcggtggggaggggcgggtatatttctctagagataatatttcttttgaccaaatttgagtgtttctttactggatactggataagcaactcctgattcttctggtggttaaagttgcttttagttggttccaggccaattcttcttcttcttctctgaatcttttaaaca

SEQ ID NO: 49675 - DNA, 1060 bp, Homo sapiens
cccaaagtgctgggattacaggcgtgagccaccgcacccagcccatcattgtatgtttttgtatgtgattgaggcttgggaaatcaaggcaaggcctgagaaaagaaagactagaattgctttttttttcaaagtcacagaagataagataaatttttatgaccatcaaaaaggtggcaaattgtaattgtagaccacaaggtaaaaagggagagaaattcatatctgtagcaacttcaaaagttctctgaggggggatgataaagatgctgtttttatttgatgatgtaatagttgttataaattgatgtaatttagagaaaggtctgttctaggctgataagttaggcagtcctgttgaggtatgtttcttgtagagaaaatggcaaaataaacttgtacttggcattcgtctgtcttctggagactaatcatggtgtagaagcagctgttgggttcaaaatttgatgtggtcatctccatggtccttttcatctctaagcctctgttagttctgaacactgttatgtctgaatgatttcatgaaatcttttttcattttgtccccctcagtgtagtgtgcttcagagtctgaaagagctattgcagaattggctgttgtggctttctatggacattcacatgaaacctgttacaaacagtcctctgtgagttatctaacggtcttccacaagagacgatctgtatacaaatgtttgcatatgtttaatagtgtggcgtgaaacaatttttttcatgtaaatgcttagtagtacttttttggaagacttttttgtgacttttcactcttcttcccccacaatcctgaaaggaaggctaattctctaagttcctattgtgtaaatcagaaagcaacccttatctgctaaatgacttctttcaagagttaatataacaaaacactagagagatgagactagaatttgcaactttgacttccattcagtttaactcattttataaattatattcttatatttaaagccaattttcatgatggctagaaaaatctctaacgtaattttgcgtacaactttgt

SEQ ID NO: 49676 - DNA, 1052 bp, Homo sapiens
tttctgttgcctgcttttgtgtgtgtgtgtgtgtgtgcttcttcctcatactgcttagtttctttgtgtgcctggttatctttgacgatgtgctggatacttggaatattattttatagaaataatttgaacactgaaatgatatatttctgcacagaggacttttctttgcttctcactggtacccagtggtgttctttgtctggtactaccctaatccaagttctgtgtctgagattccctgaactataggaggttagactgcaagcttgtgagaggactaatttacttctggttatgtcttatcttgaaggtatagcccattgggtttccaagtttaaagtggggcatgatttataagagttcccaattttggaaaaccctgtgctctgaatttaattaccttagttctttgagaccgtggaagtacagttcactttggtagcaaattcctctggattggcaaattccctcaggccaaaagtgattttgagtattagacttacttctttgggttatcatcttctatattttggccttgtaactccttaccgtagcattagcaccttgttactttaaaaaaaaatctaccttttgttatggaaaatgtcaaacataacaaaggtagaatagtatgatgaagccaggcacggggtggctcacgcctgtaatcgcagcactttgggaggccaaggcgggcagatcacttgaggtcaggagtttgagaccagcctggccaacatggggaaagcccgtctctactaaaagcacaaaaaaattagccgggcgtggtggcacgtgcctgtagtcccagctactcaggaggctgaggcatgagaatcgcttgaacccagcaggcagaggttgcagtgagccgagatggcaccactgcactccagcccaggtgacagagcaagactccatctcaaaaaaagaaaaaaaaaaaaaaaacaagaacaacaaaaaacaaatatacagttcaaaggcttttagtttattcatagagctgtgcatccatcaccatcatcaattttagaacattttcattattc

SEQ ID NO: 49677 - DNA, 1067 bp, Homo sapiens
ctgatatggtatattccattaattgaggttcatatgtttaaccaaccttgcattcttagaataaatcctgtttggtgatggataaaaattcccttttacacattactgggtactttttttgttttgtaaccctctatagcacacaggcttactaaattcaggaaaggcaaccaaaaactctttttacaagtcttatagattcttggaaacaaacagatttgactattgaagaaaaatgttaaagcatataagtgaccagtttagtttggaaaatagctcaggctagattgtcatgtaagacttttatgatgtaatgttgaacttcatgaagacaagtgagtcaagtgcagtcataaatatttgcaatgataataattattatgatgatgctaatgttttgccttgcctttgtttaataacttatcctcttttttttttctttttttttgagacagagtttcactctcgtcacccaggctggagtgcaatggcatgatcttggctcactgcaacctctgcctcctgggttcaagtaattctcctgtttcagcctcctgagtagctgggattacaggcacccgccaccacacccagctaatttttgtgtttttagtagagatgggtttcaccatgttggttaggctggtcttgaactcctgacctcaggtgatcctccctctggcctccctaagtgctgggattacaggtgtgagccactgctcccgccttatcctctttctttaagtaccacaatatacattgactctttgattatcaaagcagtcctgtgaggttgtaaggttaggcaccattattcccatctggaaggtgaaaggaatagcctcaggaagattgatttattgctaaaagggaaaaataattaacaattatttatttatttgtttatttatttattattttcaatgttttatttccataggtttttggggaacaggtgctatttggttacatgagtaagttctttggtggtgatttgtgagattttggtgcacccatcacccgagcagtatacactgtacccaatttgtagtcttttatccctcacc

SEQ ID NO: 49678 - DNA, 2072 bp, Homo sapiens
gtgtcagtgaaaagaaaaaagaaatggtacataaccaacattctatggcacagaggatgatgtgtgaaaaaatacagacatcccacaactcagaggagttgtactctgaatagaggggtttactctgaatatgaagttttagaagtactttcaccagtttattttgtttatatttactatcttatgtttataaaaatgatatatgataaaaacctgcctacatctgaaacaactattttaatcattataacaattctgttaaaaaggcattgtgttatacatagtttatttatttaaatagagacaaggtctcatgttgaccaggctgatcttgaactcctggtctcaagagatctgcccgccttgtcctcccaaagtgttgagattacaggcatgagccactgcacccggcctgttttacatagtttaagagttttcacttagcaataatttttaaaatgttatttcttaaagctgatggatatttgaaaggaatccaagagtgatggtaggaatagaactttgcaaatgagcaagtgaattgccatcttaattttctgatgatttgtactaaccaagtatttctatcaccatatctccccacttcttttttgttttgctttgttttgttttttgtttgtttgtttttaaggaaagcccagaagaaaggacagtaaatgtgagctctattcgggtaaataaatttactttcatcgtgttgagggatttcatacagcttaatttcatcaagagaatttatacttttccttttttccaaaccttaagcctgctgcctccacaaagtcaaaatgaagtgtttgccttccaaattcattccagtgactttaatgtgaatttattggcacttattctttctagtcttatctaggatataacttttgatagttacagttgcatgtatataaagtatgattgtaatgaaataaagtatgatttgttactggcgtaacaaagccatacataggctgggcattgtggctcatgcctgcaatcccagcacttggagtggttgaggcaggaggatctcttgaggcctggattttattttattttattttttttgagaaggagtcttgctctgtcccccaggctggagtgcggtggtgtaatctcggctcactgcaacctctgcctcccgggttcaagtgattctcctgcctcagcctcctgagaagctgggattgcatgtgtgtaccaccacgcctggctaatttttgattttttagtagagaagatgtttttccctgttggccagctggtctcgaactcctgacctcaagtgatctgcccgccttggcctcccaaagtgctgggattacagatgtgagcccccgcacccggaggcctggaatttgagaccagcctgggcaacatagcaagaccatgcctgtactaaaattttaaaaaattagccaggcatagtggcacgtgcctgtggtcccagctacttgggaggctgaggcaggaggattgcttgaggctgggaagtcgaggctacaatgagctgtgatcactgctgcattccagcttgggcaacaaacagagcaaaaccgtatctcaaaaaaaaaaaaaaaaaaatatatatatatatatataattatctcattatcaaaaactgctatttacacatttaatataggcagtaatataataatatctgctcctatgttatctcctagagtgtgagaatgatgacacatttccattgcacagtacttaaatttttttgccaacataataaaatggacgtttagcccttggaattgggtactttctggtttaaatgttacttagtgactgagctcatttcccccccgaactaattttgatatgtgcatgcgggatgctgcaaactcttcctagggaaagaggaggaaatagagaaaaagcatagtaaaatattcgataagtaattttcctttttctgtgcctgcagggaaagaaatggagctggtatttggactatttattttcacaggggttacaaggcttgaaactttttataagaagtagtgttcatcattcttccattcccagagcagagggcataa

SEQ ID NO: 49679 - DNA, 1061 bp, Homo sapiens
gaggaggaaaaggagaggagtaaaggatgactcagatttttgacctgtcaattgggtgaactctgagattaaattctgttttggctatgttaggttggaaatgctgtgtaggcaattggatatccaagtctggacttcagagtacaatttgggactagaaaattaatttgggagtcattagggaataaccatgactttggatgagatcacctagtacagctagagaagagaaggtagcaaaagacagagacctaaggtatgccagcattgagaagtagaggagaagaggaaccagcaaaagactgagaaggacccaccagtgacctagaagaaaaatcaggaggctggtattctggaagccatcagaagaaaatgtttcacaaaaggaaggtagtattgaatggtgtgaaatgttacctatatacctggaaaaaagcaacttcagctgctttttaagtaaatgtgatagtttgtactgcaaataactttccatattgcttttcagatcatgatattttggtccttaagatcatgtagaactttccattgtgagaagggagttgattattttatcattaaagaaacttttctaaacttaaatttatgaaaaataatttttcccttaggtttgtctttttgttcaataatgattccctgggtatctttttttgccccacaaataaaatacttagacatacctggatacctttttttgtgcctatttctcttttaactttttttttttcttcttgagacggagtctcactctgtcaccagggtggagtgcagcggcctgatctcagctcactgcaacctctgcctcccggattcaagcgattctcctgcctcagcctcccgagtagctgggactacaggcacatgccaccatgcccagctaatttttgtatttttggtagagatggggtttcatcatgttggccaggatggtcttgatctcttgacctcgggatccacccgtctcggcctcccgaagtgttgggattacaggcatgagccaccgtgcccagccctcttttaattttttaactcacttaagatta

SEQ ID NO: 49680 - DNA, 1051 bp, Homo sapiens
atctcctatctggtgaaggaaaaatcaaagctcaaaaatgtcagtgacaatttcgtagcaaaattgggattagaacctttgtcttttgactcctaattcaacattctttccactataccactttaaccgtagcttgaatggttttggcctaagtggaatatatttgaaaacataaatagaagttatgttatataacatcccagctgctgggtctggtttagcagaagcttgaagaacagcagaagagggtgggaggtaaccaagtgtgtaaaatgagttccacattttcagatgttcaacaaaagcaacagagagtgctcagaccattgactgggacaatactgattctttaacccttagtctgttatggctttgcattattccttatcaactccaatgacgaattccagcctttttgacattgtgccccctacatttttaacctgttcctccaacttaacctgttccttcaacttatctcccagcctcctgcatctatatcatacatggtgaaaatccctccctcctactctctgactcattctctcatctgaattcatattaatcttgttcgtcctgagacatttgcctctatctgttcttctaacccttttggtttttctgcatggaacctcaattcgttggaagcaatctctgctatgtaaatcaaataatatggcagaagatattctgcaaataatagctggcaaagatttattattattctgcattttctgagggatattttttactttgcaaccttactgaaacatgggtattctttgccctgatgatgctgcttccctctaaactttctccggtttgtccataacatagtcttaaactggttgtgtgtgtgtacgtgagatgggactttcttttttaaaaaactttatttatttggagacgaggtctcactatattgcccaggctggtctcaaactcctgagctcaagaaatcctcctgcctcagcccaccaaagtgctgggattacagatgtaagccactgtgcccggcccaagggggtggggctttctatagtggggaaac

SEQ ID NO: 49681 - DNA, 1048 bp, Homo sapiens
ccaggcaaatatcacttggccattcagatggggagcagagaagctgccttgcagagctaagcggtacatgttggcccctcttccttctccgtggaattatggaaagagagaagcctaattaccccaaggttccatccagcattatgaatccacagggtttacccctactctctggcgcaactcagggaggcaaaagggtatccccgagacaccttccccaccccaagtgcccctgaaaaagtctgggcagtgtgtgttctattacttcagctccaggacagattgctagccatcctaatgctacctaggtattggtttctcctcaaatatcttcattttctttagcctcagtccctgacagaccttccttaaggggagaacagttcattctggttcttctacgttatatttggaagcattaaatccatacttatgggtttagattttttttttgccccacatcttcctatttcttaaagtcctcagcattttgagagacccactgagttgcgagttgctctggaaacctggctgaagccaccctttgctcctctgagtctgtcctcacagacctgaggacacagtggcagcttgctgagcaagggagtgttgctttccttgggtaaggaagaggaagcccacctcaagtctggagtagtatgactgccatccaacacccttccaggctgtgacccttctagctctcaggctgaatcaggtgaggtggctgattgtccccagctaatcataaggcatttgcaactggctaccgtgtgtagtggcccctccataggagccacaggccacaaatcaggaagctggccactttccacccagacaacaacagcaaggccttcctgtgcctaaaattgttatttctaactctggaaggtgaatccaatcctcaaactgaactagctcttcctaggcgacatataccatgatctctttatccagaaactgttcagaatagatagtaggggtgggggagtgggcttgggaatgttgaatagattcagagcccacttaggcagctttctcccaagag

SEQ ID NO: 49682 - DNA, 1026 bp, Homo sapiens
tctgttctgttacagggccaagtgatccagttctaagtgtcatcttttattatgaagacaataaaatcttgagtttatgttcacttcatttgtttgctgttcatcttttgggagggaataagctagagccatcaatacaattccgcttgtggggaaatttatgcctcttactggtactacttgttttgcattgaagctgactggttgagttcacatcatatgttgcaattttctaatttggcacttcaatcactaggggccttatgaggcagtttgtcattatgcaatggttattggttatcatgtgagtagacacatttcaggctaatagggagaagtcagtaacacattcatagtgaatatgagatgtctttgctaagagttaagtgtcagatctttgttataacagttaatttaataaagaattttggcattgttcttcagacacagtacactgtaacatatataacattgtctgtggacttggtcttacactcttgaacattttgacattccccctcacattttaaagtagatatatttataccaaaataactacaaagaataggttttctagtgtatgaaaccccccagtggagttttttttttttttttgagacagggtctccctctcgtaagtgccagtggtgtggatcatagcttgctacagctttgagcttgcaggctcaagtggtccacctgcctcagcctcctgagtagctgggactataggtgcctgttaccatacctggctaattttagtttttgtgttgggtgtctctctttgttactcagctagtctggaactcctggccttcagtgaaactcctatctcagcatcccaagatgttgggattacaggtgtgagccaccaggtctggccaaactccccggtggaagaatcttaagagacaaaatatccattctttaaaatgcctcttaacagttccaaattatacatctttttttttttctttttttgagatggagtgttgctcgttacctaggctggagtgcaattggtac

SEQ ID NO: 49683 - DNA, 1051 bp, Homo sapiens
gcgtgatcttggctcacctccacctcctgggtacataaaagcgattttcctgcctcagcctcccgagtagctgggattacaggcacctgccaccacgcccagccaattttttgtatttttagtagagacggggtttcaccatgttgaccaggctggtctcgaactgctgacctcaggtgatacacccacctcagcctcccaaagtgctgggattacaggcgtgagccaccgcacccggccgattgctgttaatttttaatggtatctaacacgtaataggcattgaataaataactgctaaaaaatgaatgagttaaaaatttggtgaactctctgtttatacagacgtcttacagaaaagctgtcagcataattgaattttctattaatagtttgcttttttctcttactatatcacgagcatttttccatgacagtagtcttctttttttttttttcagctacaccaaaattgcattgagccaaacttgccaccaagagcccaacaatcaccatgatgctgagcacggaaggcagggaggggttcgtggtgaaggtcaggggcctaccctggtcctgctcagccgatgaagtgatgcgcttcttctctgattgcaagatccaaaatggcacatcaggtattcgtttcatctacaccagagaaggcagaccaagtggtgaagcatttgttgaacttgaatctgaagaggaagtgaaattggctttgaagaaggacagagaaaccatgggacacagatacgttgaagtattcaagtctaacagtgttgaaatggattgggtgttgaagcatacaggtccgaatagccctgatactgccaacgatggcttcgtccggcttagaggactcccatttggctgtagcaaggaagagattgttcagttcttttcagggttggaaattgtgccaaatgggatgacactgccagtggactttcaggggcgaagcacaggggaagcctttgtgcagtttgcttcacaggagatagctgagaaggccttaaagaaacacaaggaaagaatagggcacagg

SEQ ID NO: 49684 - DNA, 1231 bp, Homo sapiens
ggaaaactccagtgactatcagtcaaaccttgcttaggtagagaaggagcactaaatagctactccagatataaaagctgtacatttgtgggagttgaatagaatgggagggatgtttagtatatccagtatgattggtaaatgggaaatataattgattctgatcactcttggtcagcttctctttctttatctttctttctccttttttaagaaaacgagttaagtttaacagttttgcattacaggcttgtgattcatgcttactgtaaagtggaagttgagattattttaaaacttcaagctcagtaattttgaacactgaaacattcatctaggacataataacaaagttcagtattgaccataactgttaaaacaatttttagctttcctcaagttagttatgttgtaggagtgtacctaagcagtaagcgtatttaggttaatgcagtttcacttatgttaaatgttgctcttataccacaaatacattgaaaacttcggatgcatgttgagaaacatgcctttctgtaaaactcaaatataggagctgtgtctacgattcaaagtgaaaacatttggcatgtttgttaattctagctttttggtttaatatcctgtaaggcacgtgagtgtacactttttttttttttaaggatacgggacaattttaagatgtaataccaatactttagaagtttggtcgtgtcgtttgtatgaaaatctgaggctttggtttaaatctttccttgtattgtgatttccatttagatgtattgtactaagtgaaacttgttaaataaatcttccttttaaaaactggaaaaaatcttgaactgattgatttttattatgttctgtcatatgggcacactgattgactttacaattccctcaaagttaagatttttaattttaaaattataaatgatatttagcatctttatatgttcattgttgcatatatcattaattatttctaagatatatccctagaaatgggattgctgagtcaaagatatactcatttttaaggcttctgatttgtgttaccagaaagattctggtactttatctttctacttggagtgtgtgttttattttcccccttataccctccttattgatgcacattattctttttgaactttgccagttttttagttgagaaatgatatctcattgctattttaatttgtatttttttgattaatattaaagttgtaca

SEQ ID NO: 49685 - DNA, 1023 bp, Homo sapiens
ccacaaagagcatatttgtagtaagtaatgacacaattttagattattaccactaaactcttttaaagataatttataatctacttaagaattacacagctatcacaatgtgcatcttaacaaaggcacaaaaagataatgctcctccatggtttattatgattttgtgtataaaaagaagatatatgaatactttttttctcaactttcattttagtttcgggggtacatgtgcagatttgtcacatgggtaattgtatgttgctgaggtttggtgtataaatcatctcaccacccagattgtgagcacagtacttgataggtagtttttcaaccctcgcccccctccagcctcccgtctagtattccccagtgtctgttgttttcatctttatgtccatgtgcacccaatgtttagctcccacttataagtcagaatacgagacatacggttttctgtttctgcattagtttgcttaggattatggcctccagctgcattggtgttgctgcaaagaacatgatctcattctttttttaatggctgtgtagtattccattgtgaatatgtaccacattttctttatccagtccaccgttggtgggcgggtacccgggttgattccatgtctgctattgtgaatagtgctgcaatgaacatatgggtgtgtgtgtctttttggtagaacaatttattttcctttggatatatactcagtaatggggtgctgagttaaatggtcgttcaactctagttctttgagaaatctttaaagtgttctccatagtggctgaactaatttacattcccaccaacagtatataagtgttcccttttctctgcagcctcatcaacacctgtttttcttttttttgctttttaacaaaagccattttgactggtatgagatggtattttattgtggttttcatttgcatttccctgatgattagtgatgatgagcacttcttcatctatttgctggcctcataggtgtcttcttttgagaagtatcgttcatg

SEQ ID NO: 49686 - DNA, 1049 bp, Homo sapiens
taaaaggtaaaataaggagggcaagaaaacacaattttttaaaaaaggaaatggcatagggattttctatttttttctcagccccagaaggtaattactcttacaatgcagaagtatcaccagatactatctgcacaggttttcccattttttcctcacaccactgtggtaaagcagggggatctgtcacctccactgaggagactgaggctcacaagaggtgataacatataaaactctatcagtcatttatggagtggagcagaggctctcaaagttcagcatgcatcatctgtaggtgtataaacactaattgctgggccctgcccctagagtttctgattcagaccatctggttgagacccaaagatatgcatttctaagaagttcccaggtaatgctgatgctactgctctagggaccacagtctgagaaccactggtctggctaatagacaaacaaacaaataaacaaaacagcatttattctttacaaggtacatagagaattgcactgagctgagaggattggtggaagtacatggcctggagtcaaagcaaaggggtcagagtttgcagtgtacctaggcccatgacctgggccattcactcaggcagggggtgacactatatcattctcctaaaatgtaagggaaccagtcactggtccttagaacagctcatgtgggcattggtgatttcatcacatctcttaccctggggagcctggtgggtgagggattaagctccaggctcctgggatctcccttgatcttagctattcaaattacttattattaaatccgtaattcagatcagggtataggaagttaggagatgttaagtaaatcagggaaactgtcttataaatgcttacttagtagtgaaacctggaattactgtaaagctttccccatggtgtctggaatccaccagggctctaagtactccaatctgtctgggtaactgatgctgggcggggtatggcttagttttttaaaatagtgaaatatattacttttaaattatattattactgaaaaatttaaa

SEQ ID NO: 49687 - DNA, 1048 bp, Homo sapiens
gaggaagatctaccaagcaaatggaaaacaaaaagaggcaggggttgcgatcctagtctctgataaaacagactttaaaccaacaaagatcaaaagagacaaagaaggccattacttaatggtaaagggatcaattcaacaagaagagctaactatcctaaatatatatgcacccaatacaggagcacccagatacataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatacttggaagtaaagctctcctcagcaaatgtaaaagaacagagattataacaaactatttttcagaccacagtgcaatcaaactagaactcaggattaagaatctcactcaaaaccgctcaactacatggaaactgaacaacctgctcctgaatgactactggatacataacgaaatgaaggcagaaataaagatgttctttgaaaccaatgagaacaaagacacaacataccagaatctctgggacgcattcaaagcagtgtgtaaagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaa

SEQ ID NO: 49688 - DNA, 1058 bp, Homo sapiens
atcaggtgtgttgcagtgattcacagtcatccacagaccctcaccaccatctccactggaaaatattgaacactcgccactgctagggtagtatgtagtacatgaatggcagacaccggcgagatctcaagtgttacgacggatgaaaattccacctgttaagtctcctttccatccaagctctagcagttggttgttccatgggtgtggtgaggctgatctgattacatgcttatgtaaaatccaaataaagccccttgaatggaaaacaggttaatttgggaagtcactagtaaagcaggttaatttggtaagtcactagtaaagcactaggctcatcaggagttgggtcttaaatatatcctctagaagtcttctctgaagaaggtcttagacacctgaaaaaagatgctgagttcagccagaacttcaaaagttacaaatcacctgtgtaaaattgtcaatattagaaaacgaaatgtctttccaaagattaacttatagatcatattgaatacgtgctggttttgtttaggacaattttgtatttaaaatgtcaagaattactagtcaattttgaaagctgtaaaatagtttgcagtaacagaagacattttaaaatgtggcacaaaataatgtaaacaaaagaatgagtcttttgttatttttacaccctgaatattttttgtgtcaaatgaaaatggctatactgtattttctgattacaatattagaaaagaatgtcatattaaaagaaaaaaaaggaacacgaaaaagaaaattaaagctctacttgcaccttctgctttccttcctgatacccccttccacagcccatttggtgcaggcattgtacttagagagggcaggtcgtgtagggggcgggtggggagtgctggtcttatagtctaagagagaaataagtgattactcaaagaagaaacataaaaggccacagccaagggccgggagtgggtagggggatgcagaccctcccctgtaactgaagatgggtaaactccaaccacaaggcgatgatgccacttgtgggccctcag

SEQ ID NO: 49689 - DNA, 2179 bp, Homo sapiens
tgagtccgaatgtgtttcttgcactccccggactgtggcgaaatggcgtgctttgtgtgtctgtggttggggggaagtgggggaaatgacagcagggaaacctatcggatagtttgttcgtaatcctcctctctcaacagcacttactctccatgttttcgatctgtcatcctgcaggtctgctgtagcaggtggctccgcttgaagcgagggaggaagtttcctccgatcagtagaggtcggtgtgggcgtgggggctgcctggaatgggggaggggttagaaatcgccggcactttggacaggctcttccaatcctgctttattttccttacctccctcccatttcaggctagggagggggcagacctgtgcatgtctgggatagcataaagaggttaaaaacaaacctgataaccggaatggtgaatcaggaaagcaacgaatcaacagtcaacccatcaagtgctccattctcactggctctggtctctctgcagattggaaagattgttgggagtggcacaccactagggaaaagaagaaggggcgaactgcttgtcttgaggaggttagtgcaagggttctagtcaggtccctagggacatctgaggttgtggtgactgagaccccagcagagtctgtggattccattgacattatctaggctttgggcggggtgacctgggatggggagggaaaggctgaaatgagaggcatagagatttcgtcaacaatctacatttcctacctagcattcaattattattatcttgtccctctgtgcagctccctgcatggggcaacacaagcagaagagaaactcaaacccaattttcttcttccactcctaggtcaacccccagaatcagctcttgtggccttgaagtggctgaagacgatcaccctccacaggcttgagcccagtcccacagccttcctcccccagcctgagtgactactctattccttggtccctgctattgtcggggacgattgcatgggctacgccaggaaagtaggctgggtgaccgcaggcctggtgattggggctggcgcctgctattgcatttatagactgactaggggaagaaaacagaacaaggaaaaaatggctgagggtggatctggggatgtggatgatgctggggactgttctggggccaggtataatgactggtctgatgatgatgatgacagcaatgagagcaagagtatagtatggtacccaccttgggctcggattgggactgaagctggaaccagagctagggccagggcaagggccagggctacccgggcacgtcgggctgtccagaaacgggcttcccccaattcagatgataccgttttgtcccctcaagagctacaaaaggttctttgcttggttgagatgtctgaaaagccttatattcttgaagcagctttaattgctctgggtaacaatgctgcttatgcatttaacagagatattattcgtgatctgggtggtctcccaattgtcgcaaagattctcaatactcgggatcccatagttaaggaaaaggctttaattgtcctgaataacttgagtgtgaatgctgaaaatcagcgcaggcttaaagtatacatgaatcaagtgtgtgatgacacaatcacttctcgcttgaactcatctgtgcagcttgctggactgagattgcttacaaatatgactgttactaatgagtatcagcacatgcttgctaattccatttctgacttttttcgtttattttcagcgggaaatgaagaaaccaaacttcaggttctgaaactccttttgaatttggctgaaaatccagccatgactagggaactgctcagggcccaagtaccatcttcactgggctccctctttaataagaaggagaacaaagaagttattcttaaacttctggtcatatttgagaacataaatgataatttcaaatgggaagaaaatgaacctactcagaatcaattcggtgaaggttcactttttttctttttaaaagaatttcaagtgtgtgctgataaggttctgggaatagaaagtcaccatgattttttggtgaaagtaaaagttggaaaattcatggccaaacttgctgaacatatgttcccaaagagccaggaataacaccttgattttgtaatttagaagcaacacacattgtaaa

SEQ ID NO: 49690 - DNA, 1033 bp, Homo sapiens
tatctgtctcaaaacgcacatagaaaaaaaacttttttagaaaagagaattcagcctgtagtcccagctatctgggaagccgaggtgggaggatcacctgagcctgagaggtcgaggctacagtgagccgtgattgtgccattgaactctagcttgggtgacagagtgagacctgtctcaaaaacaaaaacaaaacaaaacaaaaaacaaaaaagaatttggtgtttgactatttatttttgcctttgtggatctatccctatcaggtaatagtacagtttttttcttgctatacttctgagatctgtttgtctacatattttagagtttgttaatattttattttttttatgtttatcattgataactgcttatagttacctttttatgtactatctttaacagattttggtctcagctttgctagctttataaaatcattagtgaactttccattttttcctgttttctggtagagtttagataacattggtattatcttttccttaaaggttagttagaacccaactgcaaaacttttggtttgttttacaatggtaaatctacaaacacatttccgatctcatctgtagtaattgttctagtcaaattttctatttcttgagttaatgttggtaacttctattctattaggaaattatatgttatctttagattttcaattttgatgtcatatgtttgtgtgtaaaattataataataataattataatataataataatttactcatgtgatttataataatcacatctatttgtgtggttcaaccctttaatcataatttgtatgcttttgctttccctgtgttttcttagtcatactcatgatgtttatgtattttattggtgatttaaaaaaaaccaactttttatcactttttaaattacactttaagttctgggttacatgtgcagaatctgcagttttgtttcataggtatacacgtgccatggtggtttgctgcacccatcaacctgtcacctacattaggtatttctcctgatgttatcc

SEQ ID NO: 49691 - DNA, 1105 bp, Homo sapiens
ctagattgttcatgaggtgtcatctgttgatggacacttaggttgtttccatcttttggctcttatgaatattgctgcagtgaacattggagtacaagtatctgtttgagtccctgatttaaattcttttgggtatatacctagacgtggaattgctgggttgtatgatttgtttagctttttgaggaattaccagctgttttccacagtgcctgtaccattttacattcccgtcagcaatatgcaagggttccaatttatccacattcttggtgacacttgttattttccattattatttaaatagccatcttaggaggtgtgaagtagtatatcattgtggttttaatttgcatttcccgaaagtcttatgatgttgagcatcttttcatgtgcttattggccatttgagtatattttttagagaatgtatgtttacgttctttgctcatttttaattgtgtttttggttattgttgcattgtaggagttttaaaatatatatattctggatacatgccccttattagctatgtgatttgcaaatattttctcctgttctgtaggttttttcacttttgatgatgtcatttgatgtgcaaaagtttttaatttcaatgaagcccaatttatctatttttttcttttgttgctggtgcttttggtgtcatatctaagaattcatcaccaaattcaaggtcacaaagatacccatatgttttcttctaaaagttgtatagttttaaacatcagagtaattagtgtttctatcacctcaaacatttatcatttctttgttttgggaacattcgaaatcttttcttgctatttgaaaatatataattatttattgttaactgtagtcaccctacattgctatatagatcattagaacttattcctcctatcttgctgtaattttgtatctgttaaccaacctttcccaccccattcctttccctatattctcttaacttttaattgaaaaaaaaaaaccacaataacttttgcaccatcctaatagtaaccactattctacactctacttctatgagatgagcttttatagcttccacatgtgaatgataatatgtggtatttatct

SEQ ID NO: 49692 - DNA, 1048 bp, Homo sapiens
ttaagcagtcagtatatttgtagaaagcttgttgagttttttttctatccattttgtttctgtatgccagttttatcacaaaataatacttatgagttcacctttcctttctgagcaataaacaagcttaaggtatctaagccttgaaaattggccttggtactattctctaaatttgaagtaatgtctttgttcttcaacaaggtcttaccagctattgtcttatagccttaggatttggggcacacagcagcaagtttagggctgagtgagtacggactgactttgtgatatgctcagtatcaatatacccagcaatttcccaagtaattccctaaagaacagttctagtataccttcctactcctaaaaatcagactgcttttcctattttcctgttgttgtaacaaattaccataaatttgattgcttaaaacaacatatatttattatgttactattctagatgccagaagttcaaatttagtcttgctgggtttaagtgaaggtgttagcagggctggctccttctggaggctgtgagaggagaatccgttttcttgcctttttttcagcttctgcctgtgttccttggcttataatctctttctcacatcatttcagcctttaattttattgtcccacctctttctgtctttgaccttcttgcctccctcttttaatgactctgcttatgttgggactaactgcataatcaaggatagccttcccatctcaagatccttaacttaattatatgagcagagtccctttttgccatgtaaggtaacatattgacagtttccagggattagaaaatggaatattgtggagagggatacattacttagtctattatacaacttacagtgaaggcagtggtcacagaatcaagcaagttatagataggtaaataaatgtggtaaaataggctattcattgagttttgggcattatgtagatatctttaacattcttacttccagttattggcattttaccatctatgaattcacatgggtatatcataataaggggaaaattgatg

SEQ ID NO: 49693 - DNA, 1030 bp, Homo sapiens
taccatacatggaatggcttaaaataataccaatttattattatcttacagtcctggaaggttggaaatcttcaaagggcttcaccacactaaaatcaagatgttgccagaggagctatccctctggcatttctagggaagaatctgtttctttgtcttttccaggttctggagacagcctgtatttcttggatcttggcttccttccatcttcaaagccaacgatgaccagtgtagactttctatgctgcttcaatctgacatggagtccctgccttccacatctaaagtacccttgcaattacattggccaagataacccagaataatcttaaattaaactcagctgaatagcaatcttaatgatcctttgtcaggtaatataaaatggtacatgttctggagaacaggacatggacatctttaggggaccgttacctgccaaacacaatgagggtagtgtctaaatgagttttcaaatggacaacagtaacaacatcaacttggtgtttaaccacattgctctgtctgtcccatgcaggaagcagggaaaggaggggctcaagagtagaggacggatgtgggggtgaaagaagaggattcaaatgagccaggttgctttgtctcggggaggggggtgcacggtgggatcctctcctgagaatgactgctgaaacaataggtagttgtggcaggtggcggagatccaagctggtttgataccagccacatttccacactgccaaatatcatggcaagagaagacttgacagggaaccgaagagaagccaggaccatccctacctggcggcatcaaagagagaggactgttatgacctcctgcgggtcctgacagggaaaggtcctcttttgggggcaactgtggggacggtgcaatgccaacgtgagccaccatttgaaatgagaaacagcggtgtggcagaaagaaatgagtctggtgcagaccagtggttggtttcctagggttagaggtctaggtctaccttcttttagaagaggggcagtggtg

SEQ ID NO: 49694 - DNA, 1043 bp, Homo sapiens
tgttggtgggactgtaaactagttcaaccattgtggaagtcagtgtggcgattcctcagggatctagaactggaaataccatttgacccagccatcccattactgggtatatacccaaatgagaagctacctttcttactttgtcccttccctccagttatccctcccccgctataatgtctgtcaaaagcctgtcgatccttcaaatattttctacaaggccatccaccccctacatggtgacactcctgatccctctcaccaactccatgaactttcaccttcttttgagcccacttcctaatctaatgtgtttataccttcactccagcggttaacttgtactgtttgattggacagccattcagataatcttcatattctgccattaacattcctgatccttccttctctgtgtatctttgtttatccttggcccaggtattcaatgctggttcaggttagtggaaacaccttgcttcagaatcaagtaaatacttcctttgagatgggactgtacactagaaagtttgtcttagaaagagatggtaagcttagaacatactgtttttaatgtgtttatgaccttagcggcatatatttttaatttttaagtcatttactaatggaattggataatgtagtattgcactgttgttttgatattagtaaagaggttaaacatattttcagatgtttattacctagttgtattttctttcttgtgagtggatatttttaggttttccccatttgcctttagaggtccttggtttagaggttttcagaggttcaagaaatccttataaatttctgtgcacacacaaacctatgaacagtccagcaattttgaaaggaaagtaatttggaggttgggcaggaatctaaaattttttttatcaacctatggttattaaaacagtagaactgactcaggaaaagataaatgggacacagagagcccatatataggcatttatactaagacgacagttcagattcatggaaaaaagtgaaatattcagtctgctgtgggtcctcaa

SEQ ID NO: 49695 - DNA, 1031 bp, Homo sapiens
tttcattctgtatactggataattttaaacaatctgtctttaagtttactgacttttttcctgcatgattaagcatgttgttgagctatctgttgaattgttcagttcagttattgttcagctccagaatttgtttggttcttttgtatagtttctatctctttgttaaatttctcattctgttcatgtgtttttaaaatttcatttatttatttatctgtgttatgttgtagctcactgagcttttctaagacaattattataattcttatcaagaagttcattgattttcatttctttggcatcagccattggagctttattttgttcctttggtgtctcatgtgtccttgattcttcatttcccttgaagccttgtgtctctgtcttcacatttgaagaaacagtaacctcctcgaggtaaagatcttcacaagtgagtctgactcaagattttgggggatctctcagatattttgtatggatatatctgctccaatcttctgaagtcttgggattgtgtaccttctcttgatttcacaatgccatgccagctgctgaaagcctcctaattattttctctatggcagtgcaatcttgaagtgtcaagattgagcattttctccaaatctagcagagttgcagtggctggtcatatctgtgtgctgtctattgaggctcatgcacactatctgtgggtgaatgcagggtctcagctcttggggaaggagcatgtggactaatgagggtgtatgtcagctagttggaaggtccacaggtgaaacatcctatgaggttcatgagtggaacttttggtggaatacacaagccagttcataggatccgtcagtttctgaggaggtctcttttggccctgagctctgccaccttgggcaggtgggtggtggggggtgacatgggtatatgaaattgttctacttaccctcttcaatacatctattcctaggttgtttttttgtttttttgtttttttctacagcagggagctcgaaactttcagctggattcct

SEQ ID NO: 49696 - DNA, 1056 bp, Homo sapiens
aacaaaaaaacatgcctgaggaagcacagatgccagacttactagacagagatgttaaaactgtgatcttaaatatgctcaaaatgctaaaggaagacatgaataatgacagtaaaatggtgtatgtacaaaatggcagtatcaataaagatatagaaattatgaataaagaacgcaaaggaaattctggagctgaaaggtacagtaactcaaaagacattcaattagtgcaaaagctgatttcagcaagcggaataaagattcagagaactagaagatagaaccttttaaattattgagtctgagggacagaaagggaaaaaaatgaagaaaagtgaacagagcctaagggacctgtgggacgtgatccagcagaacaacaggccaacttacacattatgggaatattaggaagagaagagagagagaaaggggtagagagatcattcaaaaaataataatggctaaaaactttccaaatttgataaaacacttgaatgtaaaaatccaagaagctcaatgaactagaaacaggacaaaacaaagtgacatatgctaaaacacattataatcagattattgaaagacaaagagtgaatcttaaaagcagaaagagagcagtgactgatcatatataagtgattgtcaataagactgtcagccaatttggtatcagaaacctggaggccagaatgtgttgggtttatatcatcaaagtgcttggggaagagtcaacggagaattctatgtccaccaaaaaatattttttaatggggataaattaagacattctcagataaacaaaatctgagggagttcattttcactagatatgccaagcaaggaattctaaagagagtcatgcagatttaaacaaaaagaaactagacaataactcacagctgtatgaagagataaagatctctagcaaatataaatacgtaagtaatgacaaaagccagtactgttagaattttggattgtagctccacttttttattttttgtatgacctgaaaggcaaatgcataaaaatcaatatttaatgtatgttttg

SEQ ID NO: 49697 - DNA, 1115 bp, Homo sapiens
gtgaatcctcagaattggagaagggagtaatgggaagaatatgacgtcaagagaaggagttgttatctctggaaccttgaagcagggcccaaataaaacgagaatattccaccagcaaaaccccgaatgttgaaagacagataccaataatatggggactcttatccttggcgttggcctgtctaccaagtgctcttctgccaccactcatatcctgactgtcttactttttcatgtgtttgtccataggcctactttaaggctggccaattctgcaagaaaggcaaggaggaggagactggctcacagctctggaggttagtgagaagggggagaggacaatgcaggggacagttggagagagcatggcaggtggcagatccacttccacctgtagtagaagtggcagacccacttctattctgccggatttgcacagtgccagcatcctttttatttcttgcaggagacacgagataggtgtaggttgggttgtgactcagaaaagacctgagagcagggactaggacacaggaaaccatagatacattgaactcttgaatgggaagacagatatttgtcacaggggccagagtgcccacctacctaccaagcactcacactccattctctcctgtatgttcacttgtctgtaggacccccttctgtcagctgtggggcttgacaccacttgaacaagaaaaggagggggaaactgcaccacatcagtgaaggttggtatgagagcgggtatacttttgggcggggtagtggagaccagcatgggtccgggagtgattagggtccaatctgggggcttcttggcccctcccattgccgacacactttcccaccattgttggacctgttttgtaggaggcagccggtccagagagactttctcaaagcccagctgtcccacctagcattcaacatcagtcgcactgcatacgtctcatacaattggaagagactcaaagcctcatttcattctctctccctagatccacctccagtggctgctctgctggtggtggagttgctgctgacaaccaccctcaacgggtctgcacccatccaggaaatatctgtcttcctttagcttggttgtacct

SEQ ID NO: 49698 - DNA, 1075 bp, Homo sapiens
actgggcactcctttagcctttctcactctcagcaagcttacctgccatctttgttcctgtttgatgcagagtaaaagaatgacagtgcttgggcaggacattgttgagcattagtggcagtgtgcaaggtataaaattaagtagcagagttttttattaatccacttctacacaattcatttctactctcctatgtccttctgtgtggctgtttgcatagagaagcacagttagacaagactcaaagccagtttctttcttcaacctcaggtccatctccactggtggctgtggtggctttggattgttggaagaccatcaccttcagcaggtctgcacttgggaacaatcattctcccccagcccgagcgtgcctctgccctctgtatcattgacagaggctgtatgtttggaaagagaactttgtgactgcagaactgacagttgactctaattcttgctaccaagtttttccccgacccagtgaaagagtgttaagacttcgacctaggacacattgagaaccaaggccaagactggacagggccatataactgggcttcaaccatggctgggactaagaataagacaagagcccaggccaaaactgaaaaaaaggctgctatacaagctaaagctggagcagagagggaggctactggtgttgttaggcctgtagccaagaccagggccaaagcaaaagccaagacagggtctaagacagatgcagtagcagagatgaaggcagtgtctaagaacaaggttgttgctgagacgaaggaaggagctctgtcagagcctaagactctgggcaaagccatgggagatttcactcccaaggctgggaatgagtccaccagctccacatgtaaaaatgaggctggtactgatgcctggttctgggctggggaagaggccactatcaattcctggttctggaatggagaagaggctggtaatagtttcagcactaagaatgataaacctgaaattggtgcccaggtctgtgctgaggagttggaacctgcggctggggccgattgcaaacctaggtcaggggctgaggaggaggag

SEQ ID NO: 49699 - DNA, 1025 bp, Homo sapiens
ctggttttattgtggggagggaaagaatggaatcacattccatttctgccacttctctggagagggtcttagtccctttgagaaggagcttggtcatctgtgaaataagacgcaccacattatcttcttcagagtactgtcctgagggataaatgagaaaacctgtcaagtgcctatgggagatagtaggacttcagcacataacaggtctggctatttgccccctccctcccagagagtagatgacattgacctaaaccaaagggcattactgctattgagaccttgtggaaaggtagcagcaagagctgaaatatatccccataacctatgagctttgggccagttctgagttgtgggatgagttacatgtgagagctggggaaaaggaaaaataaatcaccataccatttcctataactgcatctgccttcctatcctcttaatttatcattcagtttgacactggaggagcagtttcccattaactttaaggtagaagggacaccacagggcaatatgacaagaatactggacggaagactagagtcataagaccagacacattatgatccacgattatgttctgttatatggcaaaagggagatgatcagcataggcctgacctaattagtcaagccctgtaaaatcagagaattttctcctgctgtttagagtagggcaagtcagagattcaaagcacaggaagccttcaatgtgccattgctggatggaagaaggaggccacatggcaggcaagtggactagcccccaggagctaagaatatccccaactgacagtcatcaaggaaatggggactgcggttcaatggccacaaggaaatgacttctgccagcagcaagaatgatcttggaagcagatttttatctagatcatccgcgtgagacctcagtggagccaacatgggcaccttgattctagctttgtgagaccttgagcagagaataaggtcatgctggaccagtcttctgacctacagacctgtgagctactagatggatg

SEQ ID NO: 49700 - DNA, 1040 bp, Homo sapiens
tttggtaattctatttttagtttttttcaggaatgaccatactgtttctgtaatatctgtataaatttacattcccagtattgtacaagggttccatttttttccacatccttgtgaacacttaccatcttctgtttttttaaataatggccatcctaacaagtgtgaggtgatatcttgttatggttttaatgtgcatttccctgacaattagtgatattgagaattttttcacatatctgttggccacttgtatgtcttactttgaaaaatgtatattttattatatatggacacatgattattgtacatatttatgggggtacactgtgatatttcaatatatgtatacaatgtgtagtgataaaatcagggtagttagcatatccatcatctcaaatctttatcatttatatgtgctggtaacattcaacattttctcttctagctatttgaaaaaatacattaaattattgtttgataatttagtataatgctatagaacactagagattattcttcctatccagggtctggagtatgggctagccttcaatggatgttaatctagtgtctggagtacagacatgtgcaaagtgaccttggcttaggggcccggatcccagcctagttcctctaattggtatgttttctcagggagttatctgaagagtgaaggtgttttgctaggtctctatggcagtggctctggtgtctgaggcatgggcaggcacagtcaggcacagagctggggtctggagtatgggtatttacagagtagttgtagcttgggggggtcagtgacacatgcagcattgggacaggtggcacctctggtcccagagtggtataatagctgctgcttcttgagatgagaagtgtgtagccacttctccctctctggggttccttgggcaggaatggctgttggttatctcagtggcgaaagatgccagtgtcctctccagagcagactgctggggaccatggtgattcctgccacatggctaatagcaatagcctttgcctttcttctttgc

SEQ ID NO: 49701 - DNA, 1053 bp, Homo sapiens
tggaggctttgttcgtttttttttattcttttttctgtaaacttctcttctcgcttcatttcattcatttagtcttccatcactgataccctttcttccagttgatcgaattggctactgagacttgtgcattcatcacgtagttcttgtgccttggttttcagctccatcaggtcctttaaggacttctctgcattggttattgtagttagccattcatctaattttttttcaaggtttttaacttctttgccatgggttcgaacttgctcctttagctcggagtagttcgatcatctgaagccttctctcaactcgtcagagtcatttgctgtccatctttgttccattgctggtgaggagctgcgttaatctcattacttgttatgtgtcggttcaggttttggatttcttcctggttcaatcttggtaggttgtatgtgtctaaaatccgttcatttcttttagattttcaaatttattggcatattgttactcatattagccactaatgatcatttgcttttctgtgctatcagctgtaatgtctcctttttcatctcttattttatttatttgtgtcttcttttattttcttagtctggatacaggtttgtcaatttcatttaactttgcaaaaacccaagtttttgtttcggtgatcttttgtgttgttttcttcatttttatttcatttatatctgctctgatcttcatttattttcttctaatttggggtttgagatttattcttgcttttgtagttctttaagatgcatcattaagttgtttatttgaaggtttttacatttgatgtagacatttatacctataaacttccctctgagtactgcttttgctgtatcccataggttttagtgtttccattattatttgtttcaataactttttcaacttccttcttaatttctttcttttcatacaggtcattcaggaacataatgtttaatttccacatttttgcatagtttccaaaattcctcttgttattgatttttaatttcattccattgtggtcagagaagatgcttg

SEQ ID NO: 49702 - DNA, 1015 bp, Homo sapiens
aggaatctcagataagacttttttaaagccgagcccagccatggatttgtgccatcaaattcctgtgagttgggtgaatttcctcttctcttgaggttccaagataaacttggggctcctgggcctgtcagaaagtgacattctttacttgccaccggttaggaaccctgtacagagctgtgcagacaaaggtaagaggctactttttccaaggggctgttattggctccgtaaattaggtttgataccttaaaggatagcacaccattccagtcaaagccttggtaaaataaccagtttcttcaattgtgtcctgttacacatgaaaacagattcttattgcacttacgcaaataactatattgtcataagttaagaatactcacaaatagtttccaaattctggagaaattaggtagagagaaatatgcttcaaattttgttcacaggagtatagtttactcaattgttacaagctgtaactagcttgaaagttttcctgactctgaaaaacaaaacaaaggattagcaaggttttaaccaaaaagttaaaaagattactttagtcttctattagttcagttcacacagttaactcctgttctgcttgatattcatgaacatttcagctcttcatgagagtcctgaaagttttttcctctattctaatgtcacaaactccaaagttatcagaaacctgcgtttaacaacgcctgttacacagttctatggctgattataaaaccaccttctaaggaggatcaaacaagacaattgtctgtgaatgacaaaagcttttagggcaaccatagtcaaagacacaattgacaaggaaatttgttacctctgtggcatacaataatttaacataacaattataattattactaataatgtacactaagtcatatcagaattataggagtttcccgtgattttggaacacataccaataacatttatacaaatacatcctaaagaaaaccaaataccttttcatatttgacactgtttc

SEQ ID NO: 49703 - DNA, 1024 bp, Homo sapiens
ctaccagcaacagcctaaatctcagaggatttggcagtgctttatattcctctagaggaggctgttctataattgataaactctgacaaacctctccatctcttgccgattcagccgtatactgctgtcttcagctaaccctaaaaagtcttaatcacaaatatttacataaaaacgttaggtcaaggtgtagtctatgagatgggaagaaatgggctacagttgctaattaaagaacactccacctatagtaacccctatgaaactaaaggtcaaaggaggatttagtagtaaattaggaatagagagcttagttgaatgaacatgaacacaccacctatcagcctcctgaaatactttaacaaacccaaatttataattaacacaaatttatgtataaaagaaggtaagtcacaacaaaataatcatactggaaagtgtgcttaggtaaaccaaaatgtatctgaattcaaaacacctggcttacacccagaagatttcatattaatctgactactttgaaccaaaactaacaaatctcaacaattacatatatttaaatgaaaacattcattcataaaaagtatagaagatagaaatttatttaggtgctatagaaatagtactgtaagggaacaatgctaagaataatttttaaagtacaaaaaaagcaaagccacaaggtagtgatgccttgtagttttcatttacatttccctaattgattaatgatgtttgagtatattttcatgtgcttatttgacagttgtttatcttctatagatgagtgtctattcaactcttttgcctatttatttattggagtgtttaattgaattttgtgatatttttctatattttggatacaagtactttatcagatatgattttcaaacattttctcccaatcaggggcttgtcttttcattctcttaacaatgtctttgtaagatgcagagtttttaactttgacacattccaaattattgatttattcatctaagaaatctttacctaactcagg

SEQ ID NO: 49704 - DNA, 1049 bp, Homo sapiens
gggaatcacattgctctctgtccctgagatcttgctggagacagggctactcagtccctctttgccaggtgagtatagatgcagtgtggtgacttactcaagggcacctagagttagtgggataggtctggcactgtggccaggtatgtctcctgtcccatatccatctgcatgtccattatacacagctgtattagtttgttttcatgctcctgataaagacatacccaaaactaggaacaaaaaaaggtttaattggacttacagttccacatggctggggaggcctcagaatcatggtaggaggtgaaaagctcttcttacatggtggcagcaagagaaaataaggaagaagcaaaagcggaaacccctgataatcccatcagatctcgtgaatctcattaactatcacgagaatagcacgagaaagactggcccccatgattcagttacctccccctgggtccctcccacaacatgtgggaattccgggagatacaattcaagttgagatttcgatggggacgatggggacacagccaaaccatatcattctgcccctggcccctccaaatctcatgtcctcacatttcaaaaccaatcatgccttcccaagagtccctcaaagtcttaactcatttcagtattaacccaaaagtccacagtccaaagtctcatctgagacaaggcaagtcccttccgcctatgagcctgtaaaatcaaaagcaagctagttacttcctagatagaatggggatagaggtattgggtaaatgtagccattccaaatgggataaattggctaaaacaaaggggttacagggcccatgcaagtccaaaaatccagcaaggcagtcaaattttaaggctccagagtgatctcctttgactccaggtctcacatccaggtcacactgatgcaagaggtgggttcccatgatcttggacagctccgcccctgtggctttgcagggtgcagcctccctcctggctgctttcatgggctggtgttgagtgtctgtgacttttctggccatatggtgcaaact

SEQ ID NO: 49705 - DNA, 1051 bp, Homo sapiens
gtgctgtgtggttcattgtagtgccacaaaccattgtaacgtctaccatctccccaccctccagaatcaattttcagccccttggggacaatatctcctttattgagaatgcatggacattgtgatgatggcaaaagctgtaacttcattcctgtcccttacttgatgtatgacactggaatcctttcttagcctctgtcagcctgttcttggtcatctgtaaaaggaactcacaatgccttcctcacagaactgttctgtggggtaaattggaaatcctgtacagagtagatggcacctagtaggacttcaacaaatgtttgtcctggcccaccttttccttccctctcagagaaatgatgactgtcacctaatccaaccagcataactgccacaaagaccaccaggaaatggagcaggaagtagaacattgtgaatgaagcactggggccatttctgtgttgcaggagaactttgctgaaggattgagggagactgaagaagctcattgaaccattttctttaattccttgtcattttctcctcccttgtttgatcttctagattgatattggaaaagcagtttcccattgagtctcaaatgaagagagtgcagatgaagaggaggtaggagtcacaagcccttgaccctcatgctagacccattaccacccacaggaccttgcagtgggatttcatctgcaccatcagcttcttcagagagagaggttgttgagtgagtacgcataagggcataatcctagcaacataaaaaaacgacaagtgtttaagtcctagatggtcatcatctctaaaaggagatcatatgttgtcctttgaggagagtaagagttacatccccactcctgatcattactagatgcctctgcaaaattgattttccatcagtgagtctgagttggtaatctgtaaactggaaataatgatgccttcctcacagacttcttgtgagagaattacacaaggcatacaattgtttccatacttttagctaagttagtgctgttatccagcttttcatcctctgaag

SEQ ID NO: 49706 - DNA, 1037 bp, Homo sapiens
atctagttgtctctcctcttacgatgttaagattgatcactaggttcaaaagttgttagatttattgattataaaaattcccatctgcattatacctcaagtattttgcagcctctaaatgtgtataagtccacatttcattaaaagttgtagcaaggtgatgttctaattctatttttggcatttattagcttgaattattctataaaagaaacatcccctcatcaactataggttagtatagtatgcataggaaaataagatgaatgcttaattcttttgttatatttctacttttcaaaataatgggttgttctaggattcttcagaggggagcagtgagttgattttgttttgttttcttttgttctattctattattattttaaagtgttttcataagctctagatgtttctatatctgatgtgttttaacctattgcaatatttttattgatgttcagatttttctgtctttgtgaatggaagcttctttagctcaacttattcttgacatggttttgagtatgttagtttggtctagactcctctggtaccattcctaccccagacctggagtcagacattttttccaaaggagtctggttctttttagtgggaaatgttttagaggtctcattcttggtactagagttgcccattactattgggttggtcattattacttatccttttcagtgcttaaaaccattaaatatgtattatattttgagataatacacatgattgtctttaatcctgggctgctgttctatccctttatgcataatcatttttatcaatgtttgttttgaccttctaattttaaaattataagcaaatacattattttctcctattttatggtttaaaagtaggctactctacttcagtggagtccaatatgatttctgcagagataaagagtctctgtctacactgttcaccacagtagccactaggtccctgtggttcttgaacacccaaaatgtggtgattgtaattgaagaactgaattatttatttcatctaaattt

SEQ ID NO: 49707 - DNA, 1030 bp, Homo sapiens
tccacaggtttttggggaacaggtggtatttggttacatgagtaagttctttagtggtattttgtgagattttggtgcacccatcacctgagcagtatacactgaacctgacttgtagacttttatccctctcctccttcctaccctttccccgagtccccaaattccattgtgtcattctttgcatcctagcttagctgccatttatgagtgagaacatatgatgtttggttttatattcctgagttacttcactaacaataatagtctccaatcccatacaggttgctggaaatgccattaattcattcctttttatggctgagtagtattccatcatatatatcgatatataccacagtttccttatccactcattgattgatgggcatttgggttggttccacatttttgcaattgcaaattgtactgctataaatgtgtgggttcaagtatcttttttgtataatgacttatttttctctgggtagatacccagtagtgggattgctggatcaaatggtggttgtacttttagttctttaaagaatctcacactgttttccatagtggttgtactagtttacattcctaccagcagtgtagaagggttcccttttcactgcatctataccaacatctatttttttttaaatttttttattatggccattcttgcaggagtatggtgatcatattgcattttggtttttatttgtatttccctgatcattagtgatgttgagcttttcttcatgtttgttggccatttgtatatcttcttttgagaattgtctattcatgtcctaggcccactttttgatgggattgtttgtttttttttcttgttaatttgtttgagtttgttgtaggttgtggatattagtcctttatcagatgtatagattgtgaaggttttgtcccactctgtgagttgtctgtttactctgctgactgttccttttgccatgcaaaactctttagtttaattaagtcccagcagttcatctttgtttttattgcatttgct

SEQ ID NO: 49708 - DNA, 1048 bp, Homo sapiens
aagataggaccctaatcccttctagcttgtagggtttctgctgagaaatctgctgttaatctgataggttttcctttataggttacctgatgcttttgcctcacagctcttaagattctttccttcatcttaattttagataacatgaggtcaatgtgcctaggcgatgatctttttgcgatgaatttcccaggtgttctttgagcttcttgtatttggatgtctaagtttctagtaaggcttgggaagttttcctcaattattcccccaaatctgttttccaaacttttagatttctcttcttcctcaggaacatggattattcttaggtttagtcatttaacataatcccagacttcttggagactttgttcattttttaaattattttttctttgtttttgttggattgggttaattcgaaaaccttgtctttgcattctgaagttctttcttctgcttgttcaattctattactgagaattttcagagcattttgcatttctctaagtgcgtccattatttcctgaaataatttccttttgatcgttttttatttatgctatctatttcactgaagatttcttccctcgtttcttgtatcacttttttgatttctttaaattggacttcacctttctctggtgaatctttgattagcttaataactgacctgaattcttttttaggtaaatcagggatttcttcttggtatggatccattgctggtgagctagtgtgatttttggggattgttaaagaaccttcttttgtcatgttactagaattgtttttctggttccttctcatttaggtaggctctgtcagagggaaggtctagggctcaaggctgttgttcagattctttcgtcccgtggggtgttctcttgatgtagtactctcccccttttcctagggatatggcttcctgagagctgagctgtagtgattgttatctctctttggcatctaggcatctagccacctagcaggctcagtctggaactgggggttgtctgcacagagtcctgtgatgtgaaccatctgc

SEQ ID NO: 49709 - DNA, 1050 bp, Homo sapiens
ttctattctcttcactgctctttcttgttccacatgaggttatatttctttatttcaccccacagttaacctcagagacctggtaatccatatgaccccacagctatgcctcatgcccaaagggcaggatttcatctctaccatcctcttcctcaatgtgaagggctgttgagtgagtacccttagggaacaatactggggaagtataaaattatcatcctccaaataagaagctgctggttccattgtgtgggagggtaggagatagaacctcattgccattctgccagttatctggagagggtcttagtatctgtgagccagagcttgatcatctgtgagatggaactcaccacactttcttcacactgctgtcctgatgggtaaatggaataaaccatatatttttataccattatcttagtccatttagtgttgctataaaggaatatctgaggctgcataacttataaagaaaaaagtttatgtggctaataattctgatggttggaaagtttaagattgggcatctgcttatgatgagggcctcaggaagcttccactcatgatggaaggccatggggagccaacttgtgcagagatcacatggcgagagagggagaagagagatgggaggtactaggcttttttcaacaaccagctcttgtggcaactaatggagcaagcactcactcatcacagcaaggatggcaccaagactttcatgagggatccacccccatgacccaaacacctcctgttaggtcccacctccaacattggggatcaaatttcaacatgagatttggaggagtcaaacatccaaattgtagcaaacacttattgaaattatttcttctgaaaatgatgtttctgagatgtcgttaaataaggtgactttggggctattttgatattttggccacgctgccatgactgttcttgcacacatgccagggactctctgcagtgcagacttgagagggcagagttgacggggccatgcttgcttctctcatatatgttccccattgtctctgcaaaggcagt

SEQ ID NO: 49710 - DNA, 1051 bp, Homo sapiens
atgtactcttcggatgtttttctctgcatgtagtatactaacttacttttattgacacacacacctctaaatccatgttaatctatctatataaattattttacataaatccatgcactacattataatttatgacttaactggttgactaaatatgattctgtttcatattttttgttttggtgtattcccaagtgttggaatttatatcatttttctgagatttatatattgtctcttgatatgattggcttacttctcttgttcatgaatatttcatatttggaggatataaagcatgattgaatatgggttagaaataatttctcccaaatttttatatttctttttattttctattttggctatacagatacaattctatactttataattttttactatttaaaaagcacttcagcacattgttttcgaaagaacaactcaacaataataatgctttaaggctgggtgcagtggctcacacctgtaatcccagcactttggggggccgacatgggcagatcacttgaggtcaggagtttgagactagcctggccaacatcaggaaaccccatctctattaaaaatacaaaaaattatctgggcttggtgatgcacacctgtagtcccagctactcaggaggctgaggcaggagaatcgcttgaacctgggaggaagaggctgcaataagccaagatcatgccactgcactccagcctgggtgacagagcaagactccatctcaaaaaaaaaaaaaaaaaaatatatatatatatatatatatgcttgaagttatatcaaatgttagctgacaggacagaagggaaaaaatgttttgaataattctaggtttagaatcctggaacaatagtttataaggtagtttccctagatcaagttaccagtcttttaatttgtgttccctgatccaactaatgggcataattattggtactggatagaattgttgaaatcaaaatgagatgaaatataaaataccctttatatagtagttgtgtacctgttaatagactaccatccaggttc

SEQ ID NO: 49711 - DNA, 1028 bp, Homo sapiens
ttaacagagcatgtagaaaactctttttggtacttcgaatatgaaggagaagaaggataagggagggagagacagagacagggagaactgtatcctgtagctgaatgggtgataagggggtccaaggagagattttttttttaaatcttcaatttcttgaaacttgaccaagttaaaagctaatgtgaaaaaaaagctatctcagaattaacccttgaagttgaccacatgtttatttcccttatgcttttatatcacattggagctcatgagatacctctgatggaatagaatgggtttgagctcaataggtatttagttattacctaatgaaagaatagacattgtgtgtgaagaaatgctagtaactcttggatttttgtctctcagggaggcagcagatggctgaaattctgatccgatgtggctggttaatgcatgatctgaaaacccctgcactggtgattttgggacagatctagaatataccaataaatatattaacataccaagtagtctaggagcagccactgggcgaacaccaaaccttgcatccctgctgctgtctctgagctcagcaggtaagttcaaagacatgcctgtcttcccagtgtggggaactaaatttgggtcatctcagaagcatgatgttgggcagctcttacgagcttctgataacacccacgaagcagagaaactactgtctacaaaactttgaactcaaggcatgtcacagggacatttgctttcttcaaatagatgtctgtgttctcataagggggagcaatgagaaatgatttttcacaatgcctgccttagcactgaggctcagccagcccctagtgctgtgtcccatttaaaggccatttaagtcccaccccatgccatatactctcaagaggtttcctcatatacccatcagacagctatgtaaggatggtatggtcagtcccatttcacagatgactaacctcaggctcacagagcctaagtcacctcttcaggtaagtggcagggtttgaatgaaa

SEQ ID NO: 49712 - DNA, 1029 bp, Homo sapiens
tatttagacacaacataacatacatttgcacagattgacaaaagtaatgtgtattatgttcattaatttgaaatagctattactgtattctatttaatggtgaaggaagtagttaagtagaaggacacaaaacaagtctcaacaaatttaaaaaatcaaaatcatatcaagtatgttctcagacaaaaatgtaataaaagtagaaatcaataacaagaggaacctgggaaactgtacaaatatgtggaaaataaacaaacagcatgctccagaatgaccactgagtcaagaaaaaaaatatggaggatatcaaaaagttatttgaaacaaatgaaaatggaaacacaacataccaaaatctatgggatacagcaaaagcagtgcttagagaaaaatttgtagcaatagatgcctacatcaaaaaagtaaaaagattccaaataaccaatctaactgttcacctcaaggaactaaaaaaggaaaaaccaaatcccaaatgagtagaaggaaggaaacagtaaaggtcagagccaaactaaacaaaatagaaactaaaaatatacaaaattttaatgaaacaaaaagttagatttctgaaaagataaaaaattgataaaccatcagctagactaaccaagaaaaaaaagagagaagacacaaataaacaacatcagaaatgaaaaaggagacactacaactgataacatggaaatacaaataatcatcagagactattataaacaattatataccaccaaattggaaagcctagaggaaatagataaattcctggacgtataccacctaccaagattgaatcaggaagaaatagaaaacctgaacagaccaatagtaagtaatgagattgaatcagtaataaaaattttccaacagagaaaagcccagacctggatggtttctctgatgaattctaccaaaccttcaaaggagaactaacaaaagttatattcaaactactgaaaaaaaattgaagaggagagaattctccctaactcattttatgagggc

SEQ ID NO: 49713 - DNA, 1890 bp, Homo sapiens
cctacttgaaatagctaccaaaaaaaaaacctaggaataaatttaaccaagtaggtgaaagacctctacaaggaaaactacacaacactgatgaaagaaattgaagaggacacaagcaaatggaaagatatcctatgctcatggcctggaagaattaatatagttaaaatgaccatactgtcaaaggtaatctgcagattcaatgcaatccttatcaaagtaccaatgacattttttgcagaaatagaaaaaacaatcctaaaattgatatgcaaccacaaaggaacccggataaccaaaccaatccagaccaaaaagaacaaagctggaggcatcacactacttgacttcaaaatatattacaaggctatggtaatcaaaacagcatggtattggtatgaaaacagacacaaagaccaatggaacagaatagagaacgcagaaataaatccacatgtttacagacaaaactgattttcaacaaaggcaccaagaacgtacgttggagaaaggacatcctcctcaataaatggtattgggaaaattggatatgcatatgcagaagaatgaaactgcatctctgtctctcatcatatacagacatcaactcaagatcaattaaagacttaaatgtaagatctgaaactataaaagtactagacaaaaacctgggggaaacactttagtacattggtctaggcaaatattttatggctaagaccttaaaagcacagacaacaaaaccgaaaatagacaaatgaccaatatgtgtgtccaccacagagtccagggcctttcctctgcaacaccttgtcagcgtcagtactttcttcattcctctgtagcctttctcacctccctatacttggggagtctaaatggcactactttatgagtgtctgtagagcaatacttatcaaggcctacataggcacacacgctttgtgctagcatttccttttatatgtttatcttcaggacttagtgaagaatgttgattaaaatctggttacaagtactgccatcctgatatttcccttttttcacttttgggcttgaatttagaaagggagacgaaatgagatgcaaagacacaagccagaaggaagtaaagggaaatgtggttgtcagcacacacatacactcacactctctctctcacacacacacactcactcctacatcaaccaggttctgttatcacaatactacaattctctcaacatagttgttgggctccaaggggacccattcagctcaccagagcaaatagccatgggaactctgccctggattacaaccactaccagtgcacagactctgaaaagatgctatccatgtcgtgtagataatagggaatattggaacactctgaataatatggggttgtgaaaattgattatgtcacatccacagtatgaaatttcagaagagagcaaaaatgagttatattgaaacaatgatgagagatgattttttttgcctatcagattagtaaagattcacattatttctaatatgagcagaaaggaactttcacactggaatattagtagtataatgcttttattaaaagtattttgatttcagataaatgcatgggggcaagatggcagataggaggcaggaccagcttgcagctcctgctgagatggacagagcagcatgtggagactcgtactgtaaacctttgctccaagaagtactgcaggaacataccaggaaagctgagagaatccacagaccctttgaagaaactggatcactgttgcaggccccctgagatgccgaaaaactgtgagtctgcttgctttgtcagtggggaagctggtggtctgggacaagttctcagccctggtcactggttgccctgaaatagactcggtgctg

SEQ ID NO: 49714 - DNA, 1085 bp, Homo sapiens
ctccattggaccagacaccacacccccatcccccacagcagtcacagcaagccacacccaaggagaggctgagctcagccatgcctatccctgcccctaccgggtggtctttctctacacaccctggtagacaaagaccaaggtcataatctcttgggagttctatggccctgcccaccgcctgagaaatctgaatacttaaccagctgtccctagggaaagttggcatcctctctgcaggaccacaactgatgcactcttgaaatcaccacctcctagctggaggccaaccaacacaaaactagcacactaaaccaaaatacaaccaaggacccttacagagtccacttcactcccctgctacctccactggctgcaaaacctgaagatggatcacatcacaggactctttgcagacactccccagtaccagcccggagcccagtagctccactgggtggctagacccagaagagcaaaaacaatcatgacactttggccctcaggaagccgcatttataggggaagggggagaacaccacatcaagggagcaccccatgggacaaaagaatctgaacagcagctcttgaattccagatcttccctctgacatagtctacccaaatgagaaagagcgagaaaaaaatttctgctaatacgacaaaacaagtttctttaacacccccgaaacattgcactagctcaccagcaatggatccaaactaagatgaaatcttggaatagccagaaaaagaattcagaaggttgattattaagctaataaaagaggcagcagagaaagatgaagtccaacttaaataaatcaaaaacgtgatgcaggatatgaaaggaaaattattcagtgaaacagcataaattaaaaaaaaaacaattacaatttcgagaaatcggggaacatatagagaaatgcaaaacgcactggaaagtctcagcaatcaatcgaacaagcagaagaaagaacttcagagctcaaagacaggctttcaaattaacccaatccatcaaagacaaagaaaaaagaattttaggctgggtgtggtggctcacgcctgtaatcccagca

SEQ ID NO: 49715 - DNA, 1026 bp, Homo sapiens
atatgtgggcatcataaatataatcaggtcacaattacagtgttttttgtttttaacattttgaacaatgaaatttccacatttaaaacactagggaattgcaaatttataaaacaaatatcctctatctccctccaaggcaaatatactgatttattaaataaatctttttaatatactatttttataccacagcatatgaatgtgattcttagtcaataaatgtatttctacactatcattttgtgactagggtcacagattttcctgatttacaaaacattatcttaatgactttgtcacattattaactttttttattgtttaagccatatgaaacataattgaaatgtatattagaaattaaaaatattctgtctaaatcttctccatctccataatacaaagatggcctgtattaatttattcgtatctattctccagatcttttttctctccatgtagtacactaacttatttttagccacacacacatacatataaacccatgtagagagagatagatatatatattttttcacaatggaaccatatactacattataatttatgactttgttgattgtccaaatctgattctttttcattttgtgtgtgtgtgtctacaagtgttttggggagattaatattggtttttattgcattgtctcttgatataattgacctatctctgttgtttaagagtacttcatacacagaggataaaaacctagattaaatatgcatacagcatttatatattaacatataaaagctaccttatctaacatttgtagtgtaacttgcgtgtttaactgtagtgggtagaattatgtccccctcaaaacatgtcccaaacctaacccacccaaactttatttggaaatagggtctatgtagatataattaagtgaaagatctccagaagtaaatatcctgaatgtaggttgatgcctaactccaatgactggtgtctatataaaagaaagcagagggagatttgacacatgcaaggaagaaggccat

SEQ ID NO: 49716 - DNA, 1184 bp, Homo sapiens
tctgtggagtcagtagtaatgtcccttttgtcatttctgattgtgtttatttttatcttatctctttattaatgtagctagcagtctatcaatcttatttattgttttgaagaaccaacctggactaattgaccttttgtatgtttttgtgcaaataagttttagtcagttcagctctgatttggttattttgtgtcttctgctagctctggggttggtttgctttcgttcctctagttactctaggtgtaatgtttggttgttcatttgaggtcattctaactttttgttgtggacatttagcacttcaccattaaaactggtttagctgtgtcccaaagattccattatctgatatgttttatctttgttctcattagtttcaaataacttcttgatttctgccttaatttcattgtttacccaagagttattaaagaacactttgtgtcaggagttcaagaccagcctggccaatatggtgaaaccctgtctgtactaaaaatacaaaaaaattagctgggcatggtggcacgtacctgtagtcccagctacttgggaggcagcggcagaagaatcacttgaacctgggaggcagaggttgcagtgagccgagatcacaccactgcactccagcctgggcgacagagactccgtctaaaaaaaaaaaaagaaaaccaccaccaacaaaaaaaccactttgtataatttccatgtaattttatagttttgagcaattttctgaatactgttttctatttttattctactgtaatgtagtctgagaggtctgagagtgtgtttggtatgattttggtttgtttgaatttgataaggctttttgtttttgttttttgtttttttctgttttttttgtttttgtttttgttttgttttgttttgttttgttttttttgagatggagtctcactctgtcacctaggctggagtgtaatggtgctgtctcagctcactgcaacctccacctcccgggctgaagtgattctcctgcctcagcctcgtgagtagctgggattacaggcgtctgccatcatgcccagctaatttttgtatttttagtagagacggggtttcaccatgttggtcaggctggtcttgaactccttagggaatccacctgccttggcatctcaaagtgctgggattacaggcatgagccacca

SEQ ID NO: 49717 - DNA, 1084 bp, Homo sapiens
gggtaaatgagaaatcctatacagagaagatggcacctagagaaatcctatacagagaagatggcacctagtcttcaacaaatattcatcctggcccacttttcttctccttcccagagaagtgatgactgtcatctaaaccaaacagcataactaccacagagaccagctggtaatggagcaggaagaagtagcatatacttacatttagtttataaatgaagctttggggctatttctgtgatgcaggatggctttgccaaggaatgtgggaagagggaaaagatcatcaaaccatttctttaattctgtgtcatttttgccccattatttgagcttctatactgatattggaaaaatagtttcctatggagtgtcaaataaagaaagagtgcagataaagaggagagagaagtcacatgcccttgaccctcataccattaccacctacaggactctgaaccagaatttcatctgcaccagtgggtaattcaaagtgggaggagttgttgaatgtgtatccatgaaggcacaatactacaaacgtgtaaaactactaggttttaaatcctagaatgtcatggtgtataaaatattgataattattgctttggttttgaattaggggaaaatatatcctcgtatacttggaagtggctccctcagtatcttttattcttgagcttcagggatattcttcattctaaatgtgtatctctttcctgtgggtggggtaaggaatgcttgaatgttcctgacaatgtttttgtataattgcaggagcatttgatatttattacagttataaatacataagaaatgaaataaacagcattactctaaaacaaaagagaatacctgctctcaaaatatcttgagtatttcaaagagaatacctgctaatgcttatatctgtataatattctttcacaaattttcttatgcaggtacttataaatttatgcagaaatgaatacatttatatacttatctacaaaatataagatctcattctacatttagttttataacctgcttgtctcactaaaaccatacctcaaaggtcattggttgtgagtaaata

SEQ ID NO: 49718 - DNA, 1024 bp, Homo sapiens
ccaggagaaacagcaaatgcacaggctctaaggcaggaaagtcctcagcccatttagaactaaaggaaagcagtgtcgctggagcttagcaatgaagggaaagagtacctgtgtcagagtagtggccaagagccagatcttacagggcctgaagggttttatttttttttaactacctgaatgcaacagaggcatttattggatataatgaggggaggtgtatgctctaattatcttgtaaaatgttctggctgggtgcaatgcctcacgcccataatcccagcactttaggaggccaaggcaggcagatcacgaggtcaggagatcaagaccatcctgtccaacatggtgaaacctcatctctactaaaatacaaaaaaagttggccgggtgtggtggcacacacctgtagtcccagctactcaggaggctgacacaggggaatcgcttgaacccaggaggcagaggttgcagtgagccgagatcgcgccactgcactccagactggtggaagagtgagactctttctcaaagaaaaaaaaaatgttccttggattgccatatagagactggattggagaagggtaagaggagaaaccgaaagaccagttcactgattattcagtggcctaagatctgtgatagatacaaaacaattatgaaacataatttaaggcatcatggggtgtgggtgggagcagaacatgggatgcctgtgcaggtccactgttgcatgtaacaactgctggggaaaaaaaattgaaaaattatggggtcctgtcagcccaataaaagtctgagaaggggagtatctgtagagccagagaagttattgtgaggaagatgaatctgggtctgatctagaaaggtggattggattggagggttttttttttgtttgtttccctttgttgttgttgtttgagatgttctggaaagggctagtgaagtaaagagagtaacctggcctaagaagtgaacaaacagtgcccagtggaagcctttgcaaacctcagcaagattc

SEQ ID NO: 49719 - DNA, 1072 bp, Homo sapiens
gccatcctcgtcctccattttgctgcctgcggaagcctggagatggatctacagggaaaatggtgggctttgcggaagggaggggctcggattgagggcaccccacagggcatactggcttctcaggtggaaaaaaatgaaatgttagagtataaagtcaagtccagggctctgaattttaaaaggtgcctagtagggcctctgtcctcagtgcttatcagtccaccaagaattcagcccattttctctctcttgtctcctaggagtaatggagtccaaagaggaactagcggcaaacaatctcaacggggaaaatgcccaacaagaaaacgaaggaggggagcaggcccccacgcagaatgaagaagaatcccgccatttgggagggggtgaaggccagaagcctggaggaaatatcaggcgggggcgagttaggcgacttgtccctaattttcgatgggccatacctaataggcatattgagcacaatgaagcgagagatgatgtagaaaggtttgtagggcagatgatggaaatcaagagaaagactagggaacagcagatgaggcactatatgcgcttccaaactcctgaacctgacaaccattatgacttttgcctcataccttgaatcctaaaagttttcgctgaggttaatgtgaacactgctttacaagcttgtatttttgtgatttactttttctgtaagccttttggggtttacacttaccagtttctaatggaaattagaattctaattgaatattgttttgtctcagcctaaaagttacggtcagcatggcaattcacctattttaggaaaaatactcttttcataatatgaaatgcataaagcagttcaaaaagcagtctgtattccatcatcttcctttttcattccagtccttatttttgtaagtattacttttcctcctccggctacctggactcaaaatctcagttgtctttgacagtttttttcttgtccctgaccaaaaaagaatgatcatacccagaattcaatgtttgatattttaagaatgtatgttctagtgtttttcagagtgagtct

SEQ ID NO: 49720 - DNA, 1117 bp, Homo sapiens
ttctaaggtgggaaaaaacgaaattaaaaaatcctttgatatcagggctctgaatcctgctggtcagagcaccaagcattcagtctctctccttgcctttgtcttacttgtgttcaaagaaaaacaaccagaaaaaaaaaatctcatcatggcaaatattcaccaggaaaacgaagagatggagcagcctatgcagaatggagaggaagaccgccctttgggaggaggtgaaggccaccagcctgcaggaaatcgacggggacaggctcgccgacttgcccctaattttcgatgggccatacccaataggcagatcaatgatgggatgggtggagatggagatgatatggaaatattcatggaggagatgagagaaatcagaagaaaacttagggagctgcagttgaggaattgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagtgtaagtttctgtcagcagtagtttcacccatttgcatggaaaaatttaaagctaataaagcaatttaaaaagcaatctatacatttattgtctcattaaaaatgtatacttacatataacagatgaactaaaaaaaaatctgagattaaatacactagagtgttaattggtgaacatttctgtgtgttaactaatcccagcactttgggaggctaaggtaggcagatcacgaggtcaggagatcgagaccatcctggctaacacggtgaaaccctgtctctactgaaaaaaaaatacaaaaaattagccggtcgtgatggcacacgcctgtaatcccagctactcgggaggctgaggcaggagaatggcttgaacccggaaggcggaggttgcagtgagccgagatcacgccactgcactccagcctggacgacagagccagacagtctcaaaaaaaaaaaa

SEQ ID NO: 49721 - DNA, 1029 bp, Homo sapiens
gatagaattaggcttccctcttttccactttcccctggtacttatcaaccttgatgtaacatttaaaatcatagatgtctcagaattataatattagatttagaagtggtcttgttgatcatgtgatccgacttcttcatgttatcgagggcaagagctagaagaatccaggtcttttaatttgccttgacttgtgattatgtatgtatgtattttttatcctctacctgacatcactgggcagaaatagggtgttattcatctttgtgttcttattcatgatacttaataaaatctattgcacatagtggatatacaataagtatgtttcaattgacttaagatcagagggatggataaaatagaggtaccattcatagtattgtactctgtaccagggtactatgccaaagttttacaagaattacctgattgatcaaacaatcctatgagataagcaccatttgtagctttatttgcccaagacttcatagccagtaagttgtagaatctggacaaaaataaaattcctgtggctccagattctttgttcttagtcattgtgctatagtgcaaaacaacaaggtgggaactcaaacattttgggtttagaatacgactgatggatgaatttggcatgaaagactaacttttatttcctggaggacatagtagctgggtttgggaagatagtttgggacaatattgtagaaggctctgaatgccaagcatggtatgagaagttacctcccttccctagctctccatctgcaccagtctagatcaccgtatgaggcgcaactcaaacagtacttattgtttgaagacttccagaatcttccaagtcacaatgaatttccccttctcccacagcactttgttcatacctttgttataatacataatattactttctttcttttatgtttttttgagacggagcctctctctgttacccaggctggagcgcagtggtgtgatctcacctcccctgggttcaagcgattctcctgcctcagcttctgagta

SEQ ID NO: 49722 - DNA, 1084 bp, Homo sapiens
gtacacagaccagtgacactataaagcaatcacataaccaagcctacaaaataaccagctaacatcatgatgacaggatcaaatccacacaaatcaatactaaccttaaatgtaaatgggctaagtgccccaattaaaagacacagagtggcaagccagataaagaaccaagacccattggtatgctatcttcaagacacccatcacacatgcaatgacagacatagactcaacataaggggatggagaaaaatctaccaagcaaatggaagacagaaaaaagcaggtgatgcaatcctagtttctgacaaaacagactttaaaccaacagagataataaaagacaaagaaggacattacttaatggtaaagggttcaattcaacaagaagatctaactatcctaaacgtatatgcacccaacacaggagcacccagattcacaaagcaagctcttagaggccttcaaagacacgtagacttccacacaataatagtaggagacttactgacagtattagacagatcatcgaagcagaaaattaacaaagatatttaggacctgaactctgcattggatcaaatggacctgatagacatctacagaactctctactgcaaacaaaagaatatacattcttctcatcatcacatggcacatactctaaaattgatcacacaattggaagtaaaacactcctcagcaaatgcagaacaactgaaataataaacagtctcttggaccacagtgcaatcaacttagaaatcaagactaagaaattcactcaaaacgatacaattacatggaaatggtaattgtattacagttccatgaaagactctcctgaaagattttaggttaaataatgaaattgaggcagaaatcaagaagttctttgaaactaattaaaacaaagatataacataccagaatttctgagacacagctaaagtagcgttaagggagaaatttatagcactaaatgcccacatcaaaaaattagaaagatcttgagttaacaacctaacatcacaaccaaaagaactagagaatcaagagcaaacaaatcccaaagctagaagaa

SEQ ID NO: 49723 - DNA, 1027 bp, Homo sapiens
tttgtttgtaagttggcttgcaagcttatcagtcattctcaaacaggagcttaacttacttaggtgaacagttcatgatgacgcctttaagctgctagaccaacccaaactccgaatttgcagtttctgacctttcaccttgaacctgtgccctttctaccctctattctccatctccttttggttcttgtctgactctttagctgcatatgtaaagagcacagactttgaaacctgagctcccgcgttcgaatccccactgtaccactatctaaacatggcatcttgggcaagtgattcaagcatgctattccttggctttttcatctgtagaattggtataataatagtacttacctccagagttgcagtaaaaatattaaaatttcacatgtgaggagcacctagaacattgcctatcatgaagttaagcagtatattgaaatataaattataatgattgaatttgatctcacctaagacctctggctaataaataataaatgataataatcatttcacctgggatagaggggattgccctgttctctccaggctgaggctgtaatacctgattctagggactgctgatatggaaattactaccactctggctggagtcagaagagtatattaaagagtctctttgtactgtcctaaaataagcaaaatccaacgtttgcagttctatggaccacgcactatgataagtgctttaaacccattttgttgttattgcttcatcctcacaatagccctttgctggttcttaagtgtattaccctttcctgtcctctttgtctgcttaaagcagctaagaaaactcagattagtcagattgcatataaatcaataacttgcccacggtcacagagctaataacaaatagagccaagacttaaactcagatacattcagatgtgtcttggtatttctcaaatatcactgagaaaaaggccaccataaattcttttcaagtgctctctctcccccaactccccaccccaagaattgcctgaatgcccat

SEQ ID NO: 49724 - DNA, 1029 bp, Homo sapiens
atttgcttaaaatcaattagctaggaagtgacagagcaagaatttgaactgtctgattccagagcttactcataaccactatgctgtatgctttgtttatggatgaagattttactttagtcctaatttaaatactactttcttttaaaatagtgtactacaaaaattttcagacagctacaaaggtagagagaaaagtgtaatggaccccatgttcctgtcacccagcttcaacatttattcatatacggcatcatgcttcatctgtacctctatccactccccaacccctgccttattttgaggcaaatcctagacatgtatcattcataaatattttagtatatttccttaaaaggtaggggctcttttaaaaatacaaaaaacctcacattccttataaatgttataaatatgtcctgttaattatatcttaaaattgtatggattctgtagttctcttgatttctttcgtgttgtgtttttgaaggtggaacctaacttcttgtggaacaagtgttgccagctcagaaggcagtgaggagctgttttcatctgtgtctgttggagatcaagatgattgctattccctgttagatgatcaggacttcacttcttttgatttatttcctgaggggagtgtctgcagtgatgtctcttcttctattagcacttactgggattggtcagatagcgagtttgaatggcaggtaagtttttttgtccttttcttgacattgttactaccgaagtagaagtataaacttttcttttgatattttcatctctacttcaaagtaaatttctctaatgtttatccagtcctggagattctctgacatgttttaaggttaagaattggatgggatatctttatttttgctaatgtacctttttgatgctatagatatccttttgtagatttttatgttatttaatacttgcgtaatattaccattattatatattatcggtacctttctgtgcatgaatccaagcaaagttacacttcctaccctataataaata

SEQ ID NO: 49725 - DNA, 1070 bp, Homo sapiens
aacttctctataaattgctagaaatatacagagcaatgagatatagaaaacaccttagcttgttggttattaatagagctctaattttaactgtgaaatcatggagtttctttaaatgttttcctagagtgtttgttatcatgaacattagaaatagcattattccttttcttctaccacatgtcttgaacattcacatgggttaaagaagatggaaactgatactactgacaatcaagctgctttctgactttcataattttctttatattgtggatagcattttgaaggtgaccgtgattctgtaggaagagctgtaatcaatatttttcaaactctaagagtacagaggttagtaagatttcttttttttttactttttgttacgtcaagtagcttattaagaaaaagattcatgacttaaattcttaattctcagttgatacaaaggcttataatcatgtgttttaaaattttgatttcattttcgttccttgaaggttaaagaatggaaactggggataaaaattaatacactgcagctttgccaaggtctgtgatatggttgtaaccttttaaagactactaaagtcataatttgaaatttttactaaaataaaacatatgtgtctatggttttcaattggagtagtctttcttactttcccccttcccctctttggttctcctaaccagcttagaggacccaaagagagcttagggatagacaccagaatactctgtggaggtggaacaacttaacctcactgttttcccttccaagtataggaagagcaaatagagcatagtaactgtatctaaattctctacctgctcttagcaaaagcaaaatcccacagaatgattgcctgctgtctttacctattcttcaaggaaaacaggccacttttggagaccatagagcaccatttatctgtcaaatacttggaaactatttacttaacggtcatcagtaaaaaaccctaaacaaggtcatgatataatttaagaccaattcccctactctcccaataatcacatagtcttattactttcaatttaacttgagt

SEQ ID NO: 49726 - DNA, 1025 bp, Homo sapiens
caaattgttctgacttcggccgttggaatttctttcaggttggctcctgcgccctttcaacaagccctctcatcttttcttttttatgacacccttgttttcctcaccacaagatgtgccaggcccactgtctatcttcccttcaaaaccatcatctatgccttacagtgtgtttgctattgggatatcactgcttctagtccctcttggtgcatatagctaggaaatatatgtatgtactaacttatgcatacacacacctatgtttatttctgtatctgtctgaattacattaagaaaaaaactcatgagtccatattgatacctacaattccaacccagcaccgaaagattcatgttagccttgctcctttccttgtttaaacctttttacttgagaaacctggttctcattatctacaaatatatataaatataaatatatatatatatacatatatatactagattttcaactccagtatactgataaagtagtttcagaatccctaagccatatacccttatgagaaacaaatttatgaactagagtagtgtttgtgtatagttttttgtccttagccctataatatttcatccaaaccctgttttccaaagttacttaggtcagtttctttcttccccatacccttcatcatgtgactaatttgtaatacagctagattcatttgtcacagtttgtagtctatcctctttcccccaaaatcttggttgcagtttaaaaaatttacatgcattaaaacccacttatgatgttatagttctatgggttttgataaatatatgtagtgtgtgtccaccaataccatacaggacaccatcaactccccaaatccctcatactgccccattagagtccaacttttccccccacccttcacctatattccattcatatggtttaagtagtaggatgtaccatagtttaattattaacttgctgaaaggcctgtgaattggttcaccttcttgtctattatgaataaagcgctttaagcattcat

SEQ ID NO: 49727 - DNA, 1053 bp, Homo sapiens
gtttgtctgaaggccatgactaaggctgcagcctttctctgatctcgcttttcctttttggcctgttcctcttggtccctattatagaacaccgaggttgccaggtttaataatgcctccagattttattcagggtccagggctcacttttggaggtttctcctgatacctggggctgattgggtaataaaattatctttttggatcagttgacccttgagggagttgggtgacaggggagtatattttcttaaggcctcccatagccgctggagaaaggcagaaggattttcttcctttccctgagttatggtggacatcattgagtaattcatgggctttttcctaattctccttagtccttctagaacacaggtcaacagatgtttgcaattccagtccccatgatctgagtcgaggtcccagtagggatccattaccggggatggcttgctgaccagtagggaatttgtccctttcttcagctgtcattctatcatttacttgactaagataccagatatcttcaaactcttgggctgcagctaaaactgcattgttttcattaaaggccagggtttgatctaacaatagcatgacatctctccaagtgagatcaaaggtttgctctaggctgtgtaggacatctatatacctatcgggattgtctgaaaacttccccaggtctgccttgatctgctttaaatcagagagggagaaggggacatgtacccaggttgggccaaattcccttccccctacagcttgaaggggacataaccgatagcccaggggtttttgtggtcccttggagatttctttgcttgcttccttctgggtgggggagattagaggaggcttatcattaataggaaggggagctgtagaaaggctagtatatggaggtaagctgagaggttctgctgtgggatgtaaattgcatgctttgcatagttgtggattctccttcaatgaaaagaaagcttgggcataaggtatttcactccatttgccctccctgttacagaaaaggtcaagctgcaggatagtatt

SEQ ID NO: 49728 - DNA, 1100 bp, Homo sapiens
gtgtcagtgattatgtggaatgccctgtgtcctgagtggtataaaagtttgcgggttggtttagttcttctgcttcaagactattctgttaaaaagagttatccattcagaatacagcctgtccccgtggatccacagatcaaactaatttctacaatgggttaagtattccatgaatttgttgtcttatcgctgttttgtttatataaatttgcaatgtaccatattaggaaaaaagaccacaaaaattactgaagctgttagaacctatgaaacctttaaatttatttgtccataaaattttcaagcaatcacataacctaataaatatacctatttattattttatttattaagaaaaattatctgagacatttattgttgattgaagaatgagctccacttggattgtacttattttgttttattttatttttggtcatataatattaagttaataacgaatatattttgcacttactagtaggtgctatctaaaaagaacttctgttaactttttgaaataatttcagacttacataaaagttgaaagaatggtatagagaactcccatataccctttacgcatattcaacaattactagcatttacctttgctttatcattatatatctctcttcatacatatacatatctttacacacacacacacatacacacatatgtatgtatatatattccttgtgatccagtaagagaaagtggcagccatcatacatacccctttaagcctaaacacttcattaatatttcagtgtatattttctaataacaagagcattctattacataatctgagtacaattaccaaaatcgggaaatttaaaattgatacaatactaatacctaacctatagtcagtattcaaattttgccaattgctgcaatcttgaaagggcttttcctagttagtattggtatattgacatcacaaatatttttggaccattaagattaatatattaaataattgtttttagatatgaccgtgattttttcactttcatttgtaagaattgtagattacattgcttaagtttaaatattgtttttggtttataatacctttattctgaacc

SEQ ID NO: 49729 - DNA, 1029 bp, Homo sapiens
ttgtggtttttgcctataaaagtaatggcaaaaaccgcaattccttttgcaccaacctaatatttttacttttttgtttgtttcctttttgtgtcatttatttgggggcagactaggccaataatgattatagcctcttgacatttcccaaggccctcaaaacttggtatcctgtttttgcattctgtgtaatttgaggctattgtgggtgttttaaatttctaggtggtatctatgactatattaatttcctaccttttgtccaggccagtactacaggaaagctttcataggaagttttctctatatctggcatagtagtcttacccaggttctataactcttctagaataaatagtttagtattatagaagatgccagttctggaatattggcacaatcaagacaagttaatttttcccatgagtttatctttttaaacactacgtccaggactactactatttatatggaaataagtgtttaatccagcttttcagatagtagtataagaaggacttttgtttgtcttccttttaaaaaatattttaatagcagatggattagattcaatcattttcataaaagcactgttatgattgaagttttgccagaactgttgattatgaaaaatgaatacactaaaattgtagtcttttatgagattaataattgtgaattagcctaaagtgttttctctaaattattggttttagaatgctaacagaccctcgacctctcaagcagctagagtagaaattcaagaaagaaatggtaaacggcatcaagatgatgagcctgtgaattctcagtatttccaaactacatctacaaatttaagtctgagcaataaaataagaattcttcaaggcccacacgctaatccgtaagtcatttgtattaagtatatgtaaagtatattttttcttttgggttatctctaccctgtaaaataagcaattatcgtagaagctgtattaatttgttagggcccccataacaaaataccacaactgagtgacttaaaca

SEQ ID NO: 49730 - DNA, 1080 bp, Homo sapiens
aaattctgaatagaaccagttgatttgtttttcatttgagactctttttataaggattggttatactcttcttatcctttatagagttgctgtacctcaaccaggagcttctgtacaaacaaagggaattaaaccgggcatgccaagcatcttcaaccgtatgttactatttgttattattatttatgaaaactttatgaaacattattctatgaagattactatttaattactaagcacaagtaatacatgcttagaatgtatactttgcatatagtaatattagcttaggtcactgtcaaaagtgtactgatcaatttggtatcatcccaaaagtgaaagtaattttaaacaaacttatacttaccagtttgtttcattagtaatagtatatctcttcaaatgtactatttttaatagaagaataagtaggaagtttaatttttaattgacaacaaatatggatagctcttaaaagtaaattgtatcttctttctttgctattgggttggctgatttgaactttggcctcatttctgaagtgatttcgtaatacaattttttctggtggggtgtccgtagagtagtttggtttaagtcagatcttatcaggtatcatctctctggattagactttttagcactttatttccttgctttgcttttggtgttattttgttttcatcctccacctagacaaaagtgatactgtcattttattgaatactaccttgttaaatttgatgtctcaacgaacctttccaaagtatttaaatatgacttttgttgattgttacatgatataaaattggagcattgtgaacaagtccattctaaacattttaaatctttttagaaacatctgtccttacctattagatttatgtgggttagttaataatagatttttattcatttctcctgtcatattctagactgattattctctataaggctgaatactttgtccaaaagtttcaatgagcactttagatgatttcagtaaaaaatataatttgcggacttatggagaaaaagattatttttcccagctaagcataatttgaattaaaaaaatgt

SEQ ID NO: 49731 - DNA, 1069 bp, Homo sapiens
ttctaattctagttctcctgccatttccaccacttctgcagttacttcctaccctaaagtgttgaacacctcaaagtcatctatggggtttggaatcaatttcttctaaactcctgttcatgttgatattttggcctccttccataaatcacaaatactttaaatggcatctagaatggtgaatcctttccagaaggttttcaaatttccaggaggttttcagttttcacttttgcccagatccatcagaggaatcactatggtagctatagccttatgaaatgcatttcttaagaattaagacttgaaagtcagaattactccttgatccatgggcttctgaatggttttgtgtttgcaggcacgaaaacaacattgaactccttgatggaactccgtcagagctcctggtcatcagagctcctgagtgaccaggtgcattgtcaataagcagtaatattttgaggggaatctttttatctgagcagtagttctcaatagtgggcttaaaatattcagtaaaccatactataaacagatgtgctgtcattgaggctttgttccatttctagagcacaggcagagtagatttagcataattcttaagggccccaggacttttggaatggtaaatgagcattggtttcaacttaaagtcatcagctgcattagcccctaagaagagagtcagcctgcccgttgaagatttaaagccaggcattgacttttcctctctaactatgaaagtcttagatggcatcttcttccaatacaaagctattttatctccattgaaaatctgttgttcagtgtagccaccttcatcagttatcttagctggattttctgaataacttgcagcttctacatcagaacttgctgcctcaccttgcacttttatgttatggagatagcttctttcttaaacctcatgaaccaatctctgctagcttccaacttttcttctccagcttcctcacttatcttagccttcatagaattgaagagagttaggttagggccttgctaggaattaggctttggccttagggaatattgttgtggctag

SEQ ID NO: 49732 - DNA, 1065 bp, Homo sapiens
taatttgatttgatgatagagaacaacaaaaattgagggggtctttcatctcaatttcgttccctttttgttttccataaaggagtgtcatatataataaataaatggcccctttgtttttcgtttttgttttgtttttttttcttgttttttttttttggtttttttgttttgttttgttttttagtgacaggtctctctatgttaactaggctggtcttgaactcctggcttcaagtgatcctcctgcctcagcctccaaaaatgctgagattacaggcatgagccaccatgcccaacccctaaatggcccctctgaaggagagaagtaatgaagaaggagactgtatttgttcagtttacttttagcagagattaacaaaagtttattttaggctcaaatttccaccaagagtgagtgatctctaatcatgaatttaatttaatttgaatttgtcactgaatataaaaagaacatatgtttaagagcttttagaacatttagaaaaagtagaaagaacgtaattacaaatctacataattacaacaacagagaaaacaatgtcactttagtattttacggtaaaagtttattttgaaagtgaatttagttcctcactttaataagaattttcttttgtatattcattttatattttgtaggtagtggtttgatttttaatgttacttaaactcttcctcattaatgtgtggtttttttttgcagtgaatgacttgatttgattagtttatagatcaattgtgtctatctccttgtgtctttaacaggtcgagcaaatataaatgctaatctgcaagggaaagccagaaaaactataagtgataggtgggagagtcagctgtggagagagaaaaagtttggcttaatagatcacctacactacagccgtgtttatcctgaaagtattccacggaaatttatgtttgaacacagaaagtttcttagtgaccagtataattctcagcctgcgaaatatgtaccaccagaaggaaggcccccaaaacttgatgattttaagagcgcccgaagccttggacattttg

SEQ ID NO: 49733 - DNA, 1050 bp, Homo sapiens
tctagctactatatcatccctgaccttgcattagtcagatatctttgagtccaaatggcaataagggaacgaatagtcatctccaaactcccctgccccggaatagcacctgtcctaaatgaccaaggaaacactctacatgtcatttgtgtgaccatgctgtcctttggatagtaagattccaatcttccatcagtaggggaaaccttttgaactgttatttccagcagtggtgaaaggttgcactggagtgtctactctttcaacaaataccatgtattcataaattgcaatactaggagtttagtctccagttttcaaacacaggttttttcagatctaaagctatctggaacatgttgggatcaaaccagcaaactcggcatcagcaccacatgctaacccactgaacttttaataatgtgtgaactttctttaacaggtctgaaccatgagatagcaatcgatgttgctttcctacccatgtattgtccagaagatattcgaacatctcaaatagacacactgttgacctccatgaattacagctgtgcatatccacaggacacaactggaaatgaccgattgccaggtccaagagcggttgcaggtaaaacaatctcagtgttcttttcactcagaaaaaaaaaaaattataaacagccctagccttaagattttattatgtaaacagttttagccttaaaatttagtgtagttttaattaaagggttatttggtaaatgttccccaagacttataaatgagaatatgtcttttaaataaattgaatagctgtttctactctaggctagcattaagaatattatcttataatacaatacaattccaagtataattatttcatcagacataagtggtatgcacatggaacagtacaaattctactcttttcttcctttttctcaggcgacacaatttgtcctttcaccttgtaattgcctgaaattacaataactctatagtataatacagtaaaattattctctcttataaatgtttagttattccagtgctatgcaataaatt

SEQ ID NO: 49734 - DNA, 1482 bp, Homo sapiens
tgtgtttagggagctttttaaaacacttcatttcagattcattattgaaaaaggtcatcaaaataatttttgtgtataagggaatttaccttgcttaccttactagtatgactattatcttgacttctggtaatttatgttcactattccatttgtgaagtgtactttcattctaaagcctcagtataaggcatcctaacttacaagagtaactttccatggacatttaacatccttccaattttattcacatataatgggaaattttgaattgccagtttgaagactgttctcctaaagtgttcaacctgcacttcttacaaccaaggtagtttgtatcattttcaaaagtacacattattagggtctagttgcccctggtccttagcttgctcagctgcaaaataagcgtgctaaattaaattgtcttaaggtttttccacttcattttgtgactttgtgtggttcgaatttctcagtattttaaccagtgtgttgatgttaaagtcaaaggctgcagtatgtctatattcttgctgtactcattggtagtttcagtatatgtaatgtgagtttaaatagtgaaattgtatctcatattaacatttcaaatgctcatattgaaaatggaaaatagtaaacacgggaattgattttattctggttgtctataatacttcattttaaatgtaaatggccactctgcatttgcaaggcccggtggttgacatctgtgtggtttgttagatgagacaaaatgaccattaaatgagtttatagattattctgtatcaagataaatctgattccagttaagctataaacttgtgggattttcttgtagccctatagttctgtgacttcatttgctatacgctttaaatgtgttgagcagcctatgaacctaaagacatactgcagtttgttcataaatgtattcagtcttttattctttataattgtgtgtaaatgttaactaaacagtggattcctctcgtgttacagttttgagtgaattattaaagaagttaaaatgcaataactttttggtctcctgtctcattttgaatgaatttgatgtgtttccttcatatttttggcctaaatatatacttactaaatgagccaagatgattcttccatatgggtttaaagactgttgtcaaaacaaatctgaactatattagctttttgaaaaattatatgcacattttcagtgaaaatcaagcaatatccctaaaagaactcaagtaactctgatgttattctaaggttattgtacctgacttctagtagcttgagacctagaagttgcccctaacaaggttttaatatctattttgtagatggggaactgaaaaagactaaatgacttaatgtaaattagtaaagacaatttaatggtaaggtcaagcttatattccaaagtctatttctttaaactctaattagagcaaaaagtaaaatgtttgaggctgggtg

SEQ ID NO: 49735 - DNA, 1048 bp, Homo sapiens
atcacacaaaaaaaaagagagagaggagagatgctgctagaagcaacaactgaagtgagaaccttcctccctcaaagaaaattatccaatgtgagaactcaaaaatgagtcagactgcttgattgctaagatctgttccatttccaaaaatttatgacaagagtgaaaaattgcaacagtttagaaacaaataatcttactactatgttaaataatggcatacaaagataatccactgtcaataataaatcataatcagtatctattagttaagaaaataggacagggagcaagatggccaaataaaacccaccagtgatcatcccctccataggaacaccaaattgaacaactccccacacaagaaagcatctttgtaagaatcaaaaatcaggtgagcagtaacagtgccttgttttaacatcatattaaggaaagaggcactggataggataggaaagatagtcattaatttcttacaccacccctccctcatcccctggtggtgcagcttggcacagagagaaaatctgtgtgtttaggggaaggagagcacagtgattgtgggactttgcatcagaactcagtgctaccctgtcacagaggaaaacaacatggggcataattgtgcccatacccatggagggagcatttagaccagccctagccggaggagaattgtccatccctctggcaagcctcaccactgtgagctaaagtgccctggggtcctaaataaatacgaaaggcagtctagaccaaaaggactgcaattttgaggcaagtcctggtggttctgtgctgggctcagaaccagaggacttgcggtgcatatggccaagaaagcgtttgcatcacccctcccccaactccaggcagtacagctcacagctctgggaggagaggaaagattaaagtggactttgtcttaacatttggataccagctcagccacagtaaaataaagcaccaagcagagtcctgaagcccacactccaggccctagatcctggatgacatttctagacacaccctgggccagaaggga

SEQ ID NO: 49736 - DNA, 1029 bp, Homo sapiens
agaatacctgctatagagttaacaatctatgttgctttctagatgtgattggattttgctcaggcactaaaagtctgatgagtgccaagtttatttgtcgtaagtgtgaacacccaaataaatggagagaaatatagatatttatccaagtatatatataaaacaccatgggtaaaagtttccattcaaaagagccagagcaaaaatgttcaaaaactttaagtttagttccttgaataatctactttattacactcttcaaaatttcaaacattaaactaccatctttgaaggtaaatgttttttattttatttcttttgtcatttttttaaattttctaaccacctactgcctgttgatgaaggtgaaggttttaacgtgactttatgaatacttaagaggcaataatggatagaactgacatacttgtcatcactcttataaatttatgtttagggtttcattgcttaagaggttatttttttccctctgggatacttttcctgtagtttagaacaatagataaactgatgattcagtcatttaaattaaaggaatgtgctgtgcttgagatccagactacaaccatgaattttccaacctgtatttgcaaaaatgtaactcctcgttcaaacagctaaacttaatattaagttgtcaagtatgtgatttgtcaaaataagcatttaaaaaaaaaaagaagggaattgttgcaatttgagacctatactctctaatcattaatttttcctttattggcttcttctaccttaccctttcatttacacattgatttgaatactccttaactttccttgaatcctatctatactcatctgttctcacgctgctatgatgaaatacccaagactgggtaatttataaagaaaagaggtttaattgactcacagttctgcgtggctggggaggcctcaggaaacttacaatcatggtggaaggcacctcttcacagggtggcaggagagaaaatgagtgctgagcgaagggggaagccccttataaaacca

SEQ ID NO: 49737 - DNA, 1030 bp, Homo sapiens
ttattcttttgccattgaaagttcctgccacacttgtcaaagaatcgattgactgtagataaatgggtttatttgtagatgctcattcttgcatatgtccattcttatgcctgtaccacagtgtttttattagtgcaactttgtagtaagttttgaaatctctattccttaagaggatgtggtcatcttgtgttttgacagagatttccttgaataccaagagctcaaaaaagaaataagtaaaaactctcagtctttgaaaaaaaaaagtacatttttgttttgtctaaggaaagttttcatatagcagattcactgggttttacctgtcaaagagtaggctcactgagaaatgggatctagggccgggcattgtggctcacacctgtaatcccagcactttgggaggctgaggtgggcggatcacctgaggtcaggagttcgagaccagcctagccaacatagtgaaaccccatctctactaaaaatacaaaaaaaaaaaaaaataactgagcgtggtggcgggcgcctgtaatcccagtttcttgggaggctgaggcaggagaattgcttgaaccctggaggtggaggttacagtgagctgagatcgcaccgctgcactccagcctgggcaacagagcaagactccatctcaaaaaaatttttaaaaaatgaaaaaataattatcaaaaagaaatgggatccagggaaaataatgcttggtaagaatgaaagataagagatgtttgcaatgcaacatggtgaggcataatgggttgagttggaagtcataattgcttgggttgggaggcattatggacagccaagagggaagtcagaggtgaatggcatcagttatgcctgtagtctggatattctcatggtctcccctgcccttcacattgagataagtttccttcaaaatccatgctttcctagatctctgcattcccagggagggcttccattctccttgcccccaaccccaccacaggcttatttatggttctctgaaaagaaagagttccac

SEQ ID NO: 49738 - DNA, 1027 bp, Homo sapiens
ggttttctttggcccctgtggatatttaatccttttcctatgcgtctaggaaaaatgtgaaggcatgaaagctttattttctccttgtgttaatccttctgccctctgcataatgcagcaccccagaacctgaggctatattgggagaggagagggggaggacaacttagttttctactgattgatttctattaagtccaacatggataattgctgactggttagattttcttgtttctggcttaatcattagcttcttgtttcctagatattctgaaatcttcattgaacataatcacatttttttttatggagttccccctatctttgtttttcctatactgaagaaatggtaactgctccctataactgctcccccaggtgactcttggttgatgctctcttgagcagagtagcttttcttctaacataaggatcatccttggctgtctggttatttaggaaacacacacacacacacacacacacacacacacacacggagggggtgggtgttaaaagtgctgaaatcagagaacttggatctgaatccttaacctttctttgccccaataatctaatctgtaaagtagtacctacccatactgttgttatgaggattaaatgagatagaagtaaagttcttaggatcttgtccaaaacataataagtacaacagtaaatgttgacaagaaggggtggtgataatattgcagaaaatgtggaaaatttagaacacggaagggagaagatatgcctcttaattctgccacctgacataaatgtcacattatcatttctgacctcccagatatttgtgtaagatacactttttcaagaatgtttaatacatttatagctctcttcacttagcaatatattttgaacagtttctccctttaatatttagtatatatgattttctttttttattattaaagattttaatttattttttagagatgaggtctcactatgttgcccaggctggagtccaatagctactcacaggcacaatcatagcaca

SEQ ID NO: 49739 - DNA, 1029 bp, Homo sapiens
tttgatccttgggattaaaatattaagcaggaaggaaagtaaagtgtgacatttttatttaaagccaagatcttaacattttaaacaaactgattgccagggattgccagttaacagtgctttgcagctcacatggtgcagactaagagctcttgatttccttagtggattactcgttagtaatgcattcaaaagtgtgacacatgttcttcttgttgtggaaatagaatgaagagctacaaaacacagatgattaggaagagctaattcagaactttctaaaagccattcaaatcttcaatgactgtttctcaacaacctcttttatttcagtaacttcaacagaactgataagctgagaacttgagttatgttatccagccagatatatgggttggtgagtcccatgtaattgctagttaccatctgtaatgctagagacagcctaagaaacatccccccaactagtagttgtcatatttaatttgtcggtcattattttaatatctttctgtgggacttagaaaatagtcacatttgaaataggcaggattttctttccaaaggtgggtataggaaaactgcctttagtagacaacttattgctacctgatttttttttcattatcattgtcttatagtgatggagtattttacaattgagtgtctatcacttctgtgttggcagggtttggggagtaggtagagatccctgtgtgatattcatttgtacagtagttctctcctcaaaaggtgtagagagttactttttctagccctttttatgctttgttggtcactgaatttgttggcctttgagtatggttggtttgggatacttgaactaattgatcatgcatttgccttgggtaagtaatcattccaagcgaattggttaccactgatgttatgtgcttatgcagtagtagtaatggagagtacagggtatggttggtttagatcaaggtacaaatgttacctagattatggttcaaaccttattatgtggtcacaggttctcacttatcc

SEQ ID NO: 49740 - DNA, 1067 bp, Homo sapiens
ctccatacttgcaactccaggattaggtcagggaggggctgtgcaggacatgggtagaggctagggacatgaaagggtggttgtgtccctcttatttgttttcatgactactagaattctcgtctggcatgttgcaccctgcaaggccacctctgggaagtactcctgtaaatcagagtgacttgattgctttatgaacatatcatctgaatggtgcaaattgatttagataaaactgatttagttaatcccttccctaagagcagggaaacttgcttcaactcgcagatcctaaagtggtgccagtggagtctcacaattgcatccaaatattgctctgagtagtgagcctgtccattccttcatccctcctcccataaaatctgctgacaccacaataattgacaagggaactacacaaggagtatgtctgtcttcatcattcagcaaacctcattggcttggtgaagaggagagaatgttgtcttctcattctatcccatagaactcaagctctgtcttttcagacagggacacagagcccttaaaagggtgaagacagggctgtgggcacagaatatgtctcaaatggctgctcttggaaatacctgcttggtcttgtgtgtgtctgccattcaatctttatgaatcttggtaatatccttgctgttaggccatggggctcggctgctagtagaggccagggggtgctccatttccatttagcattaagtttttgtcctctctttggcacaaaagcgagaatgaagctctgtgttcatgaagcactccttactcattaagctgggtgtcttgacttagaacattgcatcatcaaaatatgagatgtaacatgttgatactggatatacaacagttttggataattcaaaattgtttacattttgataaatgaaattttggtaccaagatggtgttgcactaacatctgtacttcaggtctctcaaaaaatattgtgttcatcactaagcagtgtacagaagagactagaaaagtgtttctcaactggtgtgttgggtcatgctagcaagtgagaagaccagat

SEQ ID NO: 49741 - DNA, 1031 bp, Homo sapiens
caggtactaaatcacagtagctaaatataataagaacaaaacatttgagaccagatttatgctctttaaggtctggtggtaatggtggtgaacatgtgtgtgtggggttggggacagtatctgacaggtttctcagctaaaccagccttcaactcaatgctcataaaatcattcttgcttgtagatctgccttctctgtggtctcttaactgttccagacttgctccccatcacatacaatatgtgtaaatctgtacatatttcatgtgtgtatgaggataaaacacatttcatttcatctctacccaaactgtgcactaagactcatttgaacccctattcttttctctgcaagacttatattgatttctctgtctctgaactcatttattattaacaggaccctgttttggaagatgttttccattgtttctttggtttgagagcaagtttagcaagtagatactcctattatctgtacccttatctttctgtttttctgttatttcttttggctcaagttttctcttcaccaatatttgaaaggagctaacaatcgtttgtttgagaacaatttacaaaatgttgacacagagattgttcttgggtggatagaaatcctgtctgttattgttgggcaaagaaacatattacagaaatataatataggtgaggaaagatcaaggaaacaagaattactgaacacaaagaagtgaggtttaaagggaaaaatgtgataatggccttcaagttcatgaaaggttgatataatgaggtaatgccttattctttgtctcacatgaagctagaactgacaataacttaaaccgtagcatcagggatttaggctagggattcattcattcatttaacaaacaattaatgaacattcactttgtttactaaacactttgaccactgtggtaggagctgggacacaggaaataaggcacaatcccagtcctaaagggactttgaacttagtaggggagatagacaagtgggaaattccagttcagtatggtaagtgc

SEQ ID NO: 49742 - DNA, 1124 bp, Homo sapiens
atttgcatgattgaatatagagtaacagctaatagtgaataaaatgtggttagaaattataatcaccttccttgttctcatcaaaaagactattaagtacagaacaagttgtagtgaaaatagcaaagtaagcagtttatttttatagctcattcactttaggacctctctaaggtctcatcttgccactctgaagagcttatgaccctggccagcctcacccaaacatagcctgttccaacctttcccagcccatcctgccaatcaaacctttatgttcagggccctactctttttaagtgacaagtctcataaaactatccatcattgtgttaatagggaaggaaccactttggctttttaggtaacaagcagtgttttaacagttccgtcctgaagttagtattcttgcctgagtcttaatgaggtgacactagtgctgccacatgcaaatagagtaaggggaaagagtagcccatacagtagatattcaagaagtgttcttttatggatgcttgctaaatccgatcatgtaagccactgtcggctctggatacacaaaaggtctgcttttactaatccttttttatgcctggcattgtaccaggtataaagaaaacagcataggcacagtatctaccctctgagggcttacatgctgcaaaaatccaccctgatgtggatacacatgtgcaagaaatacagacaattgaatataaacattaattgagaactgggaaagaatagtgagatattgttgagagtgagaatgtattttgggatttaacttcatagtctattgggtttaggattctgtctttgatgacagggaccctacaggatggcttatggaaggccatttctgtcttctatgacatcatccattctgaaaggttagggatgtgcccttaacttcctctttttttttttttttttgagatggaatctcgctctgttgcccaggctagagtgcagtggcacaatctcggctcactgcaacctctgcctcctaggttcaagtgattctcccgtctcagcctcccgactagctgggattacaggcacacgccaccatgcccgcctaatttcttgtattttagtagagacgcggtttcaccgtgttg

SEQ ID NO: 49743 - DNA, 1074 bp, Homo sapiens
gaaggatccttaaagtgtgatctgggttaacactttagctttgatgctgccacagcaaatgctatgtctgttcataaacattgtgttttcttaaatgcatcattttaagaaagtaatgaattctttgcagctcagtaaggtgacaaggctgttcataataatttcttgataattcatcagatgtccaatttacctctcacttttccttctcatctcctttgcacagaaagtgactgcttattaaataaagccaaactcagcctcttttttctgttatggagtctcagaaggtgggatagtgatcacctgagtggtcctgggcaataatgggaagtgggaagtttgttgtgtccccctcccagttcttcatgtactgtgtctgccttctctcttcaccttgctctcaactaagatgtcaattaacaattcttaaggtgttactataatgctaagatcctgacatttttatccaagtactttcagagactcaaaatgacagcacagctctccataatatatctccaacccttgtttctagccttgtttgcctccattacatctgtcaggctgatctgctttaaccaagcacgttttctatttttctgcttatgcttttgctcatgctattcatgtaattcattctgcctaaacttgtctccccttaagctccatttctagctgcccaagtcttgctcatccttgaagaccagctcagctacatgaaactttatctaatcctctgattgtccttttccaaattttctctttcctatgatctcatacacctttaattgtattctattatattacttgttttgctggtctttaaattataattagttgtattcacactcatagtctctactagactgtaagtgccttgaaggcagaagctgagtcattttcatcgttatatcccactcagggaaacccagcactatgctggatacatgtgggatatactgtggtatgtgggagacactcaataaatgtttgttgaaataaaaacttccccaaatgaactttaatgccaaaatttcacaatattctggtgaaagggagatctatttgggc

SEQ ID NO: 49744 - DNA, 1064 bp, Homo sapiens
caagtaatatgcctgcctcagcctcccaaactgttgggattacaggcgtgagccactgccctcggccaacaattctttttttcttcaaatacgtgtatacttcaactttgttgagactgctaaggcctgactcctatactttcttccgacctaccagctatttcctgtcttcgcttctttctttagcctatttaggatctgtgatttctcacttcagatactctcttttcaatattctcaatccccttgccccattgtccttttaacataccaacctgataaagtcctaatcctgaatcagtcccactttttccattcctatatttgagttgcagcaccctactggagaaaatcacataaccaaagaggttggtactactgcatcacaaatgtatagcttctaaacctcacctgggccttcagtgctaacctgaaatccttctgcattgctttggtcagctttctttttaacttgtcatcataatggctatctcaaatcttttgtacttacctcaaaattccaactctgccacttttctgcttatgctcagtaaatgccctcttattttacaaagaacagtaagtgtgaaatagcgaattcaacttctcatatcaaacttctgaacacacttaggtccacatccattaacttctgccttccttctgattaaaatggaagagatgtctcttcatttgtgctttggccaaatacactcttttttccatagcttcaatttatccctctctatagttgacttcacatccatttttaacccactcatgtctttcctacctaaaaccaaccaaacaaaaaaaccccatgactttcctctacttcatatcccctccaattatcacctgtccctctccttccctgcacagcaaacttcgcgaaagactttacatttcttcacccctaatttactcttctgaaatatttaaaatgtatttatatccaagtaataccttgtgcatagttagaaagtaaaatattactataagtcatattgcaagaaatagcaatctcctcattctcaatgtctgctctctgataataccattat

SEQ ID NO: 49745 - DNA, 1138 bp, Homo sapiens
ttctcttctttgtttatgggactttgattagtgaactgttggacatcctagactttttttctctaattttatcttttccattttccatgactttgtcttcttattttactaagatacttccttaatttttcattaaatccttctattgaaattttaatttcagcattcctaattttattcacaagagctcatccttcaccttgtttcttttttagcattctgtttttgctttgtggatacgaactatttggttttcttcttgagaatattgtcatttttaaaagtttgcttctaaaccctgcattgtctgggtttcctcccagttccttttctctgttagtttaaattgctgtcttttcctaaatatctggcaaactactggctgtgtgtttgagtttaagcactaaaagatgactggaaactctgagtggatgggaataatttatgggttggtgaactttgctataggattataaggcggaatgctggctttttattgatggactcccaagtgtcagttctgtaggtcttttctcttgggtcagtttcccttggatgaaatcctccaatctcctgcttttgattggaggggcagcggtgtggaaggtataagcctggctgccagcattctgggagccaaggagggaaaaggagctgagagttttaagactgcttttagtataatgtcaaagatcagcagaaagtaaaactcacatatcctgccagaatgagggaagggtagtctctggtttagtgtgcatggatctgtggatctagttgttcctcatgcaaactttcaactttctgtggcactaaatcaacttgatgttgttggcttcctgatctagctttctctggactgttattggttaccacacattcatccctttctagcttccaaacatttgttgacaatcttttacttgttggcatctcttttccattctctttgtctttgtgggtttatgacatttcattctttgactgttatttcagtgagatttcatgaaagcaaaaataaaacatatattcaaaccactgtatttaataatctctgctctccaaccctctgaaatgttttgtcccactaccacaccattgaaagtattcttttcaaggtcatcaaatgaataccttg

SEQ ID NO: 49746 - DNA, 1027 bp, Homo sapiens
caattggttagagccagccgggaatttcgtgcgggtgctgaaggagctgcgggagccggagaagaatgaaactgcgtggagtcagcctggctgccggcttgttcttactggccctgagtctttgggggcagcctgcagaggctgcggtaagtccttcctcccctcccccgcgcccatcaccgctctttcacgctgaaattaccttttttttggggggggggtccctttatcttccttttggcgttgactagggaattcaaatttgctttctcatgtttaggaagaaacgttatttgcaacaccggtaactcaagccttctgaagtccaacggagaggtttaagtgcttaaaaatagggctgcttgcttccctgcagctagctcctccgggggcaagagcaaagtcagaagtgggggacgctaattaaaggctcactaggctgtggtgggtatttaaaacttttcctcccctccctccaccgtcgggtgtttccctgcctggcgactaaccttttcactacttgtacccagcccactctttgaattttgtctgtagtttaatattttggctcttcgaaaatccagcttccatcaaagtgtttttagcgcctcagtgaagttcgtcccctttgctctttccttaagcaacaggaacctacccccacctcaggtcattcaagccactgacctccttttcccttttgacatccttgttacaaatgaaatgctaaggcaacataccaagaagagtgaggtaaagtctcaggcttcaggtcttttgcgtctttttgttgttgttgttttttctaaattatgggtttttttgtttgtttacttttttttaaacctaccaaggcatctgaacaaattgagaatttgcccatcacctattcaaaggaaaatactcctttttcaaaggagaatcagtgttccagtttaaaggaaagtgggggaggaggtacatgtgaaatagcagcaaaaagctccattcagttttaggaatgtagaattcaaacctcagtatatct

SEQ ID NO: 49747 - DNA, 1050 bp, Homo sapiens
ttggataaaactgcaattgtgctgttgaaaatagttcattttaaaaacatcttcttggtgccctctgtttctggcatttggcccagggacaaagattttgtagatgtttgattaaatatatatatgttttttgatgttacttttaacaaatttgcaccagatgacaactatacaggtatgtatagcaacactacacatcaattaatattaaatcaatttatgttaacaatgaggtttctttttattgacaaaacttgagagcaagcttgttttcttggattcttaaactaatgagtattcatgaagtcattacagctctttcccttttcctcctatataatttttaaagaacattttatatccccttttcctatcattaggatattgtgcctctattaaaaccaagggtttgtttttcctggttcatacataaatattttaataggctcaaaaatatgaatgatatcggctctgcatacttgtgctggagatatcggtgaccatttctagagtaaaactggttggtggtagggctagtctttgactggagtagtttagtattggggtttttatatcaaaaaagtgttgctatttaaagtgctttactcttttataggtaaatgatttctttatctctgaaatcatgccaaattggtacatcacaaatatgtggaagatcttttttttaggtagagcattcattaggtggaataaagtaacctctatgccaaaaggttagtaataagagaagacagttttaagttggaaatataatttttagtgatggaaataacatttttatgtgaaggtaattatacctgtactgattcactgtcagtgggatatgcacttagatttgtggatgtgggtagtatgtaaaattatgttagttttattttacatagttagtaagttgttttctgtgcagtagattggatatttttgtctactttaaacgtactatcttccttgtgaccagcggcacgaatttatcaagggtaggagtgttgtttgtagccatgaaacacttcatcctctatgaagtatatt

SEQ ID NO: 49748 - DNA, 1029 bp, Homo sapiens
cccttcctacccccatcctccatccccaaataaccactgatctgctttctgtacagtagaaagtttcattttctagatttttatataaatgcaattatatgatatgtatacattctttgctctgacttatttcacttagcataattattttgagattcatccatgtcatggtgtgtgtccatagtttattattttattgcacagtagaattccattgtattgatacaccacactgttgatggacatttgggttgttttttgtttgtggctattaaagttgctatgggcattttcttgcactttaaaagtactaaattgagctataatttccataaagtgatacacagtgatcttaggtgaacagctcaattattacttaactcaattataacttaacaaagtgtataccaatcatatatactttggtaactaccaaccaagtgaagatgtagaacgtttccattaccttggaaaggtccctcatgcccgtcccatttcaatgtcttttgtgtcttgtctgaataagccacaaggttgtgaagatacatgttttcttccataatctgtatagcttcagattttgtatttatgtccatttttcttatatagatacccagttgttccagtattgtgtatttaaaagaaaaattcctttttttttcattgaattaccttgaggactttattgaaaatcaatggaatgtgtatatgcaggtgtaggttgaaactcactagtctgttctattcacctgtttgtgcatccttatgccagtatcacactgtattgattactgtggcattactttggtagcataagtcctttacatttcttcttattcaggattgtgttagcttttgtgttggctatttattccatataaattttacattaatcttgccaaattttgcttaaaaaccttttgaggttttgataggaattgtaacaattgtgtagatcaatttaggaacaactgaaatcttaaaattattatttttttcaatccatgaacaccatatacctctccatta

SEQ ID NO: 49749 - DNA, 1067 bp, Homo sapiens
gacaattaagaaatagcctctattgctcaaagtctcaagaaatactggaaaaaaatgcatggatactttattgggtgcttgttaaattattaaataggtgacaacttaggggtgctggctaaactttttaacttcttgtttggccttgtacagtttataaattttagaagtaacactgagaggacagaaaatatctagaagactttttaaaggtgcatacatatatatacacacatgcatttcagaccaacgagtgagggatgagtatggcaggaggagtggggacagaggaccgaagaagaatgagaggatgttgggaggtggagagagagataagaaacaaaataattagagaaaaattaaaaggtgtatttattaggtatagggtgaaaaaatttgcctaattcctgaatttggatgatttcagagtgttcttatctggttctgtacccaaaataatttattcttagggattctgtgagggattaaatgacactagagacaaacgatgaggcaatgagaaaattatgaagaaattaaggagaagagcaatatcttcttatttgctataattcataatacatggatgtttgagaatcactattatctagtgtataaggctgacttgttcccattatttcctaatccataatgctgctccttttttaccccataatccttcccttaaaccacatgtgcatcatttctttcatctggaatggatgtcttgtgtttcaaaaatgttttaccttatcactcttattttcacttctgaactaaaggtacattgcttgtataaccccctttttgctgttttgataaggtactaaattgaataatgtacctttaggccagagagcagtatagggcaagttacttagtttgtgagagagcctaggcaaccgattgctgaacagctattatctccttgtgatttcatttcctttgctcattattaggcacactataagtattgtgatattttctttggaaaattttggtcctaatcagaaagccatctgctaacaattgtgctggaagtgaagcagcatgataaagttaccttt

SEQ ID NO: 49750 - DNA, 1046 bp, Homo sapiens
ttttttatatgcaatgtacaaaataggcaaatctatagagacagaaactagattggtggttgcctaggactgggtgggggatgtggttggaagaaaatttgaagtgactcattggtatggggtttctttttgggatgataaaaatgttctaaaattgattgtggtaatggttgcataactctgtgaatatactgaaaaccattgacctgtacggaagtcatagcccaataagctgttagagaaaaacaattgcagaaaccaatacactttctcctaaatggttcaacatttatattaataactagggttcaatattggtttatgcattttagttttgatataaaaattccataagatgaaatgcagaaatcttaagtgaacattcactgagttttgacaatacatacatctgtgtaatccattccccatcatgttatagaacattaacatcaccgttggaagttccctcctgtcatccttctagtgagttttctcctatgtaccacctaaggcatactttgatctgattgttttccagcacggaattatccacctgatttagtattttacataaaatgcataatttaataggtacttttttatgtaagactttcactcagtatgctattaatgagattaatccatattgttgcatttctttagtgactgagtcatattccattgtatgaatataccaatgaagatttatttttttttaattttttttattttttgaagttttaaagctgggcatccgggggagacatcacatgtcagtaggttccgtgatgccccacaagccgcaaaaccagcaagtttttattagggactttcaaaaggggagggagtgtacgaataggtgtgggtcacagagatcacgtacttcacaaggtaatagaatatcacaaggcaaatggaggcagagcaagatcacaggaccacaggacccgggcgaaattaaaattgctaatgaagtttcgggcaccattgtcattgataacatcttatcaggagacagggtttgagagcaaccggtctgaccaaaa

SEQ ID NO: 49751 - DNA, 1092 bp, Homo sapiens
taattactgtactctatacttgaggcagtacagttcttttcatctccagtatttcttcaggtcaatgtaacccttgtcaataataataatttttaaaaaaaattttggattcatgaggactaatcgtgttcttcattttagctagggcaaccttaaagtgataagaccaatgtggagttggtttgcctgatacatttcatgttaaattggactaaatttttgtgcctcttctggttatttgtttatttttatttacttatttatttttgccagtgtgctttaagaaacaaacagaccactaaccaaagtttcaaatttgaagggccaatgtatctataatcagtacagtgtgctatatgattaaagggagcattgattaacttgtgtttcaggcttccaattatgtgagtaacaaattttaaacaaattaaattgatttattatgcatatttttaaagtctgaatgcttttcttatatttcttactatgtaagtaaaagaatgaactttaaagttggagccacaatgtataggtttttttctttttctgtcttttaaacttgatgtctaggccacttcctttctctcgggacctactttttccatgtgtaacaaggtggagagaagggtattggactcacaaagacacacaacagtagtaattttattctttcaaaccttctgatgaagttgtttctaggattaccgtggcatacaggtatttgaaaggaggttgctttggtgttcttctacagcaatttcagcttttgttttctaaaccaagtgtccatattagtactttacagtagtgagtgagaaaagctgggtgcctagaaaacataatgacctgcaattgctagaactattgctattattgtcctcttggtgatattaatggccttctttcttaccatcttttcccctttacaaaaataatttgaaatagtttacaataaaagaaaaatgcaacagagcagttaaaataagaatctatataacacatgggcaggaaatggggcagatcattaactattaaatgtgatgatagaatttatggcgtgatcgtctcaaaatgtctttgttggaagaaaag

SEQ ID NO: 49752 - DNA, 1074 bp, Homo sapiens
caagtgttgcttacaaaggttcaatgaaaacaacaacaacaaaacaaaacttggggaagttggggtgggggtgggggattggtcctttcccctgcagagctcaggagaaagatagatttggtcttaataggttttctcaatttgtaattgtctgattcacacttctttctttcctgagtgtgtgctttctagggacttttaataacgcatgtaggaagctgctttatgaaagaataattgagggtggcggagctacagattttctgtcatgtttgtgttcactatgaaatttaagtcaaatatacttccagtcttattaggaataaaatatcattgctgaggtttaacatattggtttttctttggttgaaatttagtaagactcttgacttcaaactgcattgaagccgcaacagtgcgaatgttggaaaacttatgtgtccagacatgttagtaacattaacttaattcgtattatccataatgagtctcagttattaatacttaggactgtactaaatctaatgaggatatacttaaagaagatcttagatattttttattcactttcattttaaaatcagcttcagtcctctaggaaataatctctttataaaatgagaagataaaattttaataagtatcagaagaaatggaaattttgagagtacagtcctatttagcagcctagtttcccttttgaatcactattccaatcttaggtcccacaactttttgtcttcttttgtgtgaatatttcttatatccatccaatagagacaggatgaaatatcacactgctattaggtgttgatttgtacatcagactggcagtctcttaaatctgaagttcatttacctttataggtctataagaagaatttgttaatatttaatttatttaatattaagttttttaagaaaatacttaatgagttacaagaatacagagtaaaaagaaatgattagttagttgggtttaatcaataaagaacatgggttttatttttaaatttttttggtatatagtaggtatatatatttatgggggagttttcttttttaaaggaagaa

SEQ ID NO: 49753 - DNA, 1008 bp, Homo sapiens
ttaagttgtactttgtttgattccttgactcttcctgactcacatgcctcacttgattcagccctttgtacattaaatgttattggatgggttgaaggggtaaactggagagaagaaaatgttagaaaaaaagaaactgattttctttttctctttcttctttttccactcttttttctttttttccttactcatttcagggcattccaggagctccaggtgctccaggctttcctggatctaaaggtgaacctggtgatatcctcacttttccaggaatgaagggtgacaaaggagagttgggttcccctggagctccagggcttcctggtttacctggcactcctggacaggatggattgccagggcttcctggcccgaaaggagagcctgtgagttggtttgatatttttggttttgtgatgttaaattttcacttagaaatgttttctaagttaattcaaaggatgggactgatgctgagataaacacccaatcaatgcttaaaacaatgtgaccatacagtaatggcacattgttactgactacgtagggtttctgcactactcttttctttcacttgttttgtaaacttatttttcttaacccattaatattgaatactattttctatgaataggtgggcaggaggttaagatgtttatgagacagtataaggttccccatctcttaacccccacatatctttccttgggtttacttaaacctcatgactgggcatggtggctcacacctgtaatcccagcactttgcgaggctgaggtgggcggatcacctgaggtcaggagttcgagaccagcctggccaacatggtgaaaccctgtctctactaaaaacacaaaaattagccgggcatggtggtgggcgcctgtaatcccagctactcgggaggctgaggcaggagaatcacttgaacccgggaggcggaggttgcagtgagccgagattgcaccactgcactccaccctgggcaacaagagcaaaact

SEQ ID NO: 49754 - DNA, 1027 bp, Homo sapiens
aaagagacctttagttgagtaaatacttctcatttaccattgatttactcttgctttcaggtcctaaaggggatccaggtcagactataacccagccggggaagcctggcttgcctggtaacccaggcagagatggtgatgtaggtcttccaggtatgtgaggaatttatttcaaagtaacttcaacaccgatggcttttttttttttttttttgacagagtttcgctctgtcacccatgctggagtacagtggcgtgatgttggcttgctgcagcaacctcctacttctgggttcaagcagttctccctgcctcagcctcccaagtagctgggattacaggcgcccaccaccacgcccagttaatttttgtatttttagtagagacggagtttctccacgttggccaggctggtctcgaactcctgacctcaggtgacccattgcctcagcctcccaaagtgctgggattacaagagtgagccactgcacctggccctgatggcttctttctttgaacgttttcctttcaataactgctgtttctccataggtgaccctggacttccagggcaaccaggcttgccagggatacctggtagcaaaggagaaccaggtatccctggaattgggcttcctggaccacctggtcccaaaggtatgttggaatgggtagcaggcagagtaggttagaagtttagcatgatgttattctctcataaaattcattcaacaaataaaatatattaattgcaccttttttctctgtgctataaagaatgtaaataaaaaatcacagtgtattttcactgtaagttcattatctttatctaaaacagtccagacaagaaaatatctacattttagatatgcaaaagtgatatataagcttaaaaatcacaggaattattgtgttttgtgttcaccatagtattttcagggtttagaacagttcctaacacatagtgtgcacttgatgtttattgagttaaaggattttttaaacagaaaacagacttattgcagat

SEQ ID NO: 49755 - DNA, 1034 bp, Homo sapiens
gctactttaatccctgatatttcccttctgagttcatctaaaattgatgtatttccaataatacaattgcagtgtattattgatatgtaattgttgagttagacatggttttggaagcagaggcctagaaacttctagtgctgatcatttcagatctgagtagcggtacagcattcatagacctttgtggaacctcctaacatttcttagcacatgacaactagaattagggttcagcaaaactttctgtaaaagtgtattttaggcattcccattttctttttttttcagtgagttattttccctttttgcccctaaaatagcagtcattttgcaattcatcagcactccaaatctttacttttaatattttatattggatactcaaaaaggtcttttgtcaacacgtaacctaatgggtttgcctctatagataggaaatcatatggttcctctaaatttgtgtgaaagcatattgagtttctggattctgagctgtctggtgatgtgaattctcgttatgttaatctaggtaagtacagtaaaggccaccttggggccatcattatgttattgcaaaataccataataatttatgaaattaaaacaaatatgaaatatttaattgttccttaattcacatgaatacatctgaaggcttaaacacagagttcagatgtgcatacatttatctgaagcaatggctatatgtttcctgaccttaaatggcagtagatattttgttattattctaaaaatttagaaactcaggttaacaatataaaaagcttgtaaatgttattttcattatgtactatttacaattgattatatggcacattatacctttttatggtccctgacatgtcactactgatttaaaactaagaaaacttagagtgttgctttgaaccaggttgttacaaaatagctgctttatcacttatggaaaaaacattctgtccaactaacaaagcagagggatcttcaggaaaaagcacttatttttaggtttgacctgctgtttttttttt

SEQ ID NO: 49756 - DNA, 1067 bp, Homo sapiens
agaaatgttctcaaatcacagtacttttcattttactatgagatggaccacatttcatatttatacaaggcacagatactcactttctaagtaaattttacttacatcaccaaaatagaatattatcttagttcatttaaaaaacatcctgatttatgtccataaatctcaataataaggtaatcggaaagattcttatatcttgataaacctacttatgttgcatggctgaaactctatcaatgtttttgtaataagcttatttaatatacttgtatttcattttgcgataggaaaaatgcaaaatattctatactgttatctctctactgtagaatgtttacattatgctttttaggctttcctttgaactccagttttctattatttaattaagcttttactatttacctttctcttttctaaaccaggctatacagtttaacacggttataagataaggtcccattgaatatcagtttcccattccatagcagggaaataaaagaaaaattgccaaaggactagaaacaaaatatttttcatctcatgacctgctaacccaggcagaaatggaggttgttgattcttgttattttctttggccattacctgtacaattactgtcttactgaatttttttagagatcagttaaatatactctatttcatgttcacagatcatatcataaccagaaccaaacgtgttatagtgtgtgtccagtcttaggacaaagcatatggctaaatcagctaaagaggaaaaaaaaattcatcaccactaatgtgaatcaaaacaaacaaaacaacaacagcaaaaccctaggaattgtttatgaattattcatgtcattttcatagatgaaggagaaaatagttttctaacacttcaggaggctacaaaacccttgggtagggggagggtgtgtgtatgtgtgtgtatggaaagttctcacgaataatacatgtttttgaaattttcctttttttataaactggttccattcggctgccaataaatttagaacatcagtatatccctatatcacatctgtagacatatccat

SEQ ID NO: 49757 - DNA, 1061 bp, Homo sapiens
tttggataaagaagggagcatatggaagtaaaagggagttggaaattggaaaactgggtgtaacctgctgtactcaattttttaggtggtggaggtcatcctgggcaaccagggcctccaggcgaaaaaggcaaacccggtcaagatggtattcctggaccagctggacagaagggtgaaccaggtgctgtagtttttcatttttcctatttttctaattttctctgtgttgaatttaacttgcctttttattacccacagtgaaattgtatcttctttcttactaagctaccacacactttccccttttcctagttaccgtcttcctcttcatcctgagactattagctcatgtatcttgatcaagttgcctcttacaaaaaaccccatatcttttcttgtctaattttttatatcaaaaagaagttacctagcctttgcaaatttctctgtggtttactatgcaatctatatttcatttatatttttttcttataagcatatagatatatttaacattcatcggaaatagaatatatgtttagatcattttctcatgttagaattgcagttctgtgttggaaataaatcttctgcatgtttcatataatatacattgctgcacctaatgaaaacctcaatgatctaaaaataatttggccttgtttcagtttgtattatccacttgagtttttgttttgttttgttttgtactctgacaggtcaaccaggctttggaaacccaggaccccctggacttccaggactttctggtaaaccttaataaaacatgctaaatcaatctataataaaatgagattatttccaaatacatctatttttccatctccaccttttactatcataaaatgcatgtaagaacccagaaaactcaaacctagtgttaacgttaaaacatttattatttagcaacttagtttaaggagttgtgttaaataaaaatgtatccttacggaaatttacatgtagagatctcttcactaaattcataaataagtgctgaggaaataagaaagaaggcaaaattgcaggaagataag

SEQ ID NO: 49758 - DNA, 1086 bp, Homo sapiens
aagaccaacagcttatcctttagaataagctctatttgaaaaagtttggctctctatacttctgtatggttctgtttgcatactgattatgctgtaagtataagaaatgctggcaaagaacattattgttttaacttgtactataatgtgaaccacttctaactcataatcttattttgtactgtgtgatgtctgatactgctaacatcgatctttgggctttggtgaactctgatcttcccaggttttcaaggttagactcttcactggtcaattcttttttttttttttttttaatgctttgtgtgtgtgataagagaaatgcaattttttgctataattcagaagtcattggagagtgctgttatcctcaagctggggttttaacattttgatgaaggtaatgtgacttgattataattaagtttcaaatgacgttagggtctttgtgtttgcaattgtttataataagtaatcaatacataaagacatgttgaattttaaacggaaatacacttatttttaccttcaagactgcattaaaatatttaggcaagcatatgacctatttgtaatctctgaatgttgattttattttctcaaaattttgttttctcagattgccctgatctgtgtatttatggctattttcagtgatggcagagatatactattgaatactgttaaaaataaaacttatatgttctttatgtaattaataactcataatttgaaggactctaaacatcaggtctgaattaacatgcaagtttcccatttttttttaatttcgaaaagtgcagtgccttaggttatttcagatgatacagtgttctgataacttttaaaatggagtagagggtcataaaaggtttctttttttcccatcttactttgttattgttatcaggttgattcacagtttatttatttttcataattagctgatttgctacttaatttctagtgcaaatcatacattgtggattaaattgacaagtttgcttagaacactgaagttctgtttttttattcaaatgtacaatgtactaaaccttttcgttatgattgagaagggaatttctg

SEQ ID NO: 49759 - DNA, 1047 bp, Homo sapiens
catcctgtgaatattagaaaaatgtatgagagaaagagaaaaagatagaaaatgagagggaaacacaaatatacaaagataatagtggtggggagaatcgttacaaaatatctatgaccactaatggctcttaaaccatactagtcactgcattagatcatattgctgaaaagtaaaccattaagtcaccaagagagctacttaacacacaaaaaatgtttagttataaatttgaaccagtaacagaattgaaataccagaaaatgtggatctgattgtcttatttcttatttcccagtaaacctcagtcagaaacgctgaaagcaggagacttgaggacacgaattagccgatgtcaagtgtgcatgaagaggacataacattttgaagaattccttttgtgttttaaaatgtgatatatatatatataaaattcctaggatgcagtgtctcattgtccccaactttactactgctgccgtcaatggtgctactatatatgatcaagataacatgctgactagtaaccatgaagattcagatgtacctcagcaatgcgccagagcaaagtctctattatttttctactaaagaaataaggaagtgaatttactttttgggtccagaatgactttctccaagaattataagatgaaaattatatattttgcccagttactaaaatggtacattaaaaattcaattaagagaagagtcacattgagtaaaataaaagactgcagtttgtgggaagaattatttttcacggtgctactaatcctgctgtatcccgggtttttaatataaaggtgttaagcttattttgctttgtaagtaaagaatgtgtatattgtgaacagccttttagctcaaaatgttgagtcatttacatatgacatagcatgaatcactctttacagaaaatgtaggaaaccctagaatacagacagcaatattttatattcatgtttatcaaagtgagaggacttatattcctacatcaagttactactgagagtaaatttattttgagttttatcccgtaag

SEQ ID NO: 49760 - DNA, 1042 bp, Homo sapiens
gaaagatatgtaaattgggcatgatgtgatttgtagcacagtttgaaagggagctgttgatacaagtgtcaccatggtcacttttaaacttcttttaaaagatctcatatatttcagcttatatgctcttttaaaaggagaaataggtttcttcttttgtcaacaaattatgagagcatctaaattagttaaattttatttatcactctgaaataatactttatgagacattttctattttaaggggaaatatctagcattaatcaatgtgttaaaaaaagaagtgtgaaaataatttctaaactattacagtgaaagatgaacagtgctgatcactttgtacccagggtatattatttggctgcagcgaagtggaattagagctatagtgagatgcttcacagaagaattttactttgtatctttcctaatctggcaagcatgagtacttgtaaactgggagaatgtctgactagaacattattttcttcctacaggtcaaccaaaccttctcagtcctaaagttgtctcaacactgaagctctgtagagcagaccatcattactgaattgtaccagatgctagagcttgtctgacatacatttaaattttcattttcctggacaacttaatgatatagaatagtcatttagtttaggtcagattctcataggcaaagtaaaacagatatctagatggtttaggcaaaatgtagagaatttttatttggcttgaactcactcagtggtggctttaatgctctaccctctcttggttatagattcctgtctcttattttttttcgtttttgtttttattttaggacagtttatcccagaaggctaaagttgccttgcatattcagttattacaactgtaaagtttggaatctgcacaaagggtctgaaatacagatttttaaaacaacagataataaataataagacttaaaagatagttcttgttttagtttgccaattcaactcaagggataaaaaacacaagcattgtaactggcattttatggctataaactaatgta

SEQ ID NO: 49761 - DNA, 1046 bp, Homo sapiens
acactttgtatgcctgcagaattagtaccacagggatgctgccaaggcttaccacatgtgccctctggaccagtggtttgagttacactggggcctgcttgagccacagctggggtgggccaaggagtactgcactataatgtggagagcacagacctgaggtgacccttggcagtgagccctgaggtcttgcaggtaccctgggccccttaatgaaaatcattctactccaaagggcctagtactctgagcctgtggtgaaaaggatagcttagaagatccctgaaatgtcttcaggatcactctctcatagtcttggtgaacaaaatctggcttctttctattcatactaatctccttatcaaaaagttgttggccatgctcttagttttctctactaatcacacttttaaattcttgatatggccaggctgagaattttccaaatctttacattctgctttccttttaattataaggtttgtcttcaaataatttcttatggcgttttactataaacagttaagagaagccatgcagtgtcctgaacaatctgctccttagagcttttttctgccaaatatctcacttccttgctcttaagttctgctttccataaagtcccgggacatagacaatttagcccagttctttgccactttaaaataaagatgaccttttcttcagtttctggcacattgttcctcctttccacctgagacttcatcagaacagtctttattgcccacatttctagcaacattctgttcgcaatcatttatgtaatttctaagaagagtgaagctttctctatagctcttctccttctgagccctcaccagaatcactcttaatgctgtattcatgttaatacagacttttttccaggattcacttcaaaactgttccagcctctacctattacccagttcaaaaacagcttccagattttaaagtatttgttatagcaacatcccattcctctggtaccaatttttgtcttagtacttttgtgctgctaaaacggaatatctgagactgggtag

SEQ ID NO: 49762 - DNA, 1189 bp, Homo sapiens
tcatggagggatattgaattttattgactgctttttctgcaacttgagagagaatcatatggcttttattcttctttccattgatttgatgtatcatatttattgatttgggtatgttgaatcacccttgcatccctgggataaaccccacttgaccatgctgtatcatttttttcatgtgatattgaatttgatttgctagtattttgttaagaatttttcgcgaaggcccgcggcgggtgttgatgcgatgtgatttctgcccagtgctctgaatgtcaaagtgaagaaattcaatgaagcgcgggtaaacggcaggagtaactatgactctcttaaggtagccaaatgcctcgtcatctaattagtgaggcgcatgaatggatgaacgagattcccactgtccctacctactatccagcgaaaccacagccaagggaacggacttggcggaatcagcggggaaagaagactctgttgagcttgactctagtctggcacggtgaagagacgtgagaggtgtagaataagtgggaggcccccggcgccccccggtgtccccgcgaggggtccagggcggggtctgccggccctgcgggccgccggtgaaataccactactctgatcgttttttcactgacccggtgaggcgggggggcgagccctgaggggctctcgcttctggcgccaagcgcccggccgcacgcaaaagagctcctgaaggaagcgctaaacatggaaaggaacaacgggtaccagccgctgcaaaatcatgccaaaatgtaaagaccatcgagactaggaagaaactgcatcaactaacgagcaaaatcaccagctaacatcataatgacaggatcaaattcacacataacaatattaactttaaatgtaaatggactaaatgctccaattaaaagacacagactggcaaattggataaagaatcaagacccatcagtgtgctgtattcaggaaacccatctcacgtgcagagacacacataggctcaaaataaagggatggaggaagatctaccaagccaatggaaaacaaaaaaaggcaggggttgcaattctattctctgataaaacagactttaaaccgacaaagatcaaaagagacaaagaacgccattacataatggtaaagggatcaattcaacaagaagagctaactatcctaaata

SEQ ID NO: 49763 - DNA, 1050 bp, Homo sapiens
ttttcccagtcttttcatgccttgcacctgttaatacaactcagcttgcttttaaataacagtatgttgctggcccctactcagtggatgatccacaagctcacagaatttttattcctttgccacagatgggccaccttcttctcagtctttgtgagacttgtttttagtttcctccccctctgtaaatactcccctgaagattctcctctacgaaacctttccataggagcctgacctgactccagtaacactttttgtcctttcccagccgtctgaatacatgtcagaatgttgggctctttaatgaatacctttgtatgcatgtaggtaatctggtgtttggccagatcatttttttttgtttgtttgttttttgttttttgtttttgcatgtttctttaatgtttctccaccattagtgggaacacttttttaaagtaaaggagtagtggatttttcctttgtaactccttgcagagctgaatataatactgtatatgcacattaattgtttaatgtgtacctggataatggtgactgaatgattgatggaactgactttttgctttccttttttctttctccactggtggccctatgttcctattaagagaatcttccagccaggcatggtggcacacgcctgtaatcccagactttgggaggctgaggcaggcagatcacgaggtcaggagattgagaccatcttggctaacacggtgaaaccctctctctactaaaaatacaaaaaattagccaggtgtggtggcacgcgcctgtagtcccagctactcgggaggctgaggcaggagaatcgcttgaaccgaggaggcagaggttgcagtgagccgagatcccgccactgcactccagcctgggtgacagagcaagactctgtctcaaaaaaaaaaaaaaaatctttctgcctgttttttgaaatagccacaggagtgaggcaatctcagctcctgctcacacatctttttgtagaatttccatcacaaagaatggttattagaatctctactcttggcccaaagtgtctgt

SEQ ID NO: 49764 - DNA, 1060 bp, Homo sapiens
tccttccttccttccttccttccttccttccttccttcctttctttctttcattttttttttttttgagacggagtttcactcttgttgcccaggctggagtacaatggcatgatcttggctcaccgcaatctccgcctcctgggttcaagcgattctcctgcctcagcctcccgagtagctgggattacaggcatgccccaccatgcccggctaattttgtatttttagtagagatggggtttttcaatgttggtcaggctggtctcgaactcctgacctcaggtgatctgtctgcctccacctcccaaagtgctgggattacaggcgtgagccactgcgcccggcctgcaggccacctctttacctggctggtatagcaactgtttttttcaatttactttcctgcccttgcttcctgtcttccacagaggagtctggccctggtgtcaccattacttgctgtttgccctggacagacagttcacagggatgtgtgtgctcactgagcctgcatgtagagccagtatgggttgcttgcagatgttggttgtttggaaatgggacccactcagctgcggatataactgaggccatcatttcctgcctccaaatagaggcctgcatctaatcctagtaaacagttgtatggggctccagggcaagggatcaaaattagaaccttagtctagcagaggtgacaaaggccaaagaagaaaaacgtcagaataatctgtcagcccagtagtagaggttagttcatcttggttgagtagtagaaacagcactggattaagggttagccagacctgggtcctggttgtaggttcatcactagctggttgacaaaactgagtaattttggccattcaggtagcctctctgtgcctcagtcttcttatataataagaaatagagtgtggtagttaaaagtgcaggctctggagccagactagtcaggttcaaatcccagttctgctgctttctagctgtgcaactctgggaaagttaattgacatatctaggcatggtttttgatttgttttgttttattttgtttg

SEQ ID NO: 49765 - DNA, 1082 bp, Homo sapiens
tcctgccaaagtcctgggattactgttgtgagccactgtgcctgtcctctagctttcttaaaggagctgttatttaatttcagggcttgtagtctctaaaactgttggtaaacgttgaataaaggctgaagggtaacagggcacttaaatacgagatgccatgttttatggctctgtgtgagaattagtaaaatttgtgttctgttttacaagagggccttgggagatgatggtttctagaagagaagcaattgaaacaacagattgtacatgtaacttttatctccttgcagggtttaagagcaggcagatacataactaggtctagtgtatggtatcattcatttatctgtgtgtcgtgaaaagatcttgtattcaggaacactaggttaataatctacaaaatctaatactattagaatggtaggcttgatcttaaaatttttatgttgttgttattgttgggtgtgtgtgtgtgtgtgtgtgtgtgtgttggcatatgtgttcttgaacccagtggcctttattttggatggtttgtatatcagcttgcatcagggaaggctctgagggcttgtccccaaagccaggctctttcctcctctcctgctggctcacgtatgtctccaggttcttataaggcagaatagactaggtactgctattagaaggaacaaaattatttaccttgggacaggaaggagaagccctaacaggtgggctctgatggcagtgctgcttggcatacagtcagtgctacacaaatgttaagcattctgctcactggtcctaggtcaaagcccttgggatgctcatcacttgtgggctcaggtatcagggcagctgagttagaaagcccaacaatattgctatacagagggagttaaaaaccagatggcatcaaaacccaagctgcacacacatcttgttcttcagctgccaactctgcacctcaatctgattttaccttattctcacctaggtctgggtaagttcatgtaattgcatgttcctgccatgaatatcctggttttcagaaaaagagtgagtgagatgaggccacagtgtggcagtatttgttt

SEQ ID NO: 49766 - DNA, 1026 bp, Homo sapiens
catgcaaattgttccattttataaggtgcccaaatgaaattcacagccaaaatttgctggaatgcaaaaaatgtcgtttctttacaggaaaaaaagaacccagagacctattcactgtgttttcatgccatccaaacctgatgatggtagtttggagtttctcattctgtaggtgattaatcttctttgtgattggtagtatgttttatttgaaaagaaactacacttcagaccatttctatcctttggctgtgttcatgcctgagagaatgagtaaacagtcatttgtatgaactggttatttgtagttcccctggggaagtaggtatcaggcaggtagcaaaggcatctagcatctggaggaagcttgtggatatagaggctttctcttagaaagatagctctttccttttcctaaaggtaaaaccaaacagatggcccatattcactggggataggtctcagggtcttcttcatcgggttctgagggtgggtagatctaaggactccttgagggctcttgaggcagagaatcagatactttctaatctctccttttttgcttttccctgatccccacttttacccagtaccatcttcctgttttccccttatacttccagaacagtacagtaaagtaggaaacagggaaaagcttggaaaatggaggactgactccaagaggacaggaataactaccctcagcttttaaactgcctctgcaggcaaaactcacaaatttgtattcccccccgccccaccgcccacccaacttctttggagggaaaaattccattggtcattaatactgggaggaggccatgtcatagagttcattcagaggcggaagactgaaaataataagccagatcttaggctaaccttctcctgtaacagagaagtgacccagaatcacagctgtttgatgaataatagaatttgcctggcatatagtttaaatttcaccttcttatgtgacttggtgttctgtgttttactagttggcatcatgtcagatcatgttct

SEQ ID NO: 49767 - DNA, 1035 bp, Homo sapiens
tataattgaatggcgccactagggttgtgcagtgcacaacctacacaactgtactcggcggccctggcataatgtaatgtcagtactttcttcatcaaggtaccagtttgggattgtcctcagggtaagggggctgaagcagtgagctgctgctgtgaccaggaaaggaagaaagaagtaaagttgtggctttgggagaattatcttctctgtaaatgagagccatcatataggagaactacgtaccttcgttctttcagtaaatagttttttaagtgcctactatgtgagggttgaagaacagggaggggtttgcataggagggagcatttgaactgggctttgtgaaagaagtagaatattaacatgtgaagatgagtcaggaggagagaatctcagggggaaggaatagcgagaagaaagacagatgggagaccacaagggatatatgggtaatggtgcataattcatcttggttggatagaaaagcatgtaaaagggagtagtgagcaatgatgctggtcgggggtcaaatgatgatgcaggaggggagggagttgaatgcccaattaaggaatttggacttttatttatcaagcaataaggagctatccaaagtttgttttttaaacagctttattgggttataatcatataccatataattcattcatttaaagtgtacaattgaatgtttttagtatattcacatatatgtgcaaccaccaccacagtcaaatttagaacattttcatcatccaaaaaataactccatacgatttagctcacccccctccctacctttcccccactcaccagccctaagcaattgttaatctactttctgtttctatagattttatctattctggacatttcatagaaattgagtaattataatatgtgacctttttccactggcttctttcacttagtatgttttcgagattcatctgtgtttagcatgtatcagtacttcacttatttttatggccaattaatattccattttaaggatatgccacattttatgta

SEQ ID NO: 49768 - DNA, 1044 bp, Homo sapiens
tcacttatattcacctacctctctcaaatactagtggaattctaattagaattgccttaagtatatatttcagtttttaaattatatggctccttttatctaagaaatggtatttctttccatctgttcacgtcttattgtttcagttagatttatctttttcttcatatctgctctatgcctttcttgatgcatttattcctcaagaattaacagcttttctgccaggtgcagtgactcacgcctgtaatcctagcactttgggatgctaaggtgggcatactgcttgagctcaggagtttgagaccatcatggacaacatgatgaaacctcgtctctaaccccccaccaaaaaaaagaattataaaaagaatagaaaaagaattaatagcattccccctctcccccaaccacgccgtaatgagtggaatatttttcccctttctattcctaagtgctttttgctagaataggaaaagattgttgatttttaaaaatatcttatatctggctatcttaccgaattctcttgttcttgtaaattttattttagttttatctcttcttttccttagttataccagttatttcattttcttgttgcatttgctagaaattcagagttaaataaaaattgtgctgacgggctactcttgcctaaaactgattttaaatggaaatattttctgtactcctccatatttgctgttggtgtttgttaatagtctattatacttaagtagtttttacatttatgtagagatttttaaatatttatttatttatttatttatttatttatttatttagacagtgtctcactttgttgctaggatggtcttgatctcctgacttgaagcaattctcctgcctcggcctcccaaagagctgggattacaggtgtgagccactgtgcccagccaagattttttaaaagaaggaatggtagctgtattttatctaatgctttttctacatctattggtcatgtgggattttttcatttaaatttttgatataataaattacattgatagattttct

SEQ ID NO: 49769 - DNA, 1074 bp, Homo sapiens
gttctgattggtgtgagatgatatgtcattttgttgttgttgttgttctttgagacagaatctcgctttgttgcccaggctggagtacagtggcctgatctcggctcactgtaaactcatcctcccgggtccaagtgattctcctgcgtcagcctcccaagtagctgggactacaggcacatgtccccatgcctggctcatttttgtatttttagtagagatggggttttaccatgttggccaggctggtcttgaactcctgacctcaggtgaactgcccacctcagcctcccaaagtggggggattacaggagtgagccaccacgcttgacctgattgtggtttgatttgcatttctctgttagtgataagagattttttcatgtgcttgttggctgcttgtatgccttcttttgcgaagtgtctgttcacgtcctttgcccactttttagtcaggttatttgttttttgcttgttgatttgtttaagtttcttatagatttgggttattagatctttgtcagatgcgtagtttgtgaatattttttcccattctgtatgttgtctgtttactctgctgataagtttcttttgctgtgcagaagctctttagtttaattaggtcccacttgtcaatttttgtttttgttttagttgcttttgaggacttagctataaattccttgccatggccaatgtcaagaaggtattttctgggttttcttctaggatttttacagtttgagagcttacatttaaatgtttaagtcatcttgagttaatttttgtatatcatgataggaaggagtgcagtttcattcttgtgcacgtgtatagccagttttctcagcaccatttatttaatagggagttctttccccattgtttacttctgttgactttgctgaacatcacatagttgtaggtgtatggctttatatctgtgttctctatcctattcctttagtctttgtatctgtttttgtaccactaccatgctgttttggttactgtagccttgtagtatagtttgaagtcaggtaatgcggtacctctgggtttgttctttttact

SEQ ID NO: 49770 - DNA, 1047 bp, Homo sapiens
cgggattccctttgtaagtgatctgacccttttgtctagctgcctttaagattttttctttttcattgtccttggaaagtctgatggctatgtgtcttgtggatggtcatcttgtatagtatcttgcaggagttctctgaatttctgtaatttgcatgttgtcttctctaacaagattggagaaattttcatgaactgtatcctcaaatatgttttccaagttgcccactgtgtttccttctctctcaggaatgccagtgagtcttaggtttggtcttattacataatcccatatatcttgaaacttttgctcatttttaaaaattcttttttctttattcttgtctgactgggttaatttgtaggaccattctttgaggtctgaatttctttcctcagcttggtctagtctgttgttaatgcttccagttgtatttgaaaacttgtgtagtgaagtttttcaattccaccagttctgtttggctctttcttaaaatgtctatgttgtcttttaactcttggatcattttactggctttcttcgattgagtttcaactttctctggagtctcattgagcttcttgccatccagattctgaattctgtgtatgtcctttcagacatttcaatctggttaggatccattgctgtggagctagtgtgatccctcggatcatcacattttaaaattaaactttaggttgggcgcagtggctcacaccttaatcccagcactttgggaggccgaggcaggtggatcacctgaggtcaggagttccagaccagcctggccaacatggtgaaaccccatctctactaaaaatacaaaaaattagctgggcatggtgatgggcacctgtaattccagctactcaggaggctgaggcaggagaattgcttgaacccaggaggcggaggttgcagtgagccgagattgtgccattgcactccaacctaggcaacaatagtgaaactttgtctcaaaaaataaaattaaattaaactttatactttgagataagtatataatatgaggagatttcaaa

SEQ ID NO: 49771 - DNA, 1043 bp, Homo sapiens
ttctctttgaagcaattgtgaatgggagttcactcatgatttggctctctgtttgtctgttattggtgtataagaatgcttgtgatttttgcacattgattttgtatcctgagactttgctgaagttgcttgtcagcttaaagagatttggggctgagatgatggggttttctaaatatacaatcatgtcatctgcaaacagagacaatttgacttcctcttttcctaattgaataccctttatttctttctcttgcctgattgccctggccagagcttccaacactctgttgaatagtagtggtgagagagggcatccctgtcttgtgccagttttcaaagggaatgcttccagtttatgctcattcagtatgatattggctgtggatttctcataaatagctcttattattttgagatatgtcccatcaatacctagtttattgagaatttttagcatgaagggctgttgaattttgtcgaaggccttttctgcatctattgagataatcgtgtggtttttgtctttgattctgtttatatgacgggttatgtttattgatttgcatgtgttgaagcagccttgcatcccagggatgaagccaacttgatcgtgatggataagctttttgatgtgttgctggattcggtttgccagtattttattgaggatttttgcatcgatgttcatcagggatattggtctaaaattctctttttttgttgtgtctctgccaggctttggtatcaggatgatgctggcctcataaaataagttaggaaggattccctctttttctattgattggaatagcccctctttgtacctctggtagaattcggctgtgaattcatctggccctggactttttttgtttgataggctattaattattgcctcaatttcagagcctgttattgttatattcagggattcaacttcttcctggtttactcttgggagggtgtatgtgtccaggaatttatccatttcttctagattttctagtttatttgtgtagaggtctttatagtattctctg

SEQ ID NO: 49772 - DNA, 1051 bp, Homo sapiens
ttatgaggcaaggtactgttattcccaagatcacagtgcgccagcaaggttagtttcttctgaggcctctctttggtttgcagatggccaccctcatgctgcctcttcacttggtcctttctctacacacacatccctagtgtctcttgtttagccaaatttcctcttataaggacacacatctgattgcatagagcccactgtaatggcctcctttgaacctaatcacctctttgaaggccctttctgcagatactgtacagtcacattctgaagtactgagagttagggctccaacatatgaattttggggggacacaattcagctcatagcacccatactaccctacatagaaaccattgtttcttcccctcaccctgctttccttcctccctccctcccctctgcctttccttcctccttccttttccgccatctcatagcagatgtgctggtgtatctgttacattaacagctaatactttccaaataaatgtgaggctgtagtcaactaacttatcaaaaatgtttaagtaacctctcctgacattgaaacttctttgttgggctgtctcttaactagtgattccagccaatctggtcaatctttgtgctctttttctaaagtgatgcttagaaaagctgggaatgtctccatttgcctatgtatttgcaattggtttaggtctggttcttttagatggttgggatccctcttggactactctggctttagggctttttgccttgcagccccttagttgagctcagattgacttaacatgagacacatgaggattggcaactctttcttaaacctgatgatccaattaggttgtaagccagcttttgacttttgcccttccttcttggccctttatctttttaattattttatttttttgctcattagcagtaatgaggaagcaagaaaaataaaatgaactgattagtgtgtgtactggtaccatagacatacatatactcacatacacaaagacagagtgacagggcattggaagtagttgtgacagtcagctaaaggatttg

SEQ ID NO: 49773 - DNA, 1030 bp, Homo sapiens
tatttgacagatcaacgagacagaaggttaacaaggatacccaggacctgaatttgactctgcaacaagcagacctaagagacatctacaggactctccaccccaaatcaacagaatatacattcttctcagcactacatcacacttattctaaaactgaccacatacttggaagtaaagcactcctcagcaaatgtaaaagaacagaaatcacaacaaactgtctctcagaccacagtgcaatcaaactagaactcaggattaagaaactcactcaataccacataagtacatggaaactgaacaacttgctcctgaatgactactgggtaaataactaaatgaaggcagaaataaaaatgttctttgaaaccaatgagaacaaagacacaacgtaccggaatctctgggacacatttaaagcagtgtgtagagggaaatttatagcactaaatgcccacaagagaaagcaggaaagatctaaaatcgacaccctaacatcacaattaaaagaactagctgggcaccgtggctcatgcctgtaatcccagcactttgggaggccaaggtgggcagatcacaaggtcaggagatcgagaccatcccggctaacacggtgaaaccccatctctactaaaaatacaaaaaattagccgggcatggtggtgggcgcctgtagtcccagctacttgggaggctgaggcaggagaatggcgtgaacccgggaggcggagcttgcaatgagctgagatcgcgccattgcactccagcctgggtgacagagccagactcagtctcaaaaaaaaaaaaaaaaaaaaaaaaaaaagaactagagaagcaagagcaaaccaattcaaaagctaacaaaaggcaagaaataactaagatcagagcagaactgaaagagagagagacacacaaaaaaaccccttcaaaaaaatcaatgaatccaggagctagttttgtgaaaagatcaacaaaactgatagaccgctagcaagactaataagaagagagagaagaatcaaat

SEQ ID NO: 49774 - DNA, 1073 bp, Homo sapiens
tcaacactctaaaagaaaagatttttcaatgcagaatttcatatccagccaaactaagcttcataagcaaaggagaaataaaatcctttatagacaagcaaatgctgagagattttgtcaccaccaggcctgccttacaagagctcctgaaggaagcactaaatatggaaaggaaaaaccggtaccagccaccacaaaaacataccaaattgtaaagatcattgacactatgaagaaactgcaacaactaacgggcaaaataaccagcttgcatcataatgacaggatcaaactcacacataacaatattaaccttaaatgtaaatgggctaaatgccccaattaaaagacacagactggcaaattggataaagagtcaagaatcattggtgtgctgtattcacgagacacatctaacatgctaagacacacatgggctcaaataaaggtatggaggaatatttaccaagcaaatggaaagcaaaaaaaaaaaaacaaaaacgggggggggagggtttgcaatcctagtctctgataaaacagactttaaaccaacaaagattaaaaaaaaaagacaaataagggcattacataatggtaaagggatcaatgcaacaagaagagctaactatcctaaatatatatgcacccaatacaggaccaccgagattcataaagcaagtccttagagacctacaaagagacttagactcccacacaataatagtgggagactttaacacctcactgtcaatattggatcaacaagacagaaaattaacagagatattcaggacttgagctcagctctggaccaacggaacctaatagacatctacagaactctccaccccaaatcaacagaatatacattcttctcagcaccacatagcacttattctaaaattgaccacataattggaagtaaaacacccctcagcaaatgcaaaagagcagaaatcataacaaacagtctctccaaccacactgcagtcaaattagaactcaggattaagaaactcactcaaaaccatacaactacatggaaactgaacaacctgctcctgaatgac

SEQ ID NO: 49775 - DNA, 1033 bp, Homo sapiens
gtatgagttccaaaaaggacctaatacatcagcataatcagaggcagatcaaagtagaaaaagggttttgagcctgttgagaggagctgctcaatgagaaaaaaaatacagaaaaccagttcatagtaagacaaagattggatgttttgggaaatgcttttgccatatggtttgaggccacctacatacattgaaaaaatactacaaactagaagagggctcaaaatgagatgaaatattaatgaaaatgtttatctgaaggcaaccagacaaagcttttaaagtaattttcctacttctgagaaacctttggagaaaagtaaacactccattttttcatgtctgtagacaggaacaggaagtaaccatctaatctagatgatgaatcctccctgccaactagcagccaatactgtcaggtcaacagtagctctagggaaatgtagttgcatacaatcagcaaaagtacgaaaagcaatgtaaatctgaacagggcactccccatctactgatgtgagccagaacaaatcagaaatatgtttgcaggagcagaatacaattaagtgatacaacaaaaaaggtgtatttacttaataatattttaccttaaaccctatctctcctgccatatcaaggcaaaacagaggttacaaaaaagtcttagactctggcaatttgctcttctttagaataagattctttagaatgagatttataggaggcaacattaacaaaattacatcaatctctaccaatgcaataataattataataattaatagaatagggtactcaacaaggttatttatattggggggggggatacaggaaaagagagaagccctgtaacttgttctgttcttctgccatcaaataatgattgtttctcaactgtattcaggtttctcagcaatttagctcaaaaatacaactatattcctcataacatccagctaaaaataccataattccccaggatctagcagcttgcagaagtacagaaatgatgatgtcttctttccaccaccaggta

SEQ ID NO: 49776 - DNA, 1047 bp, Homo sapiens
ttcatcataaattctttacctagaaaaatgtccagaagagtttttcctaagttttcctctaggattattatagtttcaggtcttacatgtaagtctttaatccatcttaagttttgtatatggtgggagataggggtccagtttcattcttctgcacatagctagccaattttcctagcaccatttattgaatagggactcctttccccagtgtttactcttctctactttgttgaagatcagttggttgtaggtatgtggttttatatccagttcactattgtgttccactgatctgtttgtctatttttgtaccagtatcatgctgttttagtttcagttactatagccttatagtgtaatttgaagtcaggcggtgtgatgactctcaacttggtctttttgctttaggattgctttggctattcatggtctttttttgttccatgtgaaatttaggattgttttttctaattccatgaaaaatgacattggtagtttgatagtgattgtgtggaatctgtagattgctttgggcagcatggtcattttaacaatattgattcttctagtccattagcatgggatgtttttccatttgttaatgtcatctatgatttttcatcagtgttttgtaggtctccttatagagatcttttgtgaatttgaaaagaaaatgtattctggtaatgttaggtccaatgttttataagtgtcagttaggtccagttggttggtagtattgatcatgttttctatctcctcactgatttttgtctacttgttctatcaattactgaattaataatgttgaaatatccaactctaattgtagttttgtctacttatccttttatgtgtattttttttctttcatgtattttgaggatctgttaggtacatacacatttagtattttgtcttcttgagttaaccactttatcattatgacatggccctcattcctcgtaacactgcctgtcctgaagtccaattcatctcttattggcataataactctagcattcttatgaatgtttgtatatc

SEQ ID NO: 49777 - DNA, 1033 bp, Homo sapiens
ctttgccaaaaagccctgtgttgggtatgccttcaatgctctgagagtttacaattctgccttagccttcacttcctgcttgcacagggtctaaaagtcagccacctcaggcagatacagtattaaacaattgctgctgcttgttttcaacaaatgtcccgaggatagggcttttccactgagtcagatcaaataaagacaagcctcgtgaatggggccttcccaaggagctaccacacaggtcaatagtgacaattatctggggataagatgtgaggagcttgcaactctccagtagctacaggttttcacagctaccatggatgcaaggttactagtttccagagatattttggatctggggaaaggttgattggattagggcaagttaaaatacaacaaatctaacttttttttttaaccgaaaatcagctattttattgaataaacactcctcaggttgttggaagcttttggttaatttttagaattctgaaaaacttgtttttaacaattgttgccagacattgcttttataggggagtagattttctgaagtccttactccaatattccagaaataccctctttacttgagtttgaaaatcattctggtattggtgtcttcctaaaaggcatcagctcttaaaattgcccaacaaaatatgtggaatccctggtgatatgtacacataagctgctaggtaaagttcataaacatctatagaattagaagagagaaaatatgatcagctttgatttatattctactttacctttggtgactacagggaaacaaatgtatttttaataacagatggaataaaaaagcatttattgttataaacgtttggctgtatttcaagtatttttaaaatactgctttatttttttaaagattcacatactttaattttaaataaaagaacatgagagactataaatgatcctagtcatggtaggactgactgcacagcatctagttcaatacctgaagtcataactaaacagaaggaagcttactaaggtctca

SEQ ID NO: 49778 - DNA, 1043 bp, Homo sapiens
aaatttcttcattaactttaggaggaaagaaagtgaccaaaccatttaattgtatcataattatagtatttttaaactacataactttgtagctagacaatttttctaacttcatctttgagacactgaagttcagaagaaaaaagatcactgaacatagaaggcactcaggcagtgtgacataaccaatgttaatctaactgacttaagctgaatgcgtactgaagaatgaaagcactttgtctacagagcagactactgcttgtgttatttcctagtctcttgtcaaggtttcatgacattcacaacattaaaggtgctggtgagacataattaaacagacaaagagaaattttaccaagaaagaggccactcacaggccattaaaattttaaaattgtcaactgttagaccttcatttcccaatgcttgttatagctagtctccttacaggtcccctttcttgctaggttctcccccacttcaacctacttttgattggtacccactgaccactgtataatgctcatcctgacctatgtctaagatgtttctctgcctagactgctttttccatctatgaaagttctacctagcctaaatcctattttgtctgtaaagctctcctgtacaatcttagcccacattagtctacccaaacaatgagtcctacagacatcactgtctccatcactcatttagctgttgaatcatatgtgacttcattatttgtttcatgaatcttgtcttttcagtatgactgcaagctttttaaggacatgaagcatggtttatgcctattttatagatttctcacccatactcataaaggggtctagcatagtgttctacccagaacagctgtattacttgttgaaatgaaatattagaaccagtcataatattaagagcagtacttgcatagaataagagataggtattgatgtcaaacacagtcttaagataatactggcaaaaaagacttgagacttcaacaaatattcattttaaaagcctgtaagcaaagggataatcatagtaaa

SEQ ID NO: 49779 - DNA, 1047 bp, Homo sapiens
gagaggatgggaggatgactaggaagggtaatgaggaagggcagggagatgggggaaggaagggaaaaactggagctcctaataaacaccaggcacattgtgaagtttatatgttatacataggtcatttgtattatgcttatcatacatgtacatgaatatatacacccaaacacatacacaaacacatacacaatcactttccagggattgactcatctatttggctcactctcaatcatgaaaagagcttaggacagtgacacttttagaaagccctgaatgagtgttaactagcctttcttcttatcatgatcatcttcattgtcattatcggcatattatataaattatctcatttatttcttctaactacaggacttagcaactattatttttatttccagtttacaaatgaggaaaccagtatcttattttatccaagcttgtgggtactgagaatataaagaggaattcaatatggttctaggcaaactttggggtcttccctatctagtgggagggaccgaggcacacataagccctcatggtccaataggtgctgtggtagaggaacgtatctggggaagttgaggaagtctccacgaatgaaggaggcttgagcagcatcttgagggatggcaggttatgtcaggaggaacagtggaggcaggggaagacattccaggcaaagtgagcagtatttgtgtgacagggcctagtgcatgtttcaaagggcaggacaattgtagctgggtgcaccactggcagcagcaggaggggagtggacgagtatttggggtcagctattcagagccctattggccaagctgaaggttttgttctgtgagcaagagggagccactggagctttttattaaggcagattcgggacagactaggaagacagtccttaccagggtgttgaaagattggagggaagagaggccagctgcatgcggaccaattgggagaccatctccagggtctgggcaagaagtggaacaggctctgaaccacgaccgtggcagtgagagccgagaggag

SEQ ID NO: 49780 - DNA, 1038 bp, Homo sapiens
tgcctaagacctgccctgacaatcagagtagggactacaagagtgtatggtgtatgaggttctgaactcccatcaccaccgaggccagtcctagttcttggtccagggagaagtctaggcaggataaatcatatcttacctcaaaaaacccttagcgtatcttgccatgtgtcagcaggcaaacttgaggaagccctggttctatttcacctggcaggggagcctataaggagagcgatgcccactcctataccacccttgtaacccagtagacttgccccatatgccccaactcatagcacctaaaatgggtctccagggtccttgccctgtttatagtatccatcctgaaccattcgttttgacccataataatagtgatagtataatggctaccagttattgataatgtatcatgtgacaggcattgggctaaactcttgacaagcaccatctcactacattcttacagtaacacaacttgttcttgtgttgtcagcttctgacctcttgatctgttgtttatggcctttgtcttgtccctcagtgggggttctctagctctgacctctgggtgaccccctcagttgttgattgctctcactccccttggctgttgtgcttcatggccagcactcttgatgagggtcttggtctataaacaggcatagatagctagaacataatgtgagcagtgtttgccttcaggtggtggggttatgggtagtttttattttcttccttctacttctctatacatttcagattctctacagtaagcatgtgttacatttgtaattataaaagtaagtaaacttcatttatgaaaaaagagttcattgtggctcctagaatttgatttactgagtcctttattcaaccaatattagttatgtaacttatgtcagctactctttgggggacagacggataagaatcctgctgatatgaacattccattccaatggagtggggagaacaagaacacactgaacttagattggaattgtgaaggctgtgaagagaagaaatcaggac

SEQ ID NO: 49781 - DNA, 1051 bp, Homo sapiens
attatttcatttagcagaggtttaagccgttgttgtcaattgtgtgcagtaacgcctctgacttcccttttgtggaattttgtatcgattttggatttttaagtcaaaggagactttaaaatcattttgatttggcacggattcttgagattatctagtccaattccatcatattcagattttaccatttgcttaaagtatagcttttggcagaactgcccctaggagcagctccttgattcccagtcccctgctctttctaccctgcataatatatgttgtaagctttttgtttctttatagttgtttgcctagtgttcattttagttactcgaattccttgcaaggtaggttttgtttgtttatttatggaagttatttagtaggaatttcacacttaactgggttttcctttggcgtatgacaaccttacctaggacttagaaatctgtgatttctgagtttttggaatttaggaaaatgctctgggtaggattgatagtagattgaataaattaagactttaagacagaattgtagacttttggagttgggagataatttaaagaatattttaaaccaccagttttacagatgaggaaacatgctaaattaatcaccacatttacatcttattagtccttattaaagaatggtaaccaaaagtctgtttgaaatgtttgctctatttgtttggtttcattacatgacagagctgcaggttcttgatattaatgagtaagtggaatgcagtttatttagcagtgttctattagaggtactgaaattttcagggataaggaaatgaaagagagtttagcattgggaaatttgcaccatggatagattaagaggtagacagttaatagaacatttacgggttggagtagatgaaaagagatgtgatgttttgggatgaccttgggaattaaggattttagatacttataatttgggaggaaagaaagctcaaaggatttgttggtaagatagtataaccaatgaatttgacatagggttctggaacatttaaaagtagtcattatctgca

SEQ ID NO: 49782 - DNA, 1029 bp, Homo sapiens
catatagtctgagaaatgacacatggacagatcatttgaaattaattttggggaaacatttggaaagggtcatcatgatagccatgtggtgatcaattttctgctgtacatgtaataccatttatttatttatttatttatttattttgagaccaagtctcgctctgtcacccagactggagtgcaatggcgtgatctcggctcagtgcaacctccacctcccagtttcaagtgattctcctgtctctgcctcccgagtagttgggattacaggcatgtgtcaccccgtggggctaatttttgtatttttagtagagactgggtttcaccatgttggccaggctagtctcaaactcctgacctcaggtgatcctcccaccttggcctccaaaagtgctgggattacaggcgtgagccaccacacccggccgtaatacgatatttttattggggagtggggagtgaaaaataattttggttaacactagtgcttagtatgtatcaggtactattcagagcactttacacatatatactcatttaatctttaaatattcctgtgcaataattggtattgtccattctacaaataacataatgtgaaaaaagttgtatttcattttagggtccaagagatgttgtggaaattgtaatttgaacactgaattccagtatacttccatcctttatggggacagtaggagagaatatttgaaatcagaggattttcctaagaaatttagattgtatgttagccacaggcgtaacggtatgctagccataggtgtataacctttttgaatttttacattgctacttaaaaaaccacagtgatggctactcatagaatccatgtgtagaatccatgtggagaaactctttcaattggtttacctgattgcaagttatttacaaatctttttcttttttcttagttgtattttaaagtttcattttggtccttgctttatttcttttcttggaattttcagcattcccacagcttctactgttgactcctttatctgt

SEQ ID NO: 49783 - DNA, 1057 bp, Homo sapiens
gtattctgttgctgttggattgaatattctgtatatgtctgttaggtccatttggtgtaaagtataattcaagtctaatgtttcctaattgattttctgtctaggttatctgtccattgttgaaagaggggtaatgagatcccaaagaggagactttttcttttttctcttccccattttccttcctatcctcctaatttagttttatcagttctgtgagattcattttcaatgttgacattattatgactgcttaactacggtattattcacatctgagccatgtagtgttcaatgattttatttcctttcctgtaaaactttgttttatctcattttgttatttcatcattttcccactttttgatagtaacatctccaaactttccaacagaagtgtacatctctcattatattcaaacacatcgggttatctaaacctttattatcttttttgagatatccacactggagttctctgtcctatttttggaaatgcttattttctagtccttctgagtgtctatcttcctgcgatttccccttcatccttatcctgtaatttctctttgcttttctcttgtgttgaatctcctatttccaagattgctcccttccacccccagactttaaaaaaaaaattctttattttggtttcacatatcttcagtagcttttctgagaaagggtggcaacatttttgaatctttttttttttctaaaaacaccttgttttactctttcatttgatagcttgcaatagaaataaaggttggaaataacttcccctctaatctagagcttcattgttttccgaatcctagtttttcttttgagaagtatattgtgttcttatttgtgttcttttgtgtataaactgttcttcttctgtgaaagctttaggatcttctctttatcccctgacttcagaaactttattgttatgtccagggatgatcttttttgctttcattgttgtggctgcttcatgggccctttcagtctcaatatggatactcatgttctacagtgctagaatttttttatattgtcatca

SEQ ID NO: 49784 - DNA, 2323 bp, Homo sapiens
tctgcagcgctgacttcaactgccttttcaggcctagactttgggctgctttccggatacctgcataagcaagcccttgttactgctacccatcctacctgcaccctgctttttccctcttgccacgctttttttcctctccctcttacccccaccctgtacaaaatgcataaaggatggaaaaactactgcagccagaagtctttgaatgaggcatcaatggatgaatatttaggcagcttagggctgtttcgaaagctgactgccaaggatgcctcttgcctctttcgggccatttcggagcaggtaaaaggaaaacatatcttccctgtactgagttttcagagtttgagacatgggatggtcctgtagtttgccagaagaaacaaaaaaattcccctgctttctagtgaaaacatcgggcctgtcaaggtcctagagagaagctgcctgctcttattagcttggtgcatgcctttgctgaatagtctatattgctgaacctttgctatcttttctgtttttttaaatgccagtttgtaatgtaggaggggtaagataaggaggctaaagacaactttgaaatatatcttgatcctttgtaagcatcccctgcttcctctaattttaatgcctaagaaaaaaattataggctgtgcacataaggagtagaaaaggggatggggcatgacagtcatccttcccccatttcgttgaagatgatattaaaaaaacttttagtaagatgatttaatttcccaatttcctacatatgttctgaataaggaagccttaagtgtccagttcatagtcttgatttagaagtgcctattttaaatgactactgacagtgggctggtctttctcttctttttagttgttttgcagccaggtccatcatttggaaatcaggaaggcttgtgtctcatatatgagggaaaatcaacaaacttttgagtctgtaagtagaatacatacccaggggagaactggtagagtgtgtagcaggtggaaaaataattgtgagcacctaccaaaattaaactatatcatgctgtctcctcaatagcaaatatataattcccaactggctcccttcccagtagctaacatgcttcttgagcctctgctagaattaggttgtttaggactctaattaaaaatcaagaataatctacattttcccactacttacctcgtcctacgccaagaactccagaccctaaaaagttatgttttgattgctgttttatattatccatacagttttattgaacaattaataatagttcatgaaaggtttggctctgttaatattttgcaatgcatattttaaaatacgtaaaaatgggaaccccctctattttcttgcttaatcctgtgtacaataatcttcagccagtcaatttgaggaatcttgtaaaacttaattgtaagggaacaaatgagtctaagtatctagtctttccatgtcacaaattgtataattagagctctgccactaatgattaactttaggtaaaacaacttacagaagacatatttgtacaccttcatgtatttgaattcttgttaatgaaattggaggcttccttttcttttttttttttttaaacacttctggcccttgcagtgctatttgtttcttctgtttattgtgggtattcgcctgctgttcgagttttactcctaattttctcaactggtttcagtgaattttaaaactatgtgaagacttcttgacttaaaagcttgttaccttgaagttcattgtagtcttctctacacctggggaaaggattattagtaacattacttcaaatgcaaggccatagtgtaaagcagtgcgtctcaagtatttctgtgcatacaaatcacctggagatcttgttaaaatacaggttttcattcagtaggtctgagttggggcccgagatttctttttttttttttcttaccttgagacagggtcttctctgttgcccaggctggagtgcagtggcaggatcacggctcgctgcagcctctgcctacgaggctgaagcaatcctcccacctcagcctccaaagtaacttgggactacaggcacacgccacctcactgggctaagttttttgtgtttttagtagagatggggtttcgccatgttgcccagactggtctcagactcctgggctcaagtgatctgcccgccttggcctcccaaagtgctgggactacaagtgtgagccactgcgtgcagtggagatttctgcatttttaacgaactgaagtaatgcttgctattggtttgtggacaacattttgagtaacaaagatgtg

SEQ ID NO: 49785 - DNA, 1056 bp, Homo sapiens
ggtctcgatctcctgacctcatgatctgcctgcctcggcctcccaaagtgctgggattacaggcgtgagccacaacacccagcctgtatgtcatttatatctcaaaactttttaaaaggaaaatttaaatgattttttaaaagtctagtgatatgtatccatggaactagaaataaatctattacagtccctgagtttaatttcatttttattgaggcatattttacattcaataaaactcgtcattttaagtttaccatttttagttttggagatgatatgcaatcatggaactaccactgcagtcaagatatagaatgtttccgtcacccctaaaaggttcgcttgtcccatggtctttttagaaactaatgaaattctctttaaagttcctcagtttaattttgtaaatgcatgttttgtcaaatttgaaatccttagaaatactggtcttgcttgatttatgaaaattgtcattacttaaattggcatttcaaatgaaactcgaaagcataccatttgatgaaatgcactggtatgtggatatgccaggaccaattcctaagatacttttatactccagcttttctccactcatgacttttgtgtatgtgcaaatcttcttgaggtgctgtgcaaagtagatacttacaccataattgttgagctgagcaaaaaacgcattgcaggataatgtagaatataatcagatttcagtaatgctgtgtatttggttaagttgagtttgttttatttttgaagtatgtggagggatcttttgagaaatacctggaacggttgggagatcccaaggtaagatcaaatatgggggtttaatcttttcagagttatttggaatagtaatgtaaatttattcattcaactgtattattttagccagaccccaaatattttatttagtagccagctgtgttgaatccaatagttctcacataagtttagaggctggcaattgaccaattgttttgtgttgaatattgataattgtgtgttaatcccatcaaccatagactagcaaaagagtatacactactt

SEQ ID NO: 49786 - DNA, 1035 bp, Homo sapiens
gcattgtagggtgcttcatagcatccctggcttctatccactagaaacaaaaatgtttccagacattgccaaatattccctagaggagggagaggcacagttgtccctggttgagaaccatggttcttaagggactttgtgtaaacttaagcactcatatttgagagctaaaaagaaaaaaatgatcttgtggagatgagtagaatgatggttaccagaggctcagaagggtattgggggtgggggataaagagggattagttaatgggtacaaaaataggtagtaggattaagatctagtatttggtagcataatagggtgactgtagttaacaattgcatatttcaaaaaaactagaggactggatttggaatgttcccaacataaagaatttgtaaatgtttgaggtgatagatatcccagttaccttgatttgatcattatacattgtatgcttgtatcaaaatagtgcatgtaccccataaatacgtactgttctacacctataaaaattaatttaaaaaacttaagctgacatggatcttaacctgagggggaaaaatatttcttagagacctgagggggaaaaatatttcttagagaactaggaaaatacctcatagaagcagccagggatattaacaggcataatttattagagaatagtaatgtgtgtgattggatgactcggagtttttggggtttttgtttgtttgtttgtttgagacagaatctcgctctttggcccaggccggactgcagtggcgctatctcggctcactgtaagctccacctcccgggttcacgccattctcctgcctcagcctcccaagtagctgggactacaggctcctgccaccgtgcctggctaattttttttgtatttttagtagagatggggtttcaccgtgttagccaagatggtctcgatctcctgacctcgtgatctgcccgcctcggcctcccaaagtgctgggattacaggcgtgttttgtttttttttttttttttttttgagacagtctcactctgtc

SEQ ID NO: 49787 - DNA, 1082 bp, Homo sapiens
tatatccttcaaaaatacaaaaattccctccctatgtttatttggtttgttcctaggggaagcattggaaagtttaaggcagtgtggtggtgacagtacactgggccttttgctttgattatgaagcttatttgctacctctttgtttgcctgaaagttatatcagagatggacataaagcaacagaagaagatgttcaagaaaattcgagggaaagaagtttacatgactatggcttacggcaagggagaccccctcctcccacccaggctgcagcacagtatgcattatgggcacgatcctccaatgcactactcacagacagctggcaatgttatgtctaatgaacattttcatcctcagcatccatctccgagacaaggtcggggatatgggatgcccaggtaagacattgacagatttgtattttcatggtctagggaaatatgaagcaattgaagagatccaagaagatagaatgccatcaagatgagggtctctgtgacatacagactgtatttcattaataatagttagccctaatgccagtattgcagagagcagagctctttctagttgaatgtttttagaaagacagattagttctatttaactacagagactgactacttaggtattagtgaatagagagttctagtttcctttctctttattcttaggaattcatctcggtttataaacaggcacaacatgccgggccctaaagttgatttttacccaggcccaggtaaaaggtgctgccagagctatgataacttctcttatagatctcggtaagtattgtgttgaaagtcagagaaaattggtaagtctgatttcattgctgaacattaatgttttaaaaagtgtcaactttgagatatttgaactgttatttagaaattaggaacaagttactatatttcatcatttttacttttttattatttgaaccacttaagttcatttagacgtagtcaccgccagatgagttgtgtgaataaggagtcccagtatggatttaccccagggaatggacagatgcccaggggcttggaagaaactattactttttatgaagt

SEQ ID NO: 49788 - DNA, 1028 bp, Homo sapiens
aagacgtgatggtaagtattaaatacatagttacctgtagaagtaagacaaatgagggctgagaagttgagactatactatgtaatagccttatgtttggagggtgtagatgtagttatttttttaaatgatagaattgagagaatatgggcaaagcattttttcatgctctcagtcacatcagattctttagtttagatgctcagaaagttattccgagactatgtaatgtgggctaaagcaaatgagtaatggtgggatattctaattttatcccgtgtccttgtgaaccaggattcttagtgtggaaaaaaggtaatgcagatgttatagaggttaattaaaagcttttatagtcttgaacttgaattagaagtatcagtatgaacttgagatattttatctttaaatatatatatatgtttcctcgctgtgtccactgaaaggcctgaaaacaataagtatccctagcaccgagtttgtggtcttaaaataccatttattacttttaaaaataaacggctctgtggagaaatggctgattccaggtctgagcaggaaatgttcaagatgagcctggaacatcttgtcataccagatagcaaggaacatatcaaagagtataggcattatgtcagaaggactcagaaaccatcacaaagagagattcccactggccaaagatggaacaatttgagcctcaacaaagatcattgcaatagattggaatataccaagtatgttgaatataaaagttcttagtgatattttaaaaattgcttactttaagaggatgataggaaatcaattaattttcttgaaaactggaacatgaaataatcaaacatttattctgccttccttatatgaactatactactgaatagccaaatagatgaggggaagtatctttttgtaatagtattctaactaatcaattaaaaagtgaaaataatttttcagttcttattaaatggatggacattaaacatcagtagctactaagattgcaaagtcagtcaaacatt

SEQ ID NO: 49789 - DNA, 1030 bp, Homo sapiens
tatgctcctatgctaaactcagtgtgctaaaactctgactttaaacatttatagaatgataagactaaactttctatgtttctcagggttaaaatgataatgcagataacaaaatgatgaaattttgtacttggatttaagctggctaaaattattcagttaaacttgaaggtttgtatcattcatcttttgtaaaaaaaaaaaattaacaaatttgcgtgttatgtcatacatatatgcaggtatgtgtttttactaggttgtaaccacattgtttcctttattgtcatagaggattaatatttaaatataattacatctgaatttcttatgtcaaaaacttttaaatattgattatttctaagctatagtaacaggtatagaaagctaaagggataagatattgtatctaacctgtttttagattctgtacctccttagaaatggaacgttcatgatttaaagttccctatattcctgagatgctaccagtagaaaccttcaaggattgctaaaatctgtagtctgtgcactttaatccatctcttattagcttctgcattttgtgatttgactgagagtgacagattgctgaaaacattcttaaatttgcattgggtattaaactaagtaaaaattttgctttagttatgttttatttatgtacctgttagctaaatgttcaaagtctgatagtcaaagctctgcctcttccagttttttcccttttaatttccaatacttttcttaaatcaaaatgacctgttatgaactagttctccattggtatgtctaagagaatgtagacaattcactgtccaagttttttttatacccaaaccttaagaattaagagttctttgaccatactggagacaagaaaagtagatgagcctactgttcataaggtgttatagttgtgtattgctactttatgttttgtttctttgttagtgattgcctcaccatcctatccatgccattctgctattcctcatgctggtgcctctctaccaccaccaccaccacc

SEQ ID NO: 49790 - DNA, 1041 bp, Homo sapiens
ttgtgatgaaaaccaaaacaaaaccctaacacttaatcaccatctaggataaacatagtggtagacttctcctttttacagattacctcttaagttgctcttgttacaaaaggtatcctgtcttttctctgcttttaaccaaatttcagccatttagaattgtttggggaaggaaatacaaaggcactgtaatttgtttggaaccctttacttacagccccttcttgacataaatctggttacgctaaaggtaaaaagctggataatttctcatagccaggaaaaataattaaattcatttttatgctgtatatattctcaaaactgattgtggctttctgccttgattaagagcagatgaaaacattgagtcggttttactgttgaaatttaagacttatgaatttaaaacagctttcatttccttaaagcttataatcaaggcataacctttcaattagctttggatttaaaaggataaacaaatcatgggattttttatgtgaacaccagacattcagaacttagacaaatctccatagataatgaatgatatagtctattgggaagggtggagcataaacttaatctagacttttgtaaatctgggccaaatttagttcatttcatatgaaacctctttaaggccttttatatttacgtttataataaagaatttatataatttatataagaattcaagagaactaatacaggttgagcatccctaatctgaaaatccaaaatgctgcaaaatctgaaacttcttgagcactgacttgctgctcaaaatgttctttgtggcaatttggaatttcgaattaggaatgctcaaccagtaaatataaagcaaatattctcaaacctgaaaaattttgaaattccaaacacttctggtcccaaacatttcagaaaagggatactcaacctatgtagcaagagacaacctcttgtttccctccatcctacctagaatgttaagtttcagtaggagcaacttgatttagaacacttgtcttctctcctacctcaatgaccaaa

SEQ ID NO: 49791 - DNA, 1049 bp, Homo sapiens
ttatccttgtaatcacttaattttaatacaatcatcccttggtatactctggggattggtcccaggaccccccgccccatgtaccaaaatccatgcatactcaagtcctgcagtcaccctgcagaacctgcagatacaaaaagtcagccctcttgtatatgtggttttacattccatgaatactatattttctatttgcgtttggttgaaaaaatctgcctataagtcgatctacacagttcaatcctctgttgttcaagagtcaactgtaattttaatgacgtgttattttatccctgctagataatatatttcataagggcagaaagattgcatcttttttgttcatagtgatttttctagtatctagtgtagtattttatgtacagtaggtactctcatatttgactgactgaccaaccatatattctattttatgtaacttcaaggaagacagctttctaagtcatagttgttgctgatcaagccgaggcagtgcataagggccatgaacaggattataaagcaggtgattccacttggagaaggtacttcagcccttgataaattacagcctttccaagcctcctatcccagtcaaatgggatcgtgtccagacacagccagagtgaagtttgcttctcctccacagaaccagccaacaactattgtgcttcatccctgtgaggaagctttacctgataatgttgattttgtatcaggctgtcagcattgcgttcctataattgaaaatagacagagatgttacatcagcagtctcccagcaccctacccacccaaacatctgaatataattatttctatatattaggactagagaatgctacaggagctcctgcctgacaaatccccaaagcaaatgtatgttggaatgattttatgatgtttaaaacagtgagttggtcacaaaggagggacgggaggaaacagttttgtttaaaaagattcataatattggccaggtgcggtggctcatgcctgcaatcccagcactttgggaggccaaggcaggaggatcacgaggtcag

SEQ ID NO: 49792 - DNA, 1041 bp, Homo sapiens
cttggaaactactgcaggaattcagggatgaggtaaggcacgggccataatgacaaacatacagcaggcattccactatccctcattcctatgcccattctgtgcattgttttttgcttatggcactctatctaatctgttgaacatggtttaactgtaatgtaaacttaagagtaaaaaaagtttgataatgctgaaaagaaaataacatcttttttattacctttccaaaaatactattgtcaatataagccttataaaacctccaaatttgttttttactagaaattccataaagatattaattaattaattttatggagaaatgcttggcttagttgctgcagaattcttcccaaatttcaagtttatgtattgcatagtaactgattgtggtaaacaaagctcagaccaattttttagcatagggatgctgcaagtgtattcctaagacaagaggccttaattttcttggcacttgttactatgtagtgagcttttcagaataaagtctagagctatgtggacactttggagctctgatgaaacatagatagcgatagctttacaaaattcttattacattcaccagggtgagaatattatggaattgttgcactctgtaatatactgctcactgtcttttgtcaataagagaatctttaatccaggcactctttaaaaatatcctatattttcccaagaagaggtatgcaaatgaaatgtcactaaatctaaagcatattttcccacttattactgctttcttgcatcccatatttttttctttttaatttttaagttgtatgggtacataataactgtatgtatggagtacataatatatattgatacaggaatacaatgcataataattacatcagggtaaatgggctttccatcaccttaagcatttatctttttgttacaaacatactaaatatacccttttagttatattgaaatgtacaataaattattgatgactataatcaccctgttgtgcaatcaaatactacatcttattcattgtacgtaaca

SEQ ID NO: 49793 - DNA, 1128 bp, Homo sapiens
ggagttcgagtccagcctgaccaacatggtgaaactctgtctcaactaaaaatacaaaaattagctgggcatggtggtgcgcacctgtaatcccagctactcaggaagctgaggcaggagaatcacttaaacctgagagtcagaggttgcagtgagccaagattacgccactgcactccagcctgggcaacacagtgagactctgtcaaaaaaaaaaaaaaaagaaaaaagaattcgggtttttccactaaagatactacatggagagcatgagagtacactcacattctggtgatgacaggatggcatactctttgaagatttggcttcacctaaattttttagaaggtaaactcactttacctagaagtcaacatggatgttgatgggtcatttgtaatttaaaaagggggaattcctatgaaggaaacaaaaataaaacaccatttaatgaaacaggtgttcccttgggaagggttgtaggggttgggctggggagtgaaattttatgtttcaaaaagctcgatcaatctgaaagtgactgactctataaaggcttcgtttaagggccacaatagaaaagtaataaaaacaaacaactatccctaaaagtacaaaaccataaattctgtatcggtgggtctatatttttcaaaagaagcaaaaagaaatgggtgaatttttgtttcagaatttgttattttattttgttttgttttttaacagtagtatgcaccctagagactaattatcagcctttcatttcctggtcacaaattactttcaagcttcattgttgtattagtatccattttgtggtgtttacttctgttttttaaccatgaatacacatattggagtaaggatgtgtaactgaggatgtaaagcaatttgctacatatgcagccaacatttaagtcatttcaagccattaaagcttataaaagcaaattatttgccctttctgggtccgctaacaataaccttcaccaaagtggttttagaggagcatagttactgaattagatcctgctgaattagtaagtttctactcccccaaacagtatttagtaagtcagcatatctgtaatttttaaattactgctcttataaacaaagacagagaca

SEQ ID NO: 49794 - DNA, 1173 bp, Homo sapiens
cgggacgtaagatgatcccagcccgggaggtggagtgggggttaatggcatctgactctagccttatgcgatgctccttgcctctcacctgagctgcacgatatccccagtggtgcagaaggttgaacttttgcagaaggttgagcttggagctaagtgggttggagagcctcgccatttagcgtcagacagacgggatgctgggggcgcccggcctgttaagagggattgggaggagggaagggagcctggctaacagtaggtagaaaatgtagggaaaagtaaaaaccattgaggggcaagcacttactccactttgctggatgtcacaatggactggggagcctaaacttgatcctcgagatgcagttcatggtgaattccaactaagtggctggagccccacacataccagttggaatcacgtgccccaagtctctgatggtcacatgacgtctttttactttaaagctggaatgtaatggttgaggcccatattccaaaaaccacctctacgtttgaaaaaaaaaaggtggggaggagtgtgaactagcttctaatcaaggaagtctactaggattttggatgaggggaccagaaagggaatttggtgctcagcttttatccaaaacaaaaacaggagctgtttttaaaataagggattgaaatatatgtgagctgggacatgtatctcctctcttcttcaatctcatggtttttctaaatttaaaaaacatcttactaattattttctagggaagtcatcctattactcatgcctcattttgtccctgaatactagatttgaagctaaatcccacaagatagtgttaaaaagtaaggctctgttcatcttccttggtctggcctatattctaattgaactgttccctattttaggcaactacttaaaggtagtaaataacctcttgactaaaattaaccaccagttatttgtggttttcaattaactggattagaaatcatgcacaaaaacagtggatagtaaatttgatacatcgagttggttgggtttttgcctgtcagtggtttggtagaataatgagaggacactgaaacaactttcccatattgacctatacccgcccaagtggcccaagttaaggttgcttctgggaaaacgtggcaatttggctattcagattatatatt

SEQ ID NO: 49795 - DNA, 1049 bp, Homo sapiens
ttgcttgagcctgggaggcggaggttacagtgagccgagattgcgccattgcactccaagcctgggctaccgagtgagaccccatctcaaaagaaaaacagaaaaacaaacaaacaaacaaaaaaaaacagaaaatgtgggaagttaagttgaaaaataaacaccttcaaagctattaacttggattttcttttcttttcttcttcttttttttttttttttttttgagtcaggttctcactctgtcgcccattcatactctgtccagttcattgaaaatacaagtctgattcccttgagttgtgatattcatacacacacgagtatatatacacttatgtgtgcatatgtatattatataaagttttacgtgatatataatataagtttttactttctgtaaaataaaatttgttagggccgtataatagttttgaatattcatattattgtgttccacattataagctctaattacatcgtgttgcactcagattgacattctgctgttgacactgaaaataacgctttcattcatagatgaatgtaattttcaagctttttttctatatttcttaacttgcttgaatgttcccatttttgccatttcttgttgttcattttaacattttggggcttgtgtttcagatcaggaagaatcaccattatagggtgcaaagagtttgctcagaggtgaaaatgatacgaaattgtccctagagcacatcctattgctatactattcaacatgtatgaattaatctactgggaaagtgtcttgtgtagtgtgtactttaaagatgttttcaatcactttgctttggattagaaaaattcaaggtaactataattttaaatgctcatatttttatgtttattttatatgtaggaagagaaatttttaaaaattggaataacactatatcccattcttttcatttattacattataaacatgtttccaagtgatcaaatatttttaaaaatgtttaaaatcactgcagtatattttatataatggctgtttcataatttatttcactaattcc

SEQ ID NO: 49796 - DNA, 1808 bp, Homo sapiens
ttctaaatataaaccttgtgtgaacaaagaaattcacttataacccaatataatcaaatctaaactaagaacaaatctcatttaaacattgttatttctttgcaataattattgcataccaaaaaagagcccactatgagttaatgttacttaaatagaacattgctcagcctacaaatgaaggtcagcagacaccagtgtcttggaataaaatagccctttggcaagaaaacgagccacaccccattaagtttttacaaaaataaaattctttccagctttactaaattgtagatgttgcgcccagcatgtacttctgcagtagttgattctgcagctgtggaaatattcatgtatgcagaagtccccaaaaacatctattcaccattacttgcacatgcagctcttatactttctgtagtaaagtattccgttaagttttattttgactcgtggataatagcaagcaactacaggtatagctgacaccttaatttcctgccttgaacttctggccacagactttatttttttattttttgagatggagtatcgctctgttgcccagactggagtgcagtggcataatttcggctcactgcaacctccgcgtcccaggttcaagcaattctcccgcctcagcctcttaagtgcctgggattatggtgcataccaccatgcctggctaatttttgtattttttagtagagatgggttttcactgtgttgaccaggctggtctcgaactcctggcctcaagcgatctgcccacctcgacctcgcaaagtgctgggattacaggcatgagccaccttgcctggcccattgtcacagaattcaaattgagcaggaatacgtaggatttcaaatctaacagttgtttcatttggtgggatagcatcaaagccatgtactgtgaccactgtatatggttttcttcaagagcagcaataaatttctgccatgtaccatgggaaagagctgtacttttagggagaaaggaaataagccctgagaaaaagccccattttcctagttcctttcacagttcacctggcacacaacgggtcttgatatttatatttgaaagagtgaaacatggatggccataaatgctccttgctgataacgattgaattgggaaaatctaatcaggaaatcagtgatttatgaattacattgcataaaatacataatgatgggagcctgtaagaagactaaacaaatggcttccttagtttatttttcctttaggttttagttgttttcagtgaatattatgagtgaatgttatcgatagtgttttcattgtgagaactgctaaactgtagagtcaaagaagaaattgggacatattaatattttgacttttatgccagctttattgagacataatatcatactttttttttttttgagacagagtttcgctcttgttgcccaggctggagtgcaatggcacgatctcggctcaccgtaacctccgcctcccagattcaagcgattctcctgcctcagcctccctagtagctgggattacaggcatgtgccaccacacctggctaattttgtatttttagtagagacagggtttctctatgttggtcaggctggtctcagactcccgacctcaggtaatccgcccacctcggcttcccaaagtactgggattataggcgtgagccaccgcgcccggccccataccatctatttttatagattttagtatattcacagataacatgcaaccttcaccagtcaattttcaaacattttcatcacctcagaaagaaaccccatacacttta

SEQ ID NO: 49797 - DNA, 1081 bp, Homo sapiens
taatcccagcactttgggaggctgaggcaggcggatcacgaggttaggagatcgagaccatcctggctaacacggtgaaacctcgtccctactaaaaatacaaaaaattagactggcgtggtggcgggcgcctgtagtcccagctactcgggaggctgaggcagaagaatggcgtgaacccgggagacggagcttgcagtgagccgagatcacgccactgcacaaaaaaaaaaaaaaaaaaaaaaagataaagtgggaataatgtttaaagcaggatatagaattaatacaagtaaatgttcttcattttccctattaatttaattatactatattctgtgtttaattctgaattagattttttaattaaactttttattttgagataattgtagattcacacctacttgtaagaaatggcacaaagagatcctgtgtacctttacccagtttcttccaatggtaaactcttaaaaaaccatagtacaatagcaaaaccacaatgttgacactgatacagacaagaggcaaatgagtttcattaccagtagaatcccttttattgtcctttgataacaacacacacctccttcctcccctgacctccatttttgaccccaggaaaccactaatctgttctccatgtctataattttgtcatttaaaaatattatataaatggaatgatatatagtatgtagcctttgggaattagctttttttctctgagcgtaattctcttagagattcaacctaagttgttgtgtatgtcaatacctcgttccttttcattgttgaatagtattccatggtgtgtatgtaacaaagtttatttaaccattcacccattgaaggatatctgggccatttccagttttttagttatcacaagtatttgtatacaggtgttagtgtgaacttcagttttcgtttctctgggattaatgccggaagagtgcaaatgctgagttgtatgagagttgcatgtttaattttataagaaattgccaaagtgtttgcccagagtgactgtaccattgtgtgcttccaccagcaatgtatgagtgatccagtttttcca

SEQ ID NO: 49798 - DNA, 1219 bp, Homo sapiens
ttctgaagaaatgtgtatttttatgattttgaaattattgaatgaatattaattagcagtttcttttttattttttaaattttttgtgtggagatggggtcccactatgttgcccaggctggtctcaaactcctggtctcaagcaatcctcccgcctcagcctcccaaagtcctggtattacaggcgtgaaccaccatgcccggccagcagtttcctttcagccataacatgaatgaccttttttaatggccaaaattgaagtttgtcaggttctaaatcactaatatgtttttgaatttaaaaatttttgaaggtttacttctggaatttttaagaccaaccattagatttataaggctgttaataagattcctaaacctattgttttgccttaaggaaagtatggtttaccttttgtgttatcccaaacaaattcatctccccatatagcaaaatggaatatgctactaaatagttgaaatttagggtaatggagtttgggatatgtttattattcatgaatagtaagtcaaaagtttttaaatgaaaacatttgtgtattctcatgctttgattgttgattctgcaaaataaaatcttaaaaattacaaaaagcatctgataaacttcttaatttaaaagaacactcagaaatttactttcaggtatttaaaaaaagagggaggctatcaaactgattaggactgaagaagaactgaagagataatgtcaccttgttggttttgggtgagggaaaattgaatgagatcatgctttctttctgtcttgctttctcaagataaagcttttccactcttctgtctgcttactgattcagggtggcaggcacaaaacaaaacgttccggttatattttccatcctgtttatatttaaattggctgtttattctttaataaagtgtataactgttggtctataacattatgaatgtgggattaagtggttagacttagcaggaatttgaaaatcagggtccaaatgtactaccctaagtacagtagcagaattacttctataaagaaaacttccctaagttacagcatctggctcatagcattatcattacagtgaagtttaccatcactcatattagtgatgtgttacttcccacttactcctaaccctgcttaggtaatgcaaaactataatttagaaagtgtgatttaaagaagatgcaatataatggtactcattgt

SEQ ID NO: 49799 - DNA, 1032 bp, Homo sapiens
aatgatcgtatcttacagagttagccaatggaacaagagtagatgccttttatccttatttatttgctttgcattaaaaagacaaatgctgaaagtttattcttgactatgaaataaaccactataatatatgacactgagttaattcctttaggatgctatgtcttccacatacatccatttaataaatatttgttgagtgcctactgtatgccaggcactgttctataagctgaaaatagattgctggacaaaacagacaaaaaatcactgccctcttagagcttattaaatacgaaaacagtagagcaatttaaaattatttaatgctatcactcagcttttaaagatcttcactgaatgagttttgagaacttttgcacatattatctacagcttgaatagggaaaaaatgacattttgtttgaaatctagttcaagaagctagaagctgataagtaaagtaaatattttattctgtgatgatcattttcagttttcatttatcagtgttatacttaggcctcttgaggaatgttactagtttaacttgtggatttcctcctgaggatgggcttaatttgtattgggggaggtggtgaaaggacctagtagccctggaatttaatgtaaagtcgtggcatttgtaaaactatcttctgtcatttgaaaaattatagaatacttaaatgtatttaatgctccctgtggaaaatgaatgtattgctcagttatttttgcctatgtgagtagtacaagagctgactcaaaggagatgacatgatggttcctgtcctgaagtgaaataagatgatgggttgtggtggaaaaatgatgtggtcatgcccatatttgctcacatctcttgttcgtttccttttatagagggaaaccagggaaagtctcatttcttattttttgtttcctttttgtattttctttcatacgccatttccctttctttttttcttaaaattgcattatagtgacttccaattcaattggctcaagttgtacttggtaatgacataa

SEQ ID NO: 49800 - DNA, 1028 bp, Homo sapiens
gccagcactttgggaggctgaggcggacaggtcatgaggccaggagttcgagactagcctggccaacatagtgaaacccggtctctactaaaaatacaaaaaaaaaaaaaaaatagccatgtgtggtggcaggtgcctgtagtcccagatacttgggaggctgaggcaggagaatcgcttgaactcgggagggggaggttgcagtgagccaagattgtgccacgcactccagcctggaggatggagtgagactccgtctcaaaaaaaaaaaaaaagtttctaaacaacattgtacatgttatgtcatgactgtcatgataaagtcttgccttttagacatgaacctgattcagcaaaatgtgctttgaagtagataagctgtagatttttgtcttgcctgaattgatattaaagagatgttttttcttttcacagttcaaaagtacagaactcaggttaaaacctagatatgtaattttgttaattttattttcagtttgaaaattcttgttaaaacctgcatactttataggtttgctgtctctaaaattagatggctccttcataaatattactgaataaagcaccagttttcaaaaagtgtggcacatgggctcatgggggttaaaattactttcatgataaaactaaattgttatttgttttttcactgtgttaacatttgcactgatgatgcaaaagcagtagtgggtaaagctgctgaatcaagatagtggccccacactgtagtgatagccactgtattcctcagcaccataccatcacctttagaaaaaaatcttacaacatgcatttcatttacaaatgtacttgatgaagcaggaaaaaataattgtattaaatctcaattcttaggtatgcatctttttaaatattgtgtgtgatgagataagacatacccataaagtatttctgctgcatatggatatatgacgattgtcttgagggaaagcacttgcgcagctgtttgagttgtgagctaaactagctgcctttttaaaaataga

SEQ ID NO: 49801 - DNA, 1042 bp, Homo sapiens
caacaagtttatatacctaatgctgtgcctggtatgaatttcctaaactttccaatatagtcccaaaattacagtagtagtttcttgaatgtaaacttgttgcctgttttatatgttagatccctttgcttctatgcttcactcactatgtttgtttgttcgctttgtttttataagtcatgaagatggaaaaaaaactgtttcatgaaaggaaaatagatgagtgttgttgaggtgtgtcattaagcacagtgggagaggcctccaatgtacgtgtcacacatggaaagtatacctagtactgggtgtggtggagagcatgacgtctggatgaaagttgtaagagactttaaaaatactatgcctagcttttgtgttacaactacatattccactgatacttatgtgaaactcccataacttttcgggttgtacctcttttttccaccctggggtgggagtgtgtccacaagtgcatgtgtgtgaactcttaactttgtgtttgtattttgagatggagtctctgtggcccaggctggagtgcagtggtgcaatctctgctcactgcaacctccacttctggggttcaagctgttctcctgcctcagcctcccaagtagctgggactacaagggcacaacaccaatctggcttttttgaatttttggtagagacggggtttcaccacgttggccaggcttgtctggaactcctgacctcaggtgatccgcccacctcagcctcgcaaagtgctgggattacaggcctgagccaccgcgcccagcccggcctgaactcttaactgtatggtttctgtttgtaacatctagagagagtgacagtgagaatttggtttccgtcggctttccttagcattcattttgatgaatttgggatgcaatttaaaagctgttttcattctgtggcctgctgatgaaaatgtagaatttattgcagaacccttgccaccgtcttgcattcccaaaccagtgttcattacccatagtaaaaaccgagatcctgttcacacacatgcacatac

SEQ ID NO: 49802 - DNA, 1050 bp, Homo sapiens
catgtcacgattagattgatattatactcttcctacgtgagttaaatcaaacagttgtcttagtgtttataatttacaaaataataaacatcactggtgattaaattttgatggcgttattggtacttggcagcaatagtgatttctggtgctcacatacattaggattttccatcacatggttgtcatataagtttaatttccccatatttctggcaaagggaagtatagctagttatacagtcaatcctcactctgagttgagtcacctctcggactggttgtacttaatatgcgcatatgaagtaaaaagtgaagcatgaaacaaaacaaaccagttttttcaattaacaagtgctgtatttgctaacatataagcaaggtatataacactgcaagaggcattttcagtgacttgccgatagctttctgcttcgtgtatatagtgatttgagttgtaggtcacaatattttatggcatttttattttgaattgaagtgaagcatggtaactagtctgatcttgcctagcctctctctctctctctccctccctctctctctctctctctctctctcacacacacacacacacacacaccccacacacacatatccctgaaagttgcccttggcttcactcaaacatatgttaattttcataagaaaggaaactggtggaaatacttcttaggtatgaaaattaattaatttcattagcagcagatttattttcccataaattattcagattttgggggtagatgtaaaagtttacttaggcatggaagacattagaccttttaaaagcaaagtgggctatttcaatctaagaagttagttaatgtaccttagctttctgaagctaggggaaggagaggtgtctttttgttgtgtctttgggtttgaaatagtattcttcatcctaggaaaaagggcttttagactataattgagacttgcattaaatagctgcaaaattcttgcctgagaaacgtttaaatgatgtctttaatctgaccaaattgaattgaatatttctattattgg

SEQ ID NO: 49803 - DNA, 1841 bp, Homo sapiens
tatcccaggcacttgtttattccctaatacaatttagggaatgaagttatggaactctacagacttcttagctttcaaattctcattgctgtgatcactggatattgggaatactgggaattttcactccctctaaacattgcagttggttggagtattttattcattttttatgtttatttttttagaggcaggcaaccatagctcactgcagcctcaaactcctgggcttcagtgatccttctgccccagccttcctagtagctaggactacaggctcaggccaccatgctggctgatttaattttttttttttttttaagagaaggagtctcgctatgttgtacaggttggtcccaaactcctggcctcaagcagttctcccacttctgcctcccaaagcactgggattataggcatgagccaccaccctcagcctcagttggtatattttgtaaaccatgcctgtgtaaccaacatccagcaatgagagtaaaaggtgaagtttagactgttctccagaaacaaacaatcatgaaatgagacttgcaaagcaaagaattacacaagtttttgtgtgctgttcgtgaaagaaggattttcttttattgaagaagattgttctctttgaccaagtttaagaatctatgtaaagaaggtagataaactgaaccaagtaggacaatggaagtcccagttagactgactgtcctcatatccacttatgtaactatagggagaagtctataattaaatttcaaaattttgtggcaagattctaaattctctgggagttgaagagaaagatcagtgggaggtggagtcattgggaaacgtgctttgggagaggatgaggcttctgaaccttgcttgaagggtgagtagaatttggatagagagagaggaaaaatagaggagagtattctaagcatgagacgcagatagagagagaggaagttcttaatggaagacaggaaaagcagaagagaccagaataaaacaaaaggtactgatagaggagaatccagaaccagctgtaatagaaacacagttctgtgagagtactgggaagataaattttatcttgggtgcggacaatctgaagatacttcctgaaataggcttttgaagtgtctagatagatgggtgaagagcattccactggagagacccagtggtctctccagggagtggaagaagcgggaaaatacatggcctgtttggggaataaggtctcttgagagtgttgggttcaagggtgtagtacatataatgggaagtagcattggaaagatgggcagacataaagctagaagtcaagtcagaaaagtgtagggccttgaatgctgtcctaaaaaggtgggacctccttttgcatggaatgtttataagatccgctcttcaggagattatcaggagattagcagtgtaaagattgcactggaggaagacagaacagcaggcagatctgataaaaaaaaaaaaaaacttttgtggggttgggggagggggaagggatagcattaggagatatacctaatgtagatgacgagttaatgggtgcagcacaccaacacgacacatgtatacatatgtaacaaccctgcacgttgtgcacatgtaccctagaacttaaagtataataaaaaaaatatataaaaagataaaaaaaaaacttgtggagtaggccagacatgaggtgataaacagatatgacggaagaatctcagatattgcaaggcaagaatccagagggatgggtggttgactgatcctccctttgttttttatggtcaaactgcagtctggagacagaggaaagtgggaaagttgaaaacgag

SEQ ID NO: 49804 - DNA, 1035 bp, Homo sapiens
ttttcctttacagaaatggcaggcataggagctaaggaggaaacagaatttgggacagatcaaagtgctttgcagatgagcgaattcagaaaaacgtagagactccaggaggttttatttttgataagtattaaaattgctgagtttaaatggaggaaaaatatatctctatttctttgaatgtcagttctctttctctctccctctctctcatcatgtaaataaagtccgcttttgcttggtggcacacatctgtattctcagctactcaggaggctgaggcaggaggattgtttgagcccagaagattgaggctgcactgagctgagattgcaccactgcctgggtgacagagtgtaaccctgtctcaaaaagaaataaacacataaagtccacttttgtgggaagacagactgggaaagaggacatatttgaaaatcagggtttttttccttttgcctgtcaatcacatattgtgaaatcggggttaaacttttattcagcaagtaatactttctcttcacctttttctagtactcatgaaaaaatttgcaaattaggaggaatgtgacaatattgacaagctgttagctattttgaaaagtgatcctaaaatatttaaagaaaaattgttgtttgtttgtatatctcctgtctgctctttaaattgtgtttagaaactggccttacggaggaaccaaattgagtcatggataaaaagtgactgacaggttttcctttaggcccatccttcttaaattactttgactaaagacttgtaatttttatatatgagggagacctattatactctgtagtcagtaattatagggagatgagataacttttcatttatcccatgtaaaaggctattagtagaactaatgccttatatttatttatacagctcttcacaattaacccaagcattcatttattccctattttctttcatgaaggatttgaagttgctatgtaatacttcatagttcacaatatgctgtcatacataccatctgtaatcttcattaggac

SEQ ID NO: 49805 - DNA, 1032 bp, Homo sapiens
aggccaaattggaaagggtgtatactcagataatataataatttacatgcataagaatgtgtatattagcacacatgtgcatttttatatcaaaaccagctataatttgttttgtttcctctttattcttcctttaatgagagtgattgatagatgtcagtatgctatttgaaaatcaatgtcttcacagtgaatgattctaaagtggcttaatgggaaaatgatactttccgtgaatcattggtcacataatattgacctttagctttggctcatataaccaagaatttctattatgtagctttttcctgtcactgctgggtactttggcccttccttaaactttttgaatgtaatttaagattttgtccttagaaggaaaattcagaaatattttttctcaataaattttggtaagtgatgacttctcatttgttttctttattaaagctgtatgtagagacatggtaacctattcagattgttttgatagtttgaaattctgtttaaattatccctaagatgagaacttagcaagagtgcttatatttatcacaattttttaaagtctgaaacgtttttggtttttctttagatctttaaatggatgagatggctaccactcagatttccaaagatgagcttgatgaactcaaagaggcctttgcaaaagttggtgagtattttttgtagtaaaactatagggaagcaatatttatttggtctcaaagttatttctctataaatatcacatgaatggttaatcaaaaacattagggcaagatagttaaaatagatgggataaagttttggaagctatacttaaaattgttttatttcttttttttttttttggtcgagtggtagctgatattatttccaattttatgtagtatttaatatggtcaaattttttagaccacagttccaatccttaactggtgactgttatgtatggttcctgaaattttcatgccaaattttagttattattatattttgtatctcatatctttctgaagaggtttgaaa

SEQ ID NO: 49806 - DNA, 1058 bp, Homo sapiens
agaaaaattcatgtaatgtaaacctttgcagagttgctttagtactgcaaacacttaccttgccttgccttttttccctcctgagcactcactactgaggttttttaaacatgaattcagcacttttgaaataaaagaataatgggtttcttaaatgactaggaatagtatgggtgtattcctttgaggtttcccaccaaactaagcaaaaaaaaattggttgtggtgattgtagctataccagacttctctcatcctaggaagttgagttgtttcaaattacttgatattcgctagtatataaaaaccacatcaggatgatgccacaaaaaaaaacagtgctttagtttaatttactttcagtattcaataaaagaacaccagtgcatatttgtttaattatgccttaaaacaaaaacaaaactatagcccgtctaaaaaaaatgaaactaatcagtgctctttcattgtgccatctggttaattatatatggattattagaagtggaggtctcgggatagtcggaaaaccatgtttcaaaggtgtggaagctagttaggagtacacatgtgtgggtgcatgggtaaaagcaatttttatttttatttttatttttattttgagactcctgggctcaagtgatcctcccacctcggcctcctaaaatgctgggattacaggcttgagccatggtacctggccagccaggtatattttgcttcatgcactagatgcgttcctgaaaatcagcaagccaactgtaaatggattttatgtagtgggatatattttaaatgtaaagagaaaatcttatttttttaagtgaagcctgctttgaatttttttatttttttatttttatttttaattattttttgtttatttattttttttgagacggagtctcgctctgtcacccaggctggagtgcagtggcgcgatctcggccactgcaagctccgcctcccgggttcacgccattctcctgcctcagccaggtggcagactacaggcgcctgccaccacgcccggctaatttttttttttgtatttttag

SEQ ID NO: 49807 - DNA, 1081 bp, Homo sapiens
gtgtactttgaaacagaatcagcattaagttcatataagttctttttggagcaatggaagaataagaaacacaaaattcctatacttacagtagaaattgttctataccatggaagtgttttgtaggtttacgatctattagttctttttttaaaatcctattagcgccaagttaataataattgtattagccaactatgcttccttgaacttagggatgctctttttaagtaaatctacttacacattgcttaaatcacaggatacatgatgtaaaaccttgctttttccatttaaatgtccatttccctttcaaacaactttatgttccccacaataagaaaatattttatgtaagtgagcttatgaactgaacctcaaatgaagggaaatactctaacttctgtctttcaattttttttccttttttgcttgctctccttttttacaaagatctcaacagcaacggattcatttgtgactatgaacttcatgagctcttcaaggaagctaatatgccattaccaggatataaagtgagagaaattattcagaaactcatgctggatggtgacaggaataaagatgggaaaataagttttgacgaatttgtttatgtaagtatgtgaaaattcacaattattagaagtagtagatgttccctcgtctagtgggatgttatagtattaagtactgttatgttaagttcttaaatatatcatattagtactgttataacatttctgtcatcctgcccactaaatgtacttcttttagctgctggaatatcttaacaaacgaattgagaaaaagagcactgcagaaacaaagatataacatgataagatgttaaggtgataagttatataaggcgaacagtctcctttcatgtcatcattaaagggcagttatcaaggtgctaagtgacatctttgaagtgttctctctcccgtggtgaacagtgtgctccaaaattttaataatacaccctgactcacagtctcggaagcttcctgagctgaactttctcattaaaaagttgttttccactcttgtggtaggggtatttaactgaaccatt

SEQ ID NO: 49808 - DNA, 1044 bp, Homo sapiens
gactgtattaaccaaatgtctgtccgcacccatctgccttgtcatcagtgaaacatcttacaaattgtcaaacaaaatatgggtagagcttagttatccaagaaatagaaatcatgttattcctgttagatattggcataaggaaatagatacaaacatgttcttgcttgttaggtttctgctttttctttgaattgttgcttaaggggtgttaattgcaaaccagactacaaacaaaaacagtttatgttaatttcagagaaatgtctgtgtgtgtgtgcgcgcgtgtgtgtgtgtatggcaaaaaacagtcccaaaattatatgtatgtaaactttaaaggtgaaaattaaatttaataccctgctttttaaaattctaagcacttcaaaactaaaaatactggatttttatgcttacaagataatgggactttttttctttgattgttaaactagtatggcactttcagcagagaagtaagctgcccagaacagtcttggacatatagtaaatactatataggtgttagttgctggggtagttctttctttaaaaaaaaaaaaaagaagttatgtttttcaaatattactaagtttaggcctacaagacattccaaaataatggaaaaattcaatcctgcctctttggaaacattttggaaataagccccaaacactggaagccagtcaattctttttttgcaattctttctgaaatctttctttcttaagtcatatgcctctggattgttttggtttggccactcgtcctgtgttgagctaactctggggtcaaaagaagttagccggttgctgagagtctttgagagaaagaaggcgaaacttaataaaaggaataaaaaacatatatattccataacggagactgaaaaagatgtatagatcaagagtggttatggcttcctgaaaaaagtacagcaggagttagctcacagatgataaagcaagtctttccttgtggagagaaaacagcacaaaacagtgagctcattagtatcacaacgggcagctttgaaaagat

SEQ ID NO: 49809 - DNA, 1121 bp, Homo sapiens
caagtgattctcatgcctcagcctcccaagtagctggggttacaggcatgcaccaccacgcccacctaatttttgtatttttagtagagactgggtttcatcaagttggccaggctggtcttgaactcctcctgacctcaagtgatccacccactttggcctcccaaagtgctgggattacagatgtgagccaccgtgcccagcctacttttctagttctagttattagttcgaattcccagacgttctcttttttaaatatgaattaatccttttttctgtgacataaacaaatttggatttattttttagctgaaatcatgatcattgaaacaacctaagttttagaagtaaatgattcttgaagcagaagcactcgtaataagaaaaataactttacatatctcattctgaagctgtaacacttttgtcattgcagggacttgtggtatgttaggcatgaagaaatgcacacctttcagattttaacttattagacaatgaagtagagttcagaaagaagtagactagtgactattgtcttttcacagagcagctgcgttgttatcaaaaggagagctataggatcaaaatgcatcacagttaaggcacagttggactaaaaaatcagattgtaaataaaaatattttaatcatttgaaaactgcctgaagtgtgtgcgtaagctccatactgttgatacttagtgaaagtcagtataatggccatagagcaggaagggtgatttcattggttgtgtttagtatttagagtagtgtgtatgtgtgtgtctgcatacatatacaaacatagacacacacagacatttattctaaaattccacctccaaaattactggtaaagctagcacagaatcacaggtatggaaatactgagtaagcttgattttgtaaaatttaagtgcttactaactattctctcaaacaaaattttatttgtaagtccaaagaaagttaggatttaatttaagaaaggtaacaggaaaaaatgactaagtaatagggccactgacaacacatacagcaacttttctaccagttactaaaagtcactttctctagatggattaattacaaaaaggtaccctcctggaaagacaa

SEQ ID NO: 49810 - DNA, 2011 bp, Homo sapiens
tcctgttttactggctttgactaatttagccacgcacattggtggatcaggaacacatttggaattaggtacattccaatacctcagaaaaatatagacagatagaatgtccaatcagatagctacacagtactaggatgtgaaacttactgtgttataacttgcttttgtacaattagaatgttccttactgtgaagagaagctggacttcataaatgccccaataagacaatcactgaaaagcctctttttggtgtttattcttgatagtcatctattactaccagcttaacacattttttaactgcattattctgtaacttttgatttaatgaattcttaatgagctaccccattatactgtaaaatagttttttggttaaatcataaaattttatctttctttgcattaagaatttttattaaagtagggggattcttcaatgttttctctccaggaaaagaataaagccttccttgtttgtagaaaattaacagatttacctgtgcctttgaaccacattagtttttggcttaaagtgagttcaatgcatgtagcgcttaatgtttttgacaagtgtgtgcaattgacattctggtgcttcattttcagaaggggtattgtagtacttgtttagcatttcaaaaactcaagcccagttttttgtatcttttaacatcagctatggaaaaaatgtaagtgatcaagatataaaagaatataaatatgcttattgtgcatagtttgaaattaattgtgaatcaacaaaattactttaattaatagatttttcaagaggtaaaaagtagtgatattgccaagaccttccgcaaagcaatcaacaggaaagaaggtatttgtgctctgggtggaacttcagagttgtccagcgaaggaacacagcattcttactcaggtaatcattttatatgcaataggttaacacaatgtgctaagtgggatggttgctgtaatgtcaaggacgggctctagaaaaacattaccttctaattaagaatacagtagaagtcctttgtgacatgtatttaggcttgagactaatacttgtcataaaggcattataagtgtttattgtatggctttgttagcttgcaagagacaggatacaatccatgtaatgacaggctttattacagtgcattatacagtaatataaatataatttttaaggaattttgtaacttttctgaggactggttaacgtgttctattctttttcttaattttgtaattcctaataaccactgtgttgcatccaagtgtctgggtttccacacagaataaccacatgtttctgacacattaactttcagcactactgcacaactattttaggctttggagtcaaatatttaataagttagagtatgaactaatgtcttgttatttaacataattttagaggaagaaaaatatgcttttgttaactggataaacaaagctttggaaaatgatcctgattgtagacatgttataccaatgaaccctaacaccgatgacctgttcaaagctgttggtgatggaattgtgctttggtaagatgttagcttgttttatatccagatatccaaaaatagccttccatataattgatatatttgtttctgcatgcttgacaggttcacctcaagaaataactagaatggaaaattatccaggttctgcctttttcatttaatctctaggtctgtccatgaatctaaaattcagccataaatcgacaacctctttatagggaagctctcagcctccattttcttctcaacaccaggccagcagaacattacaactttgttgaacttaagtatgtcagtgtctctttattctaaagtaccacagcttccaaaagaaaaaaagaggctactcttcagttctcactctccaatgacctatttctaaaaaatgcttttgtcactgctgctgccccacagccaacagcatcttggcagacataacacaacattatcaacactgccagtcgatgttcc

SEQ ID NO: 49811 - DNA, 1029 bp, Homo sapiens
gctctgttttcagcacagattgatagaaaatatgagtcttgggtattatttatggttttatatatcttgtttgacaatgtagtgttactgtttttaaggaaagtcaagtcccagcttcctgaaaacactgattacattatttttaaatcattagtgacctgcaagatgccctggtaatcttacagttatatgaacgaattaaagttcctgttgactggagtaaggttaataaacctccatacccgaaactgggagccaacatgaaaaaggtagataattaagttgctgtatatatttgttagagtatttttattctcgattaatttcttttgtttctaaaactcttgacgctgagcttcttgaggacaaaactgtgtcttatttgtttttgtgtgctgatacctagcattatacaagacacacacacacgtatgcagattaaacaaatggaagtctttaaccatttactcttgtgcctttgcagctagaaaactgcaactatgctgttgaattagggaagcatcctgctaaattctccctggttggcattggagggcaagacctgaatgatgggaaccaaaccctgactttagctttagtctggcagctgatgagaaggtatagtacacaattttagctgtttagtctttactatcatacaggtctgtgatttagtccttactgtgtttaataagtggatatgtcgataactacacttttgaaatatgttatatttacactccgaaatgagtttaattaatgaatatatgttggatgttaagtgggagatgcttccttgcaagttaggcagcagaactatggttagtcccttttttaaaaaataggaagcctgacacacagatttcggcctcgtttagtgtcagtgaattaaaaaattgtcagaacaaaattatgaacatcttcatgctcatttgaaaataaagatctctctctgtaatgctgatgaagatcactataatgctgaaaagcattcattatgactgggcaccagccaaagcacagcttatt

SEQ ID NO: 49812 - DNA, 2136 bp, Homo sapiens
agtattcattgcatctgcctaacaacttgggttttgcatctagcatgattttccacctcatatctctaagatgacttgagtgtgtgttattatgtgtgcaatgagaatattaacatggattgtatagacagcctaggtaattatatatataaagttggtgcttcaagcttaattctcacctcacattggagaaaaagagtgaataaatattattagccccaaataatagagcttaaaaacctactgtaacttcaaagtgaaatcaaaacccaaatcaaaagaaaacaaaaagcaaaactgttctaattggaactatcaatatggaatttttgcatcccagcataataattatatatgaggaaatagatgtcttacgtggtgtccttaactgacaagaatttcatcctgattttgtttccccctaaaataggtatgcagtgtcaatggctagaagaatcggagccagagtgtatgctctccctgaagaccttgtggaagtaaagcccaagatggtcatgactgtgtttgcatgtttgatgggcaggggaatgaagagagtgtaaaataaccaatctgaataaaacagccatgctcccaggtgcatgattcgcaggtcagctatttccaggtgaagtgcttatggcttaaggaactcttggccattcaaaggacttttcattttgattaacaggactagcttatcatgagagccctcaggggaaagggtttaagaaaaacaactcctctttcccatagtcagagttgaatttgtcaggcacgcctgaaatgtgctcatagccaaaacattttactctctcctcctagaatgctgcccttgacatttcccattgctgtatgttatttcttgctctgttatcttttgccctcttagaatgtccctctcttgggacttgcttagatgatgggatatgaatattattagacagtaattttgctttccatccagtatgctagttcttattcgagaactatggtcagagcgtatttggatatgagtatcctttgcttatctttgtagtactgaaaatttgccgaagtaactggctgtgcagaatgtaatagaagcttttcttattcttttattcttaagatcagtatctttttacagtattctttctacatgatccttttttgtacatttaagaatattttgattatattaaacaagactgctgattttgctactttttttaaggggtcttcaagtaagtaaaacatacatcgtagctagaagaaaaatgtaccttaaatttgcatcttccctctcatacccaagctgtaaacaattgaaatattttgtcttaaatcacttggttcaatacatgcttatttgttttaaaacctgtatcatcaaactctctctctaaatttaaaatgctgttgaatatgatacttttgaggagagagtgtgctcagaacttagacgggatttggtaggccaagtatgctaagtgtacaatatattttttaattttacacctgaaacaaagaaatgtggtcactaaaaataaaagtatatatgtaggaattaatgtactcttgctttgtcaagctgtttgctatagtttccaaggtattatgttactctaactctgaaaagtgatgtaatctggtagcaatgtagtagttcaaataaaggcatttacataataattagtctgttcttcatgcttttgtctcttaggaagtatgccaatgtttgtcaggatttttttctttttgtttttctgatgtattctgtaaaatggtgtttgttaaatttgagttttgggagctgaattagaggtactgaattaaggacagtacaaatgaagtaaaaaggttttctccaatttaccaaaatttctttatccagttcctgcttttttctttcttttccacctccctcagtcttttcaatgttctatgatatacatatcctgaaacagtggggatctgaacagtcacagaggagaaatggttcatagtagatcttctcaatctcatccatatatgacatttttggctggataactctgttggggtggggagaaggggctaccctgtgcattgtaggaggtttagcagtattaccggcctctacccactagatgtcagcacatgcccggtggtgtt

SEQ ID NO: 49813 - DNA, 1070 bp, Homo sapiens
gccggaaaccttacaagcataggaccaaggcagaaaaggtccagagggttcatggtcctccgttccacctgaatccagctagagagcgagccagggggataggtgtgcccctcgtcgcccgtgcgctgaggcactgtcacgcaaagagacattcaccttccacgtcaacgcacctttaagggcgagagcggtccgccgtgcccaagaggaacgggatgacattcaactgggacttgcctcaccttggcttgggggacctcgagagcggtcccgtgggggcggtgttactcgtggtggtagaagtggagggcgtgtccgggtacttgagttcatgggcatctctcccgccgcctctcagcctatctgcaccatgtctcacacgttcagttgcagctcttaccgttttgaaggcgcacgtgggcaagaagtcctgggcagcacaagaaagtcaatcacgttgagacagagagagcgggagaggaagtgggccccagtagaagtgggcgagagagcgttgggtgggaacgtggcacgagagagagaaattatgagattgacagagagagagagagagagagagaaagagaaagagagagagaaagagaaagagacagagaaaagaaactatgttgtttaaaatgccagcggaaagtccatgggggtgaaagagtccggcaatggccagggagttagcagcttggcgtagtgtcttcccactgttttgtctgtcttgagaatagcattcaacgcgactgtgttcccgcagcagacgttaggccgctgcccacgccttgagtgccggacgaggtcaacataggctttccgtcacagaatatgtttgggcaggaagatcggaacacttggggctgggccatctaccgctcccccacggcacacacgagtcgtcagggaaatgcccgcctctgtgtgtgttgtacgtgcagccttctgggcagagccgtggagagttggacgtaggccaggtgtgaggaggagaggtgtgtttggggtggccactggctcccttcctgcgtgacgtaggctggcgtgggctcttcccccagcccctt

SEQ ID NO: 49814 - DNA, 1046 bp, Homo sapiens
taaaaaatctgaggatgaaatataagattttttgaaacttctgagggaaaacttgaatggtatttttttttattatactttaagttctggggtacatgtgcagaacatgcagttttgttacataggtatacactgaatggtattttctaataggtatcctatacagaacaagccatacctgtaacaagctatctatatctgtataaaacctacttggccactactaattgtaatagactattccagtacaaaactcattgaaccatgggcattcttatgaaccacagatcaaactttctagagaacctataaatagtatgtagtgctgtatgcaaactcactgtcccaggagcaagcatcctgattactaagcaagctcaagagaagaggtgggagtattctttctgacattgttcttgaactggtaagaatagctgtggatgaacttaatatccatagtcctcttttaattctgtgcctgaaagtatttattgaaattggaagactaagggaatcatctttctggttattagcagtactgttaacaattgaattttttttttaaatctgtcttttaaaatatattacctatccatgccaaactaaaatggcaggtggattgaacatttcactcagccccaactccacccctttcactgccagctttttctttcctagcatagtcaatgtcattagtacagagatttcctagtataactacttcttgtcccttaaaactgagaagggtcagtgatggaagaaatataaagggtgggaacttttggaaggagtaagggaaaaattggttgcattggatatggtggacaagttggtaaagactttagtgttacaggtggtgcttagtcattggattagtgaaagatgggtgagcagaatgaacaagtagcttgataaaactagtagctttgtgagtgaaagcaagtagatttgtctgtattttgcaatgggtattttatctttattagcttggcttaagggttaaggttaatgattgagatcagtcctttttcctttaagtgcacctt

SEQ ID NO: 49815 - DNA, 1001 bp, Homo sapiens
gccaagatcacaccactgcactccagcctgggcaacagcaagactctgtctttaaaaaaaaaagaaaaagtaaaagctgagaacaaaaatgggtatctctcttcaaaatcgatataaatgtctaatacatatgaaaattttcatccacactggaaatcaaagtacaaattaaaacaccaatgagatatacttttgcctgtcaacttggtaaaaaaaagtttaaaataacacttatttttggtgagggtattaagaaacaggcattcacagagcagtaggagtgtaaacaggtacaagttggcagtttgaaagtagtgttatgtcatatacaactatatatgtacatatgaagataaaagatactcagatctctaggtgataagattatgtatgaatcactttaattttcttctctctcttttttttttttttttttttaagagatgggatcttgctgtctcccccaagctggagtgcagtggcacaatcatggctcactgcatccttgaattcctgggctaaagcaatccttgtgcctcagcctcctaggtagctgggtctacaggcaatagccaccacacctggataatttttaaattatttgtagagacagggtctcactccgttgaccagactggtcttctccactttttttttctttttctttttgagatggagtctcgctctgtcaccagggctggggtgcagtggcatgatctcggctcactgaaacctccgcctcccggttcaagtgattctcctgcctcagcctctcaagtagctgggattataggcacgcaccaccacaccctgctaatttttgtattttctgtggaggtggggtttcgccatattcaggctgatcttgaactcctgacctcaggtgatccgcctgcctcagcctcccaaagtgctgggattacaggcgtgagccactgcgcccagcctctcttccactttttgttttccacattttctacgtgcacacaagacttttcagt

SEQ ID NO: 49816 - DNA, 2054 bp, Homo sapiens
attctattttgtgaggaaatatctctttactctttattggtaaaatgtgtttttaagaacagctctctaaagcagccttctcaaagcagttctcacccccagactctctaaattggattatctggggatggagctgaagtacctacactttaaacactcccctctccacactacctctgccaatcaatttttattcaccattgaaaaccaaagctctagaatatatgaatattgtaaattgggggaaagggtgtatgtttcctttgccatattgacttgaatatgtttattccatagaataagggatttggaactcaaacacctattatttatgtttaaaaaagttatttcaaagtagtgtactttatcagtcacagctgatacatttgtctgcaaattattggacttttacagttaactgagttgatacttttttcatttttgttaaggactcaactaaagaagtttcttggaaaatcagtaaagagagcaaagcaccttgctgaggaatatggtgaacgtgctataaataaagttaaaagtgttagagatgaaggtgagttaaaacagaacatttcaactaaacattcaattaatttgtaatcgtctaaatttagcctgtagtttgtaagaagcattctatttaaaatagtaaacctttatagctgacatcttagtatttcaataaataaggtactctatgacttaattttatgagtgtgaagaaaaatggatttatacatattttgtgacttttgacagtctgaaatggttgagtgttaaataatcagttatgaattagtttcgtttgtttgtttgtttgtttatttgagatggagtcttactctgttgcccaggctggagtgcagtggcgcgatctcggctcactgcaagctccacctcccaggttcacaccattctcctgcctcagcctcccgagtagctgggactacaggcgcctgccaccacacctggctaattttttgtgtttttagtagagacggggtttcactgtgttagccaggatggtctcgatctcctgacctcgtgatctgcctgcctcggactcccaaagtgctgggattacaggcgtgagccactgcacccggccataaattagttttttaaggctatttggttttgggtttttcttttttctttttttttgagaaagtcttgctctgtcgcccagactggggtggaatggcatgatcttggctcactgcaacctccgtctcctgggttcaagccattctcctgcctcagcttaccaagtagctgggattataggcacacaccaccacacctggctaatttttgtatttttagcagagacagggttttgccatgttggccaggctggtattgaactcctgacctcaggtgatccacccacttctacctcccaaaatgctggaattacaggcatgagccaccacgtctggccaaggctatttttttcttttttggagatggagtctcgctctgtcacccaggctggagtacagtggcacgatctcggctcacttcaacctctgcctcctgggttcaaacaattctcctgcctcagcctcccaagtagctgggattacaggcacctgccaccacacctggctaatttttgtatttttagtagggacagggtttcaccatgttgcccaagctggtctcgcactgatgacctcaggtgatctgcccacctcagcctctcaaagctctgggattacaagcgtgagccaccgcgcctggccagctatttggtttttacaaatacagtcagtcctccatatccatgggttccacatggagggattcaaacaaccacagatagaaaaatatttttaaaaatatataaaaaataacaatgcaacaataaaacataatagaaaaaataatataacaactatttatataacatttacactgcagtagatattataagtaatctagagattatttaaagtatacagggcgaggcatggtggctcatgcctataattccagtactttgagaggccaagacaggagaaccgcttgaggccaggagttcgaga

SEQ ID NO: 49817 - DNA, 1012 bp, Homo sapiens
aatgataatagatacccaaataagaggtaattaaggaaagaaaaaatatatttaagtattttaattttctaatcttcttggtttaataaacactttatcacagtttcagataaggtatcttaatgattttcatttggttttagagctggaaggttaaatataaccaattttaaacctataaagcagaatacacaatattgtactaagttgtcacctgtgttttttgtgtgttgcattaggtaagggtgatataaacaagagaacctaaaatgtctacctgctcaacagtattttcctgagatttcattggctccagtatttgacactacgttttctccttctcctggctttccatggttctgtttccctttgttctcttatactcccactgtttcttcttccatctccttacatttactgtttctcagggtctgttcttggccattttcaatagacatatttatgctcttcttctagtcctgaactggctttagatctgtaattctttgtttactttcagtaactttatgatttttaaacaagaacattattgtgcttgctgccttttcacataatatataggatctctttatctacatgtaatccaaccacatcaactaataggtccaaaactaaactccttcaacaaatgttttctgagtgcctgctatatgtggcagacactgctacatgctataaaatcaaatgagacatattctctgtcctcagggatcttgtgaactagtgaaatgggtaaactcacaattacagtattagatggtgatattctacagaaggtactacacaaaaataggttagccttataaatcacagtgttaggaatagtttcctggaaacttgttatttgagctaggatttagctatatgagagaagaaaggaaggagcgtgtcagacccagggactagcaagtgcaaaagcatggaggctagtatgttaaaggtactacaaggaattacacatggctgggaaaggtgcatttgtgagattggt

SEQ ID NO: 49818 - DNA, 1601 bp, Homo sapiens
aaattaaccaggcgtggtggcatgtgcctgtaatctcagctacttgggaagctgaggcagtagaatggcttgaacttgggagacagaggttgcagtgagccaagatcatgccattgcactccagcctaggcaacaagagtgaaactccgaatctgatttgtatgtaatgagggaagcctgtttagctgtatgtctcccagcagtgctcactagtctggtagtaaaattgaggggggcgaggatggtagtcatctagcattagaagtgcttggcaaaggttacaggagtctgtgttggtggtctacctccatggttgatgtgaagatgttttttataaactgtaaagttctacacgaataatagtggtagtttttaatctatccccatgccactgtcctcattcaagccctcattattcttacttaaacttattgactgcttttcctgcctccatgctctctccaaaccatcttttacattactgcccagagttctttttctgaagcaccggtaagatggtggtggttttttcctttcagaaacctgtgttggctctccatgtctgaacttttaagccacaaatttgaggcctttttattgtttattttattttatttatttatgtatttttggagacagagtttcgctcttgtggcccatgctggagtgcaatgctgtgatctcagctcaccgcaacctccacctcctgggttcaagcgattctcctgccttagcctcccaagtagctgggattacaggcatgcgccaccatgcccagctaatactgtgtttttagtagggacggagtttctccatgttggtcaggctgatcttgaactaccgacctcaggtgatctgcctgtctcggcctcccaaaatgctgggattacaggcatgagccaccgtgcctcgccaaggcctttttgaatgtgatcccaaagtacctttctaccctaatttctgactacatctccatatactgttttctctgtcctcatcatcctacctacctttccctaaatatgcgaggcttagctaaccctctgttcttgctcatgctatgtcatgtaaaacatttgaaggacaaactttggacttacagttagatgacttgtattactgctttggttctgctgttcacaggtggctgtgtggcctttaatatattattttaacctctttgatcctcaggggtttgttgtgtgttttgtttgtttgtttgtttgtttgtttttactaatttcttcatctttatactgttaatacctacctcaaagaattgttagaatttattcagataatgaatacgaaagcacgttgtaactagatgcacagtacacatgtatggcattattttctacctacctctgtcagtatgcttttgacttcaaataacagaaatccaactgaaaatggcttaaacaatgaggaagcaactctggaggtaaggcggttccagggttggttaattcagcagctcagtagcatcgtcctactatctccctgctttgtactctttgttttgttcctttcggctttttacactatggtcttaagatggctgctacagtcttagttgtcacatgaagtcagcaatgttc

SEQ ID NO: 49819 - DNA, 1087 bp, Homo sapiens
cctcttagccgtgacaatttctcagactttccatgcttttgatgaccctgatagttttgaggagtactggtcaagtattttgttgaatgtacctcacattgggtttgtctaatgtttttctcatgattcagctggggttgtggactttaaggaagtgaattgctcttttcattacatcacatcgagggtacgttcttatcacctggctgaggtagtgtccatcatatgggcacaatttaagcaatccatcaaacattcaggttgtgcctgttttttatcactgtgaataacaatcagagatagagaaatatatatcttgtcagaatttccaattattgatcgaaggtggtaggtccttaaaatgaaagtacaaagcatgaactcttaacagtaagcaccagcctgggcaacatggtgagactccgtctctacaaaaaaaaaaaaaaaaaaaaaaaaaatccagacgtggtgatgcatgcctgtggtcccagcgaacagggagactgaagcaggagaatggcttgagcccagggggtcgaggctgcagtgagccatgttcacaccactgtgctccatgtgctccagcctgagcaacagagtgagaccctgtctcaaaaaaaaaaaaaaaaagaataagcgatgtatgaattacaagaaattcctgcatagaaattgggaaccccaatttgtagtcctggttgtggtggccttgtgacttcaggaaagataagtagttctctgcaagtctattaaaatgaagtccttggactaagatttctaactctgatggtccatgtggtccatgtgcttgccggcagtccttcagaaacagtgcagctgaggatttcctcactttctcattcatttattcaaattcctgctgacataacttgtgatcttctgtggcatcagaatggcacaatcagtgactgagttctactcctagaacatctaattacaagatcggtatattgagaagcattttccctgattttttttttctcaaaatatgttcatcaactggatcagtatacactgtctcctctaggtggtacccaacatttaaaatactgcagtgtatattatt

SEQ ID NO: 49820 - DNA, 1172 bp, Homo sapiens
ccataacttctgattcttttaagggacagctgaggtaggatttacacttgtgctataaacccaagatactcacattggggcttcaatatgagttagagccattaccgcagcaagtcaagctttcctctggtgtatctcttgttagaacatggaaaacccaccaagctgtacaaatatacagtatttcctgtttaggttttttttttattttttttttaaggattttggaattacacccttgttggcctgttgctaacatcattcagttttcctcactgtttgaaaaattcagatggctgggcctgggctatatatagcatgttgttgcgtattcaaactgttattcagttattagtacttccacgaatctattaactaactacataataaagcagacagagagactgttccactgttactgcattttcctataagttcagcatttttatgaaggtcagttttaacccagggaaagggataattacagaatcatcattgacagatttctcaagaggggattggggagaaacattataacctgagagtgtatgtgattaagagagaagtgtttacatatgtacttgtttaaaatgcagagttttaaatttttaaattgattttgttgtaattcaggatgtagctactggtgccgcaggggaacaaaggcattttgctaaacctgttgtattatggccgccctttagagaagccactttatcagcctggaagagtcgcctagtagctgtttaaatactgtttactgcggagcttaccctcaattccttgtgcgccaaaagatcgggaaagagttgctagatattaggggttgtagcccctggacgcgccgtaatgcacgcagcgtcccctggctggcatcagccagatttcgtataatagctccagtagagaaaagctctccagaagctgagaatggctgaaaagcgtctgcagctgttgactcccccaacccgccgctcacaactacctttgcatggaatgtttgttatgtttgcatttagagaagcgctgaaacggaaccactcctctgctccctcttcccaagggaatttgtgtaaagtaggtaatataggacaaaacccacagcctcatctctaaggaggtgagaacaatacggaataaaagccagtttcaacttgggcttcttgaccaag

SEQ ID NO: 49821 - DNA, 1047 bp, Homo sapiens
aactcattttgcagtagtatttgcagacatgagagggatgatcaacttgctttgatctttgtagacatgggtctacaaatccaaatttaagacttgaaataaagcataaaggttaggatcttttagatttgttgaacactgagctcattggtcagagtagtttactttaatctttctaaataatcttctacaggaaactctgagatgcccttccgatatggaaattgggtatagctgtgacctgttgtgaaccatgtataaaaactattctcaacttttctatggatgtagtgatactagagactacctcaaatactatgtacaaaaatacaagtataatcccgatgctattataatattaagtcttaatataaattatatttggggtttttatacagtttttattataaaattttaaggaaataatttcatatgaaacatcatcattaaaaattactactgtctgcccaccttggtttagaatagagtgttgagacatggctctggttgaatctgaatatctcaaagttcatcagcaattaatgactggatgtctaccgtgtgccaggtattctaagtgctgggattaaagaagtaaacaaataaaagaaaatccctgccctcaaatagtcagagaggtgaaatagatggtatatcagattgtggtaagttcaatgaaggaaaaaaaatgataggaaggtaaatagtgggatcccattcccagttcagtaccatgcacatgagaatcttggtatatttctttctttttctttccgccccccgctcccccgcagttgcaggggtcaagggctggtggtgtgcatgcatgacagctgtgggtgcatgtacagtagtgatggccagtggtggaagtcagggtcacctcatatggctgtgggggttgaggcttatggcatgcacacctgtgacaatgaaaactagtgatgatagacattgaagtcagttgcatgtgtacacacagctgcagggtcagccatgggtgtgcagaagtgggtgccgtctttgtgtatttctgaggggaaaaag

SEQ ID NO: 49822 - DNA, 1060 bp, Homo sapiens
gtcaaggtcactatgtgtgttagaacaaaaggaagagaaaatattttatttttgatatcttagtccaattgtattctcaaatctaccagactatctcttacagctaacaaatggattgcattcatttattatgcataagattttttcattaatttgttttttatgttttgttttctctcattcatattacttctcaaaaactatttattaggtgcttcatatgtgtcagacactattgggtatcaacaaattcatgaccaaatagataatttcttaatttaattttttcagagacaaggtcttactatattgccctggctggagtgcagtggcacaatcatagctcattgcagcctccaacacctgggctgaagcgatcctcttgcctcaggctcccaagtacctgagactacaggtgcatcccaccacgcctggctaccaaatagatattgaatgccttgttaatacaaggtattagcattgtggagggtagagagaagtgtcagatgtagagcttaaaacctttttgggaaggtgggctgggcacagtggctcacacttgtaatcccagcactttgggaggctgaggtgggctgataacttgaagtcaaaagttcaagaccagcctggccaacatagtgaaaccctgtctctactaaaaatacaaaaattagccaggcgtcgtggtgtgcacctgtaatatcagctactcgggaggctgaggcaccagaatctctcgaacccgagaggcagaggttgcagtgagctgagatcgcaccactgcactccagcctgggcaacagagtgagactctgtctcaaaaaaacaaaacaaaacaaaaaaccacctttttggggaggtgagacacacaataaaaataattgtttaaagatggtacagtgaccaagtgctacatgaatctagatcattgtggcctggggtcagagaaggcttcttgaagaaggcggggcctcgaaggaagtgaatcagaaaggagaaagtgagtgtgccaggcaatatgtataaggcagaatggttaggtgaagctcagtagtcatgg

SEQ ID NO: 49823 - DNA, 1050 bp, Homo sapiens
gtaggtgagatggaaatatgtaatgtgggtatatgtatatatgtatatatatgctttttatgtttattcttggattcgtggtaatagaaaccaaattaaaatgatgtaatcatggtttgcaattaaatgggaaaagaatgctatagtgaaagggtcaggagattcagatatcagaatgctttatacatttcaaagtgttaagtcttaattattgttctctagatatttgattaactgagggtaaatcatgtgattttcattcactatcttagaaaaatgaagataatgataattcctaacatcttgtcagggttgtctgaagattgtccaggcacaattgcctggcaagcttttgaggtttttagttcagagaaactattcaaatgcaatgtatatgtaacaaatgtatcattgctgggttttccccatgtaggtattcaagagacgatatttttacttgacccaacttcctgacggttcatatattctcaattcctataaagatgagaaaaattcaaaagaatcgaaaggttgcatctacttggacgcctgcattgatgttgttcaggtaaggccattgaggtaatccttctctttttctaacagggttattgataaacttttaagaaccccagatggttgggtggggtggcttatgcctgtaatcccagcactttgagaggctgaggcaggaggatcgcttgagcctaggagtacatcagcctgggcaacaaagagaccccatctctacaaaaaaatacaaaaattacccaggcatggtggcacattcctgtggtcccagctactctggaggctgaagtgggaggatcacttgagtctaggaggttgaagctgcagtgagctgtgattgcaccactgcactccagcctgggtgacagagcaagaccctgtctacaaaaaagaaaagaaaaagtgactggtgcggtggctcatgtgtataatccctgcgctttgtaaggctgaggtgggcaggtcacttgaggtcaggagttcgagactagcctaggcaacatggtgaaaccccgtctc

SEQ ID NO: 49824 - DNA, 1057 bp, Homo sapiens
tttataaatggaaaaactgagaccccaggagggaaaggttcatggttgagttcattagtagcactccagctactgtgtatttatgtacatcaatctgttgtacatggcattttgttgtatacccaaatagtgtttattaaatggaagttgctgatgtgatgggactaatttgtggaggaaaaatgtctcaacaatatagataaaagcctccagcattctgtatccctagggataagcatccagccagcatttcgagtctgtttagactctataggcagtttatctccttgtcatctccctgtgcctgtgcaaacagcagctcctgcccacacttagactaattgccttgactcctggtgacttgctccttgtcttgggagtagaaagggcagctgtatccagaaaaaacttctcccaagaatgatgagcatttgcctgctatgtgaagtaaagtacatgttaaaaccactgaacatttttccagtagaggtcttggttcaaagtgtgccctatatctatttcgtctgtcttctgctataagtgacagaagctctgttaatgagaaaatccaaagcctttatgaaatactttggacttgaaaaatggctggctgatgcatgttattctgcttgtggctatttctatatatttttttgagatttttgatgttttgtaatggtaggttggggaaattatttttctgggtgggtccatggcagtttgaacaaatacaagcctatcttcttgtttctgaccttagacggcccagaaggtgcacaggacagctaaacaagtgtgtagccgccttggacaatacagaatgcccttcgcttgggctgccaggtttgtacaaatataatcctgacccgctcactcgtgttcatatgtgaagttaagggctgttatacttaccagcattcagcactgtgtttctggcaggccagttgtatcttgggacacttgggatgtaataattattatttttgttgttgtttttgagacggagtttcgctcttgttgcccaggctggagtgcagtggcgcgatctcggctcacc

SEQ ID NO: 49825 - DNA, 1016 bp, Homo sapiens
ctgggtgattggaaagaaggtattgccaatagcaaaactgtgggtagggatggcaggtttgggacatcagttgagttttaggtgctagtgagacattggagtgatacccagcaggcagcaggactgaatatgagggagttccctttgcaggtagtatggatatgttctttatccccatagaaattgccgttagttcagggtaggggctttgaggattgagaagaaaactggcagaacgatgagaacccatgaccatgtgtacatcctgaaagctaaattactgattcattatccaaatcctagacagaagtggacaagatgctcagcggagcatgaaacagttattccgtgtgccactcatcactttgaactgtgcattctttaagtggcttcccacctttgagccagatggtgtgcttgacattgtacctttatagcttccaagtgctctctatgagttttgaataggggaaacgcttggtcgtgctctgattcatttacagtacaaaaatgttgcctaagcaatcccacagagacagaaagtagactatcggttgccaggggctgggaggagagggaaatggggagtgacttctaagggctatgggatttattttgggggtgatgaaaagttctggaattaagtggtggtcatggagatacaactttgcaaatatactaaagaccactatatgtacactttaaatagatgaattgtgtggtatatctgaatgaggtctcaataaaaatttctatttaaaaatgttgcttaagaacaagaaatagattttcctttcattttcctattttctgggctggaaatcttttctcatttgtcaaatttttagtttaactactttgacagagtcatttctaatggttcttctgctcatgttactttcctctgctttttataaaagaaaaggtctgggtaaagcatttctgtagttgaactagtaaagatgcccgtcaggcacatttcggagtctgagaaagccatttagtctacttagaga

SEQ ID NO: 49826 - DNA, 1032 bp, Homo sapiens
tcagaaagcagtagctttaaaaaatgttctccagccaataccctctctcatatgccaaaactcagtccagagcaagcttttttacagctgagttataaacacttgaatcccagagtaatttctataatggaaatactgacaccactcaacttgagtaacacagatggctctggcttttttagctagaacatgatgagttttctaattgaaagccaaaaggctcttttggggagaactgttaagaaatgtagagattggggaaaatctcttgatggattcaagtcataaacactatttcctgcctgcattctcctacctacacctacacctcttccttctgtaatcaggacaagtctgcctaactaaatgatttatgcctactgccttgtataaatatggagtgtagccgtgactttgtgaccttaattttccatagttccttaccctagggttgccataagaaattttggaacatgtgattgttatctgaaatagtctcagccgtgagactctgcactcttagtgtaagaatggatgagaactatctgagccttttgaaaataaatccaccaaaaatatttcccaaagcataaagataatggtatcgatgcgcttttaaaggtttaaaatgttttcatataatctcactctaggtttctcaataattcttgtagatggaaaggccatgttgctgttcccatttttatggtcaaagaaatagagtacataacttgttagtggccaggctgggattcagagtcgatccaaacccattgttccttccccagtactcagttgcccagcacctgaactcccacatacagatccctggagacatcaccaccctgccctgccccctagcagtcagccatttgtgtagctgattgcatttgatatttcatttctcacagtttgttattatcttggcagttgggtttgcctgggtacctttgctgaaagatggtagaatcatcacatttgagcagcagctgccagtttccgccaatcttcccccaggctacttgaatctga

SEQ ID NO: 49827 - DNA, 1034 bp, Homo sapiens
acagagaagggaggttttatgctttgacttcactgaacacaaaaactcttttggtctgaattattaatatttacataggcaagcctcactttcatcagctaacagactaccttacacttccctttggaagtgggagttgaccaaaatgaggtcaactcgcttgggctttgagagttgaccaaaatgaggaagtgtagctgaatagattacagatatgtatgtgtgtctgtgtatgtatgtgtgtgtatgtatagataaatgtatatttgtgtgtgtggctatatatacatcttgttctgaaaactgtataattgaggcccttcagtcccaattccagtgatgccacttgccctttatctttttctttaaggtcacctgaagctcagaaagttatctataaaaataaaaatgtctttctttttgtgtggaaccaattttgaatttttaaaactttacatttttaaaatttagacttttagaattatgtaattaacccttagttttgttttggtttctatagcgctgtttgacactaatggatagaggatttattttcaatttaataaatgactatatatctggattcagccccaaagatcctaaggtaagttataaggacatgattgtagtggatgtcagacatctgagcataagaccaaagtgacatttattctcttctaggggattaggaactgttgtttttatttaggtagttggactatagacatacgtaaaagcaaggaatactggactgtgttttggggtccccaggaccccccatgtgttcaatagctcattttaaggattcacagactcaacatatagttgtattgatggctgagattcatgagcgtgacataatgaggatactcagctgaatcgggaaaggaaaagacatcaaatggggtgggtagcaatccacatgcagcctttttgagctctttccctcctgtgaagggtctcacagagcacagcctccttctagcagtgaaaatgcacttgtaagtgtgcaatatttctgttcaaggaagcct

SEQ ID NO: 49828 - DNA, 1050 bp, Homo sapiens
ctatgttaactctttcctgcacaggtcgcatctcaaggtatgcttagaatactaagcacttccgttgtgaaaaataatgcgctgtattaaattcttaaaatagcaaatgcctactaaatatgagctaatgtatcatttctttccatttaggttctggctgaatacaagtttgaatttctgcaaacaatttgcaatcacgaacattacattcctctgaacttgccaatggcatttgcaaaacctaaactgcagcgggttcaaggcatgtatttgcattttccatcatttgagtttgtttttttccatgttttgctagcgctagtgtagtataatgttttctagttgaaccagtcaacttgaaggtaatttcagaattgttactatctgaagtccattaatgtttttctgcatttccttcataatatcagtaataatgttcatagtgtgaagaaatcaggtgtgttaatagattgctgcttaaacacagatgtcagatactagtgaaattactttctgtagtagtgtttgggatcttgtatgagactaaattaagaaaaagacatataaatgcatttctcctcaaagcatcaaaaaatgtaaaggtagagtaaaatggtaacatgtttgtgctaaatttatgaaatgccttcagttatctccattgctagttttattgaatgctttgttgtatagcactattcttatgttactatgttttttatttgtcccttttcttttcatatattaattagattttttttcatttgcggtggaccgtttgacttcagtaggtaggtttaactcggttcactctaaattagcttgctgttttagaaaacaattgatttgatgaattgctaagatggatgggggctttgtttgcttttcaaattctccctagccaaaatgaggctttagttaaagtacccagaaaatctaggaggcagtgtgtttgtttagttttaaaataaaactgagtgttgctagagaaatcaactttaaaacattttccctcaaaacacaagttcctgctgcaagccagcatagagg

SEQ ID NO: 49829 - DNA, 1040 bp, Homo sapiens
caaagagcttgatccaaaatatgctcatatacaagttacttatgtgaagccttactttgatgacaaagaactcacagaaaggaagaccgagtttgaaagaaatcataatatcagcagatttgtttttgaggccccttacactttatcaggcaaaaaacagggctgtatagaagaacagtgcaaacgccgtacaatcttgacaagtaagtacaattttacatattaacttcttatttgtcttggtctttttcagcatacacgagtagcagctggccagctggaacatacaactgaaattttaattattatttgttctgctgttcagttacaagtttgcacaagcacgtccatgtgataaaccatcattttcccatatgtcatccatgattgcccagaggtgtctcataaagagaatttctctctgaatcctgaagtactatatgggaccctaagtcatcttctagataaaggatggggagagttaagcacaatagagttttttctttaatttggctgtttgaacaaatgattttctaaagtcagtaaatcaatcttaacattttaatagcttcaaactcgtttccttacgtgaagaagaggattcctattaactgtgaacagcagattaatttaaaaccaattgatgttgccactgatgaaataaaagataaaactgcagagctgcaaaagctttgctcctctactgacgtggacatgattcagctccaacttaaattgcagggctgtgtttctgtgcaggtacgttggtcatccaacatgtattgaatgtttcttgatgtttcttttggttttataagggcacagagcaagcattaattgtaattatgtgttgggcacttactgagtgcaaaaacctgtgcattattttttgttcatttaatgaagatattacattgaattttttaaagttttgtgttatgtcagaggactttaacataagtccgatgactgtagcgaagccctgtatgtacatatcagaaatcactaacttactagaatatcatctttgtagattattt

SEQ ID NO: 49830 - DNA, 1041 bp, Homo sapiens
taagagtgctttatttatcttttttttttttttctaagcacttaatggtcactgtctaaaaacagtgtatctatgtttgttcatctcctaatgggagtcgtggctaagttctaagattttgcctctgtgcatagcattttaaaacttttccaatgttctttttttttgctttgtttttcctttttattgagatataattcacataccatacaatttacccatttaaagtacacaattcagtgttttttaaaattacatccacagagttgtgcaagtatcactacaatttaaaacatgtttatcacctgaaagagaccccatactcattagcagtcactcctaccggtcatcatcctccagcccctggcaaccactaatctactttttgtccctacaaggtttacctgttctggacatttcatataaatgcagtcatacaatatgtggccttttgtgtccagcttctttgacatagcatatttccaaagttcatcgatgttgtagaatgtatcagtacttcattcctttttatggctaaataataatccattatatagatacaccatattttatcttctcatcagttgatggacatttgggttatttccactttttggctactgtgaataatgttgctgtgaacactcacaagtttttgtgtggacatgtttttagttctcttgggcatgtacacagaagtggaatgactggttcatatggtaactccatgtttaaccttttgaagaattgccagactgatttccacggcagctgcaccactttatattaccaccagcaatgtatgagggtcccagtttctcaatattcttgacaacacttgttattatctgcctctttgattattgccatcctagcaagtgtgtagtatctctttgtggttttcatttgaatttccctgatgtctaatgatgttgagaattctttcatgtggttactggccatttttgtatcttcctcagagaaatatctcttttaagtccttagaccatttgcttttttgagacagggtcttgctgtgtt

SEQ ID NO: 49831 - DNA, 1030 bp, Homo sapiens
tggaaagagtgttttactagacatgccaagaaaggctctcccagttcaagtttgcttgtttggttgtttttttgttttgttttttgttcgtttgagagacagacctttttaccaaggtggctaacacaaagaattaacttgtccagctgagaactcacccctgagtcacagaggtttatgttactctggttaactcaaacatagaaccacaactaagcaaaccgcaacaactgcggcattcataaaacaagaatcatgcttaggcagtcatttaagtgggctcatcacaggacagtaaataatgacaaaagaaagcagggtgtggaagggaattgtgatgttaataactcgtacaatgcttaaatgcatgcccggcactgttctaaattaaatccttcaatgatcactacaactttgttaggtaatgacacatatccctcattttatgaatggggaaactaaggcacagcaaagctagataacttgtttgagatcacacaatcggtggcaatgctggaatttgaacccagagaatctggtgtaacagttcacactcaagccaccactttgagaggaatcaagggaaaaagaagagagatctaagagaataaaaaggggaggaaggaggaggaaaaactcagctcactaacacctgaaggcaattgctacatggtacccagcctcctttttcaggcccacacccaggtctttgcagtccccacctctacctctgttatcaagcttcctaaaatgacatgatttggggataagtgttcaaactatttttttcacaaataaatggtgtccagaggaattgatgttgtttcttttttctttttttttttttgaaatggagtctcgctctgtcacccagactggagtgcagtggcgtgatctccactcgctacaacctctgcctcccaggttcaagtgattctcctgcctcagcctcccaagtagctgggattacaggtgtgtgccaccacgcccagctaatttttgtatttttagtacagacagggctttgcca

SEQ ID NO: 49832 - DNA, 1050 bp, Homo sapiens
actgctcaggttcccagctttgaagggattaaagatccaggggtgatggtggggagaggaggaagcaaaatgggtagtggagaaaagaaacagtgaggatcctagaagacatttgtagacttctacccactgaggtattatgaacttcaaattccccaagtgaggtttctctcctgactttacctctctgtctctttcctcctagatgagttttaaaatcccactgcagatatttctgcggagtgttagcactagcatggtggctcttaaccttggctaggcaacagaggcatctgtagtgccttctcaaaatccagattcctgggccacactccagacctgggggagatgggagtacaaagtagagacctagatttttcataagttccccagttgattctgatgcccgctgaagcgaggacccctgccctggtgtggtgtgttagggacactggtccaaggcttcctccctggagttctgccctgcaagctggctccctccccccttcaccctcctccccttcacctgggcacctgtagaaacttaagtagtgaagtcttctgttttatgtcacagcttctccttagtttcttttcaccatcagtcccgggggattctcaggaacattctcccgatatcctgaagctgttggcacctcaccctagattaaaggaaaacgtagagtcaatgactactgaagttaccagccataatctaccaaggttgttacaggtaaaactcaactcacccagctcgctcgtgacgcttcgtttggctgttttgtgggcaaacgtggggagtgagccctccctctcctattttggttcctgagaaagaagaaattgagtcactagtggttctgttctttgcaaagaacctcttaaagatgcaactgtgaatttcaggcatggtcccagagtttattcattacattgaaaaaaaattatgaaacagggtctctttctatcacccaggctggagggcagtgatatgatcatggctcactgcagcctcagactcctggtctcaagagatcctcccacctcagc

SEQ ID NO: 49833 - DNA, 1067 bp, Homo sapiens
tgtgtgtaaccatacacaattttttaaaattgcttacatgtctttgatttcacagctgtgacttactggcttagaggagaggctccctgctctgtcatttactggctgttgacctggatggagcaagtgacattctctgctactgttttcttgtcagtaaaatagagaacagtgtacctactccatagggttgtcatgattaattgagaaaaatctgtttaacacctggaatagtgcctggcatataatagatactcagtaaatgttaactatttttttttccttgtagaccagaggtccagaaggaaactttgggtctatggacctctgaggatgttctatatatggattctaatagatgtattaatgtctcgaagttgtatgttaaagtatgtgggttttccaggacaaggtccacatcctttagcagattcacaaatgtgtctgttttccaaaagagcattaaaaggaggctgagatatttgcacaaaaattaagacggttggcaggctgctgttcgttgtgctggcgggtcctgcggggagggctgtggagctccagatggactaaagaacaaaccagcaatcccgagagggcccacagtccctctgaaggaagcgggttgcttctgcaggacccaggagacaccccaaatactctgggaggcaaatagcctcggtcgagttctcaagtccctctcactctcctcctggaaacagacttggagctgttggggagggcacggtggaagtgagactggcccttcagtttgcatgggagctgggtgaggcctgtgactgctgtatttccccaacttccctggtaacctgcatgactcagcaaaggcagccataatcctcctaggtacacaactccagtgacctgggaatctcacccccatcccccacagcagctgcagcaagacctgcccaaggagagtctgagctcagacatacctagccctgcccccacccaatggtccttccctaccaaccctggtagtggaagacaaagggcatataatcttgggagttctaaggccctgcccaccgctggtccctctccac

SEQ ID NO: 49834 - DNA, 1163 bp, Homo sapiens
aattcttcaaactgaatgacaataatgacacaacctatcaaaacctctgggatacagcaaaggcagtgctaagaggatagttcatatccctgagcacctacatcaaaaagtctgaaagagtacaaacagacaatctaaggtcacacctcaaggaactagagaaacaagaacaaaccaaactcaaacccagcagaataaaggaaataaccaagatcagagcagaactaaattaaattgaaacaacaacaacaatacaaaagataaatgaaacaaaaaatgttctttgaaaagataagtaaaattgatagaccattagcaagatttatcaagggaagaagagagaaaattcaaaaaacctcactaagaaataaaacaggagataccacaactgacaccactgaaatacaaaagattagtcaaggctactatgaacacctttatgcacttaaactagaaaacctagaagagatggatatattcctagaaaaatacaatcctcctagcttaaatcaggaaggatgagataccatgaacagaccaataacaagcagcaagattgaaatgataacttaaaaattgctaacaacaacaaaaagaagtccaggaccagacagattaacagcagaattctaccagacattcaaagaagaattggtgccaatcattttgacactattccacaagataaagagggaaccctccctaattcattctatgaagccagcatcaccctaataacaaaaccaggaaaggacaaccaaaaaaagaaaaccacattaaggtatgtcccttgtatgctgattttgctgagagtgttaatcataaagcgatgctggattttgtttaatgatttttctgcatctattgagatgatcatgtgatttttgttttgatttcttttcagtattatgttggttgtgggtttgtcataatactgaacggggaaaagttgaaagcattccctctgagaactggaacaagacaaggatgcccactcttaccactccttttcaacacagtactggatgtcctagccagaacaatcagacaagagaaagaaataaagggcatccaaatcagtaaagaggaactcagattgtcactgtttgctgatgatatgatcgtttaccttgaaaaccctaaggactcctctagaaagctcc

SEQ ID NO: 49835 - DNA, 1049 bp, Homo sapiens
tttataaatacctcttggatgtgttttctgaaatcgttacctaaagtggtaaaaaaattctagtcaagttctctctgtctctctctttttcagaaggagggagagaggagagagggagggaggaaaatgtgcatatgagtgtgtgcatctacatgtagatggatgatgtctatttggatgcagaaatacatgcacacatttgttgccgcatcatagagtgaagaagaaagatgggcttgagagtcagatctgacctgacatcccaaagccctgctacttaccagctagctgtgtgatcttaggcaagttattttaacctgtctgggtttaaattttctcaatagtataatgaagctaatcataattaccacctcttaatatacaaagttaagtattgacacaccaagaaatacagccagaaaaatatattccatctgttccagtcactttggctgtgcagagaagcagagtagccctaaatatagaaatgaattgagtattgaaaagtgtaatgtattctaagcatctgaaccctgaactatttcaaaggaataattatgcagcatctgtggccgcatttgtgtttgctaccactcagtcaggggcattttaatcacagcttttgctaagagattgctgtgtccttttgtgtgtgttttattcatctgctcactaaatgtcagtatttattgcaattaattagccagctatatctttgttattttagatagattacattaggttacattcttaaatgaacaataggcccaattgcaaaattctcaggaaaaatggttttgcatattagttgtagatacagattcatcaatcatcttcatcattagtaccatcaaataatataaggcattcagattcacaggactaagttaccaaggaaatgagatattttggtttggctgctctgataattagatcacagcagtggttccaaatcacacttttgaaaaacattttaaattgtgaaatacacacagtggaaaagtgcataaaatataaatatgttctcttaacaaaatattgtagagaag

SEQ ID NO: 49836 - DNA, 1108 bp, Homo sapiens
caggattaaaatatcaagcaagccacgtaaacagtggcaaatgtgtgtgtgttttccatttgtttggtaagcagccattttactcttgcactgtaatgaactgaagggaaatataagataatgcttttttccccccatattgctattcaactacctctatatgcttgatttctttttaggattcccatcctccaaatctgtacaaaaacgtttcagctcatctgtgttgtaataacaatgtgatacagacagtttgtgtgaaagttgtttgttcattaaaaaatgtttcctattgcctcactttgtgtccaacaaaactgtattcctaccttaggaaaagaattatccaactagcttcagtatcacttcggtggaagctgaatagaaaggaatgcttcaggaacatctatttgttcttgttcctattggttgtaataccagaagatcctttaaagaaatatacttgcattcagacagcaaactcccatgtatgtgacagcgaggcaggtgtgaactgattaatgtgactgatgtgttctgaaaaactggccataaagtgtttcaaaatgcaccagaaaagcttgttacataaagaattatgttgaagcattttgtcaatatctgcccctactttatatgtaaatccaagcattcacatattgggtttgcttaaagcacaacacactgcctactattttctttggcatcataaaatgttcaagaaaacaaataacacgtttttattttaaacaagcagtttattaacaataggctaaaagctaaggccccaaacatgaaccttttaacaggaaaattggtaacatttgtgacaataagtgatactgaccaagctgatcccagcagaagagcttcagcaacatcccatcttctctacagtactgattttagtcttatgctattgataacttttaaatgagttcttaccgttgagggaagaaggacacaagaatgggacaattaaaaatgaaatgatagaaaattccacttgagcttgatcttattctgtgtaacaggaccttgggggatatagaaaaaaatcagaactcctgtccatctaggccccagaggaaagacttggctctgttag

SEQ ID NO: 49837 - DNA, 2138 bp, Homo sapiens
aggattcctaaaaattagtcattctagtgcctgttaattctgtgcaaggcactgttgtagatgtgggaatatagcagtgagcaaaacagacacaaatctctgcctatggagcttacgttctagtgaatatatgttgcactgaataatatgtatttttaaaagacttttaatgttcccactagagaacatttaattgtttaaatgtttaaatattctatgaggtttaaatattctatgtttaaatattctatgaggtttgcttggtaaagactcactctaccaagccaatgaccataatttctgaaatggtaaggttcaaaccattgcatttgcctattctcaagcactaggtgctgccatttccactaggggtgtacatttatgaaaaatgtgggcttttttttaccttctttagtgaatgtggcagcatgtaatgatgattaaaaataagcatttttctttggaattttacttgcatttaaaagttgtaaaatttgtaaaaaatttctgagtgtattgaggtttcaggtgaacaggccatattgaaacttgatctattctcatacttggttccctacaaacattttaatgtcagggctgctattcaatctgccttgggggaaacaacacattgtttaaagtacactggattctcttcatttagttgtgcaatatttaaataagtctaaatatccactttgtgtacccacagaatgattctctgctctcttagacaaaagttcagtataatatcacaaataatcacattttatagagttgttttatagagttgttttgcagtattgattcagcctcttttccatgaaaattttagtattttcacagtcttctcaagcccaccaaaaaacagataatgaagactgatctctgtgttatctatttattgacagtgaaggttatgtaatgtggatagatttttaaaccaccgatactgttataaaatggttcttctgcagatgccatgagttaatgtttaattgagccttggaaccaaagatctctataagatacctttgtttcattaaaacatatcagaatatattcataaggaaatgtgttttcatgtacacatcagtgcttattatcttaagaaaccataactctcactggtgtagccccaagtgcctagaactgtcaggctcccagttcaatgttcttgtatgattccctactaccactaccccaagagatcactaaccacgtatgacttttttactagctatttggaaaccacaggagactgacgcaaatgtatagcagtttgatttacttttagttatttaaaagttaaatgacaacaggtctttctgtgtctcctacataatgttcagaatatcagcattactatggtttcctaatggaatttgatattcaaaaatggggctatgttgatgaatagggaagccattttctgtgtataaatcacagagaaattgactgtctaataaagaattgatctttggttttgtttttgaagaggggccgtatggggtctttgctggaagagatgcatccaggggccttgccacattttgcctggataaggaagcactgaaggatgagtacgatgacctttctgacctcactgctgcccagcaggagactctgagtgactgggagtctcagttcacttgtaagcatttttaaaattgtgtctgggtcaaatttctaccagtaatggggattcgtggcaggacaatagttattactaagcagcctgaaacttgggtgcattttgataggctccttaatcttggacgcatcaagttcatggcttgaagtaattgtagcagtgctgagtcacttgctatgattgcataccaatttttagccagttctctatggaaacttgggtttctggttttgattttaaaatttttgagagatttgctagattccaaatgaggatttggtgcttggtgtgtcagggaaaggacagtgtccatcttggctacagaaagggattttcataagccctctcttgtagagcttgccgtttaaaagcagcccacatctctgttgaagaatgggagacttgtattctgtgaaacagcttctctttgaatctaattgaacctaactataggcctcatctacaaatgatgcttataatgtgc

SEQ ID NO: 49838 - DNA, 1023 bp, Homo sapiens
ctgttttatatgtctgtcttctgaacaaaacaaattccctgttggcaaggacggtggtataaaccacctttgtatccttcaagaagcccaacacattgctgagtatattgcaggcctctaataaatgctttaaattgaaacgtggtaatgatgttttagaaagaatgagaatgaccatttgtgttttcttctctacctccagtcaagtatcatcacgtgggcaaactgctgaaggagggggaggagcccactgtgtactcagatgaggaagaaccaaaagatgagagtgcccggaaaaatgattaaagcattcagtggaagtatatctatttttgtattttgcaaaatcatttgtaacagtccactctgtctttaaaacatagtgattacaatatttagaaagttttgagcacttgctataagttttttaattaacatcactagtgacactaataaaattaacttcttagaatgcatgatgtgtttgtgtgtcacaaatccagaaagtgaactgcagtgctgtaatacacatgttaatactgtttttcttctatctgtagttagtacaggatgaatttaaatgtgtttttcctgagagacaaggaagacttgggtatttcccaaaacaggtaaaaatcttaaatgtgcaccaagagcaaaggatcaacttttagtcatgatgttctgtaaagacaacaaatccctttttttttctcaattgacttaactgcatgatttctgttttatctacctctaaagcaaatctgcagtgttccaaagactttggtatggattaagcgctgtccagtaacaaaatgaaatctcaaaacagagctcagctgcaaaaaagcatattttctgtgtttctggactgcactgttgtccttgccctcacatagacactcagacaccctcacaaacacagtagtctatagttaggattaaaataggatctgaacattcaaaagaaagctttggaaaaaaagagctggctggcctaaaaacctaaatatatgatgaaga

SEQ ID NO: 49839 - DNA, 1026 bp, Homo sapiens
cggaggtcaggagtttgagaccagcctggccaacatggtgaaaccccgcctctactaaaaatacaaaattatcctggcatggtggcacacgcctgtaatcccagctactcaggaggctgagacaagagaatagcttgaacccaggaggtggaggttgcagtgagctgagattgcaccactgcactccagactgggcaacagagcaagactctgtctcaaaaaaaaaaaaaagaaaagaaagaaaaggaaaaaaaagaaaaacaaaagttggttgctttctgtaaatgtgaccagatttgaatgaatgcatgtaaatctatgctgtactttgctggggaggtttttgtcagggataaggatgggggcaaactatgttaagggaagtgatgacaagaaagccttccctgcgattaagaaattataataatatatgcttaactggcaggggagataccatgatcacaaaggtggttttcccagggcgaggcttatccattgccctctggatgtgctgacccctgcgatttccccaaatgtgggaaactcgactgcacaatttgtggtagtgggggactgtgttcgcgctttcccttgagaaaaaaaaaaaagaaagaaattataggccgggcacggtggctcacgcctgtaatcctagcactttcggaggccgaggcaggcggatcacgaggtcaagtgatcgagaccatcctggctaacacggtgaaaccccgtctctactaaaacacaaaaaattagccgggcgtggtggtgggcgcctgtggtcccagctacttgggaggctgaggcaggagaatgccgcgaacctgggaggcagagtttgcagtgagcggagatcgcactactgcactccagcctgggcgacagagcaagactccgtctcaaaaaaaaaaaaaaagaaagaaattataataatataataataactaccacttattggtcacttaatgtatacaaggcagtttattatcccatttaactgtctttattgaccctatgaaataagta

SEQ ID NO: 49840 - DNA, 1863 bp, Homo sapiens
gcatcgggtggtgccgcaggggccacatccctgtgttttgtgtaccctcttgattttgcccgtacccgtctagcagctgatgtgggtaaagctggagctgaaagggaattccgaggcctcggtgactgcctggttaagatctacaaatctgatgggattaagggcctgtaccaaggctttaacgtgtctgtgcagggtattatcatctaccgagccgcctacttcggtatctatgacactgcaaagggtaagtttgctgtgggctttaacgttgtgttcttaggagacagtttaaaagagcattgtaccaacctaacagtccaagagctaaagagttgtttttttaattgctaaaggaagccaagatcatccaatgcaacccttgtgtacagatgacgtgtttaggggatgtggggaaaggaagtcagtaaaactctgctttttggtaaaagcatctctttcctattcccaggaatgcttccggatcccaagaacactcacatcgtcatcagctggatgatcgcacagactgtcactgctgttgccgggttgacttcctatccatttgacactgttcgccgccgcatgatgatgcagtcagggcgcaaaggaagtaagttccacttgagcagaagataaagttgtagtcgtggggcaatctgctgccacaaactggtgatacatacctttaaaatggctgtctgtccaagtcaagggatggggttgatagcatctgtgtctgttccacaactgcctttgagctggcccttcagatgcctatgaatgagggtgcttaaatggtgttagaggttaagaccaatgggtagtctgtattcctgtggtcatagcattaatatttcagtgttgcccatgctaatgtgtgaatgttggatttaaagctgacgttcttagaggtggggctctgctttatttagcctagtgaatcttaggatttttcatcggccttcagtcactaactccatgtctttattctttgcagctgacatcatgtacacaggcacgcttgactgctggcggaagattgctcgtgatgaaggaggcaaagcttttttcaagggtgcatggtccaatgttctcagaggcatgggtggtgcttttgtgcttgtcttgtatgatgaaatcaagaagtacacataagttatttcctaggatttttccccctgtgaacaggcatgttgtattatataacatatcttgagcattcttgacagactcctggctgtcagtttctcagtggcaactatttactggttgaaaatgggaagcaataatattcatctgaccagttttctcttaaagccatttccatgatgatgatgatgggactcaattgtattttttatttcagtcactcctgataaataacaaatttggagaaataaaaatatctaaaataaattttgtctgcagtatattttcatataaaaatgcatatttgagtgctacattcgaataaatactacctttttagtgaatgctacatttttaataaatgctacagtatctccggagatgaagaactgtctttttaaaaccaattgtcagcagtccgcttaacagaataacttggttgtgccacccacaaacatttccaacacattagcaaaggaattcaggcccagtgcatccaaaaaacattgttccattgcctatggatgatcatagctgaatgagctttctccaagaaatactgtgaacccaccttctctagtcctatggttattaatcatgagccatgagctgaattatccactttaaaatggttacgtttgttgcatgaatatcacctcatttaaacttttagaatcaataccaatttcatccagttgccttcattttcac

SEQ ID NO: 49841 - DNA, 1050 bp, Homo sapiens
aaatatatattgatgtgtttgtcacctccctactcctgtcattacatttactttattaaaagcaaaataactgttgtgctgtttccatcttccttgccaagttttcctaccccttctaccctctccttaaacatcagaaaacaccctctatgaaatcaaatgtactgtacctgggttacttgcaaaaattactaatgcttcagtttttctgttgtatttcatttccagttttcaggcagttatttttattattgtactttaagcttttaagatgaattgttatacaagaggtgcttatgcttagcttgatgaccaggatgttatttttaacaaaatgattgctgaagtgtttcatcctggctggtccttcacttgtgttggatttagaagtgaatgtgtttggaatatggcctacagagaatagaaacaaatccatgtaaacaattttgaaggaggcatgggagctaaaaatcctgtgatactaagatctcagtcatatgaattacaacgtagtatttactggcaagaaggagaaagttgaaggactcagctaaaggagtacagcaattgtagtaactgacacatcctctctttgcaagctgctgactgggcacactcatgccaagtttcagaattattggtcttctgggtttttgctttttaaaagaggtgtgggagcagaggaatggaaacaatcgtgagtttttgagctagggaaagttggagctcctttaatctttttaaaggatcagtgctgccctaagtgaataaactcaattgtccatctttattttagagttttaatgaattcaaggaagggagcatagcatatctgtggcaaactattttccactcaaatcctgagttattgctgcatgctttaatttcttccctttcagcatctgagaaccttaaagccaatgtctgcgatctttttttggatatttatacttttagatatatagtacctttaagtagcagtatgggacaaggcttgtaaatgttttgtctaatgttctattgtcaccttttatgcatttatcacttcca

SEQ ID NO: 49842 - DNA, 1049 bp, Homo sapiens
aatttaaattcaatagaattgtcatgtgtcccaaaatattcttttgatttttttcaaccattcaaaaatacagaaaccattcttagctctcaggctgtacaaaaacacgcagtggccaggtttggtccataggctgtaatttgctgagcctaggcctagataattatgtcaagactctcctctccctcctcaaacctgcaacccttcttcctccattctcacactcagttgaggacctggcttcctagtcactgagaaaatttaagcaatcacaagagaactcccacagcccatccacacatgctatctgccaacacctccacgtgactattcccccatccctctgttactgtgaatgaaacgtttgaactatgtccggcctgtctgctcgcttgtgccctagatccaaacctctctcgcccattcaacaaccctgctctgactagtcttccctttctgtccttgctgttcactgcattattcccatcaacatacaaataaatatgctgtcatcttaaaaaagctgctttttactccaactcccttgccagctacttcttcttctccttccctttacaacaaaaccctggtaaagatttgtcttcattcactgtttccaacttctctcccattctttaagtgagatacaattcacgtaatatgaaaatcaccgtttttttattttattttatttttgagacagagtcttgctctgtcaggctggagtgcaatggcgtgatctcagctcactgcaacctcggcctcccgagttcaagcgattctcctgccccaacctcccaagtagctgggattacaggcatgcaccaccacacccagctaatttttgtatttttagtagaggcagggtttcaccatgttggccacgctggtcttgaactcctgacctcaggtgatctgcccacctcggcctcccagagtgctgggattacaggtgtcagccaccgcaccggccactattttattttattttatttatttttgagatagagtctctgtcacccaggctggagtgcagtggcatgaactca

SEQ ID NO: 49843 - DNA, 1030 bp, Homo sapiens
tctaatggagggtcagaagatcattactttagatacagctactgaaattgaaggcttatcgactggttgcaaggtttatgcaaatatcggtgaagatacttatgatatagtgatccctgtcaaagatgaccctgatgaaggggaggccagacttgagaatgaaataccaaaaacgtctggcagcgagatggcaaacaaacgtatgaaagtaaaacatgatgatcactatgagttaatagtagatggaagggtctattatatctgtattgtatgcaaaaggtcatatgtctgtctgacaagcttgcggagacattttaacattcattcttgggagaagaagtatccgtgccgttactgtgagaaggtatttcctcttgcagaatatcgcacaaagcatgaaattcatcacacaggggagcgaaggtatcagtgtttggcctgtggcaaatctttcatcaactatcagtttatgtcttcacatataaagtcagttcatagtcaagatccttctggggactcaaagctttatcgtttacatccatgcaggtctttacaaatcagacaatatgcatatctttccgatagatcaagcactattcctgcaatgaaggatgatggtattgggtataaggttgacactggaaaagaacctccagtagggaccactacatctactcagaacaagccaatgacctgggaagatatttttattcagcaggaaaatgattcaatttttaaacaaaatgtaacagatggcagtactgagtttgaatttataataccagagtcttactaaactcctttgaaatactagaaagttttgttttggatgatggggcaggggtttcagaagatctgtaaaacaaattaaggtgcgaacaagttaatttgatctgccacattatctgaaggaagtgtagtgggatttttgttgataatttttagaagcaaattttcctgaaagttttgagtagaggtgagaccccctccccaagtatctgtttatatagttagttttcagctcatttaa

SEQ ID NO: 49844 - DNA, 1058 bp, Homo sapiens
aagtgctagtactaaactgtgctagtactaaaagaaaacaggttggaacatacatatagcctagcatttataacagaattgttgaacgtctgtaaatgattttttttttttttgcaaaggaaaaaattgatactggaaaagattgttgtgcatagttattagtcatttgtaaccttgcttaagtatttcttagtccaacatagatattttctttctcctgaccatgtattttaaaatatagtctatttcttgactttgaacttaaagctttaatcataatttctcatgtatacatcgttcttctgatggtaagctggatttgaaggtagtggtttcagtgtttcttaagttggtagctgagggtatcaggcatcagttcatgcaataatacaagaaaaaaaatcctttgcttgccaagaggtagagtgatgtgcatttatctgttttctgttctgtaagtctagaccttcaaaccatttgtaaactaacccctgggaaatttgaaattacctgataacttaagactctgtgatctctggaatcaccatatgtttcttttttgtgtagatattaataacattactctttgactatagtgtgcactctgaaatgtactcagtgaaaatttgttttgagtttcattaatgctatttcaccagttagacataattacttctaccgatgtgaatgatacggatgccggcagagcttccagatctttcagactcaactgctaggtcaattagtttgtcataataaaacttggcagattctacaagtctattatgacaaaccaggaactaattctataatggaaaactatccattctgaataataggtatgtaattatttgctgctgctgctgtgctctgtaaattctgaatatgacatttaaactctgtgcctactaaaggtatcttctggagtttttgggaggagagaaactggaaaattaaattgtatttttgccagaagactcttacttgcatgtgtctcagggtcttcagtttttctataagtttccatatccaaagttcagaattcatgtgaaatactt

SEQ ID NO: 49845 - DNA, 1054 bp, Homo sapiens
gctaatctactgtaaagctttgtttttcttatccaggaaatgggactgaaggcccttgccctttcccatcttctgaaggaagaaaatatgtttcttgaagattaaaaaggaagccctttgtaaagaacttgggcaccccaggggccacgttgaatgctgtgtcaggtattattagcaaccctacactatacatgtggtttagaaatctgtgatatatgtcctagatagagacaagatgcctactattgtagatgtgtgtgtcttaagcctgcttagcttgtgtcagggtctctataagctccacaaaggcagagagaaatcctgtatttatacttctgcaatgattgtctttgagtcctgtttacttatctctttctcctctcattctaaatatctcatacttaatgtggaggactcctgcaaccagcactgatttctcaggagtgcttgctaattaacatatttcgtttctgtgaaagtagcctgaaagaaaagaggtttttatacaggctctaaagactatatgacaccttctttagagattcttggctcccctatagcaatcacacagcaagagatccctaaagaagccaaatagaaacttgttaccatgctggttttgatggacagattgagggcttttcaattcagagagaaacacactacccaccaaatgatgcagagggcatatgtaatttgacctttataatcccaaagacacaaactagtgaggtacctttaatgggagtgaggtttgctttctcaacatctgtattcctgaatcctgcttgaaattgaacattattttataaagtactagaggagctggctatttaaaagaactgcatatggtatgtttcttttgtgctgtctcttggggtgccttgtgggacttggagcacagcacgcactcagtcaagttaaaaatgactttgagaccagtagcagtgacaatagcagcagctgcagcagcttggagagtagtagcagtcttctccccagagatggtgtatttgtctggagagaggatcgggaaaaggggagggactagaat

SEQ ID NO: 49846 - DNA, 1030 bp, Homo sapiens
atttaaaaattttagaacccatttgatgaccaaattagtggtattaattttgtttcagggttaatgtagcactttgatattcccctagtcttgtgacattgttactctggttctatagacccactagttagatcactaaaatcacttttagatatgagctgccacagagtaatgtagtttaatataaacaacaatgtaattgtgatgtcaataagttctttacttgtggcttaataattaaaaaataacaatatactttgaattatatttatcacgagtaagactataaaaatgcataaaagtatgtttatgtgttttttttccttctacagtgagaaagtcaacaaaggaattggcattgaaaatatccattatttaaatgatgggctgtggcatatgaagacatataaatgagcctcagaaggaatgcacttgggctaaatatggatattgtgctgtatctgtgtttgtgtctgtgtgtgacagcatgaagataatgcctgtggttatgctgaataaattcaccagatgctaaaattctgttagcttcagaaattattttaagttttcttaaactcaagttaaaattgggtagcaaacttggacattaaaaggtatctggtaagtaagcaaactcatacaactaatgtcctttcttaggctaatgatataagagtgaagagcaggacttggtcaatggattgccattttatggtagacctctagagaaactgtctagttaaatggggctagaaactagactaggaattttattctattactccaggggacccagcagtgctcattctcgtgtgtgtgtgtgtgtgtgtgtgtgtatgtgtgtgtgtgtgtgtgtgtgtgttttgttgattgtttttttaaaaaaaacttcaatggaaaattctaaacatattaagaagtctggagaatagtataatggacctctccatatccatcacccagtttcagtttatggtcagtcttatttcatctatacctcaattatttctccccaccccccaattatttt

SEQ ID NO: 49847 - DNA, 1736 bp, Homo sapiens
aaaaccaagtaaaggaccacaactccacgagatcaggaatgaatgaagaaaattgagggccagtttttaaatcattgttgagactattaggttcatctgtctgtttaagagtctggccttagggaatataatttatgcatgtaaaaaaatacaggagatgattcactggaatgtctcttaataataccatgttcattaagaataggtcattgggaggaaaaataaataaaaacatctgaactcattagtataattaatacttgcctcttagaatgaaaattaaagaactccaaattttagccttgaatactttgagaaataaaagatgaattagtgaaataatttctacttaaaatcttagttgttacagagaatgacatgcctcactattaatgtccaattctaattaatggattgttttagaaatgtatttgtgaaatatagcaaacatagctagtaatactaacaggtgaaaactgatatttcaaatgactaaatagacttaagattagaggaaggtaggaaaaggtgtgcaactaacagaagcagttaaccaaaaaatgagcttcaggcatcagtcttatttggaagactgtaaatcaacaggctaacgttcaaaatatggcagacatcttaatatcaatatatgctaaattggtttatctttaggcagaaacagaaagcaaaaaattaaactcatccaactcatacatttgttgttgttgttgttgttgttgtttttgagatggagtcttgcttcattgcccaggctggagtgcaatggcacgatctcggctcactgcaacctctgtcttccgggttcaagcgattctcctgcctcagcctcccgagtagctgggatcccatgcgtgtgccaccacacctagctaatttttgtatttttagtagagacagggtttcaccatgttggccaggctggtctcaaactcctgacctcaggtgatgcacccgccttggcctcccaaagtgctgggattacaggtgtgaaccaccacacccgacccaactaatacatttttaaaatcccattttaaaagtaaaaccacagttttcatataacaaatgttattgctcttcatttcattctccaattttaaaatgctttactttcagccaatatgtgaatataggagacttcaaaagcataatcaattactcccttaaagttcattgtaagtgttctcagaactctaccacctagaatttaaagacgggaagatttactttataattttaatttcttatcacaagactcgattgtcaataactgttaacgtccatttaataatctatggtgaaataggtaatttcttcttattttcacaagcgtgtgagtaaaagactgggttttaagcaataaatcatttgttctaactaagcacatgcttggaaaaagtgctatttttccaaacgtatgccttgaaaacaaatacaattcaattgcctttttggttcatgggaagccatactgcggtggcttccaaggttggccaacctgtttttattcttaccacctctttcaaaaagggatgttgtctttgtccccaaattctggtgttgtcctatgctgatgcataatgaagccctgaggcttggaaacttgcaaaccaataagatgatttaatgatgaaacggcatgtcagtttgacactgtctattaatagtccttgagtgagcttaaatttgagacacttttaaaagcggcatgtagttcc

SEQ ID NO: 49848 - DNA, 1027 bp, Homo sapiens
tgaaaaggagtccacaaagtatttctgctttcttgctcctgaatgcaaaggtctgagagaaggcacatcctcattagcttctgggtgttgtcaaacccaatcctctctcaagtaccaaatgcccagatacatttattgggatgcaggaatctcacttaagtagcggtttttgctgatataaagacaaacatcttgattaaagtgtagggagatagaaactataccaatttgggcaattttggctctaatgtctaatttgttgtgaaaggggaagatgttctaagctaatgttcttaaaagtaacttatgaatttcttaaaaatagtttttaaaaagctgtttcaggaaaagctgttttattgcatggcacagattaaatgtacagatgttatcttaaaacaatgaaagagttcccctaatttgaatattcaataccagctgttattcacatcaatattttaacattttaccatcaagatatttaatacaaaggattgatacatatttaactgtttagaattctagttaaacttgtccagatgagtaagagggaaggagaaataacattctccaagtacctaccatgtgcacaagctctacttatatatcttgcttaatcttagcaatgattccatgaggtagattttaactctcattttacaaacgaggagactaaggctcagagaggtcatacaacttcaggaaagttgtatgacctctctgaggtaataaatggcagaactggaatttgaacctaagtctccttgtctgcaaatcctgtgttttgcagaaaactctcctcttgtatttcataaaatgttaaatcttggcccaaattcaaatcaccatctttatgggttattggagagaggtataagttggcaagactctgttccacgatgggaaaaaatgggtaggatttgaatgagtaagagtgggatacttgcacagtatcatatttgtgtggctggagtaatgtttttctgtttccctcttagcaaagtggagtgggagaatcttgaaattg

SEQ ID NO: 49849 - DNA, 1109 bp, Homo sapiens
gttgatgtgccgtttgggggtgctaaagctggtgttaagatcaatcccaagaactataccgaaaatgaattggaaaagatcacaaggaggttcaccatggagctagcaaagaagggctttattggtcctggcgttgatgtgcctgctccagacatgaacacaggtgagcgggagatgtcctggattgctgatacctatgccagcaccatagggcactatgatattaatgcacacgcctgtgttactggtaaacccatcagccaagggggaatccatggacgcatctctgctactggccgtggtgtcttccatgggattgaaaacttcatcaatgaagcttcttacatgagcattttaggaatgacaccagggtttagagataaaacatttgttgttcagggatttggtaatgtgggcctacactctatgagatatttacatcgttttggtgctaaatgtattgctgttggtgagtctgatgggagtatatggaatccagatggtattgacccaaaggaactggaagacttcaaattgcaacatgggtccattctgggcttccccaaggcaaagccctatgaaggaagcatcttggaggtcgactgtgacatactgatcccagctgccactgagaagcagttgaccaaatccaacgcacccagagtcaaagccaagatcattgctgaaggtgccaatgggccaacaactccagaagctgataagatcttcctggagagaaacattttggttattccagatctctacttgaatgctggaggagtgacagtatcttactttgagtggctgaagaatctaaatcatgtcagctatggccgtttgaccttcaaatatgaaagggattctaactaccacttgctcctgtctgttcaagagagtttagaaagaaaatttggaaagcatggtggaactattcccattgtacccacggcagagttccaagacagtatatcgggtgcatctgagaaagacattgtgcactctgccttggcatacacaatggagcgttctgccaggcaaattatgcacacagccatgaagtataacctgggattggacctgagaacagctgcctatgtcaatgccattga

SEQ ID NO: 49850 - DNA, 1033 bp, Homo sapiens
cccatctttctttacatgttcacatttttgatatgttattttaggtgttgaattcaaaacataaaaagggtattttaaggccgggcgtggtggctcacgcctgtaatcccagcactttgggagactgaggcgggcggatcacgaggtcaggagatctagaccatcctggcacccctctctgctaaaaaaaaaaaaaaatacaaaaaattagctgggcgtggtggcaggcgcctgtagtcccagctacttgggaggctgaggcaggagaatggtgtgaacccgggaggcggaccttgcagtgagccgagattgcgccactgcactccagcctgagctacagagcgagactccgactcaaaaaaaataaaagggtattttgaatattttattttatttatttgtttttgagacattgtcttgctgtgtcacccaggctggagttcagtgcatgatcccagctcactgcaacctccacctcctgggttcaagtaattctggtgactcagcctcccaagtagctgggattacaggcgtgtgctaccacacctggctaatttttttttttttggtatctctttttttcccctcggagacagagtcttgctctgtcgcccagagctggagtgcaatggctgcgatctctgttcactgcagactccgcctcctgggttcaggcaattctcctgcctcagcctcccgagtagctgggattacaggcgcacgccaccacaactggctaatttttgtatttttagtagagacggggtttcaccatgttaaccaggttggcctcgaactcctgacctcgtgatccacccacctcagcctcccaaagtgctgggattacaggtgtgagccaccacacccagccttttttgtattttaagtagagacaggatttcaccatgttgcccaggctggtcttgaactcctgacctcatgtgatctgcccgccttggcctcccaaagtgccaggattacaggcatgagccactgtgccggcctttgagtattttaagttataaaagaaata

SEQ ID NO: 49851 - DNA, 1081 bp, Homo sapiens
ggagaagctttgcaaaatctgtatggatagaaatattgctatcgtttttgttccttgtggacatctagtcacttgtaaacaatgtgctgaagcagttgacaagtgtcccatgtgctacacagtcattactttcaagcaaaaaatttttatgtcttaatctaactctatagtaggcatgttatgttgttcttattaccctgattgaatgtgtgatgtgaactgactttaagtaatcaggattgaattccattagcatttgctaccaagtaggaaaaaaaatgtacatggcagtgttttagttggcaatataatctttgaatttcttgatttttcagggtattagctgtattatccattttttttactgttatttaattgaaaccatagactaagaataagaagcatcatactataactgaacacaatgtgtattcatagtatactgatttaatttctaagtgtaagtgaattaatcatctggattttttattcttttcagataggcttaacaaatggagctttctgtatataaatgtggagattagagttaatctccccaatcacataatttgttttgtgtgaaaaaggaataaattgttccatgctggtggaaagatagagattgtttttagaggttggttgttgtgttttaggattctgtccattttcttttaaagttataaacacgtacttgtgcgaattatttttttaaagtgatttgccatttttgaaagcgtatttaatgatagaatactatcgagccaacatgtactgacatggaaagatgtcaaagatatgttaagtgtaaaatgcaagtggcaaaacactatgtatagtctgagccagatcaaagtatgtatgtttttaatatgcatagaacaaaagatttggaaagatatacaccaaactgttaaatgtggtttctcttcggggagggggggattgggggaggggccccagaggggttttataggggccttttcactttctacttttttcattttgttctgttcgaattttttataagtatgtattacttttgtaatcagaatttttagaaagtattttgctgatttaaagg

SEQ ID NO: 49852 - DNA, 1093 bp, Homo sapiens
tggattcaaccaaggaggaattgaaaacactgagaaaaaaaaaaaagaccacacaataaaaaaaaaaaatacaaaataatacaaagaaaaagccaaaattgtcatactgttgttaagcaacagtataacaactatttacatagcattaaggttggtgcaaaaatgcaaaaaaaaaaaaagcaattatttttaaaccaacctaatatattgtattaggtattaaagtcatctggacatgaattaaagtatatgatgccagcctggacaaaaggcaaaaccctgtctctacaaaaaatacaaaaattagctgggcatggtggtgtgtgcctgtagtcctggctactccggagcctgaggtgggaggatcgcttgagtctgggaggcagaggctgcattgagctatgatcatggcactgcattccagcctgggtgacagtgcaagaccttgtctcagaataaataaagtatgtgatgaagatgtgcatacattatatgcaaatactgttttttttttttttaatttaaacagtctcactgtgttgcccaggatggagtgcaatggcacaatcttggctcatggcaaactctgcctcgcaagcagctgggactacaggcatgctccacggtgcccagttaattttttttgtattcttagtagagacagggtttcaccatgttggccaggctagtcttgaatttctgacctcaagtgattcatctcccaaagtgctgggattacaggcgtgagccaccacggccggctaatttttgtattttttagtagtgactggtttcgcggtgttgaccaggctggtctcgaactcctgatctcaggtgatctgcctgcctcggcctcacaaagtgctgggattacaggtgtgaaccactgctcccggccttgtgtgattttatctaagggacttaagcgtcctcaggtcctagggggtcgtgaaaccaaaaccccagggatagcaagggacaattgtatcttcaaagtagacaaatggcgccgggcacggtggctcacgcctgtaatcccagcagtttccgaggctgaggcaggcggctcacctgaggtcaggagttggagacc

SEQ ID NO: 49853 - DNA, 1045 bp, Homo sapiens
tctctccatcccttccgaggcccgacttcggtcagttttcttcgggcaacaattttctaaattggctggggtctggcggtgttggcccccgcgcgcagaccttgccccgaagggggccctgcctgcctggcatgggcggaggggggaagggcgggagtggaaggctgtttgttggggggttttggcgccacttttgttttagttttagtgctgcttttcattcccacccccacccgcactgtctttctcaaggcacgaactgagctgatccttgccccaggtaggcagcctgtgcgttttcactccacacttttattcttgctcggggtcgactttcttttttcttctcccctggatccggagatctgcggacggcgattttgggacgaaaagggtcggatgggccgtgggagagagaaggtgtgggaaacagcatcaagtagttccgcaaaactttgagccccgttcccattttcttttggcctagaattgtgaacgtattgttgatttcggcctttttttccccccgtcgcgagaatgtcttgttttgcctttagttttttataaaccgctgtactttcgacatttagtttccgctcccccttggtgcatatgtcattttatttttaatccttaactgtaatgggttatcgtgtgattttcgtgcttcagtgctcggctttaatttttaatattgtattagtagtttcatccggtttgtgagactttctcttccgtggcctagaatgttttttatgttgttgcctaccacccctcttccctctccctccttctttctcttggatgtagtttttaaattgagggccatggtgttggattaaatggtaatttacagtttacatgatatatctattggaaacttttgatctgtaaggttagatttaaagtaaacgaggcgcttgtgttggtttgcaatggttccttaaaatgcgcgggccacccccttctcccaccataaagccccatcttcccttcacactggagtgtaaattccataccccttttctcccacggaccgccgtat

SEQ ID NO: 49854 - DNA, 1824 bp, Homo sapiens
tctcccttaattagtgcatttgtgaactgctcctaaattctattaaggtaagtgccttttttttttttttttttggcagttctatactgttcagtgtcaggtttatttttttcccccaggagatacattttaaaaatacatgtcacagttccgaaaggaatccaaaacaatggatatttaatttatagcaaaatttcaccccaatctgggaacagacattttgtaactgttaccattagtctgtttgtgtatttcatattcaggattttagctttagaaggatgttaaaggaaaataggtgacatatttcaaatttttattcatatacaaatattcttagtagatggtaaggattgtggcatcagatttattttattgtggtgaggcaatagctaaactactacactaacacatgatgagtttggtaactttcaagtatatttagttaggattttttaaagcccaaatgctcaaataagattttcatgaaatcaaattctacatttctttttcaactgtattgacttctgcggtcacctgaggacttatgaattaaagtgaatgggatgggcttgggggacaggctaaggctcagatctattcctttgggaatttagggttagatgtgaaaatatgcagtttagtaatgcttaatattgtgcatgtttaactgataccacccacagtcatatgtgggaaggtagtaaacagagaatagcataatctttctgcttcgggttctttataatagatggcagacttcagtttttgatgctgcaagttgacttttgaacttaaaccaaaatcggcggggcacagtggctcacacctgtaataccaacactttgggaggctgagaggctgaagtggggggatcacttgagcccaaggagttcaagaccagcctgggcaacatagggagaccccatgtttatagataatttaaaaattaggtgtggtggtgcacacctgtggtcccagctatttgggaggctgaggcaggaggatcacctgagcccggtacatagaggctgcagtaagccacgattgcgccactgcacccagcctgggcaacagagcaagaccctgtctcaaaaaaaaattaaaaataaactaaaatgtacagtttactatataatggagtaccgttttgggagttggggagaatagcgagggagagggatagtttcaggtatgggcatcagtatatactgaagtgtgattgttggagagtaaggaaggaactttaaagacataggctattttaaaagtttttggctgggcaccatggctcacgcctgtaatcctagcactttggaaggctgaggcaggcggatcatgaggtcaggagttcaagaccagcctggccaacatggtgaaacccccatctctactaaaaatactaaaattagctggacgtggtggtgcgcgtctgtagtcccagctgcttgggaggctgaggcaggagaatcgcttgaacctgggaggcagaggttgcagtgagctgagatcgcgccactgcactgtagcctgggcgacagcgagactccgtttaaaaaaaaaaaaagttcttaacatttttctgcattggctacatgttcaggactttagttcgtgtttcagtactgtccctgtgtaataattctttatgtttctgggtatcataaatgatggttattgcgtgttctgattggcaaagatatatgataaagcaaaattatcagtttgatttttcagtctcttgagttgactgctttacgtttaatttacccaaattttatatttcttcagtgtaagtggtgttgcttagtggagtctaatttt

SEQ ID NO: 49855 - DNA, 1956 bp, Homo sapiens
gtgtctgagaattgttccccagtccttcagcttgttttactgagtggttagattcgaagtaaaaagtttaggctaatctttaataattcagcgctctggttctttaggggtattttttgttatttaattgtaccttaaaaattcttttttattctgttaatatctcctgtttgcttatacttcctattttagttcatctttcactattaagttttcttgttcttactgttatcaggtgataaatagttaatatcagggccccaagttattaggttcattagtgatcggtatcttagtctcagttttctttttcctttctgttttttttttagatggagtttcgcgcttgttgcccaggctgtggtgcagtggcatgattggctcactgcaacctccgcctcccaggttcaagcgatttcctcgcctcagcctcccgagtagctgggactacaggcgcgtaccaccacacccggctaattttttgtatttttggtagagacgggatttccccatgttggccaggctggtctcgaactcctgacctcaggtgattcacccatctccaccccacaaagtgctgggattacaggcgtgagccaccgcacccggtcttcctgtttttttttttttttttttttttttttaattgtaactgaagttttttttatctgaaggaattctggttgttggacttatgacctaagataaatttatggagacaaggaaaacaaaatatatatatttgtgcttttcatagccatgagtcaaatttatatgtttatattgatcattcctttaagctttaacatgtaggaaatacttttttcccaggtgatgaacagcagtcttatactcagactctttgttcattgaggagtcttttcatccatatttccccctttgtattccaagaaaaccaagaactggtgttccatgacagaattattccccgaggcatccattgtatattataaattagtttctcccctgcacatctagaaagatattagttaggtatcattcttgggagacttcaggaatagtcactgaagtcattttctgagttctgtagtcaagtcattttctgagttctgtagttaacatgaggaacactggttgagaaaggctgctagaatattaagggacttggtttggcactaaataaagttttacttttcactgtcactttcctgttagtaactctaatatggcctctattaaaattcgtgatacaatgtgaatgctgttgatactgctattgctgtgggataaattggttagtgttgatttcaagcagttagtgctgcttagttgtttgaaagaatttaatgtgggacattaaatgcatcattttatttataagaaggaatattgtgggagcactgttcattatacagttcaaaatctataaaaagtcactgacagtgactaacatgaacaagaactaatactaactgaactcttaccatatgccagatactcttaaaaatgctttgtgtgtattagcttactttatcttagtaactctatgaggtaggatgaccatatgatttattgttcaagccaggatacttttgaacgtgaaagggattgcttcttggccttttggctaagatcaagggaagagtgagtgaaagggggcactcactgaatggcatgctgagataatagcagaaactaggactgtttgagagaaaggatgtgtgatgaccctaattaataccttctttttcagaagaaactgaagcatagggagaccaaataacttgcccacttagtaagcggtaagaagggatttaaaacctctgtagaggctgggcgcggtggctcatgcctgtaatcccagcactttgggaggccgaggcaggtggaccacctgaggtcaggagttcgagccagcctggccaatatggtgaaaccccgtctctactaaaaatataaaaattagccaggtgt

SEQ ID NO: 49856 - DNA, 1032 bp, Homo sapiens
tgtgcctgtaatcccagcttcttgggaggctgaggtaggagaattgcctgaagctgggggtagaggttacagtgagctgagattgcgtcactgcactccagcctgggcaacagagcaagactcttgtctctaaaataaaataaaacctgtagagatttctatgggaatgaaagtgatttaaattattttaaattgccatattctgggagtttgtttacttttacccttttgggggagtttttgttggtacatggtcaatagtaaaaagacaagatagtgttttttaaaatccaggagaatttccacttggatttttttcaagtggctgttagactgaggtgattatattgtcttaatgttgaaaagcaactttcctgagggccacctaagttaaaacaaaactctaagataacgacatctgagtttgttttccgtatgtattattcaggttccctttaccattttcttaggcagaaatgtggattgtagaaatttttactgagaagacagtagaaagaagatgaatacttttgtgactagggagaagtgttactagaaaagaaagaaaaaggtccagtttagagacttttgaaggtaaactgattctgtagcatagtttgagagttaagtcttgtagagattaatatgtcatttcataaaaaatatccctcttttattgtgatttttaaagctattttatatttctggcctgtttatgcttgtgctgtcacctgaaaaaatattactggtgaattcaaatgtggagaaatgattttggcacagttgtggaaacaactatattgtaaactaagatctttttttttcctttgagtgggagtgaatggtagtatctgatcttaaggagacttccagttttgttttcatacttggctattttaatagttcattgagtaatttgtgtttttttttttccctctagctagttgacgtttggaggttttgttggtgtaactatcattttttttttttctttttttttgaggtggagtcgcccaggctggagtgcagtgg

SEQ ID NO: 49857 - DNA, 1043 bp, Homo sapiens
cactcaaaagagaaaaaaaacagtagtaaaataaaataaaaaaaaaatgcagttggattttaaatactatattgctggtttttaagctggggtccatgaatgggatggagatttgtgaaccctctcaaattatgtacaaactgtatacatgcatttcatcagtttctctagggctcattgttaaaatcagctggtatttaaagtacttatgggggaccgggtgcggtagctcatcatgcctgtaatcccagcactttgggaggctgaggcaggcagatcatgaggtcaggagatcgagaccatcctggccaacacggtgagaccccgtctctactaaaataacaaaaaattagccgggcatggtggcgcgtgcctgtagtcccagctactcgggtggctgaggcaggggaattgcttgaacccgggaggctgagattgcagtgagccgagatcgtgccacagcactccagcctggcaacagagtgagactctgtctcaaaaaaaaaaaaaaaaaaaatagactgggcgcggtggctcacacctgtaatcccagcactttgggaggctgaggtgggcagatcacctgaggtcaggaattcaagactagcctgagcaatgtggagaaaccccatctctactaaaaatgcaaaattagctgggtgtggtggtgcatgcctgtagtcccagctattcgggaggctgaggcaggagaattgcttgaacctgggaggtggaggttgcagtgagctgagatcacgccattgcactccagcctggacaacaagagtgaaactccctctcaaaaaaaaaaaaaagtacctatgaaagatgggatatacaatggtaaactagattacatagtctctgcccttaggggaatatagtcagttggactttgtcactacagaagggttaaaaaaatacctattaaaataccgtgtattgggtttacattaaagaatattgggctaaaaccagccatcaatgcagttttggcactgtgttcctaatgtgagattagtgacatactgaaaaattagggc

SEQ ID NO: 49858 - DNA, 1044 bp, Homo sapiens
gctttaatgtagccttggaatgcttcagtctttggcagttgttaataaacaaagttaaaagagcccatgatcatcttttcttttcttttttcttttttttttttttgagacggagccttactctgttggccaggctggagtgtagtggcacaatcttggcttactgaaacctccacctcctgagttcaagtgattctcctgccttagcctcccaagtagttgggattacaggcacccgccaccaggcctggctaatttttgtatagagaaagggtttcactgtgttggccaggcttgtatcgaactcctgagctcaagtgataacacccgtcttggcctcccaaagtgctgggattacaggcatgagctaccgtgcctggccccatgatcatcttatatatgcagttactgttatccaaaggttgataccttctttttttttttttttttttgagatggagtctcgctctgtcgcccagactggagtgcagtggcgtgatctcggctcactgcaacctctgcctcctgggttcaggcgattctcctgcttcagcctcttgagtagctgggattacaggtgcatgccaccacgcctggctaatttttgtatttttagtacagatggggtttcaccatatttgtgaggctggtctcgaactcctgatgtagtgatccgcccgccttggcctcccaaagtgctgggattacaggcatgagccaccacacccggcctagtatttgattttcattacattcactcacccacacactcatcatataaaatgattgaggtttggtatacttgaagtattttcatttcaggattgggatatatgataacctctttccttagatttccaatctttttttcctttcaaaagcaagggtaatttttacagtcaccagtgtgtctactgccttgtacctaatttgcaaactttatggtggctagaatgttattacaaagaacatgtttgatatcttcttactaaaatagaggcattttttgtagtctaaagaaatagtatatatataaagatagga

SEQ ID NO: 49859 - DNA, 1027 bp, Homo sapiens
catcttcttactatatgacaagttgtactaggctccctaacatttaattttttgtttctcacaacaaccctattgaggttgtttactgaggttcagaattgttagagacttgcccaagatcacttagctaataagtggccaagcttactttttgaatccaattctgcctaattccagaacactcctttacatggtgatacactgcctcccagtgggatgatttatagatttcatagtgatactttctttggggaaagagaatataaaggatacaagaactctaaatggaaaagacagaggaggaagttaaacttctcatagtggtcaggaaccttttgggggattaagtaggaggaaagcttattttcagctgagagctgatggatgtttgaagttgcatgtgatatgtgtcatgttttataataaacatcaagtagcaactagaaaaggcttagcggcagggagatgataaagtttcttacactgtagtgatgataaagtttcttacactgtactgatgataaagtttcttatactgtactgttttaatcttgagtaaagtgacatctgaattaattttaaggaattaacctttatagaaaataaactgaaacaaaatgttaatctaaagcattgtctccataggtagtgttcccaccaaagaacaataattctaataagaataatctgttcaggtaaactggtctaagtcaggcagcattatgattccagtttgtgttttggttttcatattccactagcctcccttttctgctgttttttttccccccctccggtatctttacagtttctgtagttcttcataaaaagtagaaatgttttgatggcgatttccttattttacttttatgctgttactgctaacagtagacagccttatttgtgaggcactgaaatagaagtgatttcaaaaattaatccatttcgtgactcagaaacatttcctttaaaaataatgaaaaaaaatagaaaaattagtccatttaaatttccctacaagcctgtg

SEQ ID NO: 49860 - DNA, 1063 bp, Homo sapiens
atagtgtacattggcttttggtgggggtacttagaattaaagagccggagggtcagaggtgaaaacatcatgcttaacttggcaggaggaagaagtaggatcactgataagagtggtcaaagaggtaggagaaaatttaggataatgtagcatacaatccataagcatctcaaatttgaaaagaatccagatggcatgttctcccatctgggagatgcttttaaattgtatacagtataaaaactgttcttccaattatgtcaagttaaaattatctttaaagctgatatgatcaacaattatccttatgtagattgtttcctttgtcgcatctcatgggaattgggttcttctcccacactgggtcccaggttacaaataataggtttaagctgggaagtggtcagggacaggaagggagggcatatttggctttattgaattctacaaagtcaaatagaattgtattggaattattttacatgcaacattggtattagtgtggctgatcaaagaattgattgtacttaaatatgcaaatagtattaggataatacaatactgcaatttgatgtcctcttcaaaatagctctgaaaaatatgattggaatttctggagtctattttgaaaaggaaaactttttttttcttttttccttctgtacttcatgtgaaataagtgtgtaggcaactactttagtttctttaagttttgtgtaaaagctaacttgggtagaaataatgctggagatgagtatcttataaaaatcacttcatttttctgcttcttgagagaatattttacagggaaattattatcaatatgaaaaatgactcataattctacttttctcattccagaagttttttttcttaattttggtaaaatatatataaaatttgccattgtaaccattttaagtatacagttcagtggcattgagaacatttacgttgttgtgcaaccattgtcaccattcatacccagaatttttttactatctcataataaaactgtacccattaaacaatagggccctgttcctccctccctccctcgctc

SEQ ID NO: 49861 - DNA, 1067 bp, Homo sapiens
tcaagtgatccgcccaccttggccttccaaaatgttgagattataggcgtgagccaccgcaccctgccggaatttacttttgaatatgatgtgaggcagggctgtacactttagtctttttttttttttttgcctttttttttgcccttttttttttttttgccgtatcatgaaccaaaaccaactactttccttgtacatttgtctgtttctatatcctcatttttaggtagcaatacttctataagtagctttatctttttccctatctaattgtgtccagcagttggaatcacgctgtcagtcagcatgaacatttttaaagctcttggtaactgaagttatattgttttctaatagggttgtactgattttacagtgccatcagtgctgtgatacgtggtaaccacattttccctgcttcggagatgttaaacagtccgtgcagttcctcagatttctttaatttgcatttctttgattactagctgaaattaatatttccccttgtttttcagcaaggtattgtgaatgtgactgacaaacttaagtttaacctgagagggccttataaattatgagtatacagtagtttttagtaaattactggcacttttttttttttagtatttagatgtatctactttttttaaattgagtttgtgtattttgtaatgtctgttcaccttatttgtggttctcctagttcatttcaatttactacttaggaaacctgaagtaatctatccatcctcttgtttagcctagtagtgctaagttgcattcagtggatagccaattcgtggatgagctgagttcaagtgttttgtaaatagagtatgagagaatcagtgggaagagcccagatttttttttcttactgtagtgtaatctttttagcagtgaagcctatagtgaaatgagatttttattagtaacttagcctgcttcttgatagtaatagttatttatagtcatgagccggacggataaagtaaaattggctgtttgacataattcttttgaaaaataattatataattgtatttatctttatgccaggtggt

SEQ ID NO: 49862 - DNA, 1189 bp, Homo sapiens
atctcaggtgatctgcctgccttggcctcccaaagtgctgagattacaggcgtgagccaccatgcccggcctttaaatttttttgtagcgacgatatctccctgtgtttcccaggctagacatctatcattttaagttcttcataacttttcaaggaataggtgcaaatctctgcattttacaaatagaaaaaattgtagagatgcatcttgtctttaatcaagagccctaaagtaaatctacttgggtctaataatgagaaaataagggataattcaacataaaatctgtacataggaagcgttgttagttattacaatgaagtgttggggtcagtcttaatgtctaataataaatgagtagattatcacatctggtggaatctcataaaactattagaagtttgtattatgaatattacagaagtgcctagaagtgcatatggagatgaaaagttgtgtacaattgtatccattttgtggttatagttttgaaaaatctacaaagtcatacaggcatatacatgtggacaaaggctgggaaggaaaatgaaaataggtgatttttcagggtattataatgctatgtgattgttctgattatttttaaagataattttgtgtaataaagagggagaaaaccaagatgatatatttcccatgtagtgtgcactgaagagcattggcattaaaacagtcaggggttccacctagatgatgtggtttatagtatattgtatcttatactttgggggaattttaatagtcttgactactggcttttaattttttattagtaaacttttagcatactatcattcaacccattgcattttaccatggagtttcactattattttattattttcttcttcttcttgagaattatggccacaataagtagacttgtatgttatgtaaataaatcttaatggactttttttttttgagaatcttcaacttggtgtcattaaagaagcatttttaagcccgagatatatgttccattgcagtattatgagggaaatcatccattataaacttctatgcccatagctttttgtgtagcttgtcttgtcaatcagcaaagcaaatactttactgctctctgccttccaaattacttcatatattttatggttgatatactttatggtatgtgtgttcttttctgtttcattgcttccata

SEQ ID NO: 49863 - DNA, 1183 bp, Homo sapiens
ctttatagcaacagccccactctcttgggaatgaatccatttccaggagaactaatccagtctcaccagagtgagaactcagaatctcactcattaccaaaagattggcaacaagtcattcatgagggatctgccaccatgacccaaacacctctcagtaggctttacctcccaacacagccacgttggggatcaaatttcaacatgagttttggtggggacaaacaaaccatatctaacccaaagcaaatgcctattgctttataataagattgatggtaaagtgcagctgttggggattttctgctgctcaagattttgctaaagatcgttttgtgtacacaattgtaaggaaactattatttttattgcatgtattgaatgaagagtaagatatttcaggggtttctatgtgatagttttagatagttccttaagtacaaaggaaggaaattaagaccttatgtttgaaattgagtgattcacaatactttaagagtgtagtcttatttttgttctgaagagctattatgtggattatcctagtaagacaagtatatatttatgagacaaatatgtagaagatgagttcaagcctagattcttgcctcttagctgtgtgaccttgggaaaagcttttaacttaaaaacaaattcagcgttgattagtatttaggggaagttgatttgctgtagaaaccatgttatgctattacttgcgtaagtattttggtaacacttctggtattaccatggtagtataaaagcatttttttccctctcgtataatacagaaacaacaacgtaaacaaaaaacctctgcaaactcctatttttagcacacttggagacataaaatgtgccgattacaaaaaatgtgtagaggggccggtaggtcgtgcatcaaagaagtgtggagaatagtgagctggcccagagatggtagatcttagaaagcttgactgtaaaatacaataatatcctttgtatgtgacaatgggagcaggtaaagagatgagcaggctacaagataaagcctttatggaaaaggtttagtcacgactagggagatatggtagggcttttgcacaacgaatccgttttagcaggaaatcatctctgtggaagcagtggagagaacttttgacttaagaagcctgaaaggctatttatcctaacatat

SEQ ID NO: 49864 - DNA, 1050 bp, Homo sapiens
tttgcatatggtacaaggtatggaaagaattaactttttttgacatatggatatccagtcattccagcaccatttgttgaaaagactatctttcttcattgaattgccttggcacctttgtcaaaaatcaaatgaccatatgtgtgtaggtccatttcaggactttctattctatttcattgatctgtcttgatcaccattcgcactgtcttaccgtagctttatagaaagccttgacatcaagtagtgtgagtcttccaactttgttctttttcaaaatggttttggttattctaacttctttgccttttcacctaagaatcagcttgctgattttgaaaaaaattttagtagaattttgatgagacagatttctaaaaattgtggtagcatatatataacaaaattttctattttaacttttgaagtgcacagtttagtggcattaagtacattcacattgttttgcaactatcgctaccatctgtttctagcaacttaaaaaattttcccaaactgaaactctggacccataaacaatgactccacagtggaggaccactacacccagcacctggcaaaccaccattctactttgtctctttgaatctgacacctttaggtacttcatcccgtatttgtagaataatagaatatttgtccttttgtgactggcttttatttcacttagcccattgtcttcaaggtttatccttggttggttggttggtttttgtttttttgagacagagtctcattctgtcacctaggcgggagtgcattggcacgatctcggctcactgcaacctcctccgcctcccaggttcaagtgattctctcgcctcggcctcccaggtagctgggattataggcacccgtcaccctgcctggctaaattttgtatttttagtagagacaaggtttcaccatgttggccaggctggtctctaactcctaatctcaggtgatccgcccacctcggcctcccaaagtgctgggatcacaggcgtgagccactgcgcctggtcccttgttgtttaatatgtcaga

SEQ ID NO: 49865 - DNA, 1033 bp, Homo sapiens
accattttttatcttttatatggtatttttactgtacccttttttaggtttatatatgcttatatacacaaatacttaccattgtgttagttgcctacagtatttagtacagtaacatactgtataggtttgtagcctaggagcagtaagctatgccatgtaacctagtgtgtagtaagcctaggctataccatccaggcttgtgtaagtacactctgtgatatttgcacaacgacgaattgcccagtgatgcatttctcagaacttaccccattgttaagcagcacatgactatatattgaggtataatttacatacaatagacatcacccatgatatatactcccttgcaaccatccacaacaatcaagataacatcatggctgggtggctcacacctgtaatctcagcactttgggaagctgaggcaggagtatcgcttgaggctaggagtttgagtcaggcctaggcagcaaagcaagaccctgtctctacaaaataaacacacaaaaacacaaaaatattagctgagcatggtgggatgcagttactgaggagggaggatggcttgagcccaggaatttgaggttgcagtgaactgtgatcatgccactgcactgtagtctgggcgacagagggagaccctgtctcaagacaacaacaacataaaaaccccatctccattaccctcaagtttcttcttgcctcctttctgtcaaggtagattagtttgcattttttgtaatttagaatttcatataagtaaaatcttacaatagtagatacaccacagtcttcatataatcccaactctttgggaggccaaggcgggagcattgcttgcactcgggagttataggtttgaatatatcctaggtgattttgtatatttgttgtatctttcctgtagatacgttagtgatgataaagttaattcctggcttagggtgatgactgtccaattttcttattgtactgctaggttttcaccttatgagtagaaaattacctgtgtggttttacttgggaacta

SEQ ID NO: 49866 - DNA, 1576 bp, Homo sapiens
tttagttaccaattttcaaattaaggtgttaatttagtaactataatgataacatagatttgttcttttatctttttttgaggtttattatagatttttattggtttaatatattttaatacactatagtcatgtgtatttgtttttgatgtattttaaaaatcagtttatattgatactcctgatgaaacattttttgctttaacttttttatggtaaaatacagataacatatacatttgaaccatttttaagtgtacagttcagtagcattaagtgctttcacatttgttgtgcagccgtcaccaccatccatctctggaactttttcttttttgaaaactttctagaggttcatatttattggcatttgacctagagtcttcctcatgggcaaggtgcagccctgggcaggactatcagcatcctgctgtctcctcaattctgttaatccaccaatcctaatccctcctaaccccactcatagtccagagaagataaaaagttcagggacatggtgtactgctctccagatcctttcccagctgaaactctatacccatttagcactaatttcccattttccctagcccaagataaccaaccaccattctactttctctttgaatttgactcctaggtacctcacatatatattcctatttagtggaattgtagactatttatccttttgtgactggcttatttcacttagcactgttttctaggttcatccatgttgtagcttctgtcataatttccttcccttttaaggctgaataattttccattgtgtatatgtaccatattttgttcatccattcattcattgatagatacttgagttgcttctaccttttggcaattgtgagtgatgctgttatgaacatgggtgtacaaatgtctgttttgagtccttgttttgctttcgtgcattctattaaaaatgttaaggttctttgctttttacttttttttctcttttatccaccttttgactttattcttaaagttttatcttggtataataatttatggtatgttgcagaattaggagcaaagtcccgtgtgtccttcactcagtttcccccaatggtaacatttttcataattacagcacaatgtcaagaccgggaaattgacattgatacagtccatatacaggtgtcccttggtatctgtgggggattggttccagaaccctcgatgataccaaaatccatggatgcttaagtttattagataaaatggcatagtgttttcacataacctacacacatcttcctgtatactttaaatcatctttcgattacttataacacctaatataatataaatgccgtgtaaatagttatattgtattgattttatttgtattttttttattgttgttatttttcattgtgttttttccctgaatattttctatctgtggttggttgaatctgagcatggggaacccatggatatggagggctaactgtatttattcagatcttgctagttatacatggactcatttagataactatgtttgcatgttttatgtgtataattctatgcagttttatcatgt

SEQ ID NO: 49867 - DNA, 1051 bp, Homo sapiens
tccttctgagagaatctattctgtccccctctcttagcttctggtggtttgctggcaatctttggtgtcctttggctggtagaagcattacctcccatctctgccttcattttcacatggtgttctccttgtgtgtatgtctctttgcaaattgtccttttttttattagagtaccactcatattgcattcctccctaaggacttcgttttaacttgataacttcagtaaagatcctgactccaaataaggtcatattctgaggtactgggggataggacttcaacatatgaatgtttgggagacacaattaaacccatagcagagttgctttcatgttttggctattacaaacaaaggtcctatggatgtttatgtacatgtttttacgtagacataggttttcatttctctgggataaatgctcaggtgtaaggttactggtggttatggtaagtgcatgtatggtttttaaagaaacgtctaagctctttgccagagtggctgtagtttacatttccaccagcagtgtataagaatcagtttctctgcatctttgctatcatttggtgttgtcactattttttttttttttttttttgagagggagtctcgctctgttgcccaggctggagtgcagtggcacaatttgagctcactgcaagctctgcctcccgggttcacaccattctcctgcctcagcctcccgagtagctgggactacaggtgcccaccaccacgcccggctaatttttttgtatttttagtagagacggggtttcactgtgttcatcaggatggtcttgatctcctgaccttgtgatccgcccacctcggcctcccaaagtgttgggattacaggcgtgagccaccgtgcccgggctgtcactatttttttattttggcaattcttacagatgtagtgatatcatgttgtggttttaatttgtgttttcttctattcagtttaacatgtgttttaaaagtttgtttgctaattatctcttttatacttaatatcttgattcttagggtcattaacaagattgctt

SEQ ID NO: 49868 - DNA, 1050 bp, Homo sapiens
agacagggtttcaccatgttggtcaggctggtctcaaactcccgacctcaggtgatccgcctgcctcagcctcccaaagtgctgggattacaggcgtgagccaccgtgcccagccctattattaattttttagagacagtctcgctgtgttgcccaggctagtttcaaacgcttgggctcaagtaatcctcctgcctcagtctcctaaagtgctggattaggggcatgagccaccatgcccagctgctagttgcaattaatttattaatcaggatagctaagcacagtcatttatggtgggtggagggagacagagggagagggagattgtgtttcatgatgaaaagatcattttgagtatttttgccaaaataataatcatagaataagatggagatccttgcatatgaataatcttctcaatcatgttgttctcagtgttgctacgttatttggcagataactttttgccaggaggataattataacacatttttttttgaaagagttttctaattgagaagtttctttcctgactaatgacttaacaaataaaccattgttacaacaaactgtgtcataacagcaaagttgcaataactatgaatctaagatagtttcaagttctctgtagtagagtgtactttcaagtctatccaaaacaaaaacgttagctctaatatatatttgtttttaataatatattgctcttaatattaaatatatgttgagtcattatttcgcctcctttcttagcatctcgatagttcttttggggatattgattttgcaggatgctttaatgtatttgttgttgtttagaaataaggcagtcttttggtcatagttctagggaaggtttaaaaacttcagtcatcttagagctcagattgagttggtctgtttggatggcatgctaaagtatatgaaatttgcttggttacagggcaaaatgtgagagtcccctaatgatatctggtaccagtaatctaaccaggtaggtaggtaggtaggtaggtaggtaggtaggtaggtaggtaggtaggtaga

SEQ ID NO: 49869 - DNA, 1339 bp, Homo sapiens
aaatgtttaacatttgttaaataggtttcaatgacagttttcatactctatggtgagcaacttaaatgtaaggttagctctggttgttcaagtgtttccatgtttttttggaaaagttagattatttcttttgatattttgctgtaaatttaacataagctttggtgcattttaccttattaaacgggagacaaaaagtctcaaaatattctgagtgtagatatcaatgattagtgtcttaatttacaaaatgacatctcaatagatcagtagttatatggtatgtggtatgcttgtttagtagaaaggtgttcttaaatgatcgatgatttaagtaaaatcctgtgagtttataccatatgagagaagcttgcttgataaaagaggtttcaaatttaattttttattgtggtaaacaacaacatttaccatttaaccattttttaagtgtataattgagtaacgttaaatatatccaactgctgtgaaacagatctacagaaatttttcatcttgaaagccagaaactctatacctattaaacaacaactcccgtttttctcttcccctagtccctggtaaccattctactttctgtttctatgaatttgactacttcagatacctcataagttgaatcatatggtatttgtcttttttgtgactagcttatttcagttagcataatgcccttagggtccatccgtgttgtaatgtagtacagatgttccttccttttaaaaggtgtgtaactcattttatgtatctactacattttgtttatccatatctgttctattccactggtctatttgtctttatgccagtacctcacagttttgattactgtagctttgtacagtaagttctcacttagtgccgttcttaggttcttggaaacttgggctttaagcaaagcggtgtacagcagatctttgaacaatatcaatttgttcagtgttgttttgttataatgttgatgaggaaaaaaattggtttcattcattatacgtcattttgcttaacattggagtttccaagaacctgttggtgatattgaggactttctctaaaatgctttgaaattaggaagtgtgagtcctccaactttgttcttttcttcctaaaattgtttgggctttttggggtcccttgagattctatatgaattttcagcttaatttttttcatttttgcaaaaagtgctattggaattttgatagggattgtgttgaatctgtagatttctttgggtagtatggacttcatgataatattaagtcttcgaattcatgaacacaggatgcctttctatttgtgtcatctttcatttcagcag

SEQ ID NO: 49870 - DNA, 1035 bp, Homo sapiens
taccaagacaaattgagctgtttcttgtgtgatatctaacctactgggagaagtcattaggagtttgtcagtatgttatatttgagcatttaatattaattggatatgtttaatcttacctgctttttctttaggtggccaccgagtactaaattcacttgggaataaaagaaaaacataagaaaattataagagaaaggtacacataagactaagagctttagactttagcttcagcctgttttctccttccttgtttgcttttaggtcattttcttcatttaggaaatgcatccttgactttcaaaacatagacataataccctttctgtctgccatttttacatgtactttggtcaaaaatggcattcatttgttgttcgtatgaaattattggcatttaaattgatcgtaagttccttgagggagaggaatagatcagatctaacattttttcccccttctcttctcaacaaagtttgttattatcatgaagtggttatttatttaataagccaggctttggactgtatgtttccagggcaggaaaatctgttttaaagttatatcttaggttttttttattagctccttttaactgtatgtgcatgataccagcaaaaggttgtattttcaggcatctcatattatggtttaaagttctcatagggatttcaggaccagtaagagtcatatcctgtttctatttaggatgtattaatatatatataaagccaggcggagaatcacaagaaaatttaaaaacaattgttttataagcttctttttcccctatgtgttattactgtggggctgcgagtgttacaacaagtccatatctagattaagcagtcaaggtcaggcacggtggctcatgcctgtaatcccagcactttgggaggccgaggcaggtgggtcacctgaggtcaggagttcgagaccagcctggccaacatggcaaaaccccatctctactaaaaatacaaaaattagctggtcatggtggcccgcgcctgtaatctcagctactcggga

SEQ ID NO: 49871 - DNA, 1026 bp, Homo sapiens
acggggtttcaccatgttggccaggcttgtctcaaactcctagcctcaagtaatctgccctccttggcctcccaaagtgctgggattacaggcggaagccaccatgcccagcccattatttattattattattattatttttttgagatggagtctcactctattgcccaggctggagtgcagtggcacgatctctgctcactgcaacctccgcctcctgggttcaggcgattctcctgcctcagcctcccgagtagctgggattacaggtgcccgccaccatggctggctaatttttggtttttagtagagatggggtttcaccatgttggccaggctggtctcaaactcctgaccttaagtaatccacctgcctcggcctcccaaagtgctgggattacaggcgtgagccaccacgcccagccccaacccattatttttttttaatggcctaaggtaaaaaataatttggtcaaaaatatgctgatgtaaaccatggctatgaggtctcaattttccctgaatttatatagatgccattaaaatacgaagtcttctacccatatggaattcctggttgagtgacctaatataattattatccactttagtggaatgaattattttagttactgttgtctattacaaattttattatttgtgcttgtttcttagaagaataaaaagttggaggcatattcatgtcgaatcattcgaattatgttttctctgcatacttttatgacaatagaagcatttaggctttctaatgttggctaaaccattagaaagtggaataaatacaatactcaaggagtatatatacttaataaagttttaatttaatttataaaagctacaggcaatagtttttttttttaatttcaacttttagatacagggattacatatacaggtttgtacatgagtatattgcacctaggaagtgagggtagtatccagtgggtagtttttcagtccccaccccctacccccagtagtccgcagtgtctatgttttccacat

SEQ ID NO: 49872 - DNA, 1035 bp, Homo sapiens
ttaatataaacaagctgttgtaaatacaacaaagtagaaattaagtaaagttttagaataattccagtcagtctatctgaaccaggtatttcttagatatttttccttgatttatctttattgtgtaatcatagtatcttttttgtacattagattctacatgttttagtcattgtttgtacctggatttcctatttattggtatataacttagaaacatttccctctcccaaccttttgttttttatactagctcttgtttatcatcttgattttatttaatttgctctatttaaaaagttttgttgttgttgtttttgtttgtttgtttgtttggagacagagtcttgctctcttgcccaggcgggagtgcagtggtgcgacctcagctcactgcagccttcatctcccgggttcaagtgattcttctgcctcagcctcccgagtagctgggattataggcatgcaccaccacacccagctaatttttgtatttttagtagagacggggtttcaccatgttggcctctcgaactcctgacctcaagtgatccgctggcttcagcctcccaaagtgctgggattacaggcgtgagctaccgcacccagcctaaaaattgaaaatcagttttgtcgttgcctctcttgccccgaaaggaataaagtattccttttatttttagttctagcctattttcttttttaagaaataaccatattgagatatatttaccatactataaaatttaccctttaaagtgcaaattcagagttgtacagccaccattacaatataattttagaatattttatttatttttattattttttttgagatggagtctcactcactctgttgtccaggttggggtacagtggcatgatcttggctcactgcaacctccatctcctggattcaagtgatactcctgcctcagcctcgcgagtagttgggattacaggcgtgcaccaccacgcctggctaatttttgtattggtagtagagacaaggttttaccatgtcagccaggctgg

SEQ ID NO: 49873 - DNA, 1027 bp, Homo sapiens
tgacaaagttttattcatatgtgaaagttatctaaaaacttagcagtttataattattatgttacttttattagatatatttcccactttcagcatctggttttaggaacaaagaaattgattaagaagggaggaggaagataatgaagagatacaggttcagatgacaggtaatcgtacagtgtagggagttaaaaagtgccatgaataacagtaagtaagcaagcaagcaagtaagtaagttacgttaagtaagttaaataaggtattgataaaatcgacatttcttctaaaaggtaaagaaattttgttgtgtgtagtggtgtctttaaagtgttttcactttattttaaaaatattttgaactgggaaagatgaaagtacaaaatacagaaatttcttccctaagacagaagtatttaggacaaacatttggcagggggacaaaattatgtaagttggggagtcatatatcctcatatggatcaataaatgagccagtcaagattacgggcaggttctgatgtatctggtgtctcccaatacttagctcatccttgaaatttcagatgatgcccgggcaaatacattttatggagatttctgggggtattttttttttttaatgaaagtggcatcaacaacattagagcattagaaattgggagaggaagttgcttaaaaatagatataaaacgttaagatggtaaagaatgatttatttaaacaaatgcagaaactgaattgtaagaagcaattcaattctgcagtattcctttaaagataccgtaatatctttgaaaaacaagtaacattggtagagtttgatcacaacattcagtgtagtatgtgtattaaatgttacctgtctgtgaggcctgaaagatagacaactatattaaattcttgagcctgtgatctttataatgtcactaaggtgttgagaaatttaaaaaattgtcttaatcatagcatatagaaagctgcctagtttacttcatttgcctaaaataaaagtagctttaat

SEQ ID NO: 49874 - DNA, 1409 bp, Homo sapiens
gtatctcttcttactgcacactagaaatttcctttctgatgtttggtctccacctgactaatgttttactacttctaatgtgtaccttttcttttttcctctcccatcctcctgtgtaagattctaaaggtccttatcaaattgtttctctttgacatagttctttattttctaacttataacatgtgtggtttttctggtgggtatggagtggaggtggagtcagagctatagcatttggcatttccacacatcagggctttgattatgtactacttttgacagcttctttttctttttggtattctttagttttaacttttaactagattacaggcgtctaggtgggcaggaactacaatttactacttagctcttttagaggatattaggatgtagttactttacatgcaatagtgcttaataaagagacttgactaaagtgaactctagctattactcttttccttatcttcagcttcatccccaaggttttaagtgttatactagatgctatctcactcttgataacatatggtttatgttaaagagacaaagccaatataaatattacagcatgagtaaagtgagtcaggtagaaatggccaaagttaattgtgttaggaaaaaagatatctgtcagaagtatggggctgttttcttgtgcatactgagaatagatagcatttgtttgtgctttatttatagattagagtatcatggtaaagattattagatgatggttgaagaagtatgccttttattgtgtgaccatagacttcttagtgttagagacttacttggaagttttctttatttttttatcacaccatatattaacttctgacatttgcaaatttcaggagttgtcacagcagaaatgtttagacatatgcagaactctgagataattcgaaaaatgactgaagaattcgatgaggtaacttactaccttaagtgttttgataacttatgcatgtttatcttgacttatttttgaaagtattattaaattgtaagcattaggctgggcatggtggctcatgcctgtaatcccacactttcagaggccgaggcaggcggatcacctgaggtcaggagttcgagaccagcttgaccaatatggtgaaaccctgtctctgctaaaaatacaaaaaaaattagccgggagtcgtggtgtgtgcctgtagtcccagctacttgggaggctgagataggagaattgcttgaacctgggaggcggaggttgcagtgagccgagctctcgccactgtactccagcctgggcaacagagtgagactccatcaaaaaaaaaggaaaaaaaaaattgtaagcattaatgttgtaaataagagctttggcattagatttaatcaaatgatgcctgtgcgacctttggcaggttgtt

SEQ ID NO: 49875 - DNA, 1020 bp, Homo sapiens
gttaccaataaatacatacatagatttactataaattaagcttcttcaaggaagggatttgggtttgtttgggtcacggctgtatttcagcaccagtacttttactcttccaaaatttttcgctgtgggttttcaagtagaaaatgttgtctgatttgagttttatttggtcttttttttcttgcttactctgatgaaggagctttgaactattattctaaaagatagatgagttaaaatggctttgatgatcgctaagtgctattaatcactccccaagtagttgagaagtaattttgaatagtggcattttttacccttttaatattgaatgttttagtgagaactttctcactaaaagggaacaactatttgagataattgtcctgaaatatgatttgaaaatgtcagcaaaccaagttgctaacaattaagatgctatatttcaatatagtcactaaattagccaatcagaaaataccaaaaaaactttttttgtggaatatcaggaccttattctcagatgagacgcaactgcacttacatgtgacatgacttcagattttaaaaaatgttctgttgacaaaaattaatttttaaaatttactgaactgaattaccttacatctctaggatactcttgtcagagaccgttacttttagatgttctatatggtattggtctctgcttttatttctaagtacttcattgtttttaatgatttgtggagaatctcagtttaccctgagactagagaatgccctcttgttgtgcaaaggaaaaccagagtaccagtcttccaaggcaatactagctacatttccatttctttaaaaaattatgattgtttatatctgttgactgtgtgatgtatttgaagctaataacatatttctaatgttttgttgatttatacatcatacattttatttgagagtataatttccatcattttgaatccatttaaaaatataattttggtttggtttgggtttgcttttgctttatatctgtgctta

SEQ ID NO: 49876 - DNA, 1050 bp, Homo sapiens
tttagaaggtgaatcatgatctatgaaaatgattattttagaggacatattatagaataatgggatttaaggatagactggagtcagattgccttggtttgaatcctggtttgactgcttatatgaactgaggcaaattttaaaatttccctgagcttcaattttgccgtgaatgaaatgggtataatacttacctttgagagggccattgtgaggattaggagataattcctgaaaagttattttattttatgttattttattgtcatttgtagcagctgcatctttcttttgttagaagcagattagctcatttctgcttaatatttctatttgatcttaaattgtaaatttttgtgtctgttagattagtttcaccatacttttactctttaaaaatagctatgaagttgatgacagctttggtgaatgtggcactaaatcttagcattaatatggataatacacaaagacaatatgaagcagaacggaataaaatgattggaaaacgagccaatgagaggctagaactcctgctacaaaagcggaaagaggtaaacttttatattgaatatttaggctattgtgtgaccaacttggtcaccattaattaggatataactttgctagtggctcagataattgtttttgaaatatttaaatgtaaataacatttcaaactatttgcccaacaaaattctgatgaatatccgtgccaacaatactgttttcttattttcaacctgcgtggactagtattaagagtggctttaagtaaggggactggggttagtctgacaagttgtcttaagctttagtattattcatctctacggtgaaaaaccttttgtcaggatgaaaagagatttcacaattaaaatcactttggaaaataaaatcactttgaaaaataacataagctgtttattggcatctaaatcagtgttttttatacagtagaaggcatttgtttaacattaatgactgaccaccaaattcaactctgaatgaggaaaataattttttcagccttatgcgaaataacagtaa

SEQ ID NO: 49877 - DNA, 1050 bp, Homo sapiens
ggctaatttttgtatttttagtagagtcggggttttgccatgttggccaggctggtctcgaactcctgacctcaagtgatccgtctgtcttggcctccccgagtgctgagattacaggcatgagccactgcacccggccttctttacagttctttagtggaaatttatgagcattagaaaaaaaatctactagctaaatattaaaatcccaatcaaatatttcaggtattaagggactttatctacctggtaatataactgttaatttttctatatggttactgttgtctagtataattcaaaattccccaaaatactggggaattctgctttttttgtgcttgtaacaacttacaggtgttcatttggttgtcttcctttacaattgaaaagaaatgatgtgtttttttacagcttcaggaaaatcaagatgaaatagaaaatatgatgaatgcaatatttaaaggagtgtttgtacatagataccggtaagttgtgacagtttttttcataaatagcattatgtaatttctactcagcaagtttgcatatttcgtggtgtagggaatctaaattagcaggaagaatgttatagtaaaatcaatgttagactccattagtgccactgagtcactctgggcaagttatttaactcatgtgagtttggtgtttcccatctgaaaaatgggataatgctgtgcttgacttgcagccagtagaagttactgctatttggagttgggctacacaatacttaattgcctttggatgcactatgttagtagagcctgcacgtgctgactcctgactctcttcccttccattgaatatcagtgggaacaattggataggttaaagtgagatattttcttttgctgttttgaatgaacagaggaaagaaatagtaatcttataaatttatgctgtaacctattcttaaattttggtagtatttttattcagcttccacatatcctcaacttggcagttactgaatcaggttaatgcttactttttgtaatgtctccatgtccattcttaccttttcac

SEQ ID NO: 49878 - DNA, 1029 bp, Homo sapiens
ttcttcaaaaagtaatcctcttgataataagtttgtgttgcctaaacccacagaataatgttaaatacttagaatttctctgggcttttaagatgttgttatatctacaaatggatttttcctcttgaaaaatcaatatagtattgttaacattgtgtgcttcccgcccccccacccccaccaccttctgaggcagtcttgctctgtcatccaggcgggagtgtagtggtacaatctcggctcactgcaacctctgacttgcgggttcaagcaatcctcgtgcctcagcctcctaagtagctgaaactgcagtcatgcatctccacgcccactaacttttgcatttttagtagacatggagtttcaccatgttgaccaggcttgtgaactcctggcctcaactgatccgcgcattttggccttccaaagtgctgggattacaagcctgagccactgtgccctgcccattgtgtgctttttatcaaacacttaggaaaaagttaatttaactaaatgttaagcttgtagtaggaacggtgactatattaccatgtataattgctcacctatgttggaagttaaaaactaaactggaaaaaaggcagtatttttagtagaggaaagggatgaatataaaattatttatggtaagccaggcacagtggctcacgcctgtactcccaatgctttgggaggctgaggaaggccactcacttgaagtcaggagttcgagaccagcctggccaacatggtgaaaccttgtctctattaaaaatacaaaaattagccaggtgtgatggtatgcacctgtaatctcagctactcaggatgctgaggcaggagaattaattgcctgaacccaggaggtagaagttgcagtgagctgagatcatgtcactgcacttcagcctgggcaatagagtgagctccatctcaaaaaaaaaaaacccaataaaaataaaaagtttgagatattttaaagtttatagtaataccacaaaatattttccattctgagtttttataaaa

SEQ ID NO: 49879 - DNA, 1032 bp, Homo sapiens
ctaacagaatgtgactaaatgtggtaagatagcttaaaaatccttcctcaactaaaatctaattataaatgtaaactttttaaagcctttgctttcaagaaataaaatatgtaatatatttaaacctagttaatcctctctggaatattttgctacttgaactctaatatcattgaaaattattttggaacttaaatcatttgggatgataattaccaggtttttttttttttaaactaaggttgtttatgaagttatttaacaaattttaaagttttagtcttaggtattctaaagtcacttactagtcatagggacgtggttattctgttatctctgataattgttattgtacgtgtttgaaacacaatcttaaattaggaaaaaatttcatgtgcaatgtgtaatgtaaatgtcatataaacaacttttaaaagttgtttatatgctttccttttaaaagttgtttataggctgttagattctataagccaaattaataaagttttaaactgctcgtggcctgtatacccggtatcaatgaattagttataagtgtaactgagattatatttattgttttacaaagagaattttgtttgtacattttgtgttacttctgaaaatctgcataacctaattgttgttttgactaaaactgaccagtataccgtctttattttaaccaagtctggagcttaatttgattagatcttaactgttttgtatatatgattttactgaagttagggattgtatgcttagaaatgatctttaggtttcagtaacattctttcctgcctttgaaggcataattttggctaaatacatactttgtgacgtgtttacatgactaacctaaaatttgtcttattgtcaagtagttttaagagataaagctctaatttgtacaaatttctttatagtattataatgactatggagatatcatcaaagaaacaatgagtaaaacaaggcagatagacaaaattcagtgtgctaagacccttattctcagtctgcaacaggtaa

SEQ ID NO: 49880 - DNA, 1028 bp, Homo sapiens
cataaattcaagcattacacatcttttttatcaacttttgtcatgatctcattgtcagatagagaaatctttgaggtttgattcctttgtctcaagttttttctttggttctgcactcttactttgtagtgaccttttcccatgttttgatccacacccttctttccatctgcatattttgttgcccttatcaaaattggaagtcgttttattttatactgggcatgtaatttagtgatcaattgcacttttaaagtatgggtacattttagacctttaacataaccaacatttgtgtattaaaaccctttatctgttacctgtgggttaaagaaccttgcttttagattctcggactctccttcatcctcttgctcatttagttataaaagtgctaactgtctctctgaggaaaatatgctgctcttgtttaagttttgcttctactccctcaacttaattattattattattttgttttttgtagagacagggtctcaccatgttgcccaggctggtcttgaacccctggcctcaagagatcctcccacttaggccaccaaaagcactaggattataggtgtgaaccaccacacccagcttcctccctcaactttaattaactctctcctttcactttcttctaaaactgaagtttatttttatgcatccattagatggtaattttacataatatttaaggactacctgtatattattttcagaaataatatctttttttcatgtaatatccttttttccttcttgattccatctggattgttttttactcagttacatatttgatagagttataatgttgggttgttattttgatgaatagaggtatttatcgtcacataaatatagttaaaatgggccttagatggggtttaattttactcttgaattgtttattacaaatgtttgtgaattattttttaacgttctatatgttagagtaggtctcctttatgtcttgaaaaatacagataatgtattgatcattatgtgagagaatttacatt

SEQ ID NO: 49881 - DNA, 1040 bp, Homo sapiens
aaaatacagttgtgttacatcctaattgattttcccaacttagttcaggccctcatctctcacctgaactattgtattagctttctaactggttttcttccctcaaatctcccatttattttctcaccaaacctctcccttcaccccccgctccatcattcacaccaccatcaagaattactattctagaataaaaatcttaccatgtaactcttacttaaaacctttctgtggctccccattgcctgctggataaactcccaacttccttagctcatggcatgcaagatgtttcaaaatatggcccctgccacgttttagtatcatttcctattccctggcagctggtaaaatcatcataaaagaacaagctcaggtgtcactttaactgaagctttggtcatctatgctcccataacactatgtatatccatatttcttatagcacttgccacattgtattgtaaatatttgtttatgagtttgtcccgtttgtctagactgtgagctcctcaagggcagggaccacattcattgcctatcagtgcttggcacgtaaaaggtgctaagtaaatgttcattgaatgaataaatgttcaatgctaaaaaaatgaagtttatcttttaaatactttgtttttactggattatgtatgataactttataaatctttctaaaatcttcattagctttggctctaaaaaacatggcagacaagcagtctttagataatttttttaaatgtcttgattggtatacagggaaaagtgtgatgattatgattaagtttttgagtttgaaagcattgtatttataatgtggtatatgttttactattgggagatagtagttgttaccctcttctttttttaatttatattttgttctgtcttgttggtttttagatgttaagaattttacctgtttttcttacaaaatgatcatttactatgagtggtggcctgcataaattcactttagttatctccatagtggtcttaacctctagagacacaaggtatactctattacacgtata

SEQ ID NO: 49882 - DNA, 1029 bp, Homo sapiens
atggtctcgatctcctgacctcgtgatccacccgcctcggcctcccaaagtgctgggattacaggcgtgagccaccgcacccggctgataattttccatgagtttttaaaatattgtgtcaggtacacttggaatcacatagaccatgtgaagaacttggatattttcagttactatctggtttgtagatatagctaaactaatgtcaacttatttccttttttcctttagccaccatcaaagaacagacgagagagaacagaactgaagcctgatttctttgatccagcttcaattatggatgaatcagtaggtttaatttaaatgtaccctaggattgcaaaatcagaagtataggcagtctctcagtttgaggttgaagacctggggcagcatactgagaatagatgaaaacagctggatgtgagaaaaagaggcaggcaggcaggatttcagtgggaggggaagagagtgctgcaatagtgttgacagattagaaaagtacttttgaatcctggctgactgggacttgaatattaaggaatttggactgttcttccaggtttgtactgttcttcaatgggttgcccattgaaagattttaaataaggtaatggcatgatcagaattgtgtttcagaaagatttccttgacatttatggatgggacaggatgaatgaggggcgtcatataaaggcatggtgaaaaataatgagaacttgaacaaaggctttgataatgaagagaagggtatctagctatctaggatgagagtcagttaccactcccaccatccttaattggttattattgggttttgtcagttatttttcttaagtacctcttatatcagtcccctgtgccatattctccttgacagtgccttgattcgggtcctcctcagttttcacatgggctgttgcaaagcctttaagctgatattgcagtcccgctgctcctttatgcctcttgtggggtcatctttctaaaaatgcagatctgatattctcacttatcgttctaagtctt

SEQ ID NO: 49883 - DNA, 1104 bp, Homo sapiens
taatataaaaactctgaacatattttgtgttgcatatacataaaattctagatttatggtgtagctggttttatatttggacacaaaattggtttataccattttgataacagttgttttctgccagaattgccaaaatacactgaagtttgatattaaatatgtttaagtatttattaatgttaacatcagaaacaggcagagtttgtgttggcacagaaaagaaagtgtcactactctcattctcttgtgttgagattctcttattagaattatttatagtataaaattggtaaagaagggctccatgtaatggagctaatttaatgttctagtaagagaatctacttataacctagtctgtacaaaacaaaaagaatctcaagtgtttgggtgctttctagtcaggcactctgtttggaaagaacttgagttcgtcttcatcccatactcaatactaaattgctaattaagattttgtactttcattcatcatcagaccttttctaccgagattcatagagtgttatggtaagaattggcctttaaacattatctcggtctttttggtggaaacgttctaaccacccaaactctgacttgaaccaaaaaaggagaaccctgaagcatgcgggaaggggagaggacaagggattagtagtgtggtagttactgtgaatggacaggtaagaaattgggtgcacgagtcctctttgttttcattacttgggattccaaacactacttgataattcattataaagaggctgcaatcagatacttgtttctggatctgcaaatacacagtttcttcagctcaaaacaatacatgagttctatgacttttgttcatagaacttataagagatttaacttacaagtaagagctctttgtaatatttcagctcattacatctggctttgatatcagttcttaatagcttattatagtattctaaaatattacttaatgggcataagtgctagaattttaattgaacaacctaacttttagtatatatactaagagtcacatgccattcttgtttagtgaacaagggagagttgctccattcatcatctgcttttacttttagacaagta

SEQ ID NO: 49884 - DNA, 1245 bp, Homo sapiens
tcatttattcatttaacaaatacctatgttgagtgcctatgtttagggtattatctagacattagtggtacatataagcataattaatccaaggttcctactttaattatatgtgaggtaagtagcatcttgattagtcctgatgttatttcattatatatcatggtcaatttaattttagaattatacatctgaagagaggggaagttttcaaagtggttttattagcatgttatttaacataataaagtattaatgtaatatttatggatatatttaaagaaatgaatgacttttaacgagattttctcccctctctctctctcattaggttcttggagtgtcaatgttttaataccagtacacaattaaatctgtggtgaagtcattttctaagtggaagaggaaattttaaagtgtggtagatacagtgaaattctgtacagatttttctctaaggagaatatgacatgcttatgcttaccaagatcaagtgcattgaggggcagttttgtttgcctgaataaacgtaaaggacaagtaaacaatttgatgataagctacagtttttcttagaaagtaaatattttatttatgcgctgttagttggcttttgaatcgattatttcatgcttttttttaaaaaaaaaaaaaaacaaaataacaatctgaagaggcatttggtacagatatgaattctcttacatttatttactggttgtactaaataatgatgacctctgctggatttctgtttacatccagaaaacaatgttaaggatgtatttattcccctaccctgaagaaagtgtaggatagaattgtttttagcattctaaatttaaatgcttaaaacgtcaatcaacaaaactttgttttaaatattgtaattgtggagaaaagtaaacttataagcagaacttttacaattttttcatctaaaagtattttaagatatttttaaaatccaagagcttctctatacttttcagaaatatccagatgcagtgaactgccagaaggtaaccagtctcaaacatgcttatcccattatcaaccctgaaagtttgcttgtcctttaagataaaaatgtaatgttgtgatattccttccagtaatgccactgtattttgtctccaaataaaagaagcttattgtagtatgtttgcagaaaaattctaaacaaaaattatacagcttattagagtgtgggaatagggatctaaattttaaataaaattatat

SEQ ID NO: 49885 - DNA, 1072 bp, Homo sapiens
ctaacaggttacagtacatttcctctgtatgtaaattagatgggataatagaattcataacccataatattctttgaaagctaagctttaaacttcattttatgtcctttcacaaataaattagtttaaaacagaaagtggctacttgccattttgacatcaactcattttgcgaggcttaggcagctagacatcgtttaaaacaaaatattaacttatattacatgtgtatctatctattgtcagtcgtctctcagttcttgaggtatattattttaatcattccatgccttaatatgcttgcaatacaagaatatcttcagatgggtgaataccaaaaggctttcagtttttagtcagaaatcaagcattgggctgtggtagccaaaaaccataggttagctaaaaagatcatgatacaattattttattaagtcatggttaataacaaatgaatccagacttgtctaacagattttccatcaacaaatattgttatgtgcaaaagtattgcctatgttgttttacacaccactgcattaactagaactgctgagaggactgtatatatgattttaaacctaagttgattttttttctcactcttgaaaggagtacttctttgtgaaagcagttcttacagctttgttttcaaccagctaaaaatgttttatatattactctaacctgttgtcctccacattctattgtcctaattgtactgttttctgatttgtatttatgtcttgagacagtaactttttgaataaaaataaacctacagtatgttgtatgttttctcttgtactcaaagggggagggtggctataaatggtttgcaaatttatatctattatcacatcttttaatgtgtttggggaataatttatagagaataccatcagtttatatttttaataaatcatatgtatttacaatgaaaccaaatccctaattggattattactttaaaataggaacctgtaaccattattgctttaattttcatctggtatgagttaaacacatttacaaatgtttacattgtttatacagggtacatttgagtgcc

SEQ ID NO: 49886 - DNA, 1047 bp, Homo sapiens
ggctatataccataccagtttatgaatggtccataatgtaattattcccctatgttgacatttgggttatttttcactagtatcaatagtaatatgatgaacatctctgcacctaaatatacctgcacatctcttatttcctcaggatgtattcctataagtgaaaatactaagctagtggatatgactttttaagaatgcatgtgttaagaattaaaaataacttcaatgaatagtgtccatatttgtatggaagaatgaagtgatagctatttagcctgccctatgtgagagagacatactaaacaaggtagccacgttccatagtaagttgctgtggccacctcacttttcaaggtgtaggccttcacagaggggaagagccaaagaacatgactttaaattaatatcctattagctttgtacctttttactctacctctaggatctcttttaccctgtttctcttagtatttttaataagaaatcaattgctgattgttagatcgtagtgctgcttcttagaacctgggaaaatatgtgcacacatgtaacgtagttccccatgactaaaggaagacttacttttgattttcatctcctttctatttcctgacccctgcatctattttgtaaactgtggccaggcgcgatggcttgcacctgtaatcccaacattttgggaagctgaggcaggaggattgcttgagcccaggggttcaagaccagcctgggcaacattgcgagaccccatctgtacaaaaataaaattaaaaaaacaacatttgccagacgtggtggcagatacatgtagtcccagctacttgggaggctgaagcaggagggttgcttgagcccagcagttcgaggctgcagtgagctgtgattgtgccactgcatgctaacctgggtgagagagtgaggccatctctaaagaaaaagaaaaccggctgggcgcggtggctcaggcctgtaatcccagcactttgggaggccaaggtgggcagatcacaaggtcaggagattgagaccatcctggctaacacg

SEQ ID NO: 49887 - DNA, 1058 bp, Homo sapiens
cacctccacccttttcagtgaataaaatgtaagtcccatgtgaaaacatatttgccttgtaggagaattatagtttaaacaattttacttttgaatctctcatttatttgctaggcttccacgtgaaaaagaagcttctaacaaggagcagcccaaagtgaccaacaccatgcggaagctctttgtaccaaatacccaatctgggcagcgggagggtctcatcaaacatatcctggcaaagcgagagaaagaatatgtcaacattcagactttcaggttagtgtctcttttgcttcctgagtctaaaaagttagtatatataacagacagtggcctgttgatatttaagacattagcctaattaagaatcaaaatatgataaaaaggaatggttgcctgtttcaagctcctgtctctatgctggccaataacatgcatatcagaaataatgcagatgctacagtttcccttggattttctttttttgtgtgtgtgggtcagggtctctctttgtcacccaggctggagagcagatagatcatggcttactgtagcctcaacctctcagtcgtaagcaatcctcccacgccagccctgcaagtaggtggaactacaggtgcacaccaccacatccagctaatatttgtgttttttatagagactgggtttcaccaggttgcccaggctggtctcaaattcctgagctcaggcaatccacccgccttggcctcacaaagtgttaggattacaggcttgagccaccgtgcttggccttcccttggattttctaactactaataatgccatgtctactaatgtctctactgagtcctagagaaccaaatcaaggtcacatgtactagagaattttcccctagcacattccataagcaagcgtgtttatatatctggcctgttaagtttttttttttcagccaatattagaaaattaaagtccatcattaccactagctcttaacttacttactttggtaaataaagaaagtttcacccagtcctcttgattgggaggtctatcttgggttcttttatctgta

SEQ ID NO: 49888 - DNA, 1026 bp, Homo sapiens
gatgtgttaattgcattgtctccctttgtggggctctcagcacatctaagggcctgttgctgttattgggagctgaggatcccatggaatgccagtctccttcctgcctgtaacttgggcaatggtagaccaatcaggcttcactagagagccctggacctacttttcttagtgggtcctgcctcggagagctgtcactcagaccatgcagacttcagtggagaacctgcaggacttcaggactctgagaggcagaaaacgttcagattctcttcccctaaagacctggctagcagccaggcaaaattttgaagcttgtccagcaaataaactgcatgcttctcagtccattaactccttggcttctaaatcccatacgtaatatttcccagtttcattcttcatgtacagagtcctcttctcctacctattttgtaatccattgtctctctcaggtgttgatagtagttgccctcaaaggattagttacaactttaaaccccttgtgagatagtggtgagtgagcccttatcaataatctacccatttttcttctctccatccttctctgttttttttatgctaatcgctacttctgttcatacatttttttgatccttagggttgtcatttggttgggagatttgaattatagactttgcatgcctgatgccaatgaggtgaaaagtcttattaataagaaagaccttcagagactcttgaaattcgaccaggtaagtaaagtttcattttataggaactttcctagatgggagatgagattgttagagttatgggaggtatatcttactctagggagtgatggaaacgtcttactgtcttgtgaaaacagtgtgactagtgatgcattgactacatacaagatttgtagtacttttattaagtgcttggatgggaggagggaagataacattagtgataaaaagtaaatacaacatttattcaaaacgtctttatcattaagagatttcagagatttgtctaaatgagttggtgaatgggtgg

SEQ ID NO: 49889 - DNA, 1033 bp, Homo sapiens
cacagaaaaatacttttagacttatattgccaagccaaagttaccatattttggtgtttttgtgttttctctttataaggcaaaaagatctgtatttacactccttcacctagggatgtgtttgttgccctcctacccaattgtcatgattgtccttagtaccctaggcctagattctgagatcttcccattctaggcctacaagcactacttgctgtagctgagacttgtctagagtcctttgttttgcacttttgacccaccccttcctggatcactcctttgcactccactcccctcgttctgtcactttgaacgaagtctgagtgaggctagtgactccttgggtgtcctcaacagtgaattcactgtctgcgtgcagttattacatgcatttgtgcatttctactacaatggcatctttatgtctctgtaacattggccttttcatggctccacactgggtggaaccatattctcttagatcacatttagtagcataactgtagggactattagagatggcatctcatcgatgagagagaatcacaatcagaatggaagcactttgagtatctgaagagtgagagcattcatgtttgacaggtcctgcttcccactatccttttcctgttattattcaaattttacacaaggactaatcctgggtgtctctgagacccatctcctgcctagacatccacctccagagcaacactggccccacagtaaaagaggaagtcttgtacctcaggcaggcccatctagagctattgctccttcccacagcaaaggtattgtggatgacccttagaatccattctctggtcttctgaaataccaagggcagatgtcacctccttcctcagcaggactgactctgggctctacaaccagctccttcacataaagggtttagagactccccttggctcccagtcaccatatccagtgttgtgtaaagagactggccaacaggaccaaccaagcaccttacctctcccatacaagatgaccctctgagcttttcatt

SEQ ID NO: 49890 - DNA, 1028 bp, Homo sapiens
atcaaacccaaatgtcacctcttccaggaagccttttcccacaacccctgcccaccacccccctcccccgaactcctagaacctgccctctgtaccactattttaacacactacataccaaaggatgttgttgcccctttgggactggaagcttcaggagagtgggaaccaagctgggcgtattttagtttccccacaatgccttgcagagagtaagtgttcaatgatgtttggctaataaataaagattgtctgttaaagcataagtgtatccaataagtgttcctgaaatgtatatacatttaattattcattctgagctctattaactttagaggagttcatgtggtagggggggacttactgaattatattaatgtaatccaagaagataatagtttttagcaaccacacagtactgttattttctattgttttgtaggcaacaaaatcagccttgttaaatttgctttttaaaattgattctcaaagtttattaaaaaattagaactagaactaccatatggttcagcaatcccacttctagagatatatccaaaagaattgaaagcagggtctcaaagctatatttgcacacccatgttcctagcagcattattcacaatagccaaaagatggaagcaccccaaatgtccatggatagaaaaacaaaatgtgttagttctctacatacaatggaatatgattcagccttaaaaaggaaggaattctgacacatgctgctacatggatcaaccttgaggacattatgctaaacgaaataagccagtcccaaaaagcactgtatgattctacttctatgaggtccctagaatagtcaaatccatagagaaaagaagcatggtgttaccaggggctggggattggggaaatgggcagttgtttgatgggtatacagtttcagctttgcaagatgaaaatgttctggagattcattgcatagcaatgtgaatactcctaacactattgaactctacacttaaatatggctaagatgatcaatttta

SEQ ID NO: 49891 - DNA, 1050 bp, Homo sapiens
cctgagcctgggaggcagagatggcaccactgctctccagcctaagtgacagagtgagaccctgtctcaaaacaaacaacaacaacagcaaaaagatcactttggctgtttttatttttggctgttatgtgaagaatgaattgcaatggggcaagagtagaagcaccaggagaaaagcaaatgagttttgaataaatattttcccctatcttctaccccctaacacgtttggggatgaatgtagaagagtgatagtgttggcatggctagaaataggcaattgaagtaagagaattattcttgcttctctgcacatttgccatctactggcattttctactgaggcttctccctacattatattgagatcttgtctcacttcttggtctgaccagaaagtttgacctttccacaggatcaggagaaaagctggtccttgcagatctgcttgagcctgttaaaacttcatcttctttggccactgtgaaaaagcaactgagtagagtcaaatcaaagaagacagtggagttacctctgaacaaagaagagattgaacgggtaagctacagagaaggtggtctattaagggaaagaaattgaattgacaagggaaaatagggtaatagaaagaagggaaagacctgaaaaatgggagaagggggagttgtgatttccccactatggataagattaaaaataatctaggagtgccaggcgcggtggctcacgtctgtaatcccagcactttgggaggctgaggtaggcggatcacctgaggtcaggagttcgagaccagcctgtccaacatggtgaaaccccgtctctactaaaaatacaaaattagccgggtgtggtgtaatcccagctacttgggaggctgaggcaggagaatcccttgaaccaggacgtggaggttgcagtgagctgagattgcaccattgctctccagcctgggcaacacgagtgaaactccatctaaataataataataatctaggagaaattgcagtcctgagaagcaagaggactagcatcctgattctttcatcc

SEQ ID NO: 49892 - DNA, 1017 bp, Homo sapiens
tcattttcattttcactgccctaatcgaggccctcattgaacctttcctttggaactttacatatatcctctacacaatcagcaggattttcttgctgaaacacagttgatcattgctctcctgcttaaaatccttcaaaggctgttcacttacagaataaaataaaattacgtagcattttagctatgctggacaacacgttgttctattacataccactcctttccctgtgtctgtgttttttgcttatgctcatctgtttggattttttttcctcctgacagaattgtacttaggcctcaaagcctaattcaaaaggtcacttccttccctaagcctaacctacctcccaataatatttaatggtaatttcctctgtgattacccctatagaataacgtagcagttatgttatttaagggtaacataaagggtatttaacccattatgttatgctgtttgtgttgtatatgtctctgctctcaaaggctgtgagctctatgaggacaggaactatcttaatcaattgtgtattcctagcaccccatacaagtgcctggaatatagctacaatcaataaatgtttgtaaattgaattgaattgaagggacattacaacattgtagtataaatcactttgtagcctgagattgatcactactgcaaatactaaaagtggaagaacatatacctttactattcagtagaatagttttatggttaaatcaatagcatcgtgtaacatgtgatgatgtgcgtttatgcatttatccaaatatttgtaagtttaatactgaccacgatgtatatggctattgaagaaaaccacacataatatgtgtgtgaggtttgaaactagctctgttgcctagggctgtctttgtgccttgccagaatgtggaccgtggcatgatcggcctgaatatttagccatcctcatgatagcatgtggaataactggtttacagttcattcgtttcatacatactctgcctagcatgtaaaattaactggaa

SEQ ID NO: 49893 - DNA, 1019 bp, Homo sapiens
agcagcccaggagacgggctcaagcttcccgcatctgacagcgccgaggccagcaacagcagggccgactgctcctggactccactcaacacccaaatgagcaaacaggttgactgctcacccgccggagtaaaggctttggactctcggcaaggtgttggagagaagaatactttcattttggcaactctgggaactggagtccctgtggaggggaccctgcccctggttaccactaacttcagtcctctgccagcccctatctgtccccctgctcccggttcggcctctgtgccccactctgttccagatgcattccaggttcccctctccgtccctgccccagtcccccattcagggcttgttccagtccaagttgccacttcggttccagctccttcccctcccttagcacctgtcccggctctggctccagcgccaccgtcagtgcccacgctcatctctgactcgaaccccctttctgtttcggcctcagtcttggtgcctgtgccagcttctgctcccccttcaggcccggttcccttgtcggctccagctcctgccccgctttcagtcccagtttcagctcctcccttggctctcatccaggctcctgtgcccccttcagctccgaccttggttctcgctcccgtccccactccggttctggctcccatgccagcatccacgcctccagcggcccctgcccctccgtctgtgcccatgcccactccaaccccatcttccggcccaccttctacccccaccctcatccccgcctttgctcctacaccggtgcctgcacccaccccagcccccatctttactccagcccctacacccatgcctgctgccacgccagctgccattcccacctctgcacccatcccggcctccttcagtttgagtagagtgtgctttcctgcagctcaggcaccagctatgcaaaaagtccccctgtcctttcagccagggacagtgctgaccccgagccagccgctggtatatatcccgcctcc

SEQ ID NO: 49894 - DNA, 1050 bp, Homo sapiens
tgggctggggaaaggaacccgctcagccccctctgggcttcgtgggagccctgcaggcagtgaggtggcttgggaaagctgcagctagagaaggacaggtgtttttaccttgcccttgtctgctgatagtatcttcaggcttccatctcccaacagctgagcagctcatccttgacgtcaccttgcttttgccagttggaggggggagtgatataataaatctctggccacacaatgatttctttcagtactagaactttcatgtgccctctgaaggatgtgagccatggaaccggcaaaccgcatccctgactaggggcctgtggccttgtcatttacctcccaaccaccacccctccatgcccctttatctgcttagcgcatttcttttcttcggttttgtacatgtatctgagtcctaatcccctatatgctccccttacagaggaaaaagacgggtttgcctgtgacctcctacataatcctcctgggagctcagatcaagaaggagacgatccgatggaggaggatgatttcatgtttgaactctcagacaagcctcttctcccttgctacaacctccaagtgtcagtgtcccgcgggtaagtgtccgagagatccacggtgactgagtgtcaggatcctggcactcagtaggaaggtggagttctccacgaggaagtgaagacctggcaacgagtgccatcacacatgacaaaggctagcctgcccttttagcccagagtagtcatgttcaaactagaggctgcaggctccatggacattgactatctgcatttcctgaaccttaaatctagattctctctcggaaggctttttttgcactattactgggtataaaagataatctgagagatacttgggcctatgaactgctagaatctctggaacatttttgtagtttctgggggtaaacagatagaacattagaaattgagattgctggaaaagccaggacatatggttgccatagccatggggccactagggtccttcagtaatccacagcctagtttctcagtgctgtaa

SEQ ID NO: 49895 - DNA, 1033 bp, Homo sapiens
agcactgctttggctgcatctcatacattttaataggttgaattttgttgtcatttagacctgtgaattaaaaaaaaattcctttgacagacacttggtctgaccaatagattatttagatatatattgtttaatttctaaatgtttgaggatttttcttattgatttctggtttgattccattattgtcagataacatattgtatatgatttcagttcttttaaatttgttgaggttggttttatgacccagaatgttcagtttcttgctgagtgtttcatgagtgcttgaaaaaaatcatattctgctgttgttgggtagaatgagatgggtagtccaaataagtaggctatctagatatgtataatctgaaaatgttgagaataactttttacttttttttttttcagaattgctcctgcgttgctaagacaagcatcatatggcaccattaaaattgggatttaccaaagcttgaagcgcttattcgtagaacgtttagaaggtcagtatacttaccctcttttgaggtgatactcaaagggattgttgaaatcatgcttagtgagaaatgttggtcatgaggtgcctgagaatggaggagagtcactgcaaagacaaagtgagcttgttctaacttggaataaatctttgcagaggtgatatatgaattagagagacctgttcttcaaatttgtcccttttcctatcaacaaaaaaggcatgtgatcatcccaaaagaaacatggaacaatcttgtccagaaaattaatgctatcttcatcaataagaggacttcaactgtaaggcattttctagctggcaattttgataagcttttattaggcagaataattttaggctgttttctaaattctgatgtacctttggctaccttatgcatattcagcattatcatatgtctgtttgctgctgtagcattttccatcatgatactacactaaatggttattttaccacaggcctggggctgttggatgtttggggacagctggaaagcctttcggttag

SEQ ID NO: 49896 - DNA, 1065 bp, Homo sapiens
tccccactgatttttgcttcatgattttatttataacagctttattgggaaaattcacatattataatgataattcccaaattctttattgagataattcacataaaattcaccatctttaaagtatacgatttaattgtttctagtatattcacagattagtgcagccattaccactgtctaagtttagaacattttcattaccaaaaagaaacccttaccctttacccatcacttctcatttcccccagccctcctagctgtggacaaccactaatctactttctgtctctatagatttacctgttctaggtatttcatgtaaatggaatcacgcaatatgtagactttcgtgactggcttcttccatttagcatactgattttaaggtttatccatgttgcagcatgtatcagtactttattcctttttatgggtgaatattaattccattgtgtgggtataccacattgtatttgtcccttcatcaattaatgagcatttgggttctttgcacattttggctattatgaatactgctatgaacatttctgtacacatttttgtatgaacatctattttcagttctcttgggtatatacctaggtgtagaattgctcgctcatatggtaatctgtgtttaactttttgaggaagtgccaaattgttttccacagtggctgccccattttacattcccactgacagcatataagggttcctatttcttcacatcctcaccaacacttgctcttttactttttctttcttaatttttttaaatttttttttgaggcaggatcttgctgtgttgcccaagctggaatgcagtggtgcaatcatggctcactgcagcctcagcctcccaggctcgggtgatcctcccacctcagcatctcaagtagctgggactacaggcacatgccaccatgcctggctaatttaaaaaatttttttaagagatagagtcttactgtattgcccaggtttgtctagaactcctcctcaagtgatcctcctgcctcaccctctcaaagtgctgggattacaggcatgagcccctgt

SEQ ID NO: 49897 - DNA, 1045 bp, Homo sapiens
attttttgtatttttagtagagacagggtttcaccatgtcagccaggatggtctcgatctcctgacctcgtgatccacccacctcggcctctcaaagtgctgggattacaggcgtgagccaccgcgcccggctgtcaggtggtgttttagaaaagattttaaagcagatgcagcttggaatagcatagactaccttaatttaagagaatgcgatgctaattttagaactagctttggctttcgatatcaacctggtgatcttccttgacttactcctcagttttttattacatacgagcagctaaagaggcttcaaatctaagaactgaattatatgtgagcccagccctgccagcctttctactcctttgcccttttcccgtgttctaatgtattttgacaatgttgtaagtgtttaccaagccgttggtctcctaagggcctcctgatggaagaacagtggggtggttcaaagttatttctatgtttgtgttaccatgttaacttttccccgagagaaagtgttaacattgagactctggccccagattggtatcttctatgaagatggatactgatgggtgacattgaaaacggcctgctttccaaatgtggttaaatgtaattggttagccccagacttgggctagagcagaaggcataggccagggtggttattgctatatgtgttacagacctcggttctcattaaagtatttattggcagaatcactttggctttgtcttcatttactattttctcctttgccaactcttgaagttacattctccagagaataataaaggaagataactatgaaattgagactggactcttaaagtgcacttttatgagacgagaatgagtgcattgtgctttcccactgccattcattgtcataatgccactgctaaacgttgggcaggtggttctttcttaaacatgaataaacaagcaagtggctcatttggaagttcctacaggtaaaaagctaaaaaaaggcttaaaatagaagcctgttcccagggttctaatcatcttaca

SEQ ID NO: 49898 - DNA, 1030 bp, Homo sapiens
tacaaaaatgacaacagactactttaaaaaatatacctgaagcatttacaattcatgaagggaaaagactagaaattggataaggaatcttaacagaaaaagaaatataaatacccaatggatataaaaattctgctcaaacttgcttttaattgtttaaagacaaatcaaaacaatgagttataattttcccctatcacatttaaaatttgatgaagttttatagaacaaggtttctgaggctatagggatgcagtaactctcatgcacagtcaaagtaaaacttggagctatatatttggagggcaatttgacatatttatcaaggttgtaaaaggccataatctttaacccagcaattccagttttaagaatttatccctagggcacatttacataaacaagcaaatatacatttataaaaggatgttcattataacattctttctaatagcaaaccaaaacaaaacaagcacagcagtaccaaaccaaaacaacaatagaaaaaaaagacagtctcctcaataggtaagtgaatcacagtacatccatcctttgaatattatgtagcaaattaaaaaaaagtatatatatatatatatatatatcctctgatatgggaagcgctcctagatacattgaatgaaaaaagcaaggtacagaacagtatgatctgatctatgtgacaacaaagcatatgcagatattcttgcatatgcattaaacaattctggaaaaatacacaagaaactgttaacagagagcttacctctggagattaagactgtggtgggaggctccgatatggacatattctacttttcaattcataatctactgtactgtttgcatattttaaccatgtgcatttattattattaccgttctttatcactaaataaatactattttatatgtaagtgaaatataataccaactccaattataacatatataatatgtatacatatatagatagaaagctagactactatacaggctactctaatagcataggagatggtcacct

SEQ ID NO: 49899 - DNA, 1008 bp, Homo sapiens
ctcttacactgtgctaagcacataacatccttattgcactcataagagtttgacactcattattctcctcctgcagatgaggacgccgaggcgggagaaattaagggacttgtctaaggtcacaggcttgtctgcctcctgggctggggactttaatctctaccttaagctgcagtttaaagagaaagaaaaagaaaacaaacttgaagttgagcaaacatggggcagagacagctcaaggttatttctcttcatatttcaatgataacctcaggttgtgatttttagaatttttctcttgtattttccttttaaatttgttatggctttgtagcctttaacttttgtttgcagttagtatcctttgaacttcattatctgttttctctatgatttctaagagaaaaatctgcagaaaaaaataattacagctaccatttatggattaccttttgcatgctaggcaatttacagacatcatagcgaatcctctaacaactctcaggattaggtctattattattcacttcaactttacaaaaagagaggctgagactcagaaagttttcatggcttgtccaaggacatgcagttggtaagtggctaagtggaagattcaaaccctgggctctttcgctccaaagctcatgttcttccccatactataaaactgactgtttgtgtaccacgctacctcaaaagggtttatggcttgtttttggtcagacaaggaaaaaagaaaagaatctctgtgtgttagccttgggaggaggatgagtgggagctgtttaacagagagcacagaacaatgcccagggcccatggaagacagaggagaatggtgagctgttggcagagtaagaagcatccccaggaatttgtgtcaacaaacccctcaccccgaagttgttgccttcagtagtgtgacccttcaaccactgagtggcatctggaactaagatgtgataccagatgggttattttccctctctctctgacacaactagg

SEQ ID NO: 49900 - DNA, 1046 bp, Homo sapiens
ttgaaaatgtacaataccttaataataaatttgatagcatgcagtgtgactcttgaagctagactatttttattattgttatgtagcaaaatattgcagatgagatgcagaaatctatcgtgagcttgtaaaattctcctagagttttatgaaggcgttaggagcaacttttagacctttagaaaacttcagttagccatgtgttcttgaaattactgtatagtgtttccacaaatcagggtgaggtagccgaccagcctataactttttaacagtttattttagagaattatgaagattgatgggaaaaatgatttttccagaaatacaaagaaaattactttatccacaattattttctccctctgaggagagacgtgaagtagaagcccagctacctgttctatcacttaagatttccagcattcctgactttcaaacaaagaaattgctgttgccactagtttaaaatagaaaagaaacttggagtgaagaaagaaaacccaggatttcgtccagttcaaactcttccttatgaattagttattcaaactcatattgttgatatttcttaatattgtggtaacgaacattttttgccacgttacaccaaatgttgagggtatgaagttttttgtacttaatttgtgcttacttctttagtgtgtaactagaggaattttccataccagtagctgaactcttgaaaatatttaaagtacaacttaaaaaaaaaccaataaacctgtttctttccactcaaatatttactctttaatgattcaaaccctgttttctttgaagttttcagttataaatcatacttaagtttaagatatttccccttagagcctacaatagtatttttgaggacaagtttcatttagaatattgttgattgttaaatctttcgtaagatgtaggtggaagaataaagttaaatgttgagttagagtactaaatgttatgctttatgctgtgcctcttgttaaagaacttttaaagcttctgctaaagaactttaaaattagccttcatgtatcttt

SEQ ID NO: 49901 - DNA, 1066 bp, Homo sapiens
atacacagaactaaaattttgaccccttctttttttcttttattttagttgacatgtaataattatacatatctatgggatacagagtaatatttttttttgaggcagggtgtcactctgtcacccaggctggagtgcagtggcacaatcacagtttactgcagcctcaacctcccaggctcaggtgatcctcccacctcatcctcctgagtagctgggattacaggttgtcgccaccatgcctggctaatttttgtatttttttgtaaatttggggtttcaccatgttgcctaggctggtcttgaacccctgggcccaagcgatcccccatgcttggtctcccaaagtgctggattacaggcatgagccattgtgcccaaccgagagtaatatttcaatatatggatatgatgtgtaatgatcaaatcagggtaattaacgtatctatcacctcaaacatttatcatttttttgtgctgtgaacattccaaatcctcccttctagctttctgaaaacatacaataaattatggttaaccatattcaccctacagtactgcagaatagaatttactcctatctagctgttaattttgtgttagttcaccaatctgtccacatcttcccctcctgcttcccttctcagcctctaatactcacaattctactatctgttttctcatatgagtgagaacatgcagtatttgtctttctgtgcctggcttaatataatgtcctccagttccgtccatgttgctgtgaataacaggatctcatccctttttacagctgaatagtactgtcttgtgtatacataccacattttctttatccgttcttaaccctatcttctgtgcatttcttacttggtcattcgccatttcagactaaagtgttagatggcaggaaccacatctttgaattaatgtttgtagaaatcaaatatttattgaagatattaactaatttctctcaatactcctataacatagagtgattctgtaggaaaatgccttcaaatttggatttaaacattaaactaagggcacattgacagccaactct

SEQ ID NO: 49902 - DNA, 1048 bp, Homo sapiens
tccccctcaggcttttctggacttgttccagccttcccctgacagcagcctgctggcctttcttttcctccatttatcatagcatcgtggatgagagtgatttgtgtctcaaaatatcaggttaaccattggtatgtcttagctttggatagtctggcaaaattagaacaaaactgtggttcatacttcctgggccccagagtaaacaaaattgtagattgcttagatgaaagagttgaagatagtctaattatcttttttatatgttcactttctcttttttggtcaagcatcttaaaaaatgtgccattgaagaaatcgaagccattgtgtttttgcattttccccatgaaaaatgtttacagaaaaagttttcagcctttctttgtgatccttgtaacagagattgtgtgttgtcagcagtgttttaaatttttccctctccttctattacctcttaaagaaaaagtggggaaaagaaatctgtacaagtacaaccctattaacttaaaatacaaaggactgaaatgcattgagttcaattcaaccatcaatggggtttttttcaatttgtttattatggaacaatagggtgtctagccaaagaattaatggttgctttgaattatggaaaaagcttcccagtatcaacttaatgaagttttactgaatttgaaatccacaccacactagatgtgttaggaaatttctaagcatgctagtgaattactctaccaggtttcaatagtgcctggtaacacaatcctaggagtgaatttttggcaggtggaggaaatacttcaagaacatctagaagcatccagatttttctttgaaaatgcatttttgagttgctctgttagtccctttttaacccttcttcccacccccagctttccactaaaccatttgctttgggacatatcaatttacagtatattatattaagctaggtttgactgcttgatgcactatagtataaataacagagcagtgggtggtgggggtgggatgggcaatatagataatcaggtggagcataagctgt

SEQ ID NO: 49903 - DNA, 1073 bp, Homo sapiens
gtattgcacatgaagtatattttacatttgaaaatacttttaatctgtcttgtaaaaataaggcttgacatttgcctatagagtttttaataaactatactaatagtagttacaactattttttaaaagtagaaaaatgcattgtcaaaataaaaatgagtaacaggatggtcactatgttcaaggagcagaaaaatatcatttgaaaatgtcatttaagaaggtcggtgaattaagagaaatcaatgtaatttatgtaaaaaatatgtattcagtaaaaattgtggtgtccatggacttgctaaatatttttattatatgaaaatgtatggaaaatatgtagaattctttacctcatttaaaaccttgtttactggaaggtaaaaacctgtgagtatgtacctatgtctaaatatataatagtattgtcaggattttacacatgatgcacttttattgtaacacatgttgcacgtttattgtggctagttctttctacctttgatatttaaattcttagtattcctgaagaaactgaactcacaacagtctgtaacatacagagtacagacaatgggaaatggcttttaatgaaattcaataccaatattaagcagttttagcgaattaggattgaattgaacattatctaggattatatttatcaagattttcaattctttgcttaatttttcctgtagaatagttttacagaaaatcattgcattaaaggaactgcttttgatatatattaatttgtttacctgttagtaaaatcagagatatgtgggcagtaaacgagtgacttctacttcacagaaacttgtcatcattgtctaagctcttattttgaagctcaagttgttataagtacttaacactatagattctaagggatagagaatggaagggaccaggcattgaattctgtttctgtgacaaacaaagtcttgtaaccggagagctgctttttttttttttttttttttttaactatttatctcttcatgaaaaatggtgactgtcactgaaagatcttttttactctgtcacaggcttctcaaagggcacac

SEQ ID NO: 49904 - DNA, 1594 bp, Homo sapiens
ttgactacctcagtagcaagagatgccagtgtcctctgcagagcaggccactggggaccatgatggcttctactgtgtagtgataccaatagcctccacctttcatctttgttcctagacatttcctggcctctcaggtatgctgatctcctcagtgatccttcctgtggagttattctttcttttttgctccactgtgttgctgcagattgttaaataggcccttgaatccttccagagttacttgggtttgtggatagctgtctatatttgggggctttttatgtatatgtggagggaggggatgattaaaactggtatctcctctgccgtcttggtgactttgtcatcgctttccatctatctgtatctatattggttaatactgatatagaaatttatcacaaatttcactgcctgtttacaaaacccgacttattctaatattggatgtatgtggtatgaatgcatagtagaatgaatcattaagcagccaaacagccactatatattacacactgtattaggtgctgaagatataaaagtgaacaaactcactactgctgtcaaggcactcacagtccagttttgcactgaaatgatgccaattttatggttaaagtatgtacaaggtatagatgatgcacaaattagtaagtagtcacttctgtccttttcaggagtggcatgaataaaaggcctccaaaaggaggtgataatgctagtaatttctatccaatttcagcatttacatctaagtgttagctattactgtattttactacatacataattatttgctcctttgtgtgataattttgctgtcatatttgttcctaaaaagctaattcagcccatcatattcttttttagagatctcatgagtgattacgcagtctcagtagttttaggttctcctcctaattcccatacaattccttggtggtacatgtgtgtgtgtgcgtgtgtgtgtatgtgtgtgtgtgtgtgtgtgtgtctgtgtgtgtatcatttgctcattctggtttactctttctggactgaatcccggtatttccagactcactctagggcaaaactgaatccttgctacttttaggcacctgtgacaaaaacactatttttggttgctgacctaaaatattaaatacgccctatttaaaatggctattccataatatattgaaaattggtactgatatggtttgacaattttattggttgcttatttattcatattcaatactcccatggaaaatgagtgacagctctatcttcttttcctaagatttcatatagagtgttttttaagttgcacagtagtatacatgtactagtcacccagtatttacttaatctttaaataattaaaaactagttttttgtttgtcccaaattttgattgtaaagtgtactcagaccagccagtgctacaaaaccatcgtccaagatagcttcttaagggattaaatcaaattatttttatctccttcacccatcattaactaaactctatgatataaaacactactttgaagaacatgttgcttcatgataaaattgtagaaatgtgcagctggcttatgttgattat

SEQ ID NO: 49905 - DNA, 1023 bp, Homo sapiens
gagacatatgtatatacacacagagaaagaaatattctataatcttacaacgttttcataccatgtatttaaatcactttcttaaattgaccaactcatttattttccatttatattacaacatagtatgactgtgtgggtttgtatttttttctaaactaaaatcacgtcaaatataacaggattctgtttcatgtagtcaacataagtcaaggccacatcctctttgtgccatcagggaactgtgttatcagtcaacttacatacttattgtggcccattgttccatttcaggtgacatggaggattttgtgagtcaagttaattgagcaaactgggaaatgggttgttcttacacaggatgtcatccataactaagacctcactgtaagctggaggaaaagtttattacatttgagagaaaattatatgttctttgaaactgtatgcagttgtagtgatttccttgagacatgcaaaaaatgtactaggtattcattttgactaagctcactgtataacttcatttttgaaaacaagagttaaaaaccagacaaacacatcagtatgaccacagtgttttcctttaattttagttcactgggcagattttcttgacaaagttagtctttatgaagagtgctaaaataagcaaacccttcccttctgatctcataatattggaataatcttttataatctttaaatatttttctagttcagtgtaaatcttaaaatgacactcaggcattgaatagaatttgaatcatgcctttatttgctgctgaaaattgcctttagatttctgtgtatgttaaggaaatattgcctcccacccaccatcaccagtatttatgaaaaaaaaaagaattgaatgaagtaaaatatttcagaatcatctgtacggctttgtggccttctccttatttttcactgaaactgtatgtgcttacagccagtttatgtatgctcaatgcctctggaatattcttttattgttaacatttgttttggagttctctt

SEQ ID NO: 49906 - DNA, 1026 bp, Homo sapiens
tgtaaatttgcaacacccttccccccatgattcattattctcttactatgctttgttattttcttcacagaagttagcaccgtctggcaccatattatttatttatttattgtctttcttattagaatgtaaaccccttaagagcagggatttttgtctggcttatacactactgaaatcctccattccgagaagggtacctggcacaaagtatggaattcattatgttttacataaatgaattctactaataaaaatttattaacaccacattttcttgagagacaagtactgtatagccattaggttccacagactattttgtggtagtatattggaatggagtttcaaggtgatatacatacatacacatatatatatatatatatatatatatatatatatatatatattattttctttttccttttacgttaggctgacatttggtcattgggaattactgctattgaactagccaagggagagccacctaactccgatatgcatccaatgagagttctgtttcttattcccaaaaacaatcctccaactcttgttggagactttactaagtcttttaaggagtttattgatgcttgcctgaacaaagatccatcatttgtgagtatatattgctattattactatttgttttctattattagatctacttatagcaaaggcagcttttcctgcagtagggaatacagtgtatgtgagaattgtctaagatccatccaggaacctggttcgtccttctgtattgctatttctattgagttcttaaccagattcttcattctttttctccttacccttcgtttttttcttgatcctcagcttcctccttattctattcattatttcctctttcagggggaaataaatttgagaaataaagttaactttatattatgtcattattaaagtgtatgtataaatacaatgatttttgttcaactgttttcatttttcatgaaaagttatatttgggtttaactattttttttttttgagatggag

SEQ ID NO: 49907 - DNA, 1034 bp, Homo sapiens
aataatagaattagctattttcctacagcattttagttgttcttatgtctacagacatacctttatacctttcagcttaataattcaaatgattttttttaccattccttgtaatcataagagttcaacaattgtcatatgcagccttgatctttttatccttagcgtcctacagcaaaagaacttctgaaacacaaattcattgtaaaaaattcaaagaagacttcttatctgactgaactgatagatcgttttaagagatggaaggcagaaggacacagtgatgatgaatctgattccgagggctctgattcgtatgtacaaattatttaatttttatgtaggcagcctatttaaatattgtatatcttttagctatgctccagtgtgcttgttctagcataaaatataaaccatattttgaaatttcaccttagaaactgtaaaaatctttttcaatcacagtctgtggaatacaatggagttggaaacatgtttttcttggaagtgaatagctctagttttaaatggtcttggtctaacccctagtggatacttgagtatattacaaaattttggaacaggattcaattaaaggtgttatattagtttgctcaaagtaataaggagctgtgttttctcatactttgatggcaacctgcaaaatccctctaaagaactgacctccaggcttttcccacctcttggccatgtaccaaaccaagatcagactgatacatttaaatattcatttatgcatgatttttatttcttgaaaaagttgtagggttttataacagcagcgtttacattaaaaattcagcctctaagtctgtcaattaatttagactaggaaagtctgtatgctatgccagaatttagtcctccaccagctgaactggcacaaaggcaacaccaaatttctttagatactactctgagattcttccatttatgagaaattgtccaatgttggaaagggataaaaaatatcagaataatttgtgccctattctaatgggtgttagccttag

SEQ ID NO: 49908 - DNA, 1506 bp, Homo sapiens
ggataggtgtttggtaatgttgaaggagttagtctggcttcatgttttacatcttcaactaaaatcccatactatctgcttggatttggagagccaaaaaataaagctgattgtcatgtgattaaatatctgatcaacaggtatgaatataacttaaatcagcatatttttgccatggtaataaattgtcctataaactatttatatatttttgttcttcataattatcactaataagcatcagtttgttgtttttaaaaggatatttaagtgagcattttctagttcatatgaaaataaccatagtacaggatgatttctgtccacacaaaggttaaattagattgcacagttaattttcacttatatttatggtactattatgtgggtgatgcctttttcttttaagcccagtacatatattatgcctgcctaagttctgaactggggctgtatttcagtagttgtagaattattgatatttagttttgatagctaatgtttaattgtttggatctgcacagtttggtttttgcacaaaagtcatttaaaaaaatctgagtaattgtcaaatattaaaagaaagatattcttcctgtaaggaatacagtttttagtcaaagtggccattacatcctctttttaatttacataatacagatacttgagaaagttgttgtggtgttgtatgccaagaaaattctttttattggtgcctatattgtaacaattatttttaatgcattgtattttgaagtaacggttcagttaaatttttcacctgctgtgtaactgaaacacaattacagtttataatcatctgtagaagtctggagataattttgcaactcatgttatgggttaaatgaatatttttgtaaaagtaaaagcaacaaatttataaattgattatttgaaactttacaacacaattgcatcccaaatacaaattgtattgcttattcattatagctattcgtcctgtaatctgtttctaggtgaagcatactccagtgttttaggggttttgaaaataaatatttaaatttcacagtcctcaatgtttgttttccttgagttgggggtgtggtatgggacttcaaggactcctttgtcctttattgttcaaacactaaaatcgaaatttctgttggaaaccagaagatacttttcacatttcattaagcattaattatagctacaatgaacatctgtcctgatttctaggcctcctgtcttgaccaaattattaataaagtcccctttcacttgaaagtgtcctgggttgaacaataaattatatggtcaccctaattattatattattaagagatcatatacagatataaacttagtaaagatttttagaaattgatatgagaaatagcattaacataaaggagtttaagtttttcctagagaagaggttgagggtgaacttagcattaaggatctagggtattaatatgtattaatatattagtatattaattatataatatccta

SEQ ID NO: 49909 - DNA, 1050 bp, Homo sapiens
taaatcagtataaagagaaacagggtaaaaatttcagatgccagagataaggcattcttaatcctgtccaaaaattgatattatgggaaaactccccttgagtttcagtttagttcactatttgaaggtggaaaagaaatacatatggatttggttgggaatttgtttacaaaatgtttgacacttggataaaagctgaaaaaaatctatcaaaaatctaatgggacatgaaacctgttctcaagtagcttataacatagttgaaaagataagacttccacacttggcatcattaaagcttgcaatgatgagtgaaatgcatataacttagtgtaaacctgcatgatacagacacgcatcaaaagctatggaaattcaggaaaagaatcaaaggattaatgaggagctcaagtcttaggaaaagcttcatgaggtatgtgtgatttatgtagactcagaggctaggcacagtttggctgcacagaagggagagagaatgagatattctgattgaaaagggggaagaaaaagagcaaaagcatgagagatggaatgaaattggtgggcagaaggcaaagaaaaggtcagactacctagggtagagtatgtgacaaggctggcatggctgggtagactcagacttggcaatgcaggctttagaagttagtttgagttccagaggcaaagagccatcaggatccattgagcagcatagtgacatgatgaatgcagtgttatgggaaaattagaccaggatttatgggattacctatggccatccagatggcaaacacaccagttgcaaagattcttacttgccggtacaatgaatgtgaagggaaagaggctgaaggctggcatgaaatcaggctatgatggaggctcagatcaaccagaatgaattcagatggagggtacagatagtttccactggcatatgagagaggtgagatgaaatattctgatatagagtacccaaaagaaactaagagggtaaaagaaactaaggagaattagagagctggaatagtgaaggtccattattatcta

SEQ ID NO: 49910 - DNA, 1045 bp, Homo sapiens
ttttggatctttcttgctttctcttgtgggcatttagtgctttaaatttccctctacacactgctttgaatgtgtcccagagattctggtatgttgtgtctttgttctggttggtttcaaagagcatctttatttctgccttcatttcgttatgtacccagtagtcattgaggagcaggttgttcagtttccatgtagttgagcggttttgagtgagtttcttaatcctgagttctagtttgatggcactttcgtctgagagacagtttgttgtaatttctgttcttttacatttgctgaggagtgctttacttccaactatgtggtcaattttggaataggtgtggtgtggtgctgaaaagaatgtatattctgttgatttggtgtggagagttctgtagatgtctattaggtccacttggtgcagagctgagttcacttcctggatatccttgttaactttctgtcttattgatctgtctaatgttgacagtggggtgctaaagtctcccattattattgtgtggaagtctaagtctgtaggtcactaacgacttgatttatgaatctgggtgctactgtattgggtgcatataaatttaggatagttagttcttgttgaattgatccctttaccattatgtaatggccttctttgtctcttttgatctttttggttgaaagtctgttttgtcagagactaggattgcaacccctgcctttttttgttttccatttgcttggtagatcttcctccatccctttattttgagcctatgtgtgtctctgcatgtgagatgggtttcctgaatacagcacactgatgggtcttgaaggtttatccaatttgccagtctgtgtcttttaattagagcatttagcccatttacttttaaggttaattttgttaagtgtgaatttgatcctgtcattatgatgttagctggttattttgctcgttagttgatgcagtttcttcctagccttgatggtctttacaatttggcatgtttttgcaggggctggtaccggttgttcctttcca

SEQ ID NO: 49911 - DNA, 1033 bp, Homo sapiens
gctggtctcaaactcctggtctcaagtgatccttctgcttctgccttccaaagtgctgggattatgggcatgagccacggtgcccagccagtcattatcttttttaaaaacagaaatggtacaaaaaatgttatcacagtatacttcttggttcagtagtgaacaatattagcatagtcataatgatgcaaattttaaaatgtgatatataactctattggtagaacagagaaggggaggggatttgtaagcaaattgactcctcatctaccattacaagatggcaatagattaattataatggatcaaaagacaacaatgcctgcttgttatttaacaatatgaaagtaaatgtcagaagaaacatttaaaaaattgaaagtaagatggggcaagtgtgagggcagagggagaacaaggagacaggagtcttgctttttgttatagcataaaccttttatactagggtaatataacattgtaattcagtatatattatttagttaaaaatcatgatcagtttgaaaaagagtcaatggtggttaaacataaggtagaggttatattcacccccattttctgaactgtctgctcccatacatcctgtggtttcctcctggccataattggagaggaaagagcctgaaaagctctttcacactgagatcttagtctactacaatccagcctgggcaacagagtgagactatgtttctaaaagtaaaaaaatatttatgaaataaaataaaataaaataaaataaaagtaaatgatttaccagattcattttttcctttgcatagtttatttgaacccatgaccctaggcacttaagggtctatcccttcaagaagagggtactggaggtaaaatctacaatttttttaaaaggagtttggagcaggtcaatgctaagcaagaaataatttctaaatatggatatacaggcatttgtacatgttctgaccaaaatggggtttggtggtttggttttaatgggtgggcaggtgacatactttctttctttcttttt

SEQ ID NO: 49912 - DNA, 1054 bp, Homo sapiens
tgagaggatcgtttgagctcaagaggtcgaggctacagtgagttgtgatcatgccaccacactccagcctgggcggcagagcaagacccatctcaaaagaaaaaaaaaacaacttatttgtggaatagccttttgttttgagaggatttattacattgaaactcttaatggcttaacaatttctatttcatattcttctcagagcaaaagtggatccaaaagagctaagtagtcataaagtaaggaagaatgaaaaccccattttccttctatcttgttggaggcccttgagaaatagattttggaagatttgccacagggcttccatagaattgactccagaaaaagttttcattaagcctggcacacaaatactgaaacccaaatgagaaaatggattaaagtgataaaaaatgttcaaatgttgtatgcatagatgtttttgtgtggatgatgtgtgatgtatccttttgtttataaaggtaaataatcgacaaatacagactgcctgtctagattcaggaatagtcaaagactttaagacaaactcagtgatgtttggctctgagcctcacacattttgcttactaaaactacaacctcttctctcaacctaggcatctcatttgcccttataccccaagaggctctttctgtcatgaatcgtcgttctctgtagcttttgctcttgccctcatgctttggtttcattttcagtgttctactttatcactttcaaagttggagaacaattaccatactgaagtgatttcagatttcctggccaaatacagattatctagcattcaagagaccacagttcttaaactcttgctctccacccccatccccaagagaatcttcgattttgagtaatgtaggacaatttcatcatgaattgtttgaagggacattttagtggcacatcttcatgctattctgggaatactatttccaacctttcttccctggaaccacagtacaggatgttttgactttttgactccacaatccgccattccttcctctttccagaggtcttcttgaatatttt

SEQ ID NO: 49913 - DNA, 1119 bp, Homo sapiens
ttcgtcagggttcaaatgggcataattttcatgtaatcaaggcagctaatgaacatatgggtatctggtgatatgtgaaaaattatgtctattaatttgtaaattttgatacacacaggtgataattataggcattcctgagcatttattttcccaatcattttctgcaattaaagcttagaatttctacaatacgtaatcttaagtactttaatttcaaatcaaatacattatataacatggtttctaagaaattttatccattaatgagtatttacctacctaagtatttaataaaaggtttaatgtttgtatttccgttttcatagcagcattattcataaaagccaaaaggtagaggcaacccacatgtccatcagtgggtgaatggataaacaaaatgtggatatacatgcagtagaatattattcagccttaaaaagaaggaaattctggcacatgctgcaatgtgaatgaaccctgaggacattaaagttaaataaggcaatcacaaaaagacaaatattgtatgattttatttatatgcattattaagagtagccaaattcgcagaaaaagaaaacagaatggtggttaccagggactggggggagttggtaaatcgggagttgtttaatggggatggttttagttttacaagatgaaaaactgctggagattggttgcacaaaatatgttaatatacttagtgaactctacatttaaaatggccatgatggtaaattttatgtttgtgtgttctattatgtttacaacttaaaaatgagttcagtgtttttagaacttcaacatgactgatttgtgtgatagaactgtgaccatataaaaaatactgatgtgaagccaggcacagtggctcacacctgtaatcccagcactttgggagaccgaggtgggtggattgcttgaggccaggagtttgagaccagcctggccaatatggcaaaaccccatctctactaaaaacacaaaaaattagccagctactcgggaggctgaggcaggagaatcgctggaacccagaaggcagaggttgtagttagccgaggtcatgccaccgcactccagcctgggcgacagagcatgattctgtctcga

SEQ ID NO: 49914 - DNA, 1050 bp, Homo sapiens
tagtctaatgacttatctttcttcttttctcttttcttgaataaagataatttgaataagtcattgcacatctagtttaaagagtgctatcttaaaattgtatttttttctgaaaactctattgaatttgatcaaaactttagggctttgagctttctttctttaagttcatttagaaaacaacttttaaaatgccaacaatgtagaaaattgtggcaccaaaaatacagtggccctaaatacccctcacggaaccttttactttaaggtaagtcattgttaatgtcttccagtgcttaacgcaacatgaaaacagctgtactgtaggtctattatctatggtttatgtatatctttgcccaaagttgaaaaagttaagtgagacagttcactgcatgcagatgtcaaactacacaaaagttcattttgcacaaaaaagttcttgtctcctttaaggaatatatccagactagctcaggtgcatccctcctggattcatgtaatcagatctgcccttctggagaggcactggcacggatcatacaaaactcagttccatacatgatgaatttcaaaaaggcatacactactttcttctatagcaatgttaagatttcagaaatagaaattaactggttcaaagagtccataggtaaaggtcaggacaactcttgatctctaattccacgcaacattgtcaacagctgacaatgactcaatacaagcaaggctgtttagaaagcactgttgatcaggatttggatggataattaagatcaacagagtatcaattcccagaaagctaattttgctctcttatattctgagccaaatgggtctgctttggaagagagcatcaaatgttctgaagcaaaaacaatgtgaaaaggaggaacaatgggaagcaggagatatttctgggtcccacaatggctaaggtagccttgggcaagtcatatgcccctggattcagttccatcaactataaaaaggattttgctaattccattgttctgtgattcaaacacttctagccagcttaaggtatcc

SEQ ID NO: 49915 - DNA, 1031 bp, Homo sapiens
acttgaaattgtcacccacacagcattccaagaagactctgttataaaccatattcagcttagaaggaagcactcccccattagcattctaccttagatgagtttatcaaattagctgattgggacattaggaagggcagaaagaatctggcaccaaaaaactggcaagactcacgagggtgagtaggaaagacatggttgccaagagccttaagtggaaagggaacgccaggtgccaggaaagatgatggtgtagtcaggagaaggactctaaagtctgggggcaaatagccaagggctgacccagtctaactagctcttatgatgtaatagactacaggaatacgggatacttgtcatggaatgagatgtgaagctcaggaactagctgatgtgacatgattttatataatgagaaggaaatcttctggaaacagccacccaggcatgcttccgcaataaggcagactttatcaatgtaatgattcatagttgtctcaagatcaccaagaatctctgatgagaaagagtccatttttgaagcacacgatagtgctcttcacttgacttttcgttgtctctgactttcctggtaaatttctcactgaagccaccagcccattctcctgcatactttttgctcttgccttttacaaaaatgagcaggaccattattgtatctattaatttttgaactgaaagaaagacctggaggtgggtgaattttccagattaaaaagttattaatcactaataaatgctgatcaatcaacaatattgaagcctaatgtatttgaaagcaatgctttctgtttatggtagctttttacttctgtaatttttttcttttcttttttgaggtgactcaccagggaaattctcctagctaagttctgctttctttggaatacttttaaactttcttaggtttgttatatgctccaagtgtatggaaaaaaaggctataaattaatgattggtctacatataaaatgtaaagggcttactgaaagtatttagatttttctaag

SEQ ID NO: 49916 - DNA, 1189 bp, Homo sapiens
tgcagcctgggtgacagagtgagacccttctaaaaaaatcactataaagatgtattttattcttttgctctgccttgtaacactaccgttcatctaatactcagacaaactgagggtagaagattcaggcttaattgtccctcctctccaccaataccccctgtactagtctgaaatgacaaggtaggagctcctcttagcaatatttacagaccattcttcacataaaagaatataagaactctcaaaaagctaaataaacagagtactctaaacaagccctcttcctgtccttttctcagaagtctgctgcaaaggctcttggtcagtgccacaggctgttcttttatctcagtaaccggagtgcctttgcaaagctggcctggaggtcaggtctcaggctcactccccggtattcagtgaattcttagtcaagtccaagcttgagtcagctgcctccattgtaactcttttgcaattcgatggatagcttggtccttatgtcttgaggattggaatctcctgggcagggattggatttcactttccatgtctacagtgtttgcactaaggttattaatatattctctacaggagggatcatattgagagcaagctgaaattcacataacaaagcctgtggcttgaaactacgctgggccaagcccccagggggatactgggtaactctgagcagccagtcacccttggagaacattgagaagcatctgagtctaccctttctgggacacagcatctttctatattagacccactctcccagacttcccaccatacctggaggtgccctgcaacgccaatgagggaaaatgtaacctgaggaacactcatttccaccgtggtgtgagggactcagaggattccctttcccaaagttccatttagaatgaaatgaatgaataatttataccagggtaagagtcaataagaccattaaaggagcaggcaactgtaatacaaagagcacaccctctaggatcagaccaggatttgaaactcagttctgctctttactaactgtgtggccttaggcaagcagttagcctaccagtgcctcagtttcctcctctgtctctgtacaataggtatgatactaatcaacaaccttgtaaggtatgcatgtaaagctagaggataatatacataaaaggccttttacaggccctta

SEQ ID NO: 49917 - DNA, 1033 bp, Homo sapiens
tctcaattactctaaacttcatttagctgtctgttatctatctatctgtatttattacggaggcatcttaggttttaatgttaatttatgtatactaaataaccatttaaaaatgtatatattaaaacctatgtcaaacaaacaacttacatgagtatgtataaactgattttaaaacaaaatgaactttgttacccttcttattctctgtagcatttcttggggcttagagtggcttaatttgtctatactaaataaacatttaaaaatgtgtatattaaaacctaggtcaaatttttaacaactttcatgaatatgtataaactgattttaaaataaaattaacattgtcgcccttcttattctctgtagcatttcttgagacttaaagtggcattctaaaggcaatttaaaaatcatgtcaagctcagttgaacagaaaaaagggcctacaagacagcgcaaatgtggcttttgtaagtcaaatagagacaaggaatgtggacagttactaatatctgaaaaccagaaggtggcagcgcaccataagtgcatggtaagtataccggcagcaacagagaccttgaaacgattcatgagactcttaataacacatgaatgttcctgaatactaaaaaaaaaaacaaaaaccaaaaaaaactcagttaaattttaagaaatggtttatcactaatgctatgccatttttactagaaaattaccatttaaatttgacatcttatttactgttttactgtgattaatttatatatgaaccttaattttttttaaatgtaatttatagctcttttcatctgctttggtatcatcacactctgataatgaaagtcttggtggattttctattgaagatgtccaaaaggaaattaaaagaggcacgaagctggtaagttggtatttctgcctcttgagaataaaaattatttaaactcattaaagaggaaattgcttattttagagtgtattgcattattaactgagtataattttaaattgcaggcttttctttttt

SEQ ID NO: 49918 - DNA, 1073 bp, Homo sapiens
aacagcatacatctgtcaatattgcgaagttcagtggagatttaatttatttggacctttttttttttttttttgacagagtctcgctctgtcgcccaggctggagtgcagtggcgtgatctcggctcactgcaagctccacctcccaggttcacaccattctcctgcctcagcctcccaagtagctgggactacaggcgcccatcactgtgcctggctaattttttgtatttttagtagagacggggtttcaccttggtctcaatctcctgacctcgtgacctacctgcctcggcctcccaaagttctgggattacaggtgtgagccaccgcgcccggccttggacctattcgttaaagcatcagaactttgtatgagttttactattataaattgttttgattaatttttagtgttatagtgtagggagataattttttccccaaatgtagtgtgttacaaataacgaaatttgttccttgatctagggaatggaacaatactgggaattgagaacacaagctttagtgacagacttgagtttgaatcccagctctgtcatttactagctaggtgatcctgattaagttatttacttctccaggccatgttttcctcacctgcaaaaggggttagataatgacagtacttgcctcccagaattattgccagaattaaaagaggaagtatataggatttaaggtggtgctgggcacatggttaggacttgataaatagtagccaccacttattgtttttgtttgtttttgtttttgagatggagtcttgctctgttgcccaggctggagtgcagtggtgcgatctcggctcactgcagcctccactgggttcaagcaattctcctgcctcagcctcccgagtagctgggactacaggtgtgtgccaccatgcctggctaatttttaattttttttttatttttagtagagacagggttttgccacattggccaggctggtcttgaattcctcacttgagaccgtctgtccgcctcggcctcccaaagtgcggggattccaggtgtgagcactgaggaatagtggcagaaggg

SEQ ID NO: 49919 - DNA, 1064 bp, Homo sapiens
gttgcctaggctggattgcagtgacatgatctcggctcactgcaactccgcctcccaggttcaagcaattcccctgcctcagcctccccattggctgcaattataggcgcccaccaccacgcccagctaattttttgtatttttagtagagacagggtttaccacgttggccaggcaggtctcaaactcctgacctcaggtgatccgcctgcctctgcagatagctattattctaattggtaccggtgtcagattatatcacagattacaagaagagaaagagttcagaaggccatttagttcacctgtcttacccctatgcaagatttcctacaagccactcaagataagatttttggcctaaggattggctgacacgtgtaatcctagtgctttgggaggccgactgggaggattgcttgaggccaggagttgaagaccagcctggacaacaaagtgagacccctatctctacaaaaaaatttaaaaattttgaaatgtggcatgttcctgtagacctagctactcaagaggctgaggtgggaggattgtgtaagctcaggagttcgaggctgtggtgagctatgattgtgccactgtatccatctagcctgggtgataaagtgaggtcctgtctcaaaaaaaaaaatttttttttgccctgtttttaaatatatcaagaaattgtaattctacccaagtaacctgaaacaagaccagtaatatataacactcttcagagttgagaaattcatccttctgtataaattaagtatttctcttaatttaaagccattttagatctgtctccttccattaaataaatatttgagtttttttttattattaaaaaacccttcatatacttgatgactgtcctcaggtcactcctaaacgttcccttttttcacactaaattttactcatgtcttatgaaatcctctgaacagttttcctgctttttctagtagtagaaatagaaatagctaacatttgttagacacttaacatgtgctagggactatgctaagttttttaattatatgatcctttttaatgctgat

SEQ ID NO: 49920 - DNA, 1035 bp, Homo sapiens
gggattacaggcgtgagccaccgtgcctggcctcccaggtgatttttgatgaacaaccctggttatggaccattgccttgtgtcaggggttggcaaactttctgtaaaggaccagacaatatttaaggttttgtaagctatgtggtctcagttgaaatcacagacaatacacaaagaaatgagcatggctgtgttttaattaaactttttatttacaaaaagtttttttgtaaataaaacaaagtttgtaaatcccgtggattaggcccacaggatgccttctgtagggaggaaaagaggtaacttttcttcctgaagatttattcagtggcctcattgtcatctgtgtagctaagcgtacatgcattgtgaatgtattcatataaatgtgattttttttaaaagctccagttatggcatgcagattaattttaatgtatgcagatattttaccagtcatttatattaaaatgaactttacttttgaggtgataaaggagaatgaatgtaaggtcaaagagaaacttggaagtgtaatgatggaggaaattgggtctttggctattactgaatacatttttttaatgcataatttttttatttgcctccatttaatactttttggtaactgggaatactgtcaattaatttcattataaaatcctcatttatttttgctaatggaggagatccaaaaccaataatataaacaaaatgtattcttggtgttgggggctgtcttggtacttatttgagcataggtgtggatgaggtgttcttcacagactaaatatagcaagcggcatagcagtttagagtaccctcagctggaaaaacccatacacgagaaaagcttggacataaaaatctgagctcagaaaatgtctgtctgaatctttcagatacacaaaaagaaacttcagaaactccaataagataatttatattcctcatcaatcatgatgcagaaagtcagatagagttggagtatgtgatattctgagcaaggtcaggagatgaggttaaggcttagtt

SEQ ID NO: 49921 - DNA, 1052 bp, Homo sapiens
ttcaccgtgttagccaggatggtcttgatctcttgacctcgtgatccgcctgccttggcctcccaaagtgctgggattacaggcgtgagccactgcgcccggcctcgtttcttttctgttttctttttcttttttttttttgagacggaatctcgctctgttgcccagagtgcagtggcacaatctcggctcactgcaacctctgcctcctgggttcaagcgattctcctgcctcggcctcctgagtagctgggattacaagcacccgccactacgcttggctaatttttgtatgtttagtagagacgggatttcaccatgttggccaggctggtctggaactcctgacctcaggtgatccactcacctcggcctcccaaagtgctgggattacaggcgtgagccactgtgctcggccagctgcgtgtttctttaaggatgataaatgggatccttgatactgtcatattataaatgatgtgagcttggtaatagtagtacattttgtgatcaccaggctttctgttatatttttattcacatctgtagtactttaaaaaatgccaatgtgttaataagtaaccaaatttaaaatacaaactttaaaaattatttaatagtttgtttctacttaaatttatataaaaccaggttagtcatgtttatatatagttagccaagttgaacttggtctgtaaaaagtatgcgaaaactctgatactgagttctgacttgtttcaaaccttttcaaacagatggttttgatacttttactagcaatataaaatggcttagatgtaatctgcgattgttctatcccttcatttagattagagatctttaaaatttttgttcgcttttgagaatatgttgcttagaattataatggtttgagcactgttgttttaggaagctgtttcttttatgaagatttacctaattattggtattcgcatgttaaaattggtggccctttttgatctctagatcttggcttttataatacaaaacaatatagtttccacttctggactcgagattagtccagatac

SEQ ID NO: 49922 - DNA, 1051 bp, Homo sapiens
tttatatttattgatttctggcttttatcacattgatctagctcaaatttagttgattttgagtgctttgtcagaaacagaacttccaattattccattgttctaatgggaaacatatgttctcctttacgatcatggtttatgatgggaggttataggattgtatttcagggactgtcttttaagaattgtactgcactaaaaaaaaaaaaaaaagaattgtactgcactagtctccagaacaaagatgaattaatatctatggtaatgtcttggtcatttgccatctgtggctcaatacttactttgctaatacttaatatgataaatgctattaatatataattcattctgccatgttagctttatataaaatgagctgttttgaaatattaaatttgagaataattgcataatatagcaattcaattttcccatcacaaataaaatattattgaatattaaatacctaaaacctatgtcatcagttttgcttcaggaaaaaatggactgtgaatttgaaaagcaattttaaaaatctatatggagtttataactatcattatgtcactaggttattagaatgcccgtcccaggaactgtatgtatttacctgttagtggtgatgggcttagataagttgcctataaaatgattcgaaacatataagaaagcatttctgggctggcacggtggctcactcctgtaatcccagcactttgggaggccaaggctggtggatcacctgaggtcaggagttggagaccagcctggccaacatggtgaaaccccgtctctactaaaaatacaaaaattagctgggtatggtggcacacatctgtaatcccagctactcaggaggctgaagcgggagaattgcttgaacccaggaggcggaggttgcagtgaactgagattacgccatttgcactccagcctgggtgacagagcaagacttggtctccaaaataaaaagaaagcatttctgataaaaaaaatatctcccctatcaatggtgacagttaactgaggacagagtccttccggaatt

SEQ ID NO: 49923 - DNA, 1073 bp, Homo sapiens
ggtaaaggaaaaaggattcagcacccaagcaaaacaattggcctgtgatagaagggcatttccactgtaataagagggaacgaagaggataagtggctcctttctggtctgccttctctgtgaaggagaatgtagcaaaaggtgtgagggttggaagctgaaggaaagagaaccgtttgaaagaatagctctgaagactgggagaggaagtttgcctggagaaatgtaaggtttccagaataggttgagggccctgttgaggttagtacccatgagtttatgtagtggttcccaacagtcaagtgatgtgacttttccaccagtaattcaggatcctgtatgtgcatagagaaagtggctagttgggtaaataaaaattgggatcttgccaagtgagtttaacgaagtaaagggatatgggagtttaggatatttgcaagagagcagtttgagcaagatagggagggaagtgacagcaggagaacaagaaacaagaaagcatcagtggactggaggtcctaatagggttgaagaacaatgagaatgaaagtacttaggaaaacaagcatttgtggtcccagagtgtgacatagggatgtcagaaatagaaccattttatgtgattataaggtttttgagtgtggtaaattggagagagtaatgcccaacttaccagtacaccaacgctcctcctagtattctaaagccctgtctgtcccttttctgattgtcttctcttcttaaccactgttttcctcatcttacatcttcctagtttatgctccatcttcctcctcctaagttctcacatcatttaacagtgtgaagtagaaagggtatctggacagaaagtctgaaactgccacccactaggtcttaacttggttaacttattcacaaggcaaagtgtcctcatgtatcaaatgagactaataaatatataatttttgtttagggggagtgggggaggacataattaagtgacagatatgtgacaaacattaaaatacagtggtgacatcatggctgcatcttactcttaaacctttcaggaaaaaatgtgtatggatatt

SEQ ID NO: 49924 - DNA, 1029 bp, Homo sapiens
ttctgtcgcccagactggagtgcagtggtgcgatctcggctcactgcagcctccacctcccgggttcaagcgatcctcccacctcagccaagtagctgggattacaggtgcctgccaccacgcccagataatttttgtatttttagtagagacagggttttgccacgttggccaggctggtctcaaactcctgacctcaggtgatctacccacctcagcctctcaaagtactgggattacaggcgtgagccaccgcgcccggccgactccatattctttctgattcacccatgtgcagagtactgtgttaggcattgtgtatgctcatctgtgatttagcacactgtacaagctttcattataggaaatttcaaacttaggcaaaagtagaaataacagcataacgtttcatctttaccccccactcactttcttcatttggattatttcgaagtaatcccagacatcagatttcattttagcacactttagtaataatatattttgggtgtatgttacaaatttgtatattcatgtgtatgtatatatgcatgtttgtgcatgtgtatgtatatatatataatatcaagtatatcaagtaaatgatttatatatataaatgatttatatatatataaatcatacctttcctgaaaaagcaggaagctgagttcacaaatgactccgcacatacagagtaaatgcacatcacatttacactggaaaaggcagggcgaatgtcctccagttttccttttgcagcaaccatgaagattcaaagcagaggtggtgatgcttgcctcaatcttaatgcctgtcctttttctttttctttctttctttctttctttctttctttctttctttctttctttctttttttttttactctgacaaacatttattgagtacctacaaggtgtgagcaccttggagaattaaagtccccatgtggacaaagagcttagagtctacacaagatatgccaagagtattaactaacaattaaatagaattttatagtttaca

SEQ ID NO: 49925 - DNA, 1434 bp, Homo sapiens
ttagaaaggattttcacactggcatttctaggtagtgatattttcttccacttacctgctgaagcacatttatgcatttctttatggcaaaaccaaataactttagttgtggtctgcctgatactaccatagcacctcagtaccaaggggagggattttgactagttgaattattaagccaccacaataaagcagatttttaaataagaaataataatgttaacttgactgtacattgagatattctgcagctgatagagcagcattttaaaaatgtaacaggtggaaaattacactgtgcttaatgactgatttttttttaaactgcgagtcccttaagatcacgtttgtcaagtgtgtattcacacatttacttaaatcaagggactcaatgcttgcttttattttaaccatcttttactatttttagaaggaaactagctttagtagtgggttgccctgtatgttttctctttttgctcttaatatgccattgggtttttgtgtgtatgtgattttcaaaattcatgacttgaagtgcaaggacagatctagatgtttgtttaccaagctatgtgacttctcccaaaggatctgtactttctttccttacaacagcttgaaaatcattattttaaaatccttaaatcactgtgtctagatcattttttacattgtgtgccatagacttacccatgggacaacagagctccttcatttttggacaactactgtaatcattttttttttaggaaaaatggaaggtgccgggggtaatcatggccagtcaataattatataaaggagttcaaatactatagctgtcagttgatgaatttgttatgtagtaaaatgtatgactttgtatgggtttcttcagccctttttctgccactagcaaccagaatagcactttaccttttggttggctagataagtggctgactacctgtttttctcactgtggtgtgattggctaaacaatctcgcattaaaaattcaaatgtaaattgaattcacatgaaaaatcatgtttggttgtaaacctccaatgttttgattctctaatcatgttttcgtcacatgctgagtaaaagtgccttacaatgtaaaaattgtacagtacttatgttcccaagtagcatcatcatcttctgggtagtaattacattgtggtattaatatttagaaaaatggacctcagcagtgtatttactgtacatctcttaagtccttaactgtagttttaataagcatgacattatttgataagtatataacatttacatcatttcaaaaaatactgccgttactgtcttttatgcatattttagcctgaaattttgaagcgtcttttttctttcttttttctttttttgttttgttttttgttattgatattaaacagtgtaatctttgcaagcgtatattgaa

SEQ ID NO: 49926 - DNA, 1050 bp, Homo sapiens
ccaggctagagtgcagtggcgtgatcttggctcattgaaacctctgcctcccagattcaagtgattcttctgcctcagcctcccaagtagctgggataacaggtgcccaccaccatgcctggcaaatttttgtatttctagtggagacggggtttcaccatggtggccaggctggtgtcgaactcctgacctcaaatgatccaccagcctcggccttccaaagtgctgagattacaggcatgagccactgagcccagccaaggcttttaaaatttctaacaaatgggccaggcgcggtggctcacgcctgtaatcccagcactttgggaggccaaggtgggcagatcaactgaggtcaggagttcgagaccagcctggccaacatggtgaaaccccgtctctactaaaaatacaaaaattagctggccatggtggtgcacacttgtaatcccagctacttgagaggctgaggcaggagaatcacttgaacccaggacgcataggttgcagcaagccgaatttgcaccactgcactccagcctgggtgacaagagtgaaactccatctcaaaataaataaataaataaataaatttctaacaaatggtggaaaataggcatagtcttaattatacagtacacatagtctttattagcattatattcatgcagatattattcctttaaactggtttcttatgaaggtatttccaaatatatccatggtgacttatgttcagtagtatccatttgatgtagcctgtggacctgggtgtagtagatgctattggtgccctgcccggctctcttcaccggctagcaccccatcccacatctgtttcaagtgcagcttacttctgcgacctctgattatctgcccttgcctgatgggaacctaggaagctatactccccttatagccaatgaatgattctgggatacaaaatccctggcccctgcctcaagcaggactactgcaaatgtttcccgctgtggacgccaaggctaaactgtatctaagaccatgtcctttctcagttctctaccgttc

SEQ ID NO: 49927 - DNA, 1070 bp, Homo sapiens
tttctgcccattccagaagtttggaaatattactcattactaggaattaaataaaatatggtttatctattgttatacctcttttaattcacatagctcatttttatcttttatttttgtttgttttttttgagatggagtcttgctctgtcaccaggcaggagtgcagtgatgcaatctcggctcactctagccaccgactccctggttcaagcgattctcctgcctgagccttctgagtagctgggattacaggcaggcaccaccacgcccagctaatttttgtagagacaggatttcaccgtgttggccaggatggtctccatctcctgacctcatgatctgcctgcttcggcctcccaaagtgctgggattacaggtgggagccactacgcctggcccacatagctcatttttagactcacttccattaagtcttgtttggacccacgaacattgtctttttttttttaagatggagtttcacttttgttgcccagactgtagtgcaatggtgcaatctcagctcactgcaatctctgcctcctgggttctagcaattctcctgcctcagcctcccgagtagctggaattacaggcgcccgccaccacgcccagctaatttttgtgtttttagtagagacggggtttcaccatgttgggcaggccaggggtgatccgcccacctcagcctcccaaagtgctgggattacaggtgtgagccaccgcatctggccaacatgtcttttttttttttttcctttttaaccacaaagagacttaagcagtccttgtcacagatgatgaattgatgttgcaagtattgtcttagcttggattaattttcttgcttactgtaattttagataatatagctttgtaattagagattttatgtgtaaaccacaaaaatgtttacatgaaggccattattacagatgtgacgtgcataattattagtaatttgtatgtttacatgggtcagtctggcaaaaaattatgaagttttaaaaattaaaaaaaattataatgccagttttactggaaagtaaaattatttcagtaatcga

SEQ ID NO: 49928 - DNA, 1029 bp, Homo sapiens
tatgttgtgctaaatggtattttttatttaattagagcaatgctgttcaatagaactttctttgaggatggaaatcttttatgtttctgctatgtggtacagagccactagtgacatgtggcttttgagcgcttgacacatcttgtgcaacacaggaactgaatttttaagtaatttatattgccacatgtggctaccgtatgggacagtgtagtactagatgatctgtaagggctgtgcttcatcagtgtcgttttttaactgacaaaaacctttagttttttttttagtaatgtgtttatttaaaagaattcataaaatacaagtaaacaaattaacttgttacctgagcatatgtcctttcatacttattttttctgcatacatattttggaaaatggaatatctgccctttttttttatctgagatacagtctacctctaaaaatacatgattctaacattctcacttttgttggcatttgatcagggtatagaaaaacagttaaaaggacagagaatggttgagagattatgatatgaagagaaaatgtgattgagtgtggtagacttggggcctgcttgaatgttgagagaatgactgttttccgataaaaaaaaaaagtccattctaggatcctaaaagaagggtctgaagttcactgcagaaagcaagctacatagtactaagccactaaggggacatggagcccttagtaattcctaccttagtaatagtctcatcatgccctcttgggaacccagccttgttgattagcctctctgctttctctccttatagttcaacctccctgtttgttccaagcagttcttttcctgcccatttattatgcatttctatacagctttcctcctctttttctataccatgctgcagttcttattgctacctagaggttttcaaaattcctaggggcggataagtaggcataaacaaagttcttccctattatccttcctattttttcacctagactgaagaggtagacaaaatagaaataaagacat

SEQ ID NO: 49929 - DNA, 1057 bp, Homo sapiens
ctagtgtgaaccattggttttggtatattgtgcttccatgtagtttaatatcaagatgtttttagatttcccttttaatttatttgttgacccattggttgttcaggagcatgctgtttacctgaaaataatggagatattaaggtatttgaatatttatcttctagtacattgaaaaactttttgagagtaaccaataataaatgatggaatgctactgctttttttttttgaagctgccagttattgtttacttacactatgccaaatataaaggcattaatctcataaaagtttcacaacaatcctgtgagggagacgatatccccattttacaaatcaggaaattaagacttaataaggttaaaagacttgcccaaagtcacagaaccagtaagtggtagagcttgaatttgaatacagacctgactctaaagctcttttctttctttagattttagtgttcattgcttacttgaatgagtatctataagaaaactttaacatgtaaaacttctgtgaaattatcttgtcccatatcagggtcatgtcaaactaatgtcctcctcagcatctttggaaaacttcagaggagaaatgagctttgcccctcctgttcatttcatataccactgttagacctgtccttccctttcagcatgctttgtccatatttagaagctgttgaagccattacttgtctggtcagtttttagtgctggaatggacctagccttttaggccttctgagatttagtttgatctcgtctttcccacctaatggctctgttctactacatagatttgatctgaaacagttctctgtttctaaaataactttcttttcatgatagtcacagtaaagtacatttattatggaaaaatcaataagtataacgagtgaaagttatttcttggtggtaagattatgggattatttgaactttctgtttcattgtattttatttatttatttatttttgtgatggagtctcactctgctgcccaggctggagtgcagtagtacgatcttggctcactgcaacctccccttccc

SEQ ID NO: 49930 - DNA, 1139 bp, Homo sapiens
gtcttctcttttgtaatgccctgtagtctctctgtatgttatatgtcacattttgtaattaacagcttgctggtgaaaaggaccccacgaagtgttggatataagccagactgtaagtgaattactttttttgtcaatcatttaaccatctttaacctaaaagagttttatgtgaaatggcttataattgcttagagaatatttgtagagaggcacatttgccagtattagatttaaaagtgatgttttctttatctaaatgatgaattatgattctttttagttgttggatttgaaattccagacaagtttgttgtaggatatgcccttgactataatgaatacttcagggatttgaatgtaagtaattgcttctttttctcactcatttttcaaaacacgcataaaaatttaggaaagagaattgttttctccttccagcacctcataatttgaacagactgatggttcccattagtcacataaagctgtagtctagtacagacgtccttagaactggaacctggccaggctagggtgacacttcttgttggctgaaatagttgaacagctttaatatacaataattgttgcattattatttcagatgataaatgtggtcataagtaagaaataaatgatcgagtttagtcttttaattcactgtcctttgaatacctgcctcttactctggaggcagaagtcccatggatgtgtttatgaacatggttgaggaagatttaggaagactgcaacagtacactacctaaagcaggttttttactccatctttttttgccacgtacactggcctcccactttgatatgcttgaaattatctccttgatttgtctttcaaaactacatattgaggctggttgcggtggctcacacctgtaatcctagcactttgggaggccaagccggacagatcacttgaggtcaggagttcgagaccagcctggcaaacatgatgaaaccccacctttactaaaaatacaaaaattagccaggcgtagtggtgtgtgcctgtaacccagctacctgggaggctgaggcaggagaatcactggaacccgggaggcagaggctacagtgagccaacatcacgccactgcactccagcctgggtgacagag

SEQ ID NO: 49931 - DNA, 1027 bp, Homo sapiens
ctgaacataagtcaaaggtttgattatttttcatgtggcttcctctgcttggaactttctgccccgcatcttcccgttgccccctgtgtcctcttgtcatgcccctacccttttttgagtgtgtctattttctggcactacaagacataacaggctcatcttgtgttttccctaccctgacccagaatcagccattacttcaaggagccctggttccattattggagaatactattagaaaccaggatctggtgctaggcatgctcatttctattggagtgtcatacaaacaatttgtaaattgtttgtaggtcctcccagtggataggattaggaaataaaacatgcatactaaccatgcatacacacacatctacgtctatttctgtatctgtctgtatacatattaaaataaacatgggttgataactaatgtttctgctgtaatccacagccttcatcctagcctgccactcttcttctttttagctttttcaacagtgggaaatgtggctcttgttatgtacactttattcacttatttgtttgaccctagtatcataaagtagttccgtatgcctgtaacagatcgactaactagagtccattatttgcggaaagatctttttgtccgaagcgttaccgcaggggtgtccaatcttttggcttccctgggccacactagaaaaagaagaattgtcttgggccacacgtaaaatacactaacactaacgatagctgataagctaaaaaaaaaaaatcaaaaaaatttcatgatgttttaagaaagtttactaatttgtgttgggccacgtttaaagccatcccgggtcgcaggttggacaagcttgccttacagtatccagtcaaaataatgttttccaaaattacttcttttctttttcatccctttcagtgtggccgttatttataatgcagtttggttcattagtgtttttattacaaatacaccctcagccttcatatcctagttttaatgaattattacggtgaaacataataagag

SEQ ID NO: 49932 - DNA, 1034 bp, Homo sapiens
agctgaatcccagagagcataagaagcttgtccagagtgacatctctgatgcataaccagtactcaaacctatttttctgacaccaaggcctgtgtgtaaactgtaaaggggctgcttggcacctactttcctaaagttgtcctatcccttctctgtctgggtcttcctgaagcttggcacttctgaagtcacctctctgaaaacattctggtaactgttaaatcccttgttctagctattcatgtgttctgtgtggttaaacaaggttcacaatgggccacctggcctttggaacttgggtgaagaggctgccttcagttgatcctccccactcccattttcaaaacatgggtttacatgagttatttgtgaattaggaaacataaccatgttttgagccttcatagaaaacaaacgtctggggtcatacaggttaaaaggagtaaccaaattcggcactatcattgttctattcagtagacaattctggggcctttctgtgtctcaggttctgtactagttgtttcaggactttgggataaatacaaactatccctgccctcagggggcttaaggtcaggtgtacaagtgactctaatgtgaggcaaggctggattcagtgctgcatatctaatgctatgggaattcaaagaggaagtgatcagaatgagaagggagggatggatcattccaggagaagcttcagggaaaagcaacatttaaaatgagacttttgagagtgagggaaatttggacaggtggatatagaggatgcaaggctagaggaaaggttttagccagaaagtctgcttgggcaaatgcctgggtaaaaaaagaaaatccactttgggaggacaaggcgggcaatcgcctgaggtcaggagttcgagaccagcctggccaacatggtgaaaccccgtctctactaaaaatacaaaaattagctgggcgtggtggtgggtgcctgtaatcccagctacttggaaggctgaggcaggagaatcacttgaacccaggaggcagaggtttcagt

SEQ ID NO: 49933 - DNA, 1086 bp, Homo sapiens
acctacgtattaagccccacatgcattagctattgatcctgatgctctctctccctgctggctccccagcaggccccggtgtgtgttgttcccctccctgtttatgagaacactttcttgacataaagatttcatttattcccatggaattctaaaggcttttcatacttgtgaaggaataatagtttagaaataaactgaactttaaaagataccattttgaaaaataatatacagccatcaaaaattatatttatgggaactatgcaataatattaaactctatcatctgttgactgcctcctatattccagaaactttacatacaccaattctaatccttacaagaacgctgtgtaggctttagcattagatggaccaggtttcaccaactgtatggtcttggataagtacccaacctcctgtccctaagtttcctcacctgtgaaaacacggtttctaccagctttcaaataagatgatcaatataaggcacttggaacagaacctgacacatcataagcactctataaatgtctattatcaccaaataattccaggtgccttgaaaatttaaatgaaaaacaaaatcaaaccatgacaatactagaagcaaatttaggtgaacacttttctaatccgggggtgggcgggggctggggggaggcagggagaagaccttttttttttctttttgagatggagtcttgctctgtccccaagctggagtgcagaggcgtgatctcagctcactgcaacctctgcctcctggattcaagtgattctcctgcctcagcctcccgagtagctgggactatacaggtgcacaccaccacggccagctaatttttgtatttttagtagagatggggtttacaccctgttagccaggatggtctcaatttcttgacctcgtgatcccatccgcgttggccttccaaagtgctgggattaccagcatgagccaccgtgcccggctgggagaagacctttctaagcatgataccaaaggcagagacaataaaggcaaagaattgacagaattcactatccgataaaaatcacttctgtggccgggcgcggtgg

SEQ ID NO: 49934 - DNA, 1048 bp, Homo sapiens
ctacccccatggtgcaggcattctgcttgggagttggaggaggaacaggtaaaaaataattaaatattcaggttaacgatatattgtcaggtttgaggattgaggaaagggcgcagagagtggcaagggctgctgttttagatacagtggccaggaggcctccgatgaggtgacctttgaggagagacatgcaggagatgaggggacagtgaagaggatttctaagaacactccaggcagacagaacagcgacagccaaggccctgaagtgggtaggggcctggtgtgtgtgaggaacctcaggattgccatcatggctggagcagagacatgaagcaagaaggccatggagatgagggcagggagatcccggagtggggagatcagatggggctctgtgtatcatgcaaaggactttgcattctgttccaagagctgggaaggttgacataattaggaaaaaagcccagaaaagcagaggtatccatttttcatggtaaagatgataatttcaattaaaacacgattcctggatatatgtaatttgtaggccaaatggtgcccaatccctacctccctcaccccctcacttccctatccctaaaacctgtacctcaactcccgttcgtaagtgatgggagttaggaatagagaaatctcccggttgggttttctgagcaaagaggtaacatagcagctctgttatttctttcacgtctccaagggaaccatgactcacccttagctatcccccgggaatgtggccctcagagtgttcttttactgattcgtgattttgttatgtacacctggagtgatggaacataccataccagcttgtcagggttgctttgtgcaaagatcgatgacgtgtgtgaacccggatccatgcttggggtcctgagtttcaggtgccatggccagttgctagcaggttgtatgtgtgtgaccagcccctatgtgagtctctcagaccctgaaactccaaacaggcttccctgggcagagacattctgtccatgctctgtggcttgctgctcgagaggga

SEQ ID NO: 49935 - DNA, 1050 bp, Homo sapiens
ctcactctgttggccaggctggtcttgaactgctagcctcaagaaatcctcccgctttggcctcccaaagtgctgggattacaggcatgagtcaccatgcctgatgtatatatttttccagctcccttcttttctgtatcatttgctattactacctcttagctattagtataaactgatcttgagttgtgtaaatctttctggtgattcactgtgatgggatgattgtgtcctctcaaaattcctatgttggagtcctgacccatggtacctcagaaagtgactgtatttgaagataggtctttaaagaggtcattgtaaattaattaataaggtcattagggtggactctaatccgatatgactggtatccttataagaaaaggaaattagcacacagacacacaatcagagggagaagacagccagtcatctacaagccgaggagacagacctcagaagaaaccaaccctgcctgcaccttgatcttggacttctagtcgccagaactgtgagaaaacaaatctcatgtttaagccagaacctagcacgtggtacttgttaaggcatccctagaaaactaatacactcactgaatgaggcaggtagctgtttcttttattttttgagacagagtctcactttgtctccaaggccagagtgcagtggagcgatcacagctcactgcagcccctgccttccaggctcaagccatcctcccacctcagcttctcaagtagctgggactacaggcatgcaccaccacgcccagctaatttttgtattttttttttttttttgtagagacggggttcaccgtgttgcctaggctggtctcaaacccctgagctcaagcaatctgccctccttggcctcccaaagtgttggatttacaggcgtgagccactgtgcctggatatggtaactttttcatatgctatttgcttgatgattatttttctgtttctgatataatgctttttattagagagttatctgtttgtttttattttttaatgtttgaatttaaaaaattagtataatttgcat

SEQ ID NO: 49936 - DNA, 1034 bp, Homo sapiens
taattatttaaattaattgacccttccaacatatatttatttttccccatttcttcttactgtggttatatttatatggcatacaattgaccattttaaccatttttaagtatacagttccctgacattaagcacattaacattgttgtgcaaccagcaccaccatccatctccagaaccttcccatcatcccaaattaaaattctatacatattaaacactaactctattctccctcctaccccagcccctggcaagaaccactctactttctgtctctatgagttgtgctactcatatggggacataactcttataagttgaatcatgcgatatttgtccttttggttctggattattttacttagcataatgtcctcaaggttcatccaccttgtagcatgtctcagtttccttcctttccaaggctgaataatattccattgtatggatatttggttcatccattcacccatcaatggacatttggtttgcttccactttttggctaatgggaatcgtgctgctatgaacaccggcatacaaacatctgttatagagcttaatatcgcatcagatttatgctacaacaaatgataaatccacattggcaaaatgtcatcaaaatgtatacattaaatatgtgcaattttgtatatcaattatacctcaataaagctgaaaaaattaatacgggcaagagggagtgttctgcttatcaattgtgacataacaaaccacacccaaacttagtttgttaaaacaacaatgatcatttcttttgctcacaaatcggcagtttgggaggggtgacttgcgatatccgggatcttaactggaatgaccttcaccgctgagggctgaaacagttaggggctgcccagcagctccttctctccaaatcgtagtctcaggacctctccatgccattgcttcatgtggtttctccagcatgatgcccgttgagtaggtggatgcccacgtggaagctcaaggctccaagaagccagtggaagctactaggccactttggc

SEQ ID NO: 49937 - DNA, 1031 bp, Homo sapiens
agatttggccccagattactggattattttccagctcccctttccctgtttcagtgcacaaagcccataataccatcttgtaatcctagttattagtcctccaactcttgcttcttttccctctctccctttcacccctgtggcatggcttccctaaggtcagcttatccactagcaagaaagtatggtaaaaatggtttttttcctttttttttttttttttttttttttgagacagagtttcgctctgttgcccagactggagtgcagtggctccatcttggttcactgcaacctccacctcccaggttcaagcgattctcctgcctaagcctcccaagtagctgggattacagacgcctgccaccacgcccggctaatttttgtatttttagtagagacggggtttcatcatgttgtccaggctggtcttgaactcctgacctcaggtgatctgcctacctcggcctcccaaattgcagggattacaggcgtgagccaccgtgccaggctgttttttttactttttagtgggtaaaacttgcttttactcctgtctttgtatgtagctattttagaaattcttaaggaatgaaacaagttcaaaggagtaaagtgacctcgtgtttatctgtgcaatatgtttctttgcttctcctaaattaaaccaaatatttgaaaatgggttatgtgttgctatttgctggtgaagcttgatataaatcctaatttacactggttaggaatataagtttaatgcagtttatttccatagtaacataatatgtattataaatatttaaaaatgaaatataagtagaaaatgaatgagatgggaaaagagaaaaacattaattttcaatctggatactgattgaatggaaaattaagacttattttcagcagtttaatggtctgatagatatcttaagttgcatatttcttttttttttttctttgtttttgagatggagtctcactctgtcacccaggcgggagtgcagtggtgctgtctcagctcactacaacct

SEQ ID NO: 49938 - DNA, 1044 bp, Homo sapiens
atgtgtattgtgaaaaatctattaaggtaagaaagaggagtaagaagaataagaggagagaaactgaaatatgctttaatgttctttgtatattttcgattaattaatggcagtcttcctaacaacataactaactcagcatgtactttttgtattctaagattaagggctagataaattctggaaaatactcttttccaaagtaagcacattgttttatgaagatgcttcggttactaagcttaggggtcttttacctgtgctgtgaaattcgggctagtgttgaaaaaatattcaaatatatcagcagtttaagagctgttagaagtcaagggtcaattgagtatttaaaataaagtacgcttaaattgaggagtgttttaccagattaaaatagttctccttttgagacatgtatacataaataggttatcacatgaaaagtatctcgagttttcttagaatttatgattgaaaaattatttttatagatcaattttaacataaaagatgtagtttctgcccagtgtcttcggagatgtgacctgtctcacacttggttttcagctgctctgaaagacgactgccttattcctttgaggtgtccctgagggaactccaaagcgaattctgtatataccacctagtccatattttcagtcataccccaccctccaaagcatgccctgtacaaatgtgctgaaaattcatttggccatttttggccagatacaataacagataaacagaaattgaaatttattcatatattttggaatatgcatattcatttgggaaacaacaaactatgtcctatttggaccccattaatacaaatgaaatgtgggagaaaggtaccataaaaataaaagagaggtcctgaggcagggggcggggggaactaaaaagaatgatgattatgtgaagtgagatcaagattagagtctccaaagcatatgatgtcatattttatggtgagaagcagcagtgacttccattaggaataagcaagagcatgggccgggcacagtggctcatgcctgt

SEQ ID NO: 49939 - DNA, 3495 bp, Homo sapiens
ttcacagaacctcatacgagtggcgtctagggccaaggctccttgaatgcatacccaagggctgatgagaggtggggacgagtgctgccgaaggactcctcaactaccagaactacgtagggcccctaacatcccctcggagcgagctccccgcgccccgtacaccaccaggtctccctggttcctctcctgctccccgtcccgctacctcaggaaactttagcccagcctctccgatacaagccggcctccttgagggctttaggcccctcttcgccagtgtataccccacgacacgcctgcgtactagggaccacccggctttgtgggcggagtccatgagagggttggagccccgctcgtggccccgcccacccaagcctaggccggccttcgtggacacgcatttccggcgacgcctcggtactgacctctgcagagccgggtggagcccattgacgtccagcgaagcgaggagcagcgatggacggtcgggtgcagctgataaaggccctcctggccttgccgatccggcctgcgacgcgtcgctggaggaacccgattccctttcccgagacgtttgacggcgataccgaccgactcccggagttcatcgtgcagacgggctcctacatgttcgtggacgagaacacgttctccagcgacgccctgaaggtgacgttcctcatcacccgcctcacagggcccgccctgcagtgggtgatcccctacatcaagaaggagagccccctcctcaatgattaccggggctttctggccgagatgaagcgagtctttggatgggaggaggacgaggacttctaggccgggagaccctcgggcctgggggcgggtgctctggggagggtccgctgtgttactggccgccgccagggtcgccaccggcgccctccctccgcgcctccctccccctcgagccgccgcgatgtcccctgcgctcctgttccctcccgcgtagtgcttgcctttgttccaggaatagcgctccaggctcctgctgccgcccctgggcctcactctggagcgagccgccgccctctccttccagccagccagcccctcccatgtacatttggacgctgtcctgcgctccagctgcaagctgggctcctgttacacactggacagaccacccactgccgccgctgccaagccctctcctccccaccagactgccagacgactacatcattctgcccacagacctgcgctgccacagccatcgccatccatcgcatcccaccgacagactgctgctcctagtgatctggactcacctcggaggtatctgggctggccacagtccctggacagtgatccagacagctggccgccccccaagggatctgtcaccttcagcgagacctatttcctccccacccccagaaacctcttgtgttcttgcctaggcccaggtgttcctggcagccaaatcgagtctctcattttctcttgtggaccagttagttttgcccataacgcagtattctgagtttgcaactgtctctctgatgtgtgccttttgttcaacacagtaacccctgcattctgctctgctctaatacactacctggagaaagtcttttccttattttcaataaatgtcagacattattgaaaagaaatggtctcaatgaatatggcacttttccctccctggttctgtaaatggggtccatatcttgttcaaaagctatatgccctgccatgctatgactgatgttgacacagagtcctgtggtgtcctgcaaatggagatcttaccagtgaccaatcccagacgattaatgttgtaaacaagcagttttgtgcctcttaggaaatgaaccttaatctgaatgtggccaagataaggtaaggaatagtcagaaagggtgctttttcttccctcatttccaaaaaactgtctaaaagcatataccccaaatggttacaagccatacatctcacacatttgttggtgaacacctctcacagttttatttaacgcattatcagggaaccagctaagtggcttagatacttcagaaaaagcatttacatttatattgctttaattgggtaggtagtggagaaaggaatgcagaactgtagttaatttaggtacaaacttgtttaatgaatgacctgaaacacaatacaattaccaccttccctaatgggcagaaaaaaaaattatcttcaacatatctctgcatgctaatctttgaaatctactgtgctaacatgcctctgccaccccatctatctctgggaaaagctcaatatcccgatagattatcctaaggtgggcttgcagggcagcactcagtcaacaactctctgccttcttttttttttttttttttttttgggatggagtcttactctgttgcccaggctggagtgccgtggcatgatcttggctcactgcaacctctgcctcctgggttcaagcaattcttctgcctcagcctcccgagtagctgagactacaggcacgtgccaccacacctggctaatttttgtgtttttagtagagacagggtttcaccatgttggccaggatggtctcagtcttctggcctcatgatcccccagctttgccctcccaaagtgctgggattacaagtgtgagccaccatgcctggcctctctgccccatttctaatatgtgttatttttccagagcatacgaatgaggaataaatcacaagagtgttttttttgttgtttattttattgcttctctctcttcatttaaataggtgaaaatttgccattcagcagtgattcatagggcggtatgtggaggtggaggtacattattatctgtattaggtatgtgataatatttgtattcccagaagtagtggaaacatcacgaatttgtagtttgtcatataataggtcaaaatctttttgaaatcagagataaaattcaaattgcttaataaaataaagtttttatgatttacagggctcttaaaacactgaaaccgggctaatcatgaaggccaattcaaggtgctgacagccttcctggatgggtatgaagaaagattgtgttaagcatattcactgtttagttttaaacacagattctgctgaagtggttggaaaagtgcttggaagcagtttacattactgagtaggtccagcatattccctgtgctctctgtccactggctctggaggtaggtagaatgggcagggaccttctaggtatcctttgaacaatgtcagtaacccccaacttccctcaacaacgatgccccagcagttttcttcctcctacaagaatgagacttattccttgatctatgctagttttatcatctcaagggtcctcttttgtgctgcaaatgtcttgggtagggtaataattcacagtcatgaacatcttcacaggattccataaagggacaaaggaatggcatttgtaagagtagaaggggctcttttgtattactttgcagtctcaccttttcagtt

SEQ ID NO: 49940 - DNA, 1038 bp, Homo sapiens
agaagttaacaggttctttggtaaaaaagaagttgaccgaggtaagtaagccctcttgtgaccactcctgtttctcctttctcatttttttctgtccttagctgtaggtggctccctcccaccccaacgatttcagagagaaacaagtcggaatctgagaagtgaggctccagataaactgtaaactgctggaagggggcgatggctgtggccctgggttgtgcaatccaggcatccttgaatcaaggctctgtgtttcaagaatatgatactgactgtgaagttttccgtcagcgcttcaggcagttccagtacagagaagcagctgggcctcatgaagcatttaacaaactctgggagctttgctgtcaatggctgaagccaaagatgcgctctaaggaacaaatcctggagctgctagtgttggagcaattcctaactatcctgcccacagagatagagacctgggtgagggagcactgcccagagaatagagaaagagttgtgtcactgatagaagacttacagagagaacttgagataccagagcagcaggtaagaaaagaatgtgggatctttgtgattggtccaaaggaagtagctgaggcagctgggactagaccacacatttgtctctatgtcattccccagcctcaagatttctccagagtcctcttcctttttctcttctgctgaactcagcaaatgagtcagtgcttttaactctatcagactcaattccccttctataacaaatagtttataatgtccactttactatgcacaaatgaaattgatagacaacataatctacccacatacatcaacccaaagcatcagtaaattgctccatggcctgaaggccaattctagccataccctgtttatctgtatactctgtatgtaatggtttttttatcttgttgaaaggtcattgaaaaaaagaggaaggagaagaactgacagtgaatgtgccccacagtgcctaaaatatttactatttggctctttataaagtttgccaaccctgaatcaagt

SEQ ID NO: 49941 - DNA, 1063 bp, Homo sapiens
ataataattttttcccgtggagacatccaggtgtctcagcattatttgttgaaaaggctattctttttatattgaatatccttgaaacccttttcaaaatcagttgaccacaggacaggtatatggatttattgctagattctcatttctattctgttatgtttagttggtttatagtattttctatgtcttgtattattgatcttctgcctagattttctgtctattagtgcaaggagttattgaagtgtccaactactattgttaaattatctggttcttgtactatttctgttgagttttgttttatatattttagtactcagaaattaagtgcatacatgattataattgttatatcttcctgatggattgatatttttatcattataaaatgatcctgtatatcttagtaacaggggtttttttgtttgttttaatgcctattttgactggctctcttgtggttgctacttgtatgatatatctttttccatccctttacattcaatcggtttgtatctttgaatctaaagtatacctcttataaacagtatatagttggatcttttcaatccagtcagaccttctctgctttctgattaagtcatttaatgtatttacatttaatttcatttgtgatatggttggatttatatctgccattttgctttctgttttctatatgcctcaagtcttttttgttcttctatccctcttttactgctttctttttcattaagtaaatatttctcatgtaatattttacttactttaataattttactacttttatttctttagtggttgctctaggatttaccatgtacatcttatcattggtttcaaagttatactaacttaatgccagtgagatatagaaatgtttctcctatgtagctctgttctcttttccccctttttgtgatattactattatacatgttacatcaaaaatgttttaaacccaagaatacattgttataattattgctttatataattttaagactcttaagaagctgaaagaagaaaggaaaatacatatatattataacttttg

SEQ ID NO: 49942 - DNA, 1052 bp, Homo sapiens
agtgcagaaggcaaatgctagacacttatcaaacaaccagatctcctgagaacaccctcattatcacaagaacagcatgggggaaactacccccgtgatccaatcatttcccatgaggtccctccctcaacacatggggattacaattcgatatgaggtttgggtggggacacagagccaaaccatattatttcaccccagcccatcccaaatctcatgtctttttcatatttcaaaacaaatcatgccttcccaacagtctcccaaggttttaactcattccagcattaactcaagagttcaagtccaaagtctcatctgagacaaggcaagacccttcttatgcttatgagcctgtaaaatcaaaagcaagttacttacttccaaaataaaatgggggtatcttgggtattacagttgggtaaatgttcccatttcaaatagaaattggccaaaggggtccaggccccatgcaagtctgaaacccagcaggtcagtcattaaatgttaaagctctgaaacgatctcctttgactccatgtctcatatcaaaagcatgctgatgcaaggggtgggcttccacagccttgggcagctctgctcctgtgactctagagagtacagcttctgcggctgctttcatgagttggtattgaatgcctgaggcttttccaggtgcatggtgcaagctatcagtgaatctacctttctgaggtctggaagatagtgggcctcttctcacagcctcactaggcagtgccccagtggggcctctgtgtgggggttccaatcccatatttccattccacactgccctagcagaggttctctatgagggctctgcccctgcagcacacttctgcctggacatccaggcatttccatacatcttcttaaatctaggcagaggttcccgaagctcaactattgtcttctgtgcacctgaaggcccaacaccaagtggaagccaccaaggctttgggcttgcaccttctgaagcaatggccctagctgtaccttggccccctttagccacagctggagctggagtg

SEQ ID NO: 49943 - DNA, 1044 bp, Homo sapiens
ttgttctgtacttagatgtcagggaaagtaggcttaaattaaaatgaaatttgaaaaatttattaaacttataaactaatctaacaagacatatttgtgaagtgaatataggcttaccatgaagatagtgcaggttcaattcccagaccaccacaatgaagtgagtcacaagaattttttgctttcccaattcatggaaaaattatgtttacactatactgtagtctattaagtgtgcaatagcattatgtctaaaaaacaatgtatacaccttaatttaaaatactttgttgctaaaaaaatgttaatgatcaactgagctttcagccagtcataatctttttgctggtggacagtcttgccttgatgttgatggctgctgagtgatcagggcagttgttgctgaaggatgggggtggctgtggcaatttcttaaaataagacaactatgaactttaccgcatcggtgaacgcttcctttcaggaaagttttctctgaagcatgcagtgctttttgataacattttacccacagtagaacttctttctattttcttttattggagtccatcctcaaactctgccactgatgtataaactcagtttatataatattgtaaatcctttgttgtcatttcaacaatgttcacaacatcttcaccatgagtagattccatctcaggaaaccactttatttggttattcataagaaacaactcattcattaaagttttattatgagattgaagcaattcagtcacatccttagcttcacttctaaatctagttctcatgctctttctaccacttatgcagttacttcctccactggagttttgaaccccttaaagtcatccatgaaggttggaatcaccttcttccaaactcctgctaatgttggtattttgacctcctcccatgaatcacgaatgttcttaatgtcgtctagaatgttgaatcattcccagaaggttttcaacttttcccagacgcatcacaggaatcactatctatggcagctatagccctacaaaatgtacttct

SEQ ID NO: 49944 - DNA, 1034 bp, Homo sapiens
tcctagacacagcatgaagttggggcactggtggtgagaggcggaatccaaaaaaattcagaaatgacttggcctcattttggatttcataatgtgaagtattcatgattttgaactggtaatataatctaaatcaagattaccaaaataatttcagaggttgatgtggtaacctttaagcgaagtttctagaggtgaaaaggcagaatcttaaatggtaccattggtgtcactgggaggagaaattggggtgtgttactgtttaccatggcagtaatggggcaaacaataaaatgcaatgtgaaatgatttgatgatttgggaaataagattgaacgcaatttacttgtttgaatttgctgttacttgctcttcttatcccactctcttctgatttttttttactttctgctccttacttctctgctattttcattgccactttttaatgttccatgtttggttttatgtgcagcaccttgacttctaagaaatgaatcatgtccctttgccccttataactgaactttgagtattttaagatttattctattcttactgttgtgtattttgtttccttatagccattaaagaaagcactaaggatgatgggagctccaaatctgatatcagataatttagattgtggacttagttacagtgttatctcttaccttaaaaaactcagccaacaggtagtattggtaaaaacaaacaaacaaaaatcctttgccctcagaagtgcatttccttattctttagtgtaattgtaatttttcaaattaaatgtgtatatatctctacactttatggattagtaataatgtgattctctatggcttctagcttcaccattaagctgcagttaagggtctgtcagtatcatttgatgctgtgccatttctccttttgcctgccagtttgtcctacccgcaagctggttgatatggggcagaggtttaatagacttctctcatgggtcacattttgtctatcttcaacctagttcctcctcagatcactctgggctacag

SEQ ID NO: 49945 - DNA, 1023 bp, Homo sapiens
ggttaaatgccaaatgagtattataaagtaatgaactgatcagagatacttcttttatagagagagatagtatgatgtggtaattaaaggtacaaggctttagaccagaggtcagcaatttttttttttttctgtaaagggccaggtagtaatgattgttgatcttgtggatacgtagatctctgtcgctgttgcattttttttctttgatttttttttctttttataaagttttacaacataaaaactattcttagctctcgggccatacaaaaacagaccaagggctgtagtttgccaacccctgctttagaatcagacctagattcccgtcacactctgcccataggtatgtgtgatcttagacaagtcccttactctcttttaccatcatctatatgttagggatgatgatagtaggattactgtgaggaagaaatgtttttagactagtaactgacccttaagtaaatgcccaagaaatgatagctgtgctattattattattattgctgttacaactgcattttctcagattaggcccagaacaactcttttaattggtcagtctcataagtcaagggacaaatacagtctttttaagagaatcaaataggggctttgaattgccctggaaatattttctctttggtagctggtatcattaacctcatctaactctaggactgaagtagaaaaggattaccgattgcattttgtgaggtttctaagttaataaaaagtgatagagcaccttggtgttagtattttttgaaggaaaaacaagggtatctcttgtggaatgtaaagtgcaagagtgttagtctgggagtcaaatctggagttgacttggcgttctttagcctgtcctattttctcattgtgggcaatgggtgctgtggaccaaacagcctcctaacttaactcgcaagtccagttcgagaatagatgggattgggtcaaagtttctttctttctctctctttcttttctttctttctttctttctctctcttttctttc

SEQ ID NO: 49946 - DNA, 1033 bp, Homo sapiens
tggcatttgatcttgccccattcaggttggggagtgaagtgtgaggacccttttcccccgcttgctgtgaaagcacagattcattgactacagtacactgttgttcagaaaagaaggctgcaaatgacttctgagactttatgtcttttcttccagaccaagaccgtagaaggagtcacatctagccggcttagccaaagtacaggtgtatatagttcagggcacttgatttagatttggaggggctggggtgggcagagagcaagaggcgagtaaagagaatggtggtttcagagatctctcttcccaaatgtgtaaatattctataccagataagtttaaataagaaatttaattgctgcttaatttttgattatgtactttatctgtatagcaggctttgtcgtcagaagtttttatatcgatttaaattgctgctctttagcagccaaacaggagcaaaatgtaaaatttttgaacttactgtgtctaatcatcatttgttagtctgtagttaatgtcaacagttaatttatgaacccacgatcgttccacactgcaccaaagtcagtcataagagaaatcgaatattctggagcactgattgcagcagggtggctcctttgtgtgcagcaggtgtagtagtcttcattttcatggtacgttttaatattaattacctaagctgccatgcatttttttttttacagttctcaaggaagagcacagaacaatttctcatttcatatttggagtatgaaagtagattctattttgtaatgctgataatacctaaagatgcattgaatgcttggaagaatgctttttgatgttgattttgacctgttcatgattcagaagaaaaacaaacttttttggattttttttccctcaggtctgagtagcattgccttaaatcttatccagttagaacattgatttatttacatgatgttcagattttccagtgaaaaatacccttctgaacaaaacatgtacttactctccgaaaggcatctatctgtgctattgc

SEQ ID NO: 49947 - DNA, 1029 bp, Homo sapiens
tctcctgtgactgaaccctgttttcccactctccacctcctagttcccttcttccccatgcctctcctttctcccccgtccggtgccagcaacattggcttttataaccttatgggagttgaaccaaatattcctgcttgctcgaacttgaggccttatctttttggctgctttccccagcttttgcctactgaacttttttttgttaattgaactatctagttgtttggatttggggtaaaagggagtagactgtaattgttttttcttaaaagatcttttcttttagctcctgtgggacaagagcagagaaaggttcttttttggtcagtggtgtacttaattaagcagaatatatgacttttcgtttattcaacaaacatttgccgagttacctcctctgttggaggctccatgctaggtgtggagttatttggttgataagaaatggcttccacctttctggtgaagttatgaaaatgaaaaatagacagtgaatctgttgtgagtaatcaagaattgtctggagttttttggacagacaaaaaagatttcttgatgtttacattcagctttgtattactgtatagagtagggagaagtggatggccagcatcccttcctgcgacttaatgcatctctgatggcaaattgggcctccccaaaatatttttctggggtcaactttgaattatggatagtaatggatgatggagcccagaagagtggatagtcctaaatagtagctcgaataaacctttgaccttctacagggttgcttcctgagtgcctggagaaatcccctctttgtggatagtgccacactggtggttttcagccagggcgcttttgccccccggggtcactcaacaatttttgctagatgcactccactggcatccagttggtagagacagggatgctgcttaaatatccaacagcgcatagggcagtgcctggcggcaaacaaaattatccagcctgaaatgtcgatatgccgaggttgatgtaatttcctctacataatgt

SEQ ID NO: 49948 - DNA, 1026 bp, Homo sapiens
aagcccattgcaaaacctccaacttatatagtgtgttatttttttttaaatgactagattttctgaacgactgctacatctctagatggaagtcatggtcataacccatgaaaagggaaagctgacaggtagttggagaactatgctatagcctcttcctggcagctatgtaaagaagcttaagggtagctccttcaaatttctcctcttccagcttgaatgatcaagtttcaatgctaaaagaggctgttagtacccaccccccattattttacagatgaggaaactgaggctcaaaggggtcaagcacctaatgtgctaacgtcagagttccagcttgaatttttagattgtcttcataggtaggtaaattttttatttcctaaagattcttcacagtcaaaaactttttcatggcctgaccctcaaaagaacaagctattgtggtgggagtatactataaaggatactaaaaggccaagtataataacttgctaatttcagaatatgttccgaacagctgtgggcagtacaggaatttttcatgttatttgctttattgtaattgaacatttagtgatggggaacctcttggatgggtctagctctcagtttaattttctctagcctatgaggcaagtgccaaggcatatgaagtatgcctataggtacaaaaatgaaagatgacattgaaagagtctttagacatggtagcctggaagatcgcaattagggcttttgctccatgaaagtatttttttcctttataaagggagatatctgttgaaattgtgggatagagattttaaagattgcatctgcttccaaactaaggtcaaaagttaaattgtagtaaatgtgtgcagtgtggtatcattaaactgtacacacatacgtgaaattgttgttttaatctggcatcttttttttttttttgagatggagtctccctgtgtcgcccaggctggagtgcagtggcgctctctcagctcactgcaacctccgcctcctagcatcaaccgattc

SEQ ID NO: 49949 - DNA, 1050 bp, Homo sapiens
agtaaccaagaaacatgaggactcctgtctagagcctaaacatggggttccagtgctctagttccttctcgcttgttgtgtttcatcatccagagcccccatttctctttcttccgtatttggtggttggtagaggcatcttggtatataccacatgacaccaagtataaatatttgtttcagagcttttaatgaatgtctagcagtgccaggcagggaatgaattttcatgtttaaaggtccagtgtccacttaaggaacatcttaatggagctacagctcaagagcaagcccatttcatcttctgatttccattagataagcaacaaaaattggctttaaggtcatgagcctccttacagcagtccctctcaccttcagctgtattccctatttcagatatacttgtttctctgctgtaagtacacttttcttttctaattaggtcagttacttcatgtctgtttttcttttttgacatggtttcttctggctttggcaccacatattttccccatatgtcattgcctctggagcttcatgttgcaatagtttttcaaggggaacggagagcacattgctaagggtgggggatggcttttgcctcttttgcctgccctttgcttcagtgagtgttcgtatttctgttgggcctagttctgtttggttttgtagtcttcagagtcagttatgtttggactgaaagatacttaagtaaaaataatggcaagtcagagatatgtctggcaaaggtgcagcacatttgttaaggttactggtttatttatctcccttgtctctatggtgactaaatctgggtctgggatttaatggacttagttttgacctcttgtaacatctcctaacttttcccagcctctgatttagaaagaattcattttcacttgaggagagaaactgtctcacttagaaaaggggtcctaactggactctcgaaaagtggaatctctagtctttgattcttacacagtcttcaaccagagtacccattgtggttgtaaagaaagctaagaagtcatgtagaaatac

SEQ ID NO: 49950 - DNA, 1031 bp, Homo sapiens
gccaacaacagatgctcacttgtaagagagaaccatgcctgggagatgaatgttggatgctccttaacttctgagtttgaaaccttgactcacttgtcttataaccgtggacgtagaatatttgttagattaaggtcatagctaagtcatacaaattttattatgatcagtacagtaagcatagctggggtcaaagcttttatggaaatcacaatgttaaggcctgaagtccttaataatgcttgagaaagaatggcacttttatcatcatcattatcattgtcatcatcattattatcatatcaaccttatatcacatgttgaaagcccagtgtggtgaactgtgctaataattgttataatttatgtatttcattattgatatttcaattttgtttgaacaactgtagggatcaatttaaaataaaaaggaggaaatatataaaaatgtatttagaatagtagcctcattgtcttgtcttatcagccagataagctttgtgctttgtagagcatctctcactgaaggatacctaattattggataaacaattagttctttaacagttcttaggctgggtgcagtggctcacgcctgtagtcccagctactcaggaggctgaggcatgagaatcgcttgatcccaggaggcagagggtgcagggtgcagagatcgcacgactacactccaacctgggtgatagagtgagactctgtcaaaaaaacaaacagacaaaacaacaacaacaacaacaacaaaacccaaaccaaagaacagttcttcacctaagtagaaaagcagaaaaacaatggtttgaggtctttgtgagtctgtggacatctcttaaaccatgtgtgagaggaccatttctttttctattctttttttttttttttgagacatagtctcactctgttgcccaggctggtgtgcaatgacgtgatcttgcctcactgcaacctcttgctcctgggttcaaatggttcttgtgcctcagcctcccgattagctgggactataggcgtgtgcc

SEQ ID NO: 49951 - DNA, 1033 bp, Homo sapiens
tgtttatctgtaaagacagggaggtgcaatctaagttaggaaattggtgacaaatagtcatagaacatgggtcacctggcttcaattagttatgtgacctttaagaaaacaagtgcccgtttcagaaaagactgacctttgaggctagagacatcaagctactcctctacttttaggaaaaaacaatgacagggttaatttaaaactctgatgcagacagagttgaaaaatccatgacagatttatataacgaacgtggatggtgttttgttttcccagaatgcagttttaaggtcagacctatgactcagagctgtgcacttccctggtggtatgcatcagtgacatgttgccagtctaatcgtccagaagggcttgtgcccagctcggcttgctccattataatccccagctgagaagccacctttcattttttttaaatagataaggaagacagcatgaacatttgaaactcaaatactatatgtagtttataacttttcagcctgaagacttgatgcacactaagttgcctctttaattttgagaagtataatctccattgccactaatccatcatggtgtggcactgcatgaggatatgttgtgtgcattgtcagtatcggcgttttgctgagtttactgttttttagttcattggcaaggcatcgtgggttttggtgcaaagagcatggatttggaatcaaaagccacttcctctctgggtggctgattagctgagggtaaccttcatatagctggcatgggatttccagatggcatcctctctgcatgaacaaaaacaatgtgccatttcagtaaactttggtgggtgctccctcatccactccagatcttttcatctctttccttttattccctccctttccttgtaaatcaaaactcccattcctttagtgctgctgatctcttttgggggttagaagaaagcagtctgattaaactaacttactactgtttttagttggttcatcctatctttaaaaaatgtatatatttcaaggctgggtgc

SEQ ID NO: 49952 - DNA, 1068 bp, Homo sapiens
ttgaaccataatgcagttttccttctcttcaaaacctctacttctaaatggcattcattgtgttttctagtgttttttctttggtatgacactagttaacctgtatttcttaccataaagctaggactcaaatactaagaggtttgactcaccttaggtggaactttatatagtactttaacttagaaatatttggaatcaatttctgcttataaaggtatcaaaagcaagtgatactaaaacgagtaggttcaaagttgtatactaaatagagaccttggtaagagagaatgagggattttcaaatatggtccagaagatagtctctgaaaggctaaaccagcaatggttactagccatgcaggaagccagtgctgtctaatcttacaaattctgttttcctgccaaatggcatttaggagcaactgataatttatttcttgccacttgccgttactggagatttatttggtttctcaactcagcccttaacaagaaagcaagtctttgttgagggcacaatattatcagtatggcaaagctaagacgaggcttctgtgtgacactggaaagaccaacaagaatggattaaagagagtgattttccatatgctgtcactgggacaggtacttttctctgtagacacacaggctaaaagcagtttaaaagcttccttacctaaacagtacatagttcaaggagataggccctgtgtccattgcgtctctagtttttgtttctaacccattatataaagaaacatcccagtttgctttttagagaaaagttcaagttagaaccattctctggtcttgctaagtctcttaattgtgacacaactgtcctaagcaactgtccttgcacaagaatgtcactcatctgcttcatctgccagctccttagagatgaggggggtctgtgtgtcagcaggaggcagaaggccctgtggctcatccagtggcctgatttcctttgtttggaggcttggttctgagtgagagttcaacagcctttgcccaggcggcttctcaaacacagggtgtggtttccttagctcactctctgct

SEQ ID NO: 49953 - DNA, 1056 bp, Homo sapiens
gatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacggaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataacctgcctcctgtcttttcattctgcctggtggaatcgctataaggtgatactcctaatccagaaacctaaatgacttattttccttccaggatatactcactttagtgcaggcgcacagaacataggaattataaacaaacctgtaaaaaccacacttgattgataaataaataattaaaaacaaacagaaaccactctgacctaaaatagtatttcccagattttcacatccctgaaaaagaaagaaaacgatgaattggtttgatttggccaggggattagggagggaatccctgatgaagcatggcactgagaagccatcttggtccctgtttgttgggtgcttcctcggtgtgcctttccccttgtgccctctggagcctggggtccaggttga

SEQ ID NO: 49954 - DNA, 1102 bp, Homo sapiens
tccctcccttccctctcatctcgtcttcttccttctccctctcggctccaacgcctactgtttcggccccaccttcttatcttggctcctccccttcccccccttatcgactccttacccagtctctttttgttctgccagtgctctctcggctcctccccctcctcctttctcctggatgctacgccctctcccatctccttctctttcccctccctctcggctcctctccctacccctccctctcttctcctttaccttcctcctcactgctgctttttctagtctcttcccctctgctcttctgttttcctttttactgctcctcctccttcctctaagtccttcccacttccctccctattggctgctcctccacctcccttttggcttctctcctgcctcaactaactcctcccctcctccccaacgccttcggttccctctcagcatctgtaacccttcccttccctccaccctttccctcgtgttcttacacaatcttccattctggacacatacactcattgtggtctttcttaaatacatccccaccatgctgtgttacccctcactcatatggtctcacactcttacccccctaattcttgttaatccacttgggtctcctgggtcctttctctgcaaacatagtgttatttacttctagagatttgtgagaataaaatgagatagtacatgaaaagcacttacgacggcaccttgcacatagtaagctttcaataaatggtaactgtcatcattattacttttctttagccagggattcctggcacaattcctcttcagcgtgtccctcaaccaccagtaatttcttggctcccttccttagtagcctcgttgttttcattgtaagctgactcaaaaggaatttttcttgcaagtaatcaattcaaaaagtattaataaataagacttatgttctgatctctagttgcctaatctagggtgtaggggggtattctggtagaaggcatcacaaatgcacacaaagttgagaatggtgctggtgccatctgactatagacttagccaactttaaggttctaggagtttttaaaggctagttctaggtgcagca

SEQ ID NO: 49955 - DNA, 1055 bp, Homo sapiens
atttctcttgggcaaatacttagtggaattgctaggtcatatgaaaagtatgtttgactttataagaaattgcctaggccgagtgtggtggctcatgcctgtaatcccagcactttgggaggccgaggagggtggatcacctgaggtcaggagttccagaccagcctggccaacatggtgaaaccctgtctctactaaaaatacaaaaactagctgggcgtgatgacttgtgcctgtaatcccagctactcgggaggctgtggcaggagaatcgcttgaatccaagaggcagaggttgcagtgaactgagatcgtgccactgtgataagagcaaaactctatctaaaaaaaaaaaaaaaaaagaaacaaactgtccgattgtttttcaaagtggttgttaccgttttacatttctaccagcaatgtatgagaatgctagttttgttcacatcattgtcagcacttcgtattgtcagctttctcttttactcattcaaataagtgtgtactggtatttcattgtggtttgaatttgtatttctgtaatgactaatgatgcttaacatctttgcatgtttttatttgctatccatgtctcttctttggtgaagtgtctgttcaaatcttttgcttgttttttaattgggtagtttgttttcttattgagttttgagagttctttatatattctagacaaaagtcctttgtgagatatgtgatttaaaatattttctcagtgcttatcttcttaatatcttaacagggtcttttgcagaatgaaaggatttgatttggatgagtcctgtttatcaatttttttcatttatgggtatgctttctgtattgtatttaagaacgctgcctaatccaagatcacaaaattttcttctgttttcttgtaaaagatgcatagttttatgttttatgtctaggcctctgatccattttgacttaattattggatatatgtgagttgtggctcaaagttttttttaattttgtttatgggtgccctgtggtttcagtactaattgtagaaaagactgttctttttc

SEQ ID NO: 49956 - DNA, 1047 bp, Homo sapiens
ttgtatgtaactgaaggatccttcctgggactagctcattgcctttacaaaagataaaacaaaaacagaaaaccagaagaataaaatgagagtccagtgttccaaatcaactagatacacatcaatataaatccacagtgtcctggcaaacagcatgctttcattttctgtctcatcctagagctcgaatcctgattcatctcagcagagactccacaggcaacaggaaagattatggcattgaaatactcatttatacttttatggtagttcaaaatggtggtcttatttctgggcaagcttacagaccatacaaggtcagaagcataacttaaacgggtgctaagactcaaatgaaaaaaatgtaaagaaaaagaaaaacagaaaaccaaaaccaaaccaaacaaaaaaaaaaccctctgggaatagccagggcatttaaaggaaccataaaaatgctaatagtatttaaacctccctttttaaaaaggggattttttttggcttaaaatatttcactctgaatgaattatgtcaactgtcaatgaaagaatgttgctaatacagtgtggacaacttttgcaatgtaaatccatgccccttgtttttacatggtgaacttcaacctagcaattattacaacaaatgttagagtctaaagctcaaacacattttagcaattttgaaattgaactgcctacaaaccaaataaaatttacatcacaacaaacatttccgcctgactgtggggacacttgggccttcctcattgatctcaggaccttttcacacaggtgcttttcttttttatttttatttttcggagacggagtctcactcttgcccaggctggagggcagtggcgcgatctcagcttactgcaacctccgcctcctggattcacaccattctcctgcctcagcctcccaagtagctgggactacaggtgcccgccaccacgcctggctaatttttttgtatttttagtagagatggggcttcactgtgttagccaggatggtgtcgatctcctgacctcgtgatcca

SEQ ID NO: 49957 - DNA, 1055 bp, Homo sapiens
acataggaagaaatatttagaatgtgaaaacatgaacttggaggacagttacagatttgttaaacacatattaacattctagagtgtactttcaaaagggaaattgttgagacgggttaattgagtttatatataaaaagggaggttatgatttgtcaagtgagaagtaatttttctggccaaggaatgataacagctgaaacgaatctctcaaaagctaggaaatttggcagaggaatattgtggctaaacaaattcattagagcagaaaggtattaaaaacattttgagaagtggagttaaatcatggaaaaccaggcttccttattaagatgccagaaactgatgagacataaggtggaggttttgttttgtttgaaagagcttgaagctacatcaacaggagcaaagtatgagcctttggagagcagaatagctatacctactgaaaaagttgttagtagacagaagaaattgtaaacacaatttacaatgtaaacattgtagaaatagtaaaatgaaagaacaaatgactgaagttgattgagtaaaggccaaatcacttgtaatgagagatgaaaaaccatccaaaacaatgattgtaaataaaaaattgagaagagatgacaaatatgatggcataattaaaatgatagacttggaatggaccttgggagaacttacaacgaaagagctaaccagagattccctgaacagtagacctcaaagcctaaactggtaatatcgtagagtggctattaatacagtctctctctctggtctctgacaaaatgtccaggaggggagaagacagatgtaatttgtggagtgggttcagggataattttctcatcatagaggcttatttatttatttgtttttgagacagagtctatgttgcccaagctggagtgcagtggcgtgatctttgctcactgcaacctccgtctcctgggttcaagtgattctctagtctcagcctcccgagtagctgggattacaggtatgtaccaccactcctggctaatttttgtagtttagtagagattgggttt

SEQ ID NO: 49958 - DNA, 1096 bp, Homo sapiens
ttgtgttttattataccaagttgttgctagctctaccttattaaaatcttcagttttaaaggctgaaagatcaaaaagagataaaaatgtattaatgctgattgttaaccaaccagtaagtatttattaagcatcttctatgggcttggtaacatattaattgagaataaggaaacattaagatataatactatttttattgagttgattatgtgccagctatttgcacacatttatctcacttaatttttacaattgccaactgaagcccagagagattgacttgttcacagtcactcagccagtaagtggtagagccatgattcattcaaacctaggtttgtctgacctcaaagctcattctttcaaagtacaactctctatgtcctcctcaagaggcactttctcgagctagagccaaaccaacaactaaagggtgcctccaaaatctgctctgtagtcctctatttgaccaagtggactgctcttaactgggggaactaagactggtgcatgtaaagcaatacaatatcaccctcaggaataaaggatgacaatagaatatctctggtctttcccatgccccttcaacccttctttaaaaaaaacatcctttctgttttactacatgattctgggatacagggagtcaaggctagtgtaacctctggaataattccattacgttcttaattccagtttattttgatctcagtttacatttatggaccgaagaaagtggtaggttctgtaggagaacaggacacagtcatccctattctcaaggatacagaaaacttctgggtcctgttcttttactcagtgcaagtagttatagactaactatgggccttgtggtgttcagtattcttcgagttttgagtatcatactaaaaagtttcaacagaaagtctcctcttaaagaggtgttctattcccccagaggtaatcagaagctgcattctctggcattcttgtgttgtgcatttcacgtcctctggcatctcatgactgggttggtctctctaccttttcctgtctaactgctgcttgttttttgaggtctttctgcacaaagtggtttctggtcacgtca

SEQ ID NO: 49959 - DNA, 1031 bp, Homo sapiens
gtggaaaacctatctcagtacttaaaataatacatattttcctaaagaacagaggaaataattaatttttcttggttttgacatgtgggtcaatactaggagttgagtaagcactattaccattattccaaggggcttcactaagctctccatttttacactatcactacaatgtagtgataatgtaagtcactccattcctcctctccttctccctgcctgcctccctgctcagccccctcttctctaagagtagatgcaggtattattagagaaaaatgattatagttgtagacagctgctaatgctggtccatgtggcatttgacacagtcccaaaaatgggagaagaaaaaaagccaaatagagcacttcctttgaccagtgagttttatcatcaataagtagttggatgccttctgtgcaaataaagggagaaatgtttgccgagtacatttctaaactgacaatgaatagtagtattaggaatgtcatcaggctgagaaatctcttagcaacaactgaaaaagcgagactatattcactttatattgactttactgaagatgtactcacatcttttcaatggttccgggctgggaatagatttctggcttgtctcagaatcataaaaacttcatcaagtcaaagtgtgtattcagcaaccctcccagggctgtacccataaccattactcacaaagtctttcatcaatgcatgctttaaatggttaccaattgatatttataaatttcttactcctcctaaagaatggcgcagggagaatttgcagcaatatccaggcaggatattgaactggtgaagcattttacctaaatgggtattattaggtctctgctgtagtacaaaggaaaggaattctctaaacaagtctacaagggctctgcgagtggctcttataacttgactttggggctgctgacaggttatgggaatgccattagaagctgtttcactacttgattttctaaactaatatgagacattttgaagagaggtgcagggaaaaaa

SEQ ID NO: 49960 - DNA, 1025 bp, Homo sapiens
aaacacaatgttagtcaaggcaagtaaagcatatcagttcaaccaattgtctggtgtagtgacatcaaggcccaaggtcagtatcctctggtgtttgtgccaaagtatgcaaatcatgccgggacagtccagtttctctggtgggaaaccctgtggcttcctccctgctgctcactaccattctcgccagcagaatggtgacaaaccagtagcaataaagaggtgggaggacttgagcctgagctcccatggctggcaggcacagtatgcaagggaaacctttgttgctgctccaaccagtgttcattcagcattctcttccccaaactgtgacccagcacaccttggcacactcctttataaaactgccaaacgccagcataaagaaaaccagtggcagatggactggatactaacttttacaagcagtcattttggcattatgcatccagtctttgagtaattctcctccccaagattaatgaggtcaccatgggagtttgtgaatagacataggaggtgaaactgccacattcctttaactcctcttttttggctgtcaaatgaaattactcagtgtggctttagtagtgcccaaggcaatcacaaatttagcacacattacacatatccattgcatctcctctactgtgccccttattcaaagtggcatttgattgtattgagaaaatatttgttcttatgtaagcttccttagaccttataaaatgtactgtcacttgcaatataactgatacaaagatgtttacataatgtgacactgatctttttgaatttggaagtggcattaatgcataaccttttttccagaatggcatgcaagttttcattctacattttccccaaaacataaatgttcaaaaacttatctgtgcagttaataaactttatcatataggaaactttcagtgaaaagtaatacagcatgtcacctattttctttcctgagtataaggactcatttgtaagttttaaaattctcaagccatttgtctccctaaata

SEQ ID NO: 49961 - DNA, 1082 bp, Homo sapiens
tgagtggagcttattaaaaggttttgtgctgaatatcttgaaaaaccaccaattgtacctgatatatattttttaatatgtagggctcttagcttgattagtgtagggtacactcttgggatttctatgagagaggaaggtcaaaatcttcaagtaagtgactttcctattggcaaagtgaggattattaattcacggttaatttgagctttgctcttagatttgtacattgaatccagggtactcaaaagcggacagaaacacttttatttttcctgcatccccccaggtagatccaagtagacaactttttaactttcctttttctgtactatattttgccctactgaaatgtggtctcttttgcaagtacataaaaaaaatcaaactacttaaatcccctaaagagagagtatgcattcaggcagtgattctatatcctgagatttgttcatattcatgtaggcagaaaattccggcacgacaacaaggtatccctctaaaatacgtatatggaaagcaattagtgtgactttgagctgacaaaacactcggtgaatagcagaaagaatatttcttggtaaggccttatggtagaaggtgatagagagagagagagagagagagagagagagagagagagaggaaggaaggaaggaaggaaaggaaaggaaaagggaaagggaaagggaaaagaaaagaaagtggccaggcgcgtattggctcacacctgtaatcccggcactttgggaggccaaggagagcggatcatcagagatcaggagttcgagaccaggctagccaacatggtgaaaccccgtctctactaaaaatacaaaaattagctgggcatagtggcgggcacctgtaattccagctattcgggaggctgaggcaggagaattgcttaaacccaggagacagaggttgcaatgagccaagatcacaccattgcactccagcctgggcgacagagcaaaacgctgtctcaaaaaaaaaaaaaaaaaaaaaaaaaaaaaaaaaaaagaaatagagatttatatctggtaaaatgtcaggtatttgttattaggtcattttga

SEQ ID NO: 49962 - DNA, 1058 bp, Homo sapiens
aggagaccagataatttttgaccttgtaggctaggctaaagagcgtaatttttattctgtatacagtggacagtcactagaaggtgtagaatagagtagtgataaaataagatttactttctttttgaaaacccaatatttatttcttccagctttattgaggtataattggcaaataaaaattgtataaagtatgaaacatgtttttataaatgtatatattgtgaaatgattaccatagtcaagttaattagcatgtccatcacctcacatagttacctttttttgtggtgagaagatttaagatgtattttcttagctaattttaagtatacaatatagtattattgattatagtcaccatgatctacattagatttccagaactgactcattctgcataactgaaactctgtaccttttgactaatatctccctatttcccccatatccctgcccctggtaaccagcattgtcctctttgcttctttgagttcacctttttaatagaatccacataaaagtgagatgatgcagtatttgtctttctgtaccttgcttattccacttagcataatgtcctccaggttcatccatgttgactctaatgataaggtttacttattttttagggctaaatggagtggaatatatatggagtggaatattattcacttatgtttctccagtggctactgtggggcatatatattacatatatatatatacacatatatatatacacacacatatatatatatacacacatatatatatatacatatatatatatatctagcattgtgctctttgcttttgcttttttgcctctttgcttctttgggtatatatatatatatatatatatatatatatatatataaaataaatgtataaatgtaaggtatgaaatatatatatatgccacattttctttatccactcatcatggagggacatctaggttgattctatatcttggctatttttaatagtgatgcaatgtacatgagtgtccagatatctttttgacttacttatttcaatttctttggaca

SEQ ID NO: 49963 - DNA, 1049 bp, Homo sapiens
cacctgggaataaaactcaggtctcaaggcaagttcattgttccattttattacactgcctctgtctgtgccctgcctttgagttatctagagactgacactgtgttatggaaggttatttcctaagtaggaagactgcagctacataatgccagtacatccctcataggtcaattgtgagttttaagttagatagtggttgtaaatgcctctcacattccttacacctaacacatattctataatctccttgcacatcctagtactgatcatttatcttattttattgactctctgttctttattttgattcactttattacaaagtaacaaacatctctttttaccttcatatctttgatctcattccttagtcagtgctactttccttagctttctactttcactgactgctaagctgaatttactgcatgaattctaccagttggaaaaaaaaagcatggaataaagccctaatgaagagataaagcttgggagcctggaggacataagacatcaatgacaggaagtctgaggagttcctatgagtagcaatgagcagagttcagagccaaggtgaatgctaagcagacctataacactaatatgataaatgatgtaataagaaagtaatgatcatcttttccaaattaatacatcctgcaaagcacctacactataaagacagcaattccattcttgaggtttatacctgaagcttagatggggtctatgatagtccattttaattgccaacttgactgggccactggctgtccatatatttagttaaatattatgctggtttgtctgtgaaggtgtttttggatggatttgagtgggtagactgagtaaagcagattgccctccctgatgtggatgggcatcatccaatcaattgagggcctgaataaaacaaaaagagaataagaattgtttctccaccttactgattgggctggggcatcagtcttctcctgcccttgtactgggacttacatagtcagcactcctggttctcagatcttaaacatggactcgaatttaca

SEQ ID NO: 49964 - DNA, 1028 bp, Homo sapiens
atgtataaagttttgtatatacaaatttatgtatataaaaggctttatatatataaaacacttgattgcttcgttctttaacaaccataaaagtaccccaggacatcaaaatagttttttccacagttttggggaaaatgggtagtatacttaaagggctttggcagcatcatgctgctaaatgtttacctgcatggcagttaaatggtctcaggtgaatttgcttttaccccctccagaagcaggacaattgtaggaattttcactgcaagcttcacaatatgcagcacagtatctgagcgcagcagaactgtcactctggagtggatctgaagagcagtcaaaggaaagctaattgctttaccttaggcttgttcagttaactttggagaatatttccatatttgtgtttgaaatcacaacttgtcctctggattgaatcctgaggagaaagtcattccccagtctgtttttgctgacaatatgctgactcatgacagcttcatatctggacagtattttcatcccatgtggctgaatgggaaaatatgaagttcaatatggtaacttttaaacaaagaaaaattctggaaagcattttgcttctgacacttggattcacttaatccatcatccattcactcattcatttccttcaaaacacatttgttaagtaccaattacggttcagattttacacaagatgttgctgatatgacaaagaatacaaaaaatcctgccttagtgagctcagaatctagtgaagaaaatgaaatatagagaatattaatacaaagttataactacagcagcaatttttaaaaacacaacttaaaaaaacaaacagttatccgaagctggatcttcaaggttcttcacagaaaagcagagtaaggcccacagaggtttaaattgcttccttcctggaagtgaaatctcagggttaagaacatttaaaggagggatagattagtctaccttgggtgttcaggagatggaccgtctatgaggagaaggaattacacaaa

SEQ ID NO: 49965 - DNA, 1020 bp, Homo sapiens
ttgacaccccagaaaaaagtctatgcatattaatacatgatgtggttggcattataactacatgaaaaaattggcttcccttgtgataaaagcgaaagttctttttctcagtatatctaaaatgaatgaaagattcttagctgtatgtatgtttaaaatataatttataattattagaagaaaacataagggatatctttgtaacctcatggtaggaaagaagctcttaaacgtgacacaacaaagcacatattagaaaataaaatattgatggagttgactatatcaaaatgttaaaataattaaaaaacagaaagttataagacaagccgaacttggagaagttatttgtgacattcgctttaaaaatttatttagcaattgcaatataaggaaaatcaaattcatgagacacaatagaaaatggccatcttgcagaagaggaaattggaatatctaagaaaaaaaaaacacaaaatatgttgaacatcactagcggtctgaggaaaagaaaccaacacaataatctatcagatttgaacctgcaccccacaagtgtttatgagaaggtggttaaacattgctagtataagtaaagaagagcaatgtaataatagacccccaatgctaaaacaatttacattttaaatagaggcaactactatcaagtaaacaaaattaggtacttgattgatttaataaatttctgtttgtgattgtttcatgttagaaaaaaagagaaattagactgttcaggaatacaaagggatcagctcaacctacagttttccttttattaaaaaaaaatatctggaaacatccctgtctgacagctttgaagagagtagtggttctcccagcacggagtgggagatctgagaatggacagactgcctcctcaagtgggtccctggcccccaagtagcctatctgggaagcacctcccagtaggggctgactgatacctcatacagctgggtgccccccgagacgaagcttctagaggaaggatcaggcggc

SEQ ID NO: 49966 - DNA, 1023 bp, Homo sapiens
gggatagaaaagaatgtaatagtatacacaatatctgaggcctttacaaggttttaggagagtggtaattataaggggtatgaaattggatggttttgtggttattaatgatgcaccggagaaaaacaagcaaaggctgagtgtaacgaattcccaatttaaggcaaaatagaaaaatctgagggattcttttatataaagaacctctcatctcctgcagctgaagggcagaaaaagctgaggttatgaatcagaaattatttacaagggtagagtagctcaagaagcttgaatgcatggatgtgagggtggtctggctgtgacatctgtcaccccattgattgccagggttgattcggttgatatggctggctaggtgggtgtccccttcctgcctcaccactccatgtacatccctcctgaagctgcttgcttggtcaaagaggacaaccatccctgatagaggaggaccggtcttcagtcaagggtatacgagtagctgcgctcccctgctagagcctccaaacaagctctcaagaagattgaatgtttaatcctgattatgttagacagaacaatcacagagaagaagaaaactctgaatcttgggatggggccatctgtgtcaatatatctgcaattcttgattcctcgggttcccttgaacccactgggttggcccagtgtctcactgttgtctgtcaaaatagcatacattcttttcttgaagaaagtgcacaggtttttgctttgtacgacaatttagagtcacaattaatctccacccaccttctggccaacagaaaaataactaaggtgaagtcataacataacttggctagggaaagtactgggttggcaaaggagggaaagggagcatatgctgaatgaactggagatactaaaagaagggtataaacagggctagaccctggagatgatgactcaaagggagggaaaatgcagatggaaggggtgagtttatcaatatggaatggatctcttaggattaaggatttaaaa

SEQ ID NO: 49967 - DNA, 1050 bp, Homo sapiens
actgtgttttctcccaagagttttataattttagctcttatatttaggtctttgatgcatattcattgatttttttttgtatgcagtatgaggtaaaggttgaaacgtattctttttgcatgtgggtgtccacttgtcccagcttcattttttgaaaacactatactttccccattgaattgtcttggcttctttgttgacaaaggatttattatttctgccacaacccagctgtttctcactgtctaaacctttatgcctgctgccccgtaggcttagtggaatgcctctccatcctccactctcttttgtttagctagtacttccttatcctttaaggggtcagtaggaacctcaccttcttcagtatgttttcctttgtcttatcaacctaccaccatcacccacacacataccttttccctaaggctgggataggaacctcttaggcaatgatctatttgataagtactcactgagttcatactagacactctgcagtatatccgtaaatgaagtaaaacctgacaccaccctcagaaaacttactgttagtgagaaaatgggctataataatagagtggggtaagtttattgtagggataagcataggatgctatgagaatgcagaggacaggaatttaacctagacttctcagttctcccgttgaagttgacatctgaactgaaatctggaagaccagtaagagatagctatgtaaaaagaggggaaggacaataggaaagaaggaatggagagaggcccagaaactacagagtatggcacaagtagtttagcattgttgggtcacaaattctaaggatatgaaagataaagttgaagaagtggtggggctggggaggacagctcctgtagagccttttacagcgggagaaggagtttggctatggtcctgcaggcagggagaaaccactgaaggggagaaacatacagaataaatttgagtaagaagcttaaatctccccaagcccttttaaaataaattaagatataaagcctttgggtttctttatgctttgtcctattct

SEQ ID NO: 49968 - DNA, 1475 bp, Homo sapiens
tttcttaaggccatggaggtctgtttaattggtctttgctctcattctttcttgatgtccctgtgttcatgattttgtggttccttcagtgattctctcataacttttagcccagagctgcctccttactttgattgtgagtattatgaaaatatactcatatgcctcttaaacatcgaattattcttaaatgatctatcatacttttggctaaccatttatcagtgaattatcaatgaaaaagaacgaaccagattaatgaaccaggactcaaaaaacatgacttcttgaaaagtcctagaattattttatagattttattactctagtctaaaaaaaatgggtattgcacttttaaattatttatgctagttgtattcattcattcaaattatcaggtctgttgaacaatgagaaactagtatgcatgcctatctttcttcactactaatattaaagagatttacatgttcctataagaaattcccatttttcaacatgagccactaatacgtttggttttcattaatggcatgctagaactgaacactaaattttgataatggtatttaaagacagtggttatccacaagtttgggatgtcagtgtaacttagtttcgtcatcactggatatttacaagtgctcatcataattgtggatccagatcacaaggtcttacggactctggtctcatgttagctttcagatgcttactaagtttttaatttttgacattttttgattattcagtttaactactgtaccaacaatttttgattccttaggttttgagggaggtgtcattttaatgtcatttcaacagaggaatgtttagaccacagtacctaatgatgttataaaaaatggcactgtttccagaaaatatatactgataccttttaataaaaatgaagcgaataaaattttctataaagatgatatttaaacatttttttacctaaataagtaacattgagtttgtcagaccgagtgagctggtttttactggggaacatttgacctgcttcttagttattatattgctgatgtcattggttaactaaggcagccttgtgataagttttcagcagttaccttggaaaatgtcaacaagttctttcctattaacaaaaacatataaaatgtcatagacctttagtaacctaaaaagtacttaggctgtgagaggtattttctaaaacctgttagttttaacctaaaactattaataatttatggacccctcatatacagggtcaagataatttacatggctggcctaaatacagttgtcgtaatagttgataaagtgtattcatcagacgtccatttctcttcagagttcaaggcagcttgcctcgagatttcatgaacagtttatcgtaagagaagatctgatgggtctagctattggtactcatggtgctaatattcagcaagctagaaaagtacctggggtcactgctattgatc

SEQ ID NO: 49969 - DNA, 1025 bp, Homo sapiens
tgcaatttctttttcagggtatggtaccatttgtttttgtgggaacaaaggacagcatcgctaatgccactgttcttttggattatcacctgaactatttaaaggtgagaacagaaagaactttaacttctaatccttttgtactaaaatatacaaactttatagtagatctttcagcagttaggactcattctagcctgtgcaaaacactgtatgacttgtcaaaggtaatagagaaaatacgttgtttggcttataatttttttaaaaatggaagtctttataaatttaagtaccaatataccagttttcaataaaattttatacttccctttattcttctcttaaacccttacactcagtttaggcaatcctgtacatagcctgttaatccatttgatcctttctagcattttggttttttccagacaaaaatctgtgtctataactcttgcctttattgttccttttatgtcatttatcaaggaaatctaagcatttcatgaagttctttgtttaaatgtttaccctatttttctctttactgttattcaaaatacaaactatttgtgtcttctcataaatgttcagtttagttagtgtgatgcggttatgcctccttaaaatttcaaactggaagataggaacgaggaggctacaaggtgtagtggagcaagcactggatgggcaatgcagcaatttacttataagacttcagcaaatgaactagctgtgtgactttaggcaagtcacttccctacactagatgcttcttgaaattccttttggccaaaatgttctatactttaatgaaatggaaactgatctacttcattttcataatgttttatttgtatccatacatatcaaaattataatgtagctggtattaaatgtttttaaaaagcatttcaactctatttatggcattaagaatttttttgctgatttcttgaaagaaataaaaagtacatgatttctgcttgtgtgtaaataagaatgaaaggaagaaaaagtgtaatact

SEQ ID NO: 49970 - DNA, 1048 bp, Homo sapiens
caaggcgggtggatcacaaggtcaggagatcgagaccatcctggctaacatggtgaaaccccatctctactaaaaatacaaaaaattagccgggcatggtggcgggcacctatagtcccagctactcaggaggctgaggcaggaggatggcgtgaacctgggaggcggagcttgcagtgagccaagatcgcgccactgcactccagcctgggcgacagagcgagactgtctgggaaaaaaaaaaaaaaagatacaaatcaaagtactgaatccttggtaacgagacatttaaaacacatgcacatacccactacttaaacatactttgaaattacaaccatttggggatgtttttagcatttgtgcttgaagtagatcaatatttgtagttgttttagttccatttgtcactgttaactttcatttgtacctctggaattagcagtgctgtattcagcattggcacttaaaatattttatagctcttagaacactattttttaaattacattgatctttatactctcctaggattccagtccttccacaaattattatatgcagttttctttatactgttccattcttcagacagagttcaggttgtaggatcatctgaattttcttagtgaaatacaagccagtagaaaccaaagctcgtgtttttctactgtatgactatgggagctctcagtatagagaaacttgatcatacctgtgatagatataaagatgtaaattaaagtctagttagtgagttatttgagggtaaagccagaataggaaaacattttgtttctcttttcctgggcttcacaatctttggagaataactaattttattttaactctagtgttagaggcatgtatgtcttctggtaatcagtaatagtaattcattttacctgtttgtttctcactgttttattctacttagaagaagacatgataggattgtgagtttttctctaactttggatgcagtgagatgaccagtgtgttccagttaaagaagaagagtgttttaaaatcataaaccaaataaaga

SEQ ID NO: 49971 - DNA, 1032 bp, Homo sapiens
cataataatcctgcaaagtacaggtactttgtctaagaaacattggaagcaggttaaatgttttgtaaactttgaaatatatggtctaatgtttaagcagaattggaaaagactaagatcggttaacaaataacaacttttttttctttttttcttttgttttttgaagtgttggggtttggttttgttttttgagtcttttttttttaagtgaaatttattgaggaaaaatatgtgaaggaccttcactctaagatgttatatttttcttaaaaagtaactcctagtaggggtaccactgaatctgtacagagccgtaaaaactgaagttctgcctctgatgtattttgtgagtttgtttctttgaattttcattttacagttacttttccttgcatacaaacaagcatataaaatggcaacaaactgcacatgatttcacaaatattaaaaagtcttttaaaaagtattgccaaacattaatgttgatttctagttatttattctgggaatgtatagtatttgaaaacagaaattggtaccttgcacacatcatctgtaagctgtttggttttaaaatactgtagataattaaccaaggtagaatgaccttgtaatgtaactgctcttgggcaatattctctgtacatattagcgacaacagattggattttatgttgacatttgtttggttatagtgcaatatattttgtatgcaagcagtttcaataaagtttgatcttcctctgctaaattgatgttgatgcaatccttacaaatgattgcttttaaaattttaagctaggaaaagaaatctatagaaagtgttctgttacaaaatgtaactgttaccattggaaatttcacgtcataggaagttagcctttatctaccaactttcaagaacttgtttaataaagcgaaaaactcaaccaaatggtacaaaaccacagtgtaccattaaaatatgcactaagtctcttttttacaaaggctgtattcagcaaggcgctaacttgcttaaatgtgaat

SEQ ID NO: 49972 - DNA, 1033 bp, Homo sapiens
tcccctcaaccccagtcccatttcctagagaagctacttttagcttttttaatgattctagaatatcataatactaaaaatctggtgttctttcttgctgtttcattgttagatagtacatattgacagtattttctgttgctcttatatatgaggaatttaggaaactacactcactgttttccagatttcatctcaacttcctgattttattagttatattatttttaaaacagccagtgatttcattttcaaatttgaacaatgtatatccagctgtatttcgtgtttcatcaaattttgacactatttatttactccctactttgtaaacaaaataaactaacacatacacacatatcccacgtctccttctctccttctgcctcctgttgtctcctacatcattactcttatgttgtcaatgtttgtaacatttacagcgtattctgtaactactgatttgaaccatatgaaattgtaatttatgttcgtcaaaaatagttaaatatcagcaattttatgtggttcattccatgtttgcagatgatataatcttatatttggaaaaacccagggtccaccaaaaaactattagaactgataaacaaattcagtaaagttgcagtatactaatacaattatgttttctgtgcttgcctatagcttgattctaaaagttgaaagccaatagacattcgtagtattagatatatgtatgtttctcatgacactaaattttcataagatctatggttttaaatagcatttaatgactttcataaataaattcccagtctcaacctgttccctgtaatacagactgctatctaactacctacttacctgtgcattctaacatgctatctcaaacttaacgtgtccaaaacatctttttctctttaattttttatttataatttttgtgggtacatagtaggtatatatatttatgggatacatgaaatgttttgatacaggcatataaaatataataatcactgtctggggccaagatgactgactacaagca

SEQ ID NO: 49973 - DNA, 1133 bp, Homo sapiens
ccctcctctttcactatcttttaaattcctgacatttattcatataaacagttcagtagttactgttttatttggttccttgaataggtctgacagcatttggaaaaagacagcttatgatgtgggcatcatggtcttatttcactgtcatccttttaattgtattacttacatctgataaattttcagattattttctaccttttattactgatctaggatacttatggcagtgttttgaaaggtgagaaacacaacactgctttctgaattttttctaaagactatggtgcattttatgagataaatgtttaaaaggttgttatgaatgagacagcctacactgaatgactgaggagactggacagaatgaaaccttattttaaaggaaaaataagccatttttaccttccgtaagtttactttgaaaggtaataaacaaattgtttcctcactggaaaaaagggaggaaataacatattcgggaggcagaggcctttaatatcttgcaggctgtttgactgtattctgaatttcatgtccaaaactgtcgttgctaatgtagacttatgaaccatcatttaaaaaaatccaaggaggcatcttgcatttaaattgtagaattattagaccttaattttcaatgaaatgaaaagacactagcaattctagctgttttgctttagctaataaagccatacttgtttctatttccagtgtcttatttccaggaagactgaattttcataaataggcaatggataagcaagccttcttagctttagtactgatactttgtatccctccattatttattaactggacaattaaggccctctgtgagatacattttttttcataatgatagtctcccatttaaaaatagagttgtaaaaatcataaaagctataacgatataaaaagaaatgtgatcaatttttatgaatcagtgtgaactaatttcagtggtgtgcaggcaaaatggtgaatgcagctatggctcagttctcgtgcaatgtatgatgtgtaaagaagaaaggagaatctcccattggttctttgcaatggttgctcctgattcatgtcccagcagtggtataggatcttagaacttcagatctgtaaaggtcctt

SEQ ID NO: 49974 - DNA, 1092 bp, Homo sapiens
atccagtataaagctgtgaagcagccacagttggtgtctttcgttagtaaaaatcatggacatccttcaggaaagcaaaactaccctctcactgctagtttccttcttcatagccaagacgcgagaaaaaataaatgtctaaaaattagagatctttcagctacgccagatgcctttgaaaagaaacaactcagtcattcaaacagcctgattttatgaggtgacattttagattatgatatgacattgcagatttgacatgattgtgctaattgtgagaaaatatgctactttgatcaaactagaatgaaggaaataaaaaggcactgtggctcaacttgtaataaagagcagctcatcctcacagctttgtgattgttgctatagttatctattcaacatgggatgcacaatacagttaacgtttcattaccagtagcctgttgcgtgcttattgttaaaaggaatttaacatacaagtttttgtatgttttgttcgcctaattctgattcctcgtgctgactggcatgagacagggagctggattgtattaaactggttttattgtgatgtgactatgatggatgtgacaagggcctctattattcgctggggagtgtggccattaatgaagccattagctgagctaaggcaagtgaagaaaatagggaaattaccactattctgaagccattaagttgtaatccaccactttctctccttactcaaaaaggcatcttctttttaaggcctccctgactgtcctttaaagattcattaattcattaactttccaaggagatgggggtggatagcatagttgaaattttaatcagttcagtgtatcatattattaacattatggcagtgtctgtgctcattgctggaccacatcaggttaattttaaacaaaccacattacagcagatgtctttctgttctatgcataacagaagagcttccatttgtagagtactttagatttcaccatgctcttttatgtttggttgatacccagggcaggcactatgtacctctgttatacagatgagtgaactgaggcttagtgaggctaaaataacctgagggat

SEQ ID NO: 49975 - DNA, 1041 bp, Homo sapiens
atagtatttctttctgctcacaaatatacactcttgatcaacaagagaacatttattgcaatcttgccttgcagttggcagagcagaatgaatcgttttgaaatataaacttcctcagatctaaaatatatcacaggaaaacacaagacataaggggagtggattatgaaataaaaggagcatatttcgtaatctataggttataatcattaaagattgccattagtaagatgctgggccaaatgtgtaagactacatttggtaagcaggtatgaaaagctcatgatttccttgaaactgttctttggaagcaacactgcattgtggaatggtaagaagtggccccttactggctgtgtgaccttgggtaagtcactttccctctctgacttcagtttcctcatctgcaaaatggtagtagtaaaaatgatggtgatggtgataatgatcatgatgatgaggaggaggaggaggaggaacagaagtaggaataggaggaagaggatttctctatctagggttgtaaaatttagataagaaaatctagaaaactctgcatatagaagatgtacaatgtgagtcatattcctttctactttccctaagaacaaaccatgttagtacttaacatttcgcttttaccaagcttttagcggtcgtttctttgctattcaatgagaactgaagttttgctgaaatatgggaaaagtaaccaaacatctctaaaaaacaaaacaaagcaaaacaaacaaaaatacaaggagtaagaaatatgccatattttctagacacattttatttcagttttttcccctgggtgtagagttagggtgcaaaatctatcaaattcttctattaattttaaattaagaaatgtggagatttgctatgttagaaccaaagctttcctgattctctgaggataactgtgtgtgtgtttgacctctagagctgaagtcacggtgttagccccttgtgacattagtgttcagaagctctttctatgcatggataaatcttggttgtctagcacaggttgtg

SEQ ID NO: 49976 - DNA, 1037 bp, Homo sapiens
agagttttagagtttggtaagattgaacgattgactgccaatgccttccacacacaaaaaacaaaaaagtattatatgtttgcatcaacactcgttcaatgctgaaatacagctagtcaaaacccatgttaaagtttttcatatattacataacaccgctgtataatacattaaaatacatactggattggagataaattactgaagaaataccagatttcgtttgtaggttttaactgcaacataattcattgtgtgatttacataggtagacataagtacatttctttccaaactatatagcaatatacgtataaaagctataaagtaaaaaaagcaaaaccatactagatgactgctaagaaaagatgaatgttaattttttaaatagcaatctgatagtaattttaaatagcaatctgatagtaaacatgatacaagaggaaaggttttactaatagacatttaaaaattatgtcttcataaatcaagaggatatattacttagagctagaaataacagtgccgtgcttcctgttttgaataagccattatgcatttttgtctttgcatccctatttaatttgtacagtgttatttattccaataattagtgttaactttcttggcagtaggcgttataattacctttaaaatttaaatgggataaaaatgccttgagaacatggtttaggaaaactcttaatatttattttcacttgtctctttaattattcatttatgtagtatttgaaagaaaatcttgagaaatggaaggccactgacagaattacttcccagatgagcagacttggtttttcagttggttgggtgacattctggactgttgaggcattagtgatgccaaatggaagctctactacccattcaacattgccaatctaaatacatttcacttagaacagcacaggccactttttcttattctctttcttctgaaagtaagtcattatttaaaataagccattattctgaaaataagccattcacatgacttctgatttcaaatatacata

SEQ ID NO: 49977 - DNA, 1110 bp, Homo sapiens
aaaaagaaatctttttcaaaacattatacttgtgatttggtttaccaatagttaacattctatattttttagcaaaaacatattaaaaatgttcctaacttgtattatttggatgtgttttttttcttgtactgagaaattccaaaaactttacttggatagataaatacctaaacctcatgtctttggtagagtatatcagggaattgtggtgctcaggaaatggcagatactattctcattattattattgttagaaggacaaatagttctagagtatcaggaaatgagagtggatatagcgtggtaacactcttgtctgaggtgacctgagtagagagatcaacagaggactttgccatcatctagctgatgagttgtgtggtcttggattttcttgtgttggttacacatacactgagcaggttgcgtctaccctctgagctgactttctcagctgtatcagagggagaagtaatctttgctttttactttctttaaaaggctgtgtgactatgtcctgaggttgtggattgtgagtgctgtgtaaactgtgaagtgtttcgtgcttgcaagatgagggcttcatacatcttcagtagagctccccagatgcttttatctgtgcaattaaaattacatatgtgttcttttcaatttctatggttgcaaaaatgaatgtatcagtctacgtagtactcaatgacagaatggatttacttttaaaataccatgttttgagctctagctttgcatatttatgaacttctggagttgtccatgtggatgtttcctatgctaccctgctttcttgcgaatgaagaggtctgaaatgcttctggagtacttctatgtcagttttgcttatatgcatttaacatgttggtcttacaggggagacatgtcttttttaagtataaagtacatatttctggcctttttcttccttctctattgataagttgtaactgcagtttttgtttgtaggctttccaagcctggtgatttttcatctgattcaacctttctcttgacaaaacaccagcctcaaatgctttgcccattcctggtcaaggcttagacttgcacccttccctagtggcaagagac

SEQ ID NO: 49978 - DNA, 1183 bp, Homo sapiens
tgtaggagaaagcacattacaggataagagtgtgctaagcaacctctagtagacagggcttgttctctggagaaatctgcctattgtgattgtgtgggcatgtcagtggacatgaggagtttctgattagaaagcccatcttgtcctgggtagccaaatagcaggtgcttaaaaaatggtggtattgacagccatcaccatttcttaactaggcctcatggattctgcctagttaatttgcctgctttctctgacatgatttatttgttcactctccgtgcatgttgcttatttcaactggggttgctgtaacaaagtaccgtaaactagaaggcttataaacattaggaatttatttctcacagttccagaggctgagaagtcccagatcacagtgccagcagatttgatgtctagtgatgtcctcttacattcttagtatcttcttgcggcaatcctcatgtggcagaaaatgcagaaaagcaaggcagctctctgaagcctcttttatcggggtaccaatcccattcatgaaggaggagccctcatgacctaatcacctcccaagggcaacatcttctaataccatagtattgagggtgaggatttcaacatatgaatttgggggaatgtaaacattcagactatagtacatgtactattcccactgccaggaataccatcctattttccctgctaataatcgactctacctttgacaacagagcaaacaagttataatatgaactttgttagtcattgtcttttatctgctgctgggcttttcacctacctttgtatccagtacttaccaggatgtcctgaacccaggatgagctctcttaatgtctgcagaaggaaggaagacaagggaggagaagtgggcaatttagtcaaaccactggggaatcaaacaacttgttaataatcccaactatggagtttgtccatctagtcctagccctgaatagcatcccaattttttaaaaaatgaatttcaagtgagagaatgtcatgttcacattagtattgaatgagccacagcacgtccctgatttatttatgttgtgtgaaaatttaagtagtgatgtaagaacatatcactttggggacatttgctgttttttaatttaacctttgtggcagcagaaaccatctcctcaatgaagacccctaatgaaag

SEQ ID NO: 49979 - DNA, 1029 bp, Homo sapiens
attcattaaagacaggagagtaaataggataacatataaggttaatagaataacattggccttcatattcccaagattgtatttcccatttggctatattagcacagagactagattaataagaaactgcttagggcttgtatgatgtggtttttaatatgcttgagacaagtctgtgactgtttagaaacctgtgtgctgaatttttttattacaattaggtcttctccttcagtaccaatttttttgacttgtaatctatatacaatagaatgctttgagcatacagagatgcatagaagtgtaatgtttttatgtattgtgcttatctcatggtcagtaatgaccaaatactggctagtgtttaataaactttatgaattatccaactatgagcatttcagttgcaaagccaatagctcttttgcttagcttagcacttttccacaatgaccttaagtcagacactggtgagggtatgttgtttgccccaagatccaaacagaaacaaaaatggatatgatctgtcatttcaaaatagataatgctcatatgtgacagggatgaccacagccttttcacccacaaagagcacacagcacatatatggttctgtaaagagtgtggcagtgagagagcagccacctctggaaagctggggaccactaagtacagacttcagttgaagtgcctggagaaaagagtcctcatcatgttgccctttctgggctggaggaagtgactggacatcactggtcctttcttcactcaaaccccaccctctgtttggtccaagcacattcttttccttaagtctcttcatcatcccaattagggtcctaatccattcttgcagcctggaagtttcactctggagtcatccataagtaagtcccaggaaatgcaccatgtgtgcctaacttcattggtagtttccaagccttgagtttaatcagggttctagaatatacctagaacagtatgcacatctcaagcaaaagttatataatgaaacactttgccactttg

SEQ ID NO: 49980 - DNA, 1032 bp, Homo sapiens
ctccttccttctctgcccgctgcttttccatccaaaccactatttttttttcatttcattgccacccaaaatctagccgttgctaaaattagccaaatggcacttgagatgacctaattagaatgtcattttaatagagtcagctttggctcccagccaggcagaagagtacctgtccagtggcttctgggcctcacttccagggatattcacccttatctctcagaaaacacttgcaggtgatgcgtatccatcacctagctcttgtgctgtgttccacctcactggaacaggagcacagaatgctttccattcctgccccagatggaaactcctctctgctttatccactattcaaaaggaactgctgagcagttttctattccaggcttttctctcatgcctgagaatctggctctggcaccacacagcttcattacaattagctccccgagaaggaactacagtttcccaaagtccaaaaggttttggctcagggcatgtacactcaactattaatactctcacctgttgctccacaccctcaccgctctcttattttccctccagatcttagaagacatctagccactttaattatgtgactgcagatcctagactctaccgccctaaggttaggggtggatgtggcttaccttagcatctctactattaacctaagccttccaaatagcagatgctcaatgaatcttttgagaaaaaatgagccagtgagcagggggacctaattattcatatgtaattctcttgcatgatcaaataagccaagcaaatctggtaagacttcaggatagtgggttccctcctggcccaggacaggtctaaaaatgccgtccaaaagccaagttctgaaatcaagaaccccaaaagacagcttggttgtcttctccactgtgggttctaagggccctcactgaaaccagttatgtgaaaccacctggtagttttcctgaaccaaatcttgtggaaaataaacttattaggctgtccgccaggcacaagaattaccct

SEQ ID NO: 49981 - DNA, 1145 bp, Homo sapiens
tttaggatatatttttgagatatctttcaggagtccacaggcaattccatatatttcccagtttttgccagctgccctttattggaatagcttgcaggaatacttctgctcactgtgctgatgcatccagtgttaggacaagaggggtgaggctgaagggtacattgtaatgtcactgtgacttgcagcacttggcatcaggggtatgttggcagtggaggagaaccaagattcacaatgtacagcaccagaagctagtctgtggaaaaatcttccagtcatcaatcagatgtgtaaaattgtaagtgaaggattccattttcactgaaaagcaaaagtgctctcttgtcagaaatatacccagcgtgcagtgtacgcaattgtaaatacaagatacatttatttgcacatttggaaggggattttgtgaaatggcatttttcagaattcctgtgattgtaggacatggacctgtagaaggactagaaacattgagtagtatgcagaagagttttgctgggcaggcacagaattaaactgcgcaaaccaggagccagagacagctaagaaacacaacctcttaaattggtcgggactgaattcccaaacagtcacagcatcaaatgtgtcctgagctagaaagggcacagtcatagttcctgtgactgctacccttagaaagacctgcttggaagttacgctccctgctggcatctggaaacttgactctcagaatttccctagtcaacagttaactgataagatggctcactgtgccttgactgttgatacagaaaacgtagtttatgctgaatatctgctttccttctgggagtctggaattttggtgcatgctaggcagaggaagtctctgttaccaaacaccagtgtaaagtgtgggcaatgagtctgggcttctctggccagaaacatcacacgtgccactgcatatttgttgccgagagaagcatgtgctctgtgtggcccctcatgggagggagagagcataaggaagtctgtgcatgggctcctccaaactttgcctgtcttttctgcttgtgatctggctgtgtgccctaactacattgctgtaataaatcttggttgtgattataactatatgctgaatcctgtgtttccaacta

SEQ ID NO: 49982 - DNA, 1032 bp, Homo sapiens
cattttcctgagggctaatgatattgaacatcttttcatgtgcttatttggcatctgtgtatccttttcagttaaatgtcttttgcctcttttctaattggattttttttttaatgttgagttttgagagttctttatatattccagatataagtcctttgtgggatatataatttgcaaatttttctctcagtttgtaatttgtcttttttcatctccttgaaagagtttttcacagagcaaagtttttaaatttgatgaggtataattttcaatttttacttttatgggtcatgcttttgatgccaaatgtaagaactcctcacctaatcttatgtctgaagattttctcttgtgtttttttgaaaagttttacatttttacatttcacactatgttccattttgagttaaagtttgagatttaagtcaaggctcatttttctttttctttctttccccccctccgccatgtatgtccagttgcttcaacaccacttgttgaaaaaactctgcctcttcctttgaattggttttgcacctttttcaaaaatcaattgggcatctttgcatggatctatttctgtctctgatactctttttcgtctctttttaagagtcagtgtctcactccatgcccaggctggagtgcagtgatgcaatcatggcttactcctaggcttaagcaattctcctgcctcagccttctgagtagctgggactacaggtgtgtgccaccatatgcagctttttttattattattattttttgtagagacagagtctcactctgttgcccaggctagtctcaaactcctggcctcaagtgatccttccaccttggcctcccaaagtatatgtttgctattctgttctgttgttctatgtgtctatacctccttcagtaccatactgtgtggatcattattactgttgaattttgagggttttttttttattctggatacaagttcttcttcagatttatgatttgcaaatattcttttccagtctgtggttagtctttttattc

SEQ ID NO: 49983 - DNA, 2124 bp, Homo sapiens
tacattagctagtttgctctccaagttgaatattccaattaaacaatatttttgtggttttgtgtttatttttattttaacctttctctttacaataataaaagacaggaaaaaatccaggcttgctcatgtgggtttggtaatttgaatatagattttctgtgactagttagtgtaccagtgcctaagactggggttttatggattcttggctatgtgttagtatgggtgtgtcaggtccacataaagggtcccaaccctccttctcaggccagggcgtatgaatgattgcttggtaggaggtgttattgttcagtgtctgatgctgactaccgacacgcaaggtggaatgtattctttctgagaaccaaacattgtagcggagtagtaaaacaccatgtaaatgtccgtggaagggcgcagttgtattgaacattgatgacatgtcattgtgaagggtctcaggaggtagtgttccagtttctggcatgggaggtgatcgtgggagggatatataggctttgaagcagggacaaattggacaaatggtgtctcccacttgactgtctttctttgttgcccagggacagcatacttttaatacttctccttggcatgatgaaaggtaaggccactcctgactttggtggcctggggcaagggtgcaaaatacagactcactgcaaattcccacttctcttcaaccttctcgctctgttccttcccctaagaggacttccacacattatatttgaggagccttgcttctcaaagtgtggaccccagtccgcagcatcagcattacctgagagcttgttagaactgtggactctcaggccccactctaggcctgctgaaccagaatctggattttaataagatgctaggtaattcacatgcacattaaattttgagaagcactgccatagcccacgtgttcaagctccatcaacactgagtggaggggcaacagctgccctgtggccacccctcagtcactcttcaggcctagggtttagtccatccttaggaagacagaactaggaaagaggatcacacaggctccaaaggcaggcttgaggcacatgggcagaggatttcaaggtcatgggtatcctgaggatagcctctaagagggaagcatagacttggggttggcaagaccccttggccctctataccccttgccctgtgaggagtgtggctgcagcagggccagagtaaggccctgccaaccatgaggcctagggcaggatctggttgtcccagtctaagagtgatactgttgaaaggtgtcccaaatattcaaggggatgaagatttgagtgggagtgattcatagctccctgaggtactggccagcagccagggtcttggtggctctttggagtgtgcggaagttatggtggtgggaccattactgctttaagagggaatcagtgtgaactgttataagcaaagtctttggtagctagagacgtatacattgacttatctgtagaaggtatacagcgaaggtgcctcctgtagtgcctaataacaatttgattagattagctactagcctccgtagaagacaggtggatgtggctgtggagggctttgaacaacttccttcaaacctaagaaacgggccacttttctcgaagaattgagagcagtgtctggtgtggttgggatgccgtggctgttggaggggcaaaatatgccattttgtgtccaccaccacctgtatgatgccacggttgtgggacagaggcaagtctgaaatgaagatcaacagattgctgtcccagctcccacaccccacctcttcctctgtaaaatgggtctaacagtccttgtcctgcctaccttgcggaggtgttgggtggctctagtgagacaatggatggaaaagtgctttgcagcctgtcaagtccgtgcatgaagaaatgatgatcattctgccatttgttgtctttcctttgtgagtgtgtcttcacctgcacttgagttttagatttaggttgccctctccttagcactgcagctttcaggtcacagcaacatacaaggttctgtgcaaagccatatctgcccctcttcctgacaccttccagcctcttccatgcagatacactg

SEQ ID NO: 49984 - DNA, 1022 bp, Homo sapiens
tgttgttgttgtttttgagctcatatatggggtatgtaggcctttggccatttgaagcattgcagggaatggtatgttttagttggtgcatttgttactgtaagaaatcagcaaatggtttgtggtgccttttaagatttatttagcacatatttttcctatgggctaggtgctgagctggatgctggggatgcacagatgagaaaggcacagcgcctgttctcagattgtctcacagtctagtaggaaagagagagacacatcaacagctaactctgatacctaacgatctggatagaaaatttcaggtcagggcactggcatgaacagagattgagaacagataaatgcgtggtttgttcagggaatcacttatgtagtaatatggatattggcagaaaatgactagagacaagatgtaaaggtagattcaggtcacattttgaagaactgagatttttagcttttagaagattatgttggtatcccttgaactcaagatgttgggtccaaggtagtgattctgtctacattcttagaacttttttgtagagtagcaggaggtagaagaaaaagttattgaagctgaaatagtgatccttagccttagggacagtgtgtgtcagaggttagagcatccagcatggctggtggccagagctttgcatcagtctgagatgtatgtgatgtatctttagctcagggaagagagaggacttgatttttgaggaaggcttgggaaggagggatagaagagctggatagttttgctgctccccagccagaaatttatagtttgatttcattattgccttgaaatattgggatgtcccagaacacacagccattcatatttaaaagtaagcatggcaacctcacgtctgattcggatataaagggctgatttggcttatttatatgatttcaattcacaggcagccataatcaagtgcttactaggcttgtaagagcagccagaggtcagaccatttaggaacacactggggatgataggagctatt

SEQ ID NO: 49985 - DNA, 1047 bp, Homo sapiens
acttctcttgaaaattgagtaaaagaagcccttaaataatagtagctcaaaatggaaagctgtgagctgtgtagcccaaagtgatgactctatttgaaagcccttattttttcctgtccaggaatcctcaaatggtatgtttgtaaaaggaattgacaaaagcatgcagctatacgaggcagcaagattctctggatgagcagatcacagctttcacatattagcatgtcctgaacatgtaactcccagttatagatctggaattacttgcatcatcaattcaatactttgggacttagggctccagttgtattggtgccagatggagaattaatatgttgtctaactcagactagttaaggggttttgctccttggagggagtgggagagaatgtgactgttttgctctcattttcctcatcctgcattagaaacaaagcaaaaagttggctggaatcagtattagcattgcccacagctgctgaactctgatttaaccagatgccatagctatagcaacggggaaatattggaattttgaaattaacatgctactgaaagttgctaaatatatcacgctttgtggaggggttcatattgtaggtatttccattatttctcaaatgacaaagtaagtcaggctttagacagaaagttaatttattatatatggtggttgctgaagtctcccctacttgatctatatctataaatgtgttttttgaagccaaatgagataaatcagtttgattgtccaaggcatagatggaaattggggctgtcataaagccatcttcagatgcgtgtgggtgtcagaatattcatctttggggtttagtggaaagaacctcaggctaggagtcaggaaacctaagtctcagcctctatgattaaattattaggtgatcttgggcagatctcaggttccccattttttaaatgccaggtgttgaactcttctgccttccaattctaggattctggaatagttagggttctatttcccccggctgtggctctagggggtacttactgacatcctgtga

SEQ ID NO: 49986 - DNA, 1814 bp, Homo sapiens
tatggtgagagagagaacaagagagagacggagaaggtcccagtctcttaaaaaaacagatctcatgtgcactcaaagtgacaactcacttatcaccaaggtgatgatgctaagcagctaaaggggctgaccagtcacctctcaccaggtcccacctccaacattaggaatcacatttcaacatgagatttggagaggacacacattgaaaccatgtcacatgtgtatctttccatgctttccatgtcagcacatgcagtcttgctgactcccttaaaggctacatggttgaaatgtaactttaggaaaaccctgaggttttgataagttttgtatatagggcactgaatttgattttgaatgtgtaaattcagtgttcatttgctgtcttcaggtttcttttactttttctctatattgagggcactacccagttatgcattctgacacttgaagacttctggtggcttgcaaatgctccatggagatgaaaattaacttgattggttttccttcctgagcaccatgtgtccactctggccttgggcgactctcaaagtgggtttcaaaccaggcttcagagtttgtcccaatactttctaatagtttattttatccttttcataagttttctcctaccgcttcagtccatattttctggtctggccttatcaactataaagttcttgtttatttggaacttgaggtcagtgacttctgacctcactagctttcattctagctcactcttatttaggcatttactatatgcataatttcctttaatcctcatgacaaacccatgagggaggtgcagtaattatctccaaagtgacagatgaggcacaggaaggctaaggacattgtctacggtcacacagctggtagatggaagaactagaatttgaacccaggtttatctgaccctaaaaaatatgcttttaatcaatatatatactgcctcccttaaatcagtatttctagcttttctatgagcctgcgattctctagtggcaagccacaataatagccacactgtgaacataacactgcatgccagactccataccagagggtggagctgagttttctcatgctggaacagcattttcttacaagctaaaccatgggagggatcttgggtgggaagaagcacttcctgcttataatacaagccaaaaagagattcccacagtatgaagcccacagtttttcctgtgtaatgacattatgaagacctcaggcagaatctccagctattgtgcatttttgtttaatacatttatactgtaaattagttagagctatggacttgcaactcctactttgacccaaaacaccaagacacaagagggaatggtcttttattttattttcctgatcagaactctctagtttccttatcagtgttgctcaccctgggtgttgcctctgaattcagatttgtgtgaatggggttttctaagagaaaccttggtaaccaagagacagtttctgtctctgccttcttctggtggactccaatcctggctctccagctgccttgccttcacgttttagggattcagaatcaggatgcgatcatggcccaatcacagaattgaacatttctaagttcctcagtatccaaaaggaaaggcatttcagatgttaggtaactgtcctttattcactgtctgatagaaatttaatggttacaaaggggtttgtttttaggtttttagttttattatttttagtttatttccagcactggaaaattagcctgaaaatctggaaagggaaaggccaaaccgatcacagttggccctgga

SEQ ID NO: 49987 - DNA, 1395 bp, Homo sapiens
gttgctgaggcaacccgcctgctacagttgtggttaactctaaaatttactgataatgctgacctgagacttgagtcttatcttcactgaatgcagtacaggtgtattgtaggtaggctgtaggaggaccatagctacctctaaatctttacagaagattttgaatgtggcttttgttgcatagaaaataaataaaataaaataaatctctacagaagactggcaagagattggtgcatatttaatagcaaacagtgggatgctttgaaagggatggataacatagaacattgaacagcaagagctttagtggggtttaggttttagtagttgtccagccaagactctgcctgttactgaagctagggatatgtggagtgaccaatttacatcagtcatagtagagaagtaattgcttttatctgacaaaagcagtctggacccagtcaacaacatgctgatgctacagtccctattcttgatgttttattggaaagtggtaagacttctttttctctctgagctggtaccaccaatttgcagtggtatgttctagaagcaaatcatatttcagagctctttggttgtgtaatttttttcaataggcatgatgagtattctggaagctgtatcatggtgccttttgcttggctgtgtgtcattactataatgcataggttttttacttgtttgtgtgattgtttttattccaaagactgccatccagggccatgcagcaaacaagcaacagggaaatatcccactatgcaatcctattttgagatgatatttaggatgagagaacatgcattagttacctaccagcttgacaggaatggatttccaaatctgacacaccatagcctgaattctcaccagtttgctcctggaaaggcccgctcatggtaagctccttagagtttgttagtagtggggaagccttgagtttcaggagaacgtgtttggatggcattttaagaagccattccatttttggtagagtagaaaaagtctgcatctgagtctgtagtacagtctgttctctggatgaacacaatgtctctctcacatttttctgatatttattctgcaaatcagcagcatgagcccctgccactcttctaaataagcttccaggcattacctgcatgctgtgttcctgtggtgggatggcagtaatctctgctaagataaacgggagcttctgtggataaagcataaacgcagtgaagtgtgtgtggctggaagatttaatgcctctacaggtaatttttttagagggggatctggcatttgatcaaatccagagtcattatgtaaatttaatcaccttgcaacacactagtaattttattatctccttttcatttgacagtgcttagatacaagttgagc

SEQ ID NO: 49988 - DNA, 1026 bp, Homo sapiens
cacaatgattattttttactctcgccgacagacccacaagataattttactcagatctttactgtaagaacttgttggatttttttgaaggtaaagacaacaaaatgttggggttttccctatgcctgcagtcctcaatttgtcattctcatagtagtctacactcagcctgcagcaatttgttaaaattaccagttttggtattcctagtttgtgactccagtgactctggtccaagcaagcaaattgcagctatgtctctctggatgttcctgactctctagatttcagggtggtggtttgccctacaacctcatttgtctgaaggattcatgaaaagtcattgattttaagtttgtccagcttcttcttgtaaggatgggagtgatgatttccacgatcttgtcagaacttaaatcagagtaatattccaaaatttatatgaaaagacacaggtcctagaataactagaacaattttgaaaaagagtaataaagttggaggaatcggtctacctaacattaaggctaactacatagctgtggtaaccaagaccatgcagtattgccagatgagttagatatataggtcaatggaacagaatagagaacccagaaatagacccacataaatattcccaactgaattttaacaaagatgcaaaggtgattcaatgaaggaaggatagacttttcaacaaatggtgctgtgttggaacaactggatattcataggcaacacaaacaaagttcaacttaagccttacaccttatgtagacatttactcaaaatggatcatgtaagtttttaaaacataaaactaaacatattttagaaaactggaaaaaatcttccagctctaaggctaggcaacagattcttagacttgacaccaaaagcatgatccataaaaggaaaaagtaattggtaaattggaactcatcaaagttaaaaactttctgtggaagtttttatgaaacatccttttaaatatgaaaatacaagctataaactggaagaaagtat

SEQ ID NO: 49989 - DNA, 1034 bp, Homo sapiens
cagtagggtttgcattcctatgagaatctaatgctgccactgatctgacaggaggcagagctcaggcagtaatgctggcttgcctgctgctcgcctcctgctgtgtggccagttcctaacaggccacggactggtattggtccatggcctgggggttgggaacccctgttttaaaagaccaaaaactctgtcaatacaatcaaccaaatctagagggtggggaattctgcaggaaaaatggcctgattttttactaacttaactgcttaaaatataacttctattgttattgcaaatttgctttctttgattaatagtgagactgaaatgtgtgtatttgtttagcagttatatttcttcgtgtgaggaagtgaattgagtattcctgcccattatccatttactcagaatgtgttttaaagcaaactggatcaaaatgtttcatggacttaaatgtaaaatataaactataaaactttttagaggaaaacataggaaaaaatttcagatctaggatttggtgaagaattcttagacttgatacccaaagcatgatctataaaaggaaatgtttgtaaattagagctcttaaaaaaaagttttacaaaattaaaagttaaaaaattttgctctatgaaagaccctgttaagggaataaatgacaagttacagacagggagaaagtatttgcgaaccacatatccaacaaatgactcatatctgggatatacaaagaatctcacaactcaacaggaaaaaaatccaattaagagatgagcaaaagacatgaagagacatttcaccaaataggattcacagatggcaaataattacatgaaaagatgttcaatatcattaggcatcagagaatgcaaattaccataatgagatgtcactacatgcctattagaatatctaaaatgaaaaatagtgataacaccaaatgctggtgaagatgtggagaaactcaatctctcatatactgtttgtgggaatttaatatggtacaaccactctgaaagaaagtatggaaa

SEQ ID NO: 49990 - DNA, 1028 bp, Homo sapiens
tgcagtacccaccatcctcctcctgactctgacagcccctattgcctctctgctggtatgtcctctagcctccctgtctctgtttcctcatcttcaaagtagtctaagttaagtttgttaaaatcagcttctttttggaaactccctagaggtggaagaaaacaaggaggaactctgctgagctatgaagttaacttaggaggcaggaggtggtactggttgataacctaaacatgttgaaatgaaggggaggttgggccagggcaggcaactggcttgtcccgccaaggcatcaaccttgaagtttccttgtcctcctaccttgccacatcaaggcccctctgcccttggtgattgcctgcacacccagaatgcagcatgcagagaccactccatttgtcatgggaccatagccaatttaggcaaatctgttaacctttccttgtaattcccaggagcactgaggaattgttcggggatgatatccttggatgcacttcagacttcatggattttatgttctctctgatatttcttgtatcagggagctgagaggaattggtctctgaactgatattaatttctttgtttatttcaagtccagacaaagaagagcactgattggccctgtcctcacaaagctgcagaaggtatttggcacaacctcaaatctgggaggggcctaccagttccaaaatcctatgtccagttcaggaatcccctttcaagaattaattttgtgtttaaatatctctaggaacatgctgctcacttcttcctaaggcacctgtgccagtttcagacagtgccaatcatttggaaagttttccttcttctgagctgaaatttatctccccaaaatgtctaacccacatagtcctggatctgtcctctgtatgcactttccaaatacggctaccatggacccctcatcttcttgtctcagggcttatcattaattcgtcttatgtcgtgattccaagacccttcaccatcctgttctccctctgttttttaccagtttcttc

SEQ ID NO: 49991 - DNA, 1026 bp, Homo sapiens
tctgagtaacattagttagtcattctttcaagtaaatatgatgttctatgaaaaatcggccagtttagctcacaactcaaaacacgcagtagtgctttgccttgagtcaacgactacactttgattccagcagaactgctttgagcatagttctcattgtgtctcaccaaattttaaaaataaggggactcaagggctagtatttaataaagttaattttcactgcttcgctaagaacattcgtaagtgaagctggcattttttaaactgcaggtgtgtggtggtgaagaatccaattgacaactagtacagttggtgccatggtcccaattcatgctcaggaacctgctcttttcacctacctctgcttttgcaccagcagtgcaaatggaaagcatgacagtggaatatcaaagaacatttcagtattattgggaaaatagttttcaccttgaggatcctctaaaagggtcttggagacctccacgggtccacagatcctactctgagaaccattgcacatggctatgcatggtgccacctcccttacttaagagctttgatggcttactatcatctgcagaatcggacctgccctcacccatgatgtcagcccaggacacagggacccagccaaatgggctccttgccattttccaaatgtgtcctctcatgcccttgtcactgctctcccctctaccaggaatgccttcatcaccaactctggccattgaaatattacatatcctccaaggcccaggtcaaccactgccttttccagaaagctttctcagggtttttttgttttttggtttttttttgagatggagtctcgctctgtcgcccaggctggagtgcagtggcacgatctcggctcactgcaagctctgccttctgggttcacgccattctactgcctcagcctcccaagtagctgggactccaggtgcccgccaccgcacccagctaattttttgtatttttagtagagacggggtttcactgtggtctcgatctcctgacctc

SEQ ID NO: 49992 - DNA, 1032 bp, Homo sapiens
gaaggcgcacggagcctcagccccggccctcgctgcacgcccggcctgccagccctggacaccctaaatcctggcggccgggacggccgagtggactgcactgcgagctggcgggcgcgcgcagaggccctaggctgcaagcgctccgcggggtgggcagacgcgactcgccgatgcgctcgccgggctcgggcatagggggcgccctttccttggtttcgctttgcagcgggcgcccctcgccgccggagctcagggcagctgtcgcgcccgccggtggctaagacggaggcggcagctcggaggcttaggccacccgcgtctggctacacgcctcatttcttcccgcgccctcctgccacaccctccgccccaccacacacaagggctcaaactctccgagcgccctttgtttggaggcgcggaggcagtgggagccgccacctccggggttcgtgtagcctaggcgggcagtgaggatgagcgtgctactctggactgcgcgctggcctgctgcctctgcacctaacccagcgcctgacactaaagctgccagctttagttagattgaccatttagcgggtccttgtcccttataactgcccccctaaaactttcgagaaccagggcttgcactgaggaatgtcaaatataatgttagaagtaacctttcgccattctgttggcctgctccgcccctgtgccccaaagtggtcggtgtctctcatagagtttgttcgggaagggaatactgaaaagaaaaaagtgacaaataaggaaagtgggcggggcccaggctcaggctggtgggtctcccaagcgaagtcagattccacccgctctctggccgcctccgcccctcctacttccatttaatctgatgtcgacgttttatttgtgcctttttgcatatctttctcctactcccctcccctcccatctctggaggttattgataagtgctgctcaaacatttgttttctgcgtctttggagtagaagatgaagcgttaacacccccaacgcgcataca

SEQ ID NO: 49993 - DNA, 1047 bp, Homo sapiens
atggtcagagcagtgttgtggaaaggtttctctaccacagtatggaggacaaatgggaaagccaagactggaggcaggggaagccccctgggaggtggctgtggcaggagtccagggaagagatgatgaggataaaccggggcagtggaaggacacagacctggcagacggttgagaggcagaattaacagatggctattactccaaagacagatttgaatgatgtgtcactcatacagagatgcgggctggaatctgtgatagaaatattatcatcggcaactgtggatggtattcaacacaaggacttgaattgggctgtgagttgaattgtgtcccccaaaacaatacattgaaatcttaacccttagaacccgtgaatgtgagtttactgggaaataggatctttgcagatgtaatcaagttaagaagaggccattagggtaaaccttaatccaatatgactagtgtagttataaaaagagggaaatttggagacagagaaggacacagagacatacagggaagagaaagccatatgaagacagagggagagataggagtgatgcatctttaaggaacaccaagaactcttggaagccaccagaagctaggagagggcaatggggcatggaggcctcagagcctccagaaggaatcagccctgctaacatctggatttcagacttctggcttccagaactgtgaaagaatgaattgctgttgttttaagccccacagtttatggtcatttgttatggcagccccagcaaatgcatacaaatggtgcgaaagaacaattgagcaggctttcagaggctattgaggggctgatgaggagacattcattttgtaaaactctggcattggtggtactcaatcatcttatatttaggacccagcctgccctgttttcttgcagggaggttcgctcattagaataaaaagttgtcacatgctgttgtcagagaaacaagacggtggcctaagagatctacaaattcactctgctctagggctgaagtagctccctcttggtcacagact

SEQ ID NO: 49994 - DNA, 1046 bp, Homo sapiens
gtcaggtggcagcaaggtagatctagctccaactggcactttgagatgggcattagggatccagcagggtccatggtctgggagctaaaggtcccagataagcaagaggtcgtagataatgtaaggaggggtaaaccagtgataactctggggttactggggtgccttcagagcccagcacagagggtctttgctctctttcatatcttcttctgggtatgggtggctaagggctcccaggtgtgtacttagagcctgatgtgggaaaagagactgcccacaggcctctgtttctgtgactaaggtgtgagtacagtactcactccactccacttcctgggtccacaagtaacaaagccatagagcaacacatgtccctggaacaaccatttacttgaggacgcaggcattttttcctatattaaagcaaacatggatgtaatataaaatcgaaagttgaagacccacagatttatttgactaaactccaaattgcatgtggcagatggctttggagttcctctttatccctggattgttcatgagtgagaaacattgctgaggatttggtttctttctatcagaggcataggcttcctgggcaggtgctcatgaacattgccatgggaagatggtacacagccaggcatttggatgcaaaaggtggcttactcctgctttggacagaaaggtctgcttaagggctatttcataggcttggattcatgtagagggaaagaagaaacaaagctgtgtccacaggctaatgtgctgaggttgtgagatacctttcaacttggaccaaagtcaatgtacaggcagtgatccctctccagtgtcccttccattggccctgcttcctgggtccagccagtacctgatgaagattgtggtggtgagggagtaggcagctactgcacaccagagaattgagcctttgtgtaggaagttttggccactacctcaccagtcccctttacattggctctgggtgtcacaaagggggaaggcataaaatcaatagagtggagtctttgaaagccaaa

SEQ ID NO: 49995 - DNA, 1055 bp, Homo sapiens
tgggctgtgtgttctaactctgaggggctggtatcaagtcctcagttttgttctctggcccttcaaggttagaaacctgctgtgctgaaggggctgaggtgttcctggactgctggtcacaacactgcaatggatggtgccagccaaagcactccatcggacagtagcagcaggatccatgctcattcacatgtgccagcagcagtagcagaacggcagggtgcactttctttggttggggtgggtgccggtaggtgcaggggttgccagcctccatgcagatgttcacagtgtcagcgatggcaatgtggcatggaggcagctacttcttcttttttaaaatgtgtgcattttatttcattttcttgccttattggactagctagagcttccggtattatgttgaatatcagtgtcaagagcagatagccttgccttgttgccactcttagaaggaaagcagtcagtctttaaccatgaagtgtgatgttaactgtagatttactgtaaatattctttatcaagttaaggacattcccctctgtgcctggtttttatcatgaatgagtgttgaattttgttgaaggctttttctgcatcacataataggatactatgattttaattatttttttgagatgatgtagattcaaatgaagttgtaagaactaatacagatagatgctatgtactcttcagccatattcccctaatgataacatctggtgaaatgatcatacaatatcacaaatgggatattgacattgacacagtcaaaatacagaacatttcaatcaccatgggtagctctcattttgctcacatatagacatatctacttcccttccatacccactctctccttaatctctggaaaccactaatcagttctccatttctatagttttgttattttaagaatgttacataaatagaataatatagtatggaacctttggggatggtcttttttttttcacttacaatcattctctacagattcatccaggccgttgcttgtatcaactgtgtatttctttgtatcgctgagtagt

SEQ ID NO: 49996 - DNA, 1025 bp, Homo sapiens
ccctaacaaatggtacccatttcaggtagaattacaggccctcatgcggccacgtgtttagcttcccctcctgtgccaaagctggccccaactccacactcccaattccacccttctcaaaagttcttgcccctaaaagtgtttcttttccttccatttctcctcccatcagcatccagagagaactttttcaaagagatgaagccaatccttcctctgcttaagtcccccgatggcttccctacaaacaaaatacaatccaatccctttcccatagcctgcaagaccctctgcaaattcacgactacttccctggtgcattgtgtgacaggcacactggctgcctgcccgtcactggaacagtccaaaagccccaccccagggccttcccacttgctgccctcctgcctgggatgctctgcccccagtccttctcctggcctgctcagagccacctgccattctatcacatcactattttttcagtctttgaaagaatactgcacacactcttaacttgttcttgttgttcacttaccgtttgtcctactagaattccagctccttctctctggttccccacttctctccctggcctgtgctcattctaatggaagtgtcagttctgggccccctaggcagccctgcctgccctttactgtcatatgacttcatctctatagtggaggggagcccagtgccactctgtaggtgcttctttcctagaataagcttcaggccctaaagttgtctagccttagggctgcccatgtgatgctgtcagcaaaactaaacatgttcttgcctcttttcctccctcaagtcaagcccttagagtttagaacaatgaacttggcctatataaaatacctccaggaaatcagtcctcaaacaccaactcccaacatctgctttctgaatatatggcttcaaacagctaagtgtacagtatctaactgctgtccatccttttgttttttttagccacatgacatctaaggaacttagaaaatgccttgcccttt

SEQ ID NO: 49997 - DNA, 1026 bp, Homo sapiens
cacttgattgagtggctccaggccccctcttgattgctgctgaaatagaactgcccacactgtcggggtatcttccgccgctggtcatttccatgtgccatctgcagttttttctgcctgatggactactgaggcactgcgtatgttatgctgatggggggtcctgtttcttgacccatcactaatatcttgcaagtcacaggaagctaccagggattcctgagcaaaagcttaaaatgcttcagttctctacaaataagccccattcattgcttttagagtgtgttatcatggagcagacaagtaatcagaacctgagtaatatttgcatattgaggtcttcaaaactccagtgtggctataaaatggtatttaaagttatcaaggagctaggtatgcaggcagaaagaactgtccattgcagaaagcaatgcctctgctcatgtcccagataaccttgctccaaggacaaactggagcttgataacatgaagctgcagatggccggtgagctcagctctgtactcactaaccaccccatgggaggggcactgagccctctatggttggcataaatcccattagaatggtaaagaaatccttttcacaagtacatagaaatcgcttgctaagatttcatgggttttcttgactttgttgtttttgtttgggttttagagggtgggcatgagtcatctctaaaactgttcaggtagttaggttgtcttcttattcccatttttaagtatttataattagttcttaaaaatttgtccggaggtccacacctccccttggaaaaccttgcctgtacttttcttaatggcacattttaagtttctatgtttcaaaacttgcttatcatataacatgctaatgactaaacacatgcacacctccacaccaatgcaaacgacatgtgggcttgggaacgaggcaagcctgggtttgcatcctgctctgccactagtgggctgtatgattttgggcaacttagttaacctctctgggcctcattggcctcat

SEQ ID NO: 49998 - DNA, 1030 bp, Homo sapiens
agacttaacacagagatgttggtttggcagtcagctattgggcaacaaacgcaagcaaagccctttaatgtagattctgagagaggatgtgtggggaaaagatcagaggactttgagtggagctttgggcctgtttgtattcagggcaggaggtgagaagtggagctcagtgaaggaggcataccagagaaatggacatcaaaggaggatattggaaggtaaagaaagggtcttaagaagaaagggtcagtggtacttgaaggaggtttattagcgaggtcctttatgaccttgggggtgtctagtgatgtggtgggtgtgagtgagaaaatagaggtaatgaatatcaactgttcttttaataagagagagagttaaggaagggggaagtgttgaggatcatatgactatgagaagggcttttcaagtcatgggaagcttcagcctgttttgtagacaaagagaaaagatttacttcaggaatttttttaagggaaataatcacacaggtctgaaaatatgaatatactagaatgcttatgatagtggaaaaacagagccagcatggtggctcatgcctgtagtcccagtgctttgggaggtcaaagtgggaggatcgcttgagcccaggagtttgagaccaccctgggcaacgtagtgagaccctgcttcttacaaaaaactcagacaaacaaacaaaaagacaaaaaatagttgtagttgtgcacaactgtagtcccagctactcaggaggcagaggcaggaagattgtttgagcccaggaattttcaggctgcagtgacctattaatatgattgtaccactgcattccagcctgggtgacagaacaaggccccatctctttaaaaaaaaagtggaaaagcattggaaagaacctaaatgtacaagaaaagttatatatatatacatatatatatacatatatatacatatatatacgtgtgtgtgtgtatatatatatacacacacacacacacacacacacacacacacacacatacatacagaa

SEQ ID NO: 49999 - DNA, 1053 bp, Homo sapiens
aacaggatttcaaggagaatacttaaaatgcttgaagaaataaacggctctagtcattttaggagtaatggattttgtacaactaattgatgtacatccttaggtcccttaacctttccttcttggcactactttatccacttatctttagttacattgtatatgtaaaactaatgaagttacatttctttatttttatttttgtagattcaaggggtaaatgtacaggtatgtcacatagatattgcatagtaaggtttgggcttctagtttacccatcacccgaatagtgagcatggtatccagtaggtaatttttcaaccctaatacatcagatctttcacttggtctgccttttctgtgaattagttaaaataagcgaatttccatttccttgaattgggtaaaatgactataatacatgtctgttgcatggctgttagaatttggaagctccgtggaagaaatcttttaaaaaccaacccaaaattacataatatatacaaattgttgatacgcatgtgaaaagatggaactctcatacattgtttctgggaatgtgaaatggtacaaccacttttgaaaatagtttggcagtttctttaaaaaattaaacatatggccaggcacagtggctcacacgtgtaatcccagcactttgggaggccgaggcgggaggatcacgaggtcaggagatcgagaccatcctggctaacacgatgaaaccccatctctactaaaaaatacaaaaattagctgggcgtggtggcgggtgcctgtagtcccagctactcgggaggctgaggcaggagaatggtgtgaacccaggaggcggagcttgtagtgagctgagatcccgccactgcactccagcctgggcgaaagagcgagactctgtctcaaaaaaaaaaaaaaaaaaattaaacatatattcaccatttgatccaaccgtttcactccaagatattttacccgagagaaataaaaacactgtgtcccttcaaaaaatgtgtatgcaaaagttcatgccagcactattcatagtaaccaaat

SEQ ID NO: 50000 - DNA, 1040 bp, Homo sapiens
cccctacagtggctgtaccattttacattccctccaacagtacacagaggttctgatttcttgatgttcttgccaacagttgttatttgtgatgtttgtggtttttgttgttgctgttgagacgtaggagttttttaatatgttctgggtattaataccttgccagagatgtgatttgcaaatattttcttatgaaattttggggatgtattccaaccatagcaagtataaatctaataagacatgaacaggactcataagctgaaaactatcaaatattgattaaagaaatcaaagaagatctaaattaatggagacacacagtgttgttcatgtatttggatgattcaatatagggaagatgtcacttctcccctaattgatatacacatttagcacaattcctatcaaaatcccagaaagattttttgtagatacagatttaaaacttatatggaaaggcaaaggaactgaagtagctgaaacaattttgaagaataaagtgggaagaatcagtctaaatgacttcaagacatgctgcatagctacagtaatcaagactatggcagaggtacagacacatagatcagtggaacagagcagagaacctagaagtcatcccacagaaatatgctcagccgattttttttttccaccaagacatgaaaacaatttaatggttgaaagataggcttttcaacaaatactgctggagtaattggacatctatagacaaaaaaacaaaacaaaacaaaacaaaaccttgatctaagtctcacatcttatacaaaaattaactcaaaatgaatcacaaacttaaaaatataaaacttttacagaaaaaagaaaatcttaaggatctggggctaggtaaatcattcttcttaaactttacaccaaaagcacaatccataaaaggaaaaaattgatcaaaatttaaaatcttttgctctgtgaaagactctgagaagatgaaaagacaagctacaaagtggaagaaaatatttgcacacctcatatctgacagatgactagtattt

SEQ ID NO: 50001 - DNA, 1046 bp, Homo sapiens
cataatcaccgaaaactggaacccacccagatgttcttcatcaggtatattgttaaacaaattgtagtatatccatgctatggactatattactcaacaataaaaagaaataatgatacacacaggcaacttggatgaatcttaaaggaattacgtgagtaaaaaaatggcagtaccaaaaggttacatactgtatgacttcatttatatgacattcttcaaatggcaaaatgatagaaataaagacagatgagtggttgccaggggccaagaagagaggaaagcagggagggagtaagatgtggctataaaaggtcaacagtagagttcattgtagtgatgaaatttttctgcatcttgattgtaatcaatgccaatatcctggttctgatattgtactatagttttgtaatatgctacgactgagggaattgggtgactggtacatggaatctgtattatttctcacaactgcatgtggttctacaatgatcccaaaatttaaagtttaattttaaataagtcaagatttttagactgctgaatgattctatattacatgtaaaaatttgtatcattgtatttataacaactgaaaaatatagttatactaaaaaagatgttagaagttaactattgtgtttcttatgttagatttatgtaacaactgaaatatatagttatatttcagttatatatatataactatttaacaactgaaaaatatactaaaaaagatgttagaagttaactattatgtttcttataataaatttagttaacgacaagatgatgcagtatgcttgctttcttaaatagattaagatcactatcaactttttttgcaccttctcataggttcttgacatgtttaggagttgagggaggggatgtggggcatgtgaaaatagttgtggcacaagttggggcagctgagactcatcaactgaaaaaggttacttatccaccccaggtacaattatcttaactgatttaaccctgccaacaatctgcaagggaggtgctctcgacatctcccatttaga

SEQ ID NO: 50002 - DNA, 1034 bp, Homo sapiens
ggaatggcattgaatctataaattgctttgggcagtatggccattttcacgatattgattgttcctatccatgagcatggaatgtgtttccatttgtttatgtcatctctaatttcttcgagcagtattttgtaattctcattgtacagatctttcacctccctgggtagccatattcctaggtattttattctttttgtggctattgtgaatgggattgcattcctgatttggctgttggcctggctgttgttagtgtataggaatgctagtgatttttgtatgctgattttgtatcctgaaactttatcaaagttgtttatcagctgaaggagcttttgggtcgagactatggggtttttactttttagaattctattttatgtcctgtgattgcatattagctataattgtttgttttgttatgtaactagttattttacatctttatgtctaccttcaaatgattgtatgctgcttcatgtacaggataagaaccttatagtagtatactcccatttgtcccctcctaccctttatgctgttgttgtcatccattttacttttacatatgttataaaccccacaatatattgtttttgtttttgtttaaacagttatcttttaaggataatgataataatgccttagtctcctacagaagcacttgccaatccactccctgccaacttctctggcctcatattcgactgtcctcactgcacccattgatccaggcatactaacctctaacaacttatcactgtgcccttcctcccttccttctcttactccccctacccactttcctattgagttaagttgatccttttctgaacttccattgtaatactttgtgtccacattgttattttagcttttgtcaacctctagtgcagggatccccaacccatgggccgtggatcagcactggtccatggcctgttaggaacggggctgcacagcaggaggtgagcagcgggctagtgagcattatcgcctgagctccgtctcctgtcggatcagcggtggca

SEQ ID NO: 50003 - DNA, 1074 bp, Homo sapiens
ttgagatacaaagatgtttttaaaattaggagacaaggtaaaattagtcaatcaaattggaatggggctagattttagtaatagtttgatttaggatttgtttttcttagaatcatagaatattggggatggaaggggatttttagagctcatgtagtcagaattgtttcatcctgaccaaaacattgagtctgatggccactacaatgctgtgattggcctgcccactctcacttttgaagaaaatatgtataagagaccgtgcttgagaagggaacttgtttttcctaccaggtaattagagcatacattctttaggaactgtactaatatttattgcttaaaaacactaggtgttgtcatggattcatccggaaagtcaagcaacgattacccgttgcagccagccacttgtgggtcccaatgataagcgctgcaaagaggatgaaaaatacttgcaaacaataatggatgctaacgcacagtcacacaagcttatcatctttgatgctcgacaaaacagtgtcgctgataccaacaaggtatattcttaatagcactgcagaaacactggatattttcatgtcctgtctgtaaatcattatgcagttggaataactcattgatttcctcaccacctgaagttagaatcatttggagtcccatagctattcctccctggtgtatgctccttgggctgtgtttggtgtctcacatgggttgggatcttgtctgtttcattgcttctctacaatatcctgtctgctaaatcaattaagtaaagacctagaaagacaattatcatctaaaggatttagcattttaatgaaatgatcgtgaggtccttggaagtccgtttaaggaatatagtggttagttgattaattcatgtctggtctgaatttcttttagaatggaatcagccatgtgaaatgtgtaaatgtacaaagtttccataaatctcatggagcacctgtgtagtgtacctcgggtggcagtgagacatggttaaaaacacctccgttcccatgactttcatgatatcacaccctgagtttctctcgctcttcagcc

SEQ ID NO: 50004 - DNA, 1043 bp, Homo sapiens
tctgtgcctcaggttcctcttctgtaaaacaggagataatatcagtgtctcatgtcatgggttgtgtgaggattaaaattcagtgagaagaatgcatgtaaatgacttagcacagtggtgagtgcatcctcagggcacagtacatgatgctgataagctcgccacccctgtggtcaagggtgttgcccaggtgtctgacttgagggtgaatagtggtgtctgttactgagatggggaagactgggagaggaacagggcagggaggaagatggggaagtattagttttctgaggctgtcatacaaattactaccaatttgttggcttacagcaccagaaatgtattgatcacaattctggaggccaattctgctccctctaaaggttcaaggggagaatctgttccttgcctcttccagcatggggtggctgccccagccttcctgggcttgcagccacatcactccaatctcttcttccgtcatcacatgaccctctcttgctctgggtttctgcgtctcctcctttctcttctaatgacacttgtgatgacatttaggttccacctgaaataatcctggatccttaaacacatctgcaaagaccctcttttcaattaatcttggaatccttaaacacatctgcaaatctcaggatccttaaacatctgcaaagaccttctcttcaaataaggtcacattcaccattgccagggattcgatgtggatgtctttggcggggccacttttcagcctaccatagggaggcatccctcagtgaggcccccttgctccccacatctggatcattagctgtgtcagtctttctacatctctgcctcccacctgtcaccaccatatcccaaggaattacaaaatgtgagaaaagccatattggtggaggccatcttcagactagccaacagggtgagggcagttcattgtgttttatcccatgcaggagagatagagacaggacactaaattgtatatctagaataattttaactatggcagtatatgtgtctaggaaacagtattttct

SEQ ID NO: 50005 - DNA, 1033 bp, Homo sapiens
tctgagccttctcttgctagtcattcaccaggagctctggccttggctgcttcagtcacggggaagggaagcagccaggacactgccggtgatctgcggggatgctaccaatagccctgctgctcttgattgatcctcccgcagccttatcaccatcagcccagggccttttcagaggacatctgcctccctactgcagaaagtctgtgaaatactaggcctgtttccccactgagagctactgttactgatggcagtgtgtgttggggcagaaggaaggttgatagtcatgatgctgcctgtgctgtccggctccccagcagctctgccctgaggaggacctggagaactcagaagatggctctccaccttgagtgcacacagccagcccctgggaaccttcttcctgtgagcctggagacaggcttaggtgtgtgtaaaagttccccaggtgattcagatgtgcaaatgagtttgacaaccagtgatctagcttagtgctccaaatgtggtcctgagaacttgttagagacaccaaacttcagcctcactgatgaccttccagtgctctgggtgtggggcccagccctctggttccacaagcccttctgggggctgatggatgctcaacttggagaccattgctgtagactaacattgctcaaaccttaatgagcacacaagtcccctgggactcttattgaaatgcagattctgattcagtggggctgaggcagagcctgagatgccacatttctgataagctctcaggtgatgccatcgggtcacagatcacattttcagtggcaagggagcacagagacatacctctagaaataaggaacaaaggggagggagtctgaatagccaaagtagatttcatggagtcctcaggccctcacttagaaattaacactgacttttacacccagcttcaacaaactgattggggtctcacatgatctgatggccaggtcacaggtgattaaagatagcctgttagagagctggcctgggtaagaggggctggtcc

SEQ ID NO: 50006 - DNA, 1047 bp, Homo sapiens
ctgctgccatcttagctgtggacaaaggggggtcagctggcatgagaatattttttttttttaagtgcggtagtttttaaactgtttgtttttaaacaaactatagaactcttcattgtcagcaaagcaaagagtcactgcatcaatgaaagttcaagaacctcctgtacttaaacacgattcgcaacgttctgttattttttttgtatgtttagaatgctgaaatgtttttgaagttaaataaacagtattacatttttaaaactcttctctattataacagtcaatttctgactcacagcagtgaacaaacccccactccattgtatttggagactggcctccctataaatgtggtagcttcttttattactcagtggccagctcacttagggctgagatgaaggagagggctacttgaagctactgtgtgattttgtttgtgtctgagtggcattcagatgaagtctggaggagttaggagaacgacataggcaaggttcagcagccttccaaggtataggaaggtgggtgattaggactgaggctatctaggtttaacttttgtcccacctccaccccctattttgtggggccaaatgcattgctaaacagcaatttcagagtgtatggtgtgtcaaaaattaaggccttattgtttttctctttcacccctaccccccgtgctcctggcacatatcacattatttgtggtgcccaacatttggggtcttgagcctgctgctggtctcctggatgccagtgagggtatgtgggatggggtggtggggtaggggacggtatcctttttttgctcctacttggaaacaccaaacaccccaaggaagatgataggctccatcttgggccacctgagctatagggcaggctaatggaatcaaccatttctgagcactaaatgtatcatgaaaagttgaatggcctgctcataagtttagctcattcactggaaatgtagattgatgttcaatgttaaactggaaggagcttggtttgtgtgtcagtggttatattagtgggtagtgt

SEQ ID NO: 50007 - DNA, 1030 bp, Homo sapiens
tagggattggcgggagggcgacgggagagctcagaggcggcgatgggggactcagagaggctgcaaagggctggggtctgggagccgcaggcgggacttcccccgctgctagccactgccgagcgggaggaggccgggggccgggggccggcggcgagcagggcaggagggaagcgtgggaggatgccgggcgctgcgacctgtgctgggggtgggggcggcagacactgcagagcagctagtccggcttacaggttgggcgggagagggctctggaagggaggggaaggggcaaaggcgcccaaactccgagttcaggccgggggagggaggggcggcgcctggaatttccaccgccagattctcgatcggctggggctaggagtggggaccgaagggggtctgagagggtggggagaccagctggattctcccgggcagggcgtgggggagaggtggcggccggggtctgggggattactttgcttgggcaaggagtcacgaacactgaacaagtttaaaaacgcactgactggcacacagtcattaaaagttttcttacaaagtctggtgggtgtctccgatttctccttcgtctcctggaatcgtggggccatacactaggtcttcaccttcacccccgcggtgcggtcccgaggtgcaaacccacggaatcctgggggcgacctgcgaagcccattttattccctttagatttcttttctttctttttctccttctccttccttccttctataattcaaataaaggcttttatggttgttgtggttttgtttttaaggctttgccccttctcttttcggctgtatttccctgaattcattactctgccggaaaaccatagaaagaacctcttcggtagaaagtgctgaggccgagtgctgacagcgctggaggaaggaggaagaaggagccatacctttgcccttttcaaaagcgctcattttctcctagtccaagatgaagtgcaatattttgccaaaccaatgctaattagcaacgaggtgtc

SEQ ID NO: 50008 - DNA, 1047 bp, Homo sapiens
ttctctgtctttcccctttctccctccctcgatatgtttttcaggcaacatcttcgtggtcagtctctctgtggccgatatgctggtggccatctacccataccctttgatgctgcatgccatgtccattgggggctgggatctgagccagttacagtgccagatggtcgggttcatcacagggctgagtgtggtcggctccatcttcaacatcgtggcaatcgctatcaaccgttactgctacatctgccacagcctccagtacgaacggatcttcagtgtgcgcaatacctgcatctacctggtcatcacctggatcatgaccgtcctggctgtcctgcccaacatgtacattggcaccatcgagtacgatcctcgcacctacacctgcatcttcaactatctgaacaaccctgtcttcactgttaccatcgtctgcatccacttcgtcctccctctcctcatcgtgggtttctgctacgtgaggatctggaccaaagtgctggcggcccgtgaccctgcagggcagaatcctgacaaccaacttgctgaggttcgcaattttctaaccatgtttgtgatcttcctcctctttgcagtgtgctggtgccctatcaacgtgctcactgtcttggtggctgtcagtccgaaggagatggcaggcaagatccccaactggctttatcttgcagcctacttcatagcctacttcaacagctgcctcaacgctgtgatctacgggctcctcaatgagaatttccgaagagaatactggaccatcttccatgctatgcggcaccctatcatattcttctctggcctcatcagtgatattcgtgagatgcaggaggcccgtaccctggcccgcgcccgtgcccatgctcgcgaccaagctcgtgaacaagaccgtgcccatgcctgtcctgctgtggaggaaaccccgatgaatgtccggaatgttccattacctggtgatgctgcagctggccaccccgaccgtgcctctggccaccctaagccccattccagatcctcctctgcctatcg

SEQ ID NO: 50009 - DNA, 1330 bp, Homo sapiens
ccactggccacatcaagccagctaccagccatgctgagcccaccactgctgactatcccaagcctgccactaccagccaccctaagcccactgctgctgacaaccctgagctctctgcctcccattgccccgagatccctgccattgcccaccctgtgtctgacgacagtgacctccctgagtcggcctctagccctgccgctgggcccaccaagcctgctgccagccagctggagtctgacaccatcgctgaccttcctgaccctactgtagtcactaccagtaccaatgattaccatgatgtcgtggttattgatgttgaagatgatcctgatgaaatggctgtgtgaaaaatgctctcgtaggtggccaggcagtggtcccctttctagtttgttttgcatatgtaatccaaagtgagatgccttactgcatctagacacagacactgacacatagagatggtgtaagctacatccacctttcaggcgtactcatcctttacttaatgtactgtattaaagtgtgtgcgtgggtgtgtgtgtgcttgctattttagagaccttaatttccctcaagtttgacatctgttgttccaaacctccctttccaactatggtcgaccttcagtcctcagtgatccttgaaattttagactttgatttttttcccactcctctgtccctcctcccctttcctcatttcctctgccttgttcctgctttcttctcccattccccgagggggttgggagaggggtatgtgcgcaatgctaaaggtgtgttgtggtgaacgcttccgttaatgtgactgcacagctttatgttcttcaatgtgtaactctatattgtacttttaatagcagtcagaaaagcagttgtgatcaagtacaagtactggaaagtttctttcctaaatttcagcaacaacatatgacccatatttgaagaatacaatttgataagctcttattaaaaatacattttttatgcctatgagatcaaatggcaaaaggaaagatatgggcacaccaaattatttctattttttgaaaatttgaacattggtgctttttatagtcaaacatggttgcaaatgataagacgtttttaccttatttgtaattatttaccttttttagcatttgccgggattttttttcatttagttccagagaaataaatccattcataaactagtttcttctcctaaaatccaatcttacggttgctaggatcaattatggtaatatttttaatattataagtcataactactctttactgaagattttgttttttaaacagcctggtgtttttacagtttttgc

SEQ ID NO: 50010 - DNA, 1048 bp, Homo sapiens
acagaagctttttagtttgatgcaagccgctttattttttcttttgtagcctgagcttttggtgtgatatccaaaaaatcattactgaggccaatgttaaggacctttccctctgtgttcttttatgtcttaaaactttatatctttatgttttagttattttatccattttgggttgatttttgtttatggtgtaagagtccagtttttttctttgcatgtagaaatcctgttttcccagtaccacttattgaagggactgtcctttccccattgtgttcctcttaacacccctgtcgaagattagttggccatatatgtttggatttatttctgggctctattctgtttcattgttatatgtttctgtttttatgccaataccatattgttttgattactataactgtaatattttaaatcagaaagtgtgatgcttacaactttttcaatgttgctttggctatttggggctttttgtggttctgtatgatgaattttaggattgtttttctattttaatgaagaatgctactgtaattttgatagagattgtgttatatctgtatgttgctttgggtgctgtagacatttcaacagtattaattcttccaatccatgaacacaggatatctttacatttatttgtgtcatcttcaatttctttcatcagtgttttatacttttcagtgtacaagtcactcatcgccttggttaaatttattcctaagtttctttttttttgaaatagagtcttgctctgtcacccaggccagagtaaagtgccccaatcactgctcactgcagccttgacctctggggctcaaacaatcctcccacttcagcctcttgagtagctgagattacaggcacgtgccaccatgcccagcgaattatcaaaatttttttttgtagaggtggggttttgctgtgttacctaggcttgcgtcaaactcccggcctcaagcctcagccttcccaaagtgctgggattacaggcatgagccactgagcctggcccctaagtatttttttttaatgctattat

SEQ ID NO: 50011 - DNA, 1286 bp, Homo sapiens
cattctgctgcctcagcctcccgagtagctgggactacaggcgcctgccactacgcctggctaattttttttgtatttttagtagagacggggtttcacggtgctagccaggatggtttccatctcctgacctcgtgatctgcccgtcttggcctcccaaagtgctgggattacaggcgtgagccactgcacccggccaacataatgttcttaatatatagaaggtactcatatcttttagtgaatactttattcattaccacccaaaatattactttttaattgcctgactagttaaataaatacatcataaaaattaggatgctttgttttttttttttgtactttggtaaattttgcaataaaatggaaactgttttttttctcttgataggcgcccttgggatgtccaatagggacagctatttttacgctgctattgttgcagtggtcgccgtccatgtggtgctggccctctttgtgtatgtggcctggaatgaaggctcacgacagtggcgtgaaggcaaacaggattaaagtgaacatcacctttttatagcattaaattcattttttaaaatgataaatgctggagggggccatctgatttgaataaagttgaaagaacatgttaaagtcagtcttaaggagtcacgtttgagtatgtaaattttgatctttctaatatgttggtttgtatattcagttttaactgtatgaatctgatttgcaaatgagaatttggaaaagttagttacaaagaaatatgttaatttaattagacaatactctggaaggaattttatcttctttcaacaaaacatgttttatagtattctgacttacggttgcttttgagttttactcatttggatatattaagatgcacacagtgaagcaaattaaactccactttacgctggaatgctttctttagcatgaaaataccaggtccttggatttgggattttaatttcctatggaaagttgcttaaattgtggacactggaattaatctgaatgtcactgaggaatttcacatgaagtgtaatccctagtcaataagaattatccattacattattttatgggaaaactaggctaaattacatccattcaggtaaaaggaccttagcttactgaaggatctaaagagcaaagcaaagatctcactactcaaacactcagcctgcttccttcaagtccccttgcaggccagctttgtgctttgcagaccaactttttaatgagatactttgcttcctcattcaacattgaagctaggc

SEQ ID NO: 50012 - DNA, 1569 bp, Homo sapiens
tgcaatctaaaaacactcccacaagtatttgttttttaattataaaatcatagtatatgttctttgtagaaaactggaaaaatacatattcaaacaggaaaaaaaatcaaaattccccataatgttgccatctaaaaataacctctattttagttgatatcccgtattcatttttgaaagccattccttaatgctagtttgatacacactaaaagtttagcttacaagttcaaattctgccagcttttcctgacagctatttgcatttttttcagatgagtgattattggccattttctttttctttttctttattttatttatttatttttttgagacagagttttgctctgttgcccaggctggagtgcagtggtgcaatctcggctcactgcaacctctgcctcctgggttcaagtgattctccacctcagcctcccaagtagctgggactacggatgcctgccaccacgcctggctaatttttttttgtatttttttgtagagacggggtttcaccatgttgtccaggctaatcttgaacttgtgacctcaggtgatccacccgcctcggcctccgaaagtgctgggattacaggcgtgagctaccacgcccggccttattgaccattttctaaataagcacattctatctttattctcttaaaattcaaattttctgttactgataatcctaatactaggattcttgcttaagtatgtgaaaccattaccgatttgttgttcacatttattttttatgttgtgaaactggactaaaggaatagagggatgattagtcataaaagtcaaatagcatttgtgtttaactgttgagaaaagtgaaagatcagtatgattattatggaactgtttttaattcttgcttaaagactacaattttagtataatgacatttgagtctagggtagtatgtggtagatttctagatggtccctaattaagaagtattgttgtatttagaattgtccacctaatttctttttatataatgccaaggtatttcttgtgcttttgggatcttatgctgtttgtaaaatgttactgtccaatgttggattattgttttggtttcaggcatttgctgaataggtgatgatacatgggtatttttctgcaagtatttaaaccaggggcatatgcaaaggcagttgtaatttcctcttggaaaaagcgccaaatgtttgaaggttaaaatcaaatgctagggttgatatttaggcttataacaaaataggcttgttttcaaagcagttttttcctagagttttaactgttaactcactagtttgctgctgtttttaactatgttaaataacatatggtatttggcaaatagatttatttttcaaaatgtctcactagtttccttttacacaatgtatatacttcaagatgtatagaaaggaaagctacagttgagcccttatacatgttttaaggtagaaatatgttccctattgtttgaaaactgattgtaagaataacctcagttaggagatataacttgaagtgtcagtccaaactactgatttaaccctatttacg

SEQ ID NO: 50013 - DNA, 1100 bp, Homo sapiens
ctctgtgtcacccaccagattagtataactattaattcagactgtactcctatgtttaagataatttttacaagagctggctgaagcagcacattagtaacctgacaagatttctttttcccttttcagggggaaagggtcaccttaaaaataaattattttcagggactttgggaatctaatgataaatattacacataatctatgaatagcttaatcctttatatattccttaaaataggaattcctcgacatcactcctggccacactttccttgcctgtgttgttgctatgtgtatttgaaagtaatatctgcattccttttaagatgttctgtaagtcatatttgtcagttatacagagtagtcttccttttccccacgttcagtgtaatctcactgaacagtaataatagcaatagctaacaacatctgcacagcaccttacagtttgcaaagaacgttcacacattctcatttgagttttgcatagtgaacctgttacgagatgtctcttgacgtcgatgctaaaagtgttagaatctttacatcactagagtcattgaatatgctgtagtattgaatagtgccctgactagggggaggatttggatgtgctgcatttcaagccgtgtataatcatcaaaatggggggcttgagttctttagctacttgaatccgatttacttctgttaagtgatgcttttctaaccgttttctggatggattttgtattcactatattgtagcttgtaatttgtataaatgtaccatctgatgtcattaaaaaaagtgtttgtagtgctactttgctgtgtcctgattcaattaatgttttattaaccgctgtgtttttaaaaatttgtttgcctgcttctcattttataacatgtagaatatgtacagagctcactttaaaaaatttgttcgttggcctctgtttgtgctatgtagattatatagagagctgtcaaggataagtttttatgcagtaaatgtcaaccagaaatgctcaaactgattgggagtgtgggggaggggtgttgagctgtaaagggctggttatacttcgtctggggtgggcttcaaatgcccctaa

SEQ ID NO: 50014 - DNA, 1030 bp, Homo sapiens
tcccgcctcctcttgagctgttgtaatgaagtttcctagcactagtttggaaatcagtgaagtactctgaaatactttaatatcttccagatatcaatgatcttgaaaatgggttcaactttttttctaatttcacgtggacttgaagtaatttgagggtaagtgctctaatcagccacaattcatgagaagttttgatttaagtattgtcagttgatttctgccaaggtggtattttgaaatcagtacattatttcaagtgccaatagaacacagggctgtactcatgtactctaccatcaggggaagtttaaaagctcctaatggatcagctgaaacggaagtcattaaaatctttatgcaaaaatggatcagaaaataatgtcatgattgtaactgagtcacttcactttattttccacttctggcttctttcctttacttttgaaatggctttaaaatctgcttggataggtgaaataacccatttcagttggactcactgtcaggcctcacggatacctagaaatgggatgagggtgggaaggaggacatggggggaggcacaacagcttggaaaagatacttatcttgctgtcttccccatggcctctgcctagggcttctggcacctctaaggactgagtctcaactaaggcactgccttgtgaatttggaccagtcctttgtgggaccagatggtttctaggagcccttgcagccctgaaagtccataggtccaagcctcaaagtttcttaccagtaataggctgcccaatgcgggaatggtgcttttcccagggaccagattatgtgcttggcgggtgttatgggctgaattgtattccccccaaaaaagataaattggagtcctaaccacagtaggtgactcagctcagaatgttagtttatttggagatagtgtctttatagagataatcaggttaaaatgagggtattagggtgggctgtaatccactatgactggtgtccttatagaaggagaaaatctgcacacagagacagacat

SEQ ID NO: 50015 - DNA, 1050 bp, Homo sapiens
agctgggcatggtagtgcgtgcctgtagtcccagctactcgggaggctgaggcaggagaattgcctgatcctgggaggtggaggttgcagtgagctgagattgcgccactgcactccatcctggtgacagagcgagactctgtctaaaaaaaaaaaaaaaagagaaagaaagaaaagaaaagaaagtgggctgtcatctgagcttacttctcttcaagttactaatgaaatgctagccccaagggcttggcattcacatggcatagtccttttctatacacattggcagtcaagtacactggcagatgacctggttgggtagacagcagcaatggcatgctactgccgcttacttgctcccaaactcagcttctctacaaccgttctcttttctatcccacctgatgatttaccagtcctttggcttatgttaaaaaaaaaaaaaaggctaattttagagcactcttaggttcacagcaaaatggagaggaagatacagagatagcccatatactccctgcccctgtacatgcatagcctctcccacagtcaacatccccaaccagtgtggggcatttgttatgatcagattaatttttaaattatgaaatatgttagacatacaaatgagcaaaaaaagagtaatgcaaccaaagcttacatacccactgctcagcttttgtaatgaaacagtacaaatgcagttgaagtctctcatccacccaactctgatttcattttcctgcctcctccccaaagtaatcactattctgaatttagtggtcttcattcccatgcatttctccatacttttactcaaaatttatgtgtccataaaatatgtaatattattttaagtgtttttaagcctcacaaaatagtatcatgctataaattacccttctgcaacttgctttatgtcactcattatctgctcttaagatccatccatgtagacatatatacttttagttcatgtattttaactactgtatagtattccattgtaggaatgtaccacaatgtattatatattctcctcttgatgga

SEQ ID NO: 50016 - DNA, 1332 bp, Homo sapiens
ctaaggctgagtttagggaccgagtgcatcagagcagccagaaacgattaccttgcgtgttggagcagggactgtactcacggggcaactgagacccggagaggggaaggggtgtgctgagtgttgtcgcagaggtcggacggctgggacctaggaactgaatccagccgaggctcgctctttgagggtggcccttcgagagcacccctagactgacccagatgtataggccccagaccaggttccaagagaggatcactttagatcttacctggctaaaagcagcccaggacggtgaactggggcctttgggaacggactttgaaaggagtgagggggatgtgagcgagcatgaggggcggggagaggtcatcaaaatatactctttttgacacccacacaatgcagataaggaggagcattccaggccgagacgccctcatcagcagagtcacaggagttttggaagtgagaggtatgcttggagaattaaaagggagcgtgtgcaagggctgtggactgacatagacctgcagaagtggagctggaggtccagtttgccctctttagctatccccgtggcttttagccttcacctgtttttcctccaggcataggggcagtaatctagggagacagagggcagagagtaagtttctcagacagagaaaggcccgaggcttattagaaccttttaaatggagctgctgccctttgccctcttctctcttcagcagtgaacagattcctgacttttgggtcatcatcatccccccaagtagtacgagccagagttctcactgtgatctccaaagcttggcacgacgtgtccccttccatcgctccacaactcttctctcgtctggctcactccagccccagaacactggctttgtggttgaacctcatgtgccagccacactcctgcctctcatctttgtctcagttgtcctctccgcctgcctcctcttaggcaccctatttaagtattgcagcccccagtacaaacaagccactcaccttgctctacttttttttccaacagttcttatccccttctgacctactgtatattttgcttgtttgttttgctctttgttgtccctccactagaaggcaggctgtctgagggcaggcatctttgttgtattcactactggtactccaggacctagaacagagaggggcacatattagacaactgatgagtagctcccctgtttcccagctctcacctagctagtcctccctgctctaccaggttaatcttcgtagtgaacggccctggtcagggcatctccctgctcttaaaccttcagagcctgaaccgta

SEQ ID NO: 50017 - DNA, 1033 bp, Homo sapiens
acatcttttcatgtgctttttagccatctttaaagtagatcttctttggagaaatgtctattcagtcagagctattctcaatgtacattttaacccaagcgtatatcacatggtgaatttaggtgagtaggcaggggacgggggttgcctatgggatctgactcatttgcgcggctagctctgggtactccaacccatagagacagctaagctgtcaccaaaattcttatctgactcatagtatttacaaactttaaaataattggtatataatttgagacaaaggagattttgttttgacaagaggctggtttgcaaagaattgtgtgattattgtttcagcagtacagctccgttggggtgagacatgtttcttctttgacctcctacatcctcctctagcaaacgaggagaggaataggctctaaggcttcttgcttttgctagtcatacaaggggacttgtggaattggcagctctgctatttggatttcggcactacaaaggatactcgtatagtttgctgggtctgctgtaacagatgaccacaaactgggtgacttagaaaagcagaaatgtgtctctcacagttctggaggccacaagtccaaaatcaaggtgttgacaaggttgtgttccctctgaaggatccaggggagactcgttcttcattgtttccaccttctagtggctccaggtgttcctttgcttgtagccacatcactctaacctctgcctccatcttcacatggcctcctcctcttctccctgcctttcccctctgtatgtctcttataagaccacttgtcattggatttagggcctaccaggcctccaaggacctctattggcccattcttttcctacttttcatgcaaaacttaaggctacgggagcagttaaagttactttttggttcaagaagaactgaatgaagcatttggtgttagtcattatgctattcattgaatgaggccaaagaggaaatgattctttccacccaagtttgcttgcgagtcccagtctttcttta

SEQ ID NO: 50018 - DNA, 1064 bp, Homo sapiens
gctgcagcaattaggcagtgagaatgcgatctgcacgggcttaatagatgcttcaactttgggcaggtgggggtggtgtttctaacttcttgttcttgttctcccgccaggcatttcacatcaccaatgatgagcccatccctttctggacattcctgtctcgcatcctgacaggcctcaattatgaggcccccaagtaccacatcccctactgggtggcctactacctggccctcctgctatccctgctggtgatggtgatcagtcctgtcatccagctgcagcccaccttcacacccatgcgggtcgcactggctggcacattccactactacagctgcgagagagccaaaaaggccatgggctaccagccactagtgaccatggatgatgctatggagaggaccgtgcagagctttcgccacctgcggagggtcaagtgagggacactggaggctgggctctctcgacacgttgctcagccagtcactccttcccctgtggattgatgaaataacatcctttgaatgagtttgctctgagcctgtgactccttctgctaggcagagagcgcaccctactctttccgtgacgatgagggcggcaaaaacagacatttcttccttcatggaactggatttggatttcttgaagcaggcagcttcatattataccgatttgttctctgtctttttgtgtctctctgtttaccccctcccttgccccctcttctggtttatacatttcattccagtgtccttgtacataatcaaggaagctgtaggaagctacaacccatttgttagttctgatggagaaccatttccatgcagaccaatactagagtgaagcctctagactttgttcaagatactctatcttcaaaatatcccagaagaaaaacagaagctgttaacacacaggtgagactttacatatacatttcatactgacagtgagcttagagcaaaagctgaaagctgaaatgactgtaattcctccccagtctctgttgcttgttcaactccttacatgttccacattctctttcaggtacgttgccg

SEQ ID NO: 50019 - DNA, 1046 bp, Homo sapiens
tcctatctctgtaagaggctgcagtggtacttcctagtgcactagtggatgtggctctgccattcatgggtccatgcctgggaagccagctccagtccgtgaaggccgggcctgtgagggcattcctgtgttactgtaaaggaatacctgaggctgggacatttataaaggaaagaggtttaattggctcacagtttggcaggctgcacaagcatggcaccagcagctgcttggcttctggcaaaggcctcgggaagcttataatcatggtggaagccgaagtgggagcaggaccatcacatggcacgagcaggaacaagagtgaggaaggggagggcccggactttgaaacaaccagatcttgtgtgaactaactgaatgagaactcacttttcactaaggggatggtgctagctgttcatgagggatccccccatgatcccgtcacctccctccaagccccacctccaacactgggaatcacatttcaacatgaggtttgtctgtctctgtcacatgcccactgcttcacctgcattcctggccacctgtcagggtgcaggaagggatgtcactgcaggaaggctgctcagtgaggtgtgtgtgttgggggcgggaggggggcatatccaagggggcctctgcagacatcaggtcagcaggctggagtgtgcagcatggaaatgggggaaaatttggggccatcctgagcccagcatgatgcagaccttgtttccagtcctgcagaggccagtccaggatgaggcaacctctaggcctctggactctaggagtgagaatggagaggttagatgtgaggtggagattgcacagtagctgagtaccttctgggaagtgctgagtggtaaagactgacagtgtaggattaaggcttggaggatatcttggttgtgggtagaggggaaagacgacgcagccctaaagtaggggtggaaagcccacaggactgaagtgtagaagtatagaagcctggggagaagatggggtcaccgaggtctgcatggaggaggacagcacattgtcat

SEQ ID NO: 50020 - DNA, 1056 bp, Homo sapiens
gggactattgttttaaggaatccccgtagtgagtcacgtcgctgagtgatgggcccttctgaaaggcgggcccttgcttggtgggtctgtagggagcaggtgacggacagtctgccttcaggagggcccacggtggagggcatgtgcccaggtaggcccccaggcgtccacctcctgccctctgcccctgagttctgcttccttcttgcttcggggccacggcatcctgggcctggctctggcttccagatggtctgaatgcccaggagccgcatgttctcatcactgagggtccagtgactagggagtgactcgggagctgggacttcctggcagtacatgccccatcatccctgtggggatatatgtccacgcagaccccagaaactgaaggggtgctcgactggggtgcagtggggctgttttcaggaaagagaatggcgtgaatcccgatgcgtgcatcacctgagatctggaggacggtggtgggatctcgccctccatctgttctctcctccataaaggcggagcaggtggccgagtggaatgcagcctgggcctgctggggaggctttcaggggtgtcatcagagcgtcccagcaagggcggccatgacccacctcaagtcacatggaaggcagggctgggagaaccagggcaaaagcaggaggcttcctgagcctcagtttccccctctgtaaggcagggagagttctcctggccctcgtagggtgtttccaagggtgcagtgaaagaaacatgtctgtcaagagctggcatgcagatgtgggctcaaaactcagtgtgtgccatggggtcctgagaggggccccatgggagcgggggtgccccctacttagaaagtgccgagccttctggagcatgctgggctgcccagggcctggaggaagtccatgggggactaagctggaggtgccagcagagcccccaaagccagggagggacaacataggggaaagaggacccctgggtctctggtcaggtgggtttgagtcactgggtggggagtaggcactctgagcctagttgggaggt

SEQ ID NO: 50021 - DNA, 1012 bp, Homo sapiens
tggtgttcctccaggagatgccctctccaggagagactaggccagagctccagctgtcctctcccaggggagttgcgcaaacagcgcctgtgtctcccagcaacggtgtggagcgacatgcagggagtattgtcaaccagggcagctcacccaggccccggtgtccagggcttttcttgcggtggttcacagagccatgctgtggtcacgtggctggcctccatctccagccctctggaggtccagctgttagtgtagcctacggggcacggtccccagccccctgccccactgagccatgctgctctcaagcaggatgttccaggggcttagcgatccctcccaggagcccttgctgcaccgcgttccactcgggccactccctgggccctttggctgaatggagctccatggaggatccgcttatctctgtcttcatcagctctgactgccatagcaaaataccatagactgggaggcttagacaacagacacttactttctcgaagtcccggaggctggcccagagctccacgtactcctgaaaatgcatctcagccccccgggggaacactacgccagttctccaagggctgccagttcccggggggactgctctagctttactccctttgcttagtcacaaaaacaaatgacatcctttggaagaaggaggccggcgtctccctctggagagggaccttacaccaggcagatgctgctcagcctggctctcacggccacttccgtgtggctcccccaggtcattgccaccatccccaccagccagctcaagtgcctgaaggaagccgggcacgggcccgggaaggacgagatgaccgacgaggagctggccgaaggcgaggaagagatcgaccatgccgagcgggagctccgcaggggccagatcctctggttccggggcctgaaccggattcagacgcaggtaagccccgactcgctctcgccctggcacttccaccccaagagggtagaggcaagctggccagca

SEQ ID NO: 50022 - DNA, 1027 bp, Homo sapiens
cccgcattagcctctcaaagtgctgggattacagacgtgagccaccacacccaggctgttgtcattcttgattatttttgttgaaaatgtttctatttcacccttattcccaagctaaagttgagttgcgcaatggagtctaggtggactgttcttttctctcagccctttcacaatgtctcattgtctccctgcttcttctgtagctgctgacaaatctgtagctgctaacaaattgtcctccctgagtaccctgtgtttctttttttctgggtactttgatcactttctttctttttggcattctgcagtttcactatgacatgtttaggtgtcagtttttgttgattctgcttgagacttgttatatgtcctttgaatatttgagtttttcaatcattctggaagattctcagctattagcttttcagatattgcctgactctcattcttttttcctgttcttctagaactggcagccagtgctggacttctgactctcttcgttgtgtctttcggtttctgtttactgtttcccatctcacactgtctgtgctgaattctggggatgccctgaggccttcctgtttgctcattttccagttcaccagttttctctttggccatgtctaattggaattttgttcacatttcagtggctgttttgtaagttctatttcattctatttcaaataggaatttgaaaatggacatttcctttttcaagtagaaatgtcaggctgtttctgtgtcttatttgctcatctttttgactgctccttttatactgtgtatcaggttagtcatacttaccccaccgtctctatctgatggtttggttagcttcagttcttgggagtatcattcgcctgtcttctgtctgctggtcttcactcatggtggatcatttccttgtgggttttgcaacagaacttctatggggattggtgtggcctcaatggagggtgtaagtccaaatgtccttctgttttggccaagcactccagggtaagcagttggaggccat

SEQ ID NO: 50023 - DNA, 1333 bp, Homo sapiens
ccagtgcattgcctgcctgcagcccccacccccgatgtctctgctgaggatgccttcagtaactcgtccaggccgtttgtggctctgaattgaggctggcgtggcccccgggcctccgtgtcataggtccaagtgttggcatgtattgtccagtgaatccagcccccacctgtccccagttcgctcttcctgcacacctccagaaagccggccttgcccctccccagccttccttcacagccatcccgcctacgttgccattgcatttgtgaccgagcacttggatctgtctcgcatatcccacctggaaggggcaggaagagcgcatgggtccccagctgatccgtgctatgaggcagggccgggccatcctgccctcagaccgggatactcgagctggccttacccaggcatctctccctcttccccgcagccgaggcctgcctggagccccagatcaccccttcctactacaccacttctgacgctgtcatttccactgagaccgtcttcattgtggagatctccctgacatgcaagaacagggtccaggtgagacagtggggtttcagacaggagggcgggtggggggtgctcctcactgctagttgatgggggacctgtgtcgatagagggagaatcaagattccaactcttggggtgccggagagatcagggcacggtgatgccagatcctagccagtgttgacaggtcaccttcctcacctgctttgtgtgctgtgcctacacgaggtaaccctgggctcaccacccgctgtttcctgaatgagtatctggaccgggagaaagggccaggagtcagcccaccccggttgccattggccagtttgtctgtgtgggtgttttgtttttgtttttgttttttgtttgtttttttgagatagggtctcactctgttgcctcagctggagtgcattggcacgatcttggctcactgcagcctccacctcccgggttcaagcgattctcctctcagtctcctaagtagctgggatgacaggtgctcgccaccatgcccagctaagttcccataagtccaaagaaggaaatggggccttttttgggtatggccctcttagggtaaagcaccccttgggcagcccactgggcacccctgaccccagcacctcccttgtagactcaggaaatcactcagcccttttgatcatcccgcccctgctcacagtcaacagggttcctatgcgtccagttaggcccggccatggggatctggccttgtgcccccgtagggaagaccaatgcagagggccagtcacgggattggtgagtgttacttggtacctcctgccag

SEQ ID NO: 50024 - DNA, 1036 bp, Homo sapiens
agaccccagacccaggggccagtgctgttgaggtgttggctttcccatgccaggcgctgggggaagctgtgacgagatttgagtgtcacataataaggatcatggcaattcaaaggtacagggaagctaggctataaggtaaccagctcggttttcctgggggtcttggacaggtgctttgattacatggtcactgtcagcccgtacccccggtcagatagactgaacccctgcagccggaaagaggagttgctttccatgcccttcctggagttcttcctcgatcaagttgacagtgtttgactcttgttccagctctccgccctgcttgctggcaggcaggagggtcagactagcatgggtgccatggggccctaggtgggtgcagggaaggacctgtagacgccatgcggggcctcagctggtgtctcagctggagtcaggagctgaacggggaagtgcctgagaggaaatgacagctgagtcaagggcaatggccaggcgaagtgggcaaagggcttccaggacagagctgggcctgaggagctcacagggctggatggggatggcactttaagtctggccaagactttgggacatgatccaggacatggaatgggaagctggtcatggaagggtggaaagccagggcagacatgatcccatccagggctgctcaaagatgctggggctgcggtgtgcacacccctggacccagaggcttttttgactgggaggacggggcaggaggagttcgggtgccccatgctgagatggcaggcttgtgtgaagcaaggacgtatggagtgatagtgaggactgtggttcctgtgtggcaacaccatgcttcagagggcaatggggcacccacatgccaagcctggtggccctcctcagcaacggaactccaaggcaagaaggctgagaatgaggcccaggaggatgcggtgggccccaggacctgcttgagaagtgaaatagcaaacaggactggtaaaagggagcagaggtgctggctttgttctttaatataatt

SEQ ID NO: 50025 - DNA, 1532 bp, Homo sapiens
ccagctctcagggcacggccggtctgtgccggctgctcccgcggttaggtcccgccccgcgcagcgcgcgcagcctgcggagccagcggccgtgacgcgacaacgattcggctgtgacgcgacaacgattcggctgtgacgcgagcgcggccgctcccgatgcgctcgtgccgcccccgccgtgctcctcggcagccgttgctcggccggttttggtaggcccgggccgccgccaggcctccgcctgagcccgcacccgccatggacaactacgcagatctttcggataccgagctgaccaccttgctgcgccggtacaacatcccgcacgggcctgtagtaggtacgcggcggcgggcgggaccccttccgggccccctcctcgtgctccgcctcgcgacctccccgctgccctccccgcgcgccttccccggcccgcggccctgaccgccccgtgtccggccaggatcaactcgtaggctttacgagaagaagatcttcgagtacgagacccagaggcggcggctctcgccccccagctcgtccgccgcctcctcttatagcttctctggtgagagcctcgcctgtggggacagcctgggacgcggggaggatggggtcgcgagggtgtggcaggggggccggtcgagagcggcactggagaaaggggagggaagtctgggggggcaaacagttctgtctcctcctttcaatccagacttgaattcgactagaggggatgcagatatgtatgatcttcccaagaaagaggacgctttactctaccagagcaagggtaaggcaggggttgggtgggcacgctggcaccttcacccgacttcgtcagggaccccgctcacagggaggacctgagacctcagtcccaaccactccagcagccttaggagggagaaactgttacaggtcccgaaatgggattcagattagggccatcaggccaggcggggcacaccgatgccccctctgctaccgctgccccccttcccaaggctacaatgacgactactatgaagagagctacttcaccaccaggacttatggggagcccgagtctgccggcccgtccagggctgtccgccagtcagtgacttcattcccagatgctgacgctttccatcaccaggtgagctggctggcaggcgtcctgtacttgggtacaacctaggggatcgcggctgtgtttggataaatccaggggggcactgggtacaaatggtggctcttgggcctccggggagactctgtgtgactagagcaccctggtctgggatctaggctcagactcttcctgagagtcctgggggcaaaaggggatgctggggcatgagcacaagtggcaaggccccatggataaagggctgaacacccagagccattcaggagggtgtgggttcctggcctctaaccaaaggtcagaggggactggctggggaagtttggactgagggacatgacagggccatggtggccctgccagccagtcccctcgccctgactctcttctgcaggtg

SEQ ID NO: 50026 - DNA, 1049 bp, Homo sapiens
tgtgtcctgcaagctcaccgcattttcgggcgctagatacgctcttggggcctttgtgtgcgttctctgtcttatttccgggcgacgtgccgcgtgcgttgtcggacgtgaagggcagtccgggaaaaacgggtgcggccgcctcctgtgtcctacagggggcgccagacgcatttccactcggcttggaggtggatttagtgccacgtgcccgaaagtcttaaattgggtgacctgagctgtgcaatgataatgcggcgattttgtagtacgcagtgtcttgaagagagaatttttaactaggaaagtttgttgcaaagtgtttataggaagcgtaagacaaagtaacggaagatggtgtctgttgtttctagtcttgggtgttgtctgtgttgcagcagccaactgttgctttgtagtttatttccccgaatggaaacggtttagaagtggacgtgcattccccacccttttcccgtccctcgtttgggttgttccttgaggggcaaagtgcctgttgggctttctgtgaacctcacctaacctgtgttttttcactcccctgcagttaccggtattgtaagaacaagccgtacccaaagtctcgcttctgccgaggtgtccctggtaagtagtggaagagcccctgcactggttggctctgcggactccgcgtccgtctgtgacaccccctgcacacttacccaatccttttagatgccaagattcgcatttttgacctggggcggaaaaaggcaaaagtggatgagtttccgctttgtggccacatggtgtcagatgaatatgagcagctgtcctctgaaggtaaggcaggattctttgttcgtcaccccccagtccttcctccgtgctccctcaaccccacccacatacactgcactggaattgggagttgatgaaacatgagccttacaaaactcagccaacacagttcccctgagctggagatagtcgtggtgaatgtttctctattatcttctctcactttgctgcttttcttctccctacctagccctggaggctgcccg

SEQ ID NO: 50027 - DNA, 1085 bp, Homo sapiens
cagtcccagctcctcaggaggctgaggtgggaggatcacttgagccctcgattttctttttccttgagacaatgtctgtttctgttgtccaggctggagtgccgtggcgtgatgatggctcactgcagcttctgtttcctgggttcaagggatcctgtcacctcagcctcctgagcagctgggactaaggagtgtgcccagctaattcttttttttttttggtagagttggggtcttactacattgccagggctggtcttgaactcctagactcaagcgatcctcccgcctcagcctctcaagtgctgggatcacaggcatgagccattgtgcccaacccagcccaggaatttgaggccagcctgagcaatatagtgagaccccaggtatagatagataggtagatagataggtaggtaggtaggtagatagatagatacgtaggtgggtaggtaggtgggtagataggtaggtaggtacgtaggtagatagatagatagatacatacatacatagatagataagatagatagattgattagatagattagatagccaggtggggtggctcacgcctgtaatcccagtgctttgggaggctgaggtgggtggatcacctgaggtcaggagtttgagaccagcctggctaatgtggcgaaaccctgtctactaaaaatacaaaaattagctggatgtggtggcgcacgcctgtaatctcagctactcgggaggctggggtgggagaatcgcttgaacccaggaggtggaggttgcagtgagctgagatcatgccactgcactccagcctgggccacagagggagacctggtctcaaaaaaaaaaaaaaaaaaaaaaaaaagatttttgtatttgactgtgctctctcatccaggtggtgacatgcttgtatctgtggttaagaggtagtatctgccgggcgcggtggctcatgcctgtaatcccagtactttgcgaggccgaggcgggtggttcacctgaggtcaggagtttgagaccagcctgaccaacatggcgaaaccccgtctctactaaaaatataaaaattagccgaggctgggcgcggt

SEQ ID NO: 50028 - DNA, 1080 bp, Homo sapiens
ggtaggagatgacttgagctgatgctgcctggcacataggggtttagaagatattaggaaggaagccccacagcgtgcccaagtgccatgcaggccctggagacggtcattggagggcgtctgtggatggcgcagtgggggatgggaagtccctaatctgctggggctttcccagcaagcagggactgagggggatagtccccaacacatgggccccagggagaagggcctgtttcattgaggtttggagagtgttgagggtaagctaacctgtcaccccacgcccccgagaatggttactgatagggagaggccttttccttgcaggagatggcgtctaccagaaggggatggacttcattttggagaagctcaaccatggggactgggtgcatatcttcccagaaggtcagcagggctgactgggtcgagcccccccagtatgagcgggatgggctcccaagcctcgcctctgtgctctctcaccagggaaagtgaacatgagttccgaattcctgcgtttcaagtggggtaagggctgctggtctctggccacagccatcctcccggcccagagatggccctgtgggcccctggctcccgccccctcgggctggcttgtatgggggtagatgggcgtgtttgtagcgccaggaaggggacaggtgctgagactaggcctgcctctcgcaggggcttgcccaagggagctgaattgaactggaggatgtcgggggtggcagtggccagaggctggcacagaagcttggctcagggcccagcttatgctaacatttctacctcccccctgggcaggaatcgggcgcctgattgctgagtgtcatctcaaccccatcatcctgcccctgtggcatgtcggtgagcctggggacggggacagagagatggcatctggggtggggggcctgggactccctctggtcccaggctgccctgctccaccccacgtctggccttctgtccactgtgctgcaggaatgaatgacgtccttcctaacagtccgccctacttcccccgctttggacaggtgggtggggactgctgaccttcggctgtct

SEQ ID NO: 50029 - DNA, 1092 bp, Homo sapiens
tcagcctcccaaactgctgggattacaggcgtgagccaccgcgcccggcctgtgagggggaattcttataatccacataaaacatctagccaggatcccccagtcttagggcattcacccattcattcatttgcccaatatggaaagcctactatgtgccaggtattgtgaagtgttggggatatggcagtgagcagaagaacccaagcccccaccctcaggaagctgacattcttgtgagggtggccagtaaatactaagtcggtataggatatgatgtcagtgttacggcctttagggaaggaagcaggctaaggggacagagtgactgggatgctattttagataagggtggtcaggccaggcctcattgaggaggtgatatatgagcagcgatcttaatggagggagggagccgtttggggaaggacattcctggaacagcaaattcgagggtcctgggcgaggtgtgctcttggccagctcaaggaagagctggtgtggctggagcacagtgagtgagagaaaggggtaggagatgtaggagatggtttgcaggtggctaggcgatgaagtaggaccttgtaggccatgagggggaaggtcagttgcagttcgaaatgtgtgagaaagccttgggtaacgtggagcagggagtggtgtgatttctcaattaaagaaagcccacaggacccaccagcagttcctgggctttccgactgagaaccccggtggccaaacagcagcaaggtcctgcccacaagggaggggaggctgggcgagtgtgtataccaaacaggttagggaagctgattaaaatctcctcagggcctaactgggaagggccagaggaagctggggatgggagtggagggtaggagcaaaaggacaaaggacatctgtaggttgtggagaaaaagggatggggtcggggccactgtggtcctaagagctcaaaagacttcaatgctcgatgcttcctccagcatgttctgagatcctcacctctccccttccgccaaaagcaggtggggggagggtcccgtccagactggacatagccgactctccttttctctggctgggaggcct

SEQ ID NO: 50030 - DNA, 1025 bp, Homo sapiens
ccaaccgcctctacccagtgtctgcccggcactggtttaccatggagcgcctcgaagtccacagcaatggctccgtcgcctacttcaatgcttcccaggtcacagggcccagcatctactccttccactgcgagtatgtcagcagcctgagcaagaagggtagtctcctcgtggcccgcacgcagccctctccctggcagatgatgcttcaggacttccaggtatggagcgggcgtggcccagcttcaggtgggggagcccaggctagtggttgagagacgaagagaggcttgggcttgggcatgtagttgagagtcctgtccctgcgctgcccctgtcccagttcttgctgggcctcccaacggtcctttctgacccgtgtctgtgtgtctgccagatccaggctttcaacgtaatgggggagcagttctcctacgccagcgactgtgccagcttcttctcccccggcatctggatggggctgctcacctccctgttcatgctcttcatcttcacctatggcctgcacatgatcctcagcctcaagaccatggatcgctttgatgaccacaagggccccactatttctttgacccagattgtgtgaccctgtgccagtgggggggttgagggtgggacggtgtccgtgttgttgctttcccaccctgcagcgcactggactgaagagcttccctcttcctactgcagcatgaactgcaagctcccctcagcccatcttgctccctcttcagcccgctgaggagctttcttgggctgcccccatctctcccaacaaggtgtacatattctgcgtagatgctagaccaaccagcttcccagggttcgtcgctgtgaggcgtaagggacatgaattctagggtctcctttctccttatttattcttgtggctacatcatccctggctgtggatagtgcttttgtgtagcaaatgctccctccttaaggttatagggctccctgagtttgggagtgtggaagtactacttaactgtctgtcctgcttg

SEQ ID NO: 50031 - DNA, 1039 bp, Homo sapiens
cctggtgtttgtggcaaacttcgatgagaatgaccccaagacctttgagggcgttgacccccagactaccagcatgcgtgacgtctaccggaagtttgatctgggccaggatgtcatcgatttcactggccatgccctggcgctctaccgcactgatgagtgaggggaagctgggtggtggcagccccctcgcccggcccgcccccacccttcccacacctgcctgctgtccccctgccccgcatgtctcttgtactcagccacaggctcacctatcaccctttccatttcccccttgcatttgatcctcatcttccccaggccattcagggtggtgggaagactggcctggtacctgggtgggggtaaatcaggggtgctgctattcccccagctacctggaccagccctgccttgagaccgtcaaccgcatcaagttgtacagtgagtccctggcccggtatggcaagagcccatatttatacccgctctacggcttgggcgagctgccccagggttttgcaaggtgaggacatgggttttttcagttggcatagctgagtaggactagggccaggagtggagatggccgccttgagcattttcttggtagtatttcctcctttccaattcgtgctcttcatttacttcactccatccttgggtgatgagggcacaaccccagtgcactgaagtacagaagtctccacacttgaaaaaacgagtctccacaaatgtgacttgctcagttcccggcagcaccaggactgggcccagggtcccagaaccttgagtcagggcttagctgggagctgacctatctccagagagtccattctggtccctcaggctgtcttggtgcggagcactgatccctcatgccccctcccgctggcccttggcagtgtattctgagcagaagctccagagaggaaagagcccgcggagatggggccagcgttcacggcagtgacagagctgggatgaatcccggcgtctcctacctgctgcctgcctggggcagccttctttgcacttt

SEQ ID NO: 50032 - DNA, 1317 bp, Homo sapiens
cttctgggactcaggaactgccggcctccatcttgcgcctgggagctttgactctcacgggttcctcctctgtttcaccagcccatgcagatcaacggcaacttctgtgggctggtgttgaaccagcctctgggaggcctgcatgtgatcgaggggctgcccctgctggccgacagcaccgacggcatggccagcgtggccgcctacacctaccgccagcactctgtggtcttcattggcacgcgcagcggcagcttgaagaaggtggcccccagagccctgggcatgtgggggtggggacagtctcagatatgggacaaggctggtggtgggaacacacgggagagctctgaggacaggacaggagaggacacggctggtgcagggagggagatttccctggctgggtcccaggcgcctggccctgctcctcgggtcgccccttggccgcccaccctcaccattgccagttcccactgtggactgaattgccagcttcgtatggctctggggacagagaacagacctattgtggagtctccctgccacgagagcaggcctggggctgagccagcattgctgggtcctctgttgaatgaacaagggagcaaatgccttgcccctcaagcctccctatgcctgggacagacccacttgcccctgccctctccttggctcactacttcccatccttcccctcctacccatgggcccgggggctgaagctgcttccattggggatctgggggtagcttggcatgaagggggagatgaacttctgggcactcaggtacgtgttgaataggtaggagtcgggggactgcagtgctctcatcctgcttgcctcgtagatgcagtgccatcccccaggagggcaagtgttggtctgggggcgcagggaagggtttgtggagaaggatgatgaactctcctggcccacctgctctgttcctgggaccctcttttcctttgtagcagctttgttgaacgcgtactatccaattcacccattttaaagtgcacagttcagtgggtttctgtggatctgcagagtggcacaaccatcgccactacctcattctcctaatcaatgccatcttctagctcttcccctcccctgcatcccctgaccttgggcaacacgaatcactccgtccttctgtttgctgagggcattttctggcgtctgcaccctcctttttttggcctccgggctgtgggtgtgagtgctgaaccccaccaggtcctgacgtcagctcagccacaacctccaaagtctttggctggagaagacagtgtcccaggtgcaggaggctg

SEQ ID NO: 50033 - DNA, 1019 bp, Homo sapiens
cagcccctgccattcttccccctcaccccctctccctgccactgctctgcattgccctgggttagcctggcggggccaggtggcacccgccatatactcttgcctttctgctgcgggggccttctaagcctcgggtcccagagctgcagggaggggcggcatagactccccacatggctcactgggtgtggtggggcctgtagccctttttgtttcatcctttggttcctgctggggactcaggcctaagtgtccaccccatcgtggaggacaacaccccttccttgcaggagtcatccctgagctggcagcttcaattggctctccgtgtcctggctggctggcagctcctgggcgaggtggcatgtgccgtgactactagagatcgctgtcatgggcccactcccccgccttctttgctggactgtggtccgagatgttatgtggggctctgtgctgacaagtcacatagtctgtaggcttcagagagtggctctggctgacaccccgtgggcagagacaagacccatgcctgcgatgtgtctcctcttactgtcaaggcaaatcacctttccttccatggaggaaggggtcagtgcagtcagcttgctgtcagggggctgcttggtctcctcgacggtgaggctgaattggagaggccctgctggagcatggagacccaacatgacctgcctgttccaggacagggtcccccacctcagtgccatcggcacctggggctggagaattctcttgtacgttgtagggtgtggagcagagtccctggcctgtacctgctagatgccagtagcacctgtcctgttgtgacaactaacaatatccccagatatttattgccaaatgacccctgggggatacagttgtccctggtgagacccactgtattgggatcttcagagcactggtgcacagagaggtgacagttagactgggggcttctgctcatccccaggagagtgctctattgagggggacttgagggtgagtgttgcaggcca

SEQ ID NO: 50034 - DNA, 1077 bp, Homo sapiens
agtgcactcaacactgttgtagaacacatgtccccacaatgttaaattgctgagtttgtcaacagttctcagtttttgtacttagtccatcttgcagacctatgccagtttgtgggccacatagtggtactgactctttttttacatgtgctcacgacatggtattttgttttgtgttgtgtcgttgctttgtagaattttgataagctgaatgtaaggacaacacactatacacctcttgcatgtggttcaaatcctctgaagagagagattggggactatatcaggtaagtgttgggaggaggcactgtgcaaacttactttcttttgaaaatgctttcacatcagctattcaggaaggcagtggcatgccagaatagctttgtcttgaatatataacctgtacccgcagtgaattatttttctttttaacttttcagatttgttgtttcactggagcattaagagtgggtgatacattaattttttttttttccattccaggacaggtttcattaatcttgacaagccctctaacccctcttcccatgaggtggtagcctggattcgacggatacttcgggtggagaagacagggcacagtggtacgctggatcccaaggtgactggttgtttaatcgtgtgcatagaacgagccactcgcttggtgaagtcacaacagagtgcaggtatgtgggagagggagggaaggactggctagagtgaaaagctttctgtatttcccttctatgttttgtctgctggaaactatttcttcattaagaaaaaaaaaaatcctaaagcaaggatattgttttggtttctgtgtacgttctgtcccctgccagatcttggtggtccgcgctttttggaattccacatactaagcatgtattcatcaagctgactggatccatttgtccgggttcagctctcagcttgtcactccaggcttctcactctgtgctaccgcttctgcctaaagtatccttcgttcatttttatctgagaaaagcctgcttatcttgcaaggctttttccacgcagcttctacactgagtactcccaactgtccct

SEQ ID NO: 50035 - DNA, 1052 bp, Homo sapiens
tgatcagcattgagcactttttcatatgcctgtttgccatttatttgtcttcttttgagaagtgtctgttcaaatcttttgcctgttttttgatcagattattagattttttttcctatagtgctgagttccttatatattctggttattaatcccttgtcagatgggtagtttgcggatattttctcccattcttatgcatatggatatctagttttcccagcaccatttattgaagagactggtttttacccagtgtatgttcttggcacctttgtcaaaaatgagttaaatgtaggtgtgtgcatttgtttctgggttccttattctgttccattggtttatgtgcctgtttttatgccagtaccatactgttttggttactgtagctctatactataatttgaagtcaggtaatgtgattcctccaggtttgttctttttgcttaggatagctttggctattttgagtcttttgtggttccatgtaaagtaccagtgttttttaacttgtgaaagcttagctactgttggattgtctcttaagactttaaatgctctgcgcaccctcttagtgaatgaaccttagagctattcatttaatgggtctaatttgtaccagaagtaagcatgtcatcaggattccttagctctgtgagcaggcaaggcagccacggcttatggacagcagcagaaaaggaatccttaaaacttcaaaggttctgtggccccaaagggagtgtgcatgccgttcttatagacgtcttgagctgcaagcctgttatgtgtatcgttaggtgctttggttaggtgttttttaacttcagaagtttaacgtcatttcaaaggcctccttctcataatggagtatttcctccatatgcacatcctgagcaaaggtaaccccaattaaagtagtagctcagagttttaaaagttttaaagtggcatacaacagtagaattggggctcatcaattatcaattctttcacccttcaaataattcttttctttattcaatgcctgtagctattgcattaatgaccacagc

SEQ ID NO: 50036 - DNA, 1733 bp, Homo sapiens
tgggttaggtgttggtgaagtgaagaggggaggggagagttcagggcattgggagcaagcagcatgtgcaaaggcaaaaaagtagagtggctgcggtggggacgttatgtctgcagaggctctcactaataagctttgtgatcttcaacaagtcctgtgtgtgttggagttagtgggcaaattctgaatgctctggagaggagtttgaggccctgctgagaatacaccagggaggaaccttgttctattctttgtagtcaccatgcccgcttccagcattgacaccattctaatgttgacaccttgatgttccaccaggcaagtcagaagaagctgatgatcaagcagggccttctggacaagcatgggaagcccacagacagcacacctgccacctggaagcaggagtatgttgactacaggtgagggcaggatgtttcagagccggggtgggtagagacggcacacttgctgccttgatgcaggagtatgtcaacaacaggtgaggatgggaaggtagagcccacttgccatctggacgcaggagtacatggacaacaggtgaggaacaggtgagcatggaggttgtagagcccaggggagggggagtcacttggtttggggcaaacttgctaaatgcaggaccacaggaaccagctcttcagctcccgtgagattttggctgcccaggccagttaggggtgtgggcctgcacggcagacagttatccctttctagtctggctcgtgggactctagagggagtcagtctgcaacagtaagtggtgagttcttctgtccagcgtcagtattttgatggtggctttagacttgccagataacactacataacatcagtactgccctggaaagccattcagtgaatttgacctattgctacctctttttcagtgagtctgccaaaaaagaggtggttgctgaagtggtaaaagccccgcaggtagttgccgaagcagcaaaaactgcgaaggtgagtggcatgctgtcctcagtttggaatgtgcttagggagataatcctaagaggcactggcattcgtcttactttgtgactgtccgcagtccagccatatacgctagcatcagaggtgcagcgcatacacaggtaatgctgcctcataccctggggtgcttgtttgggctctgcaggctcctctgatttgtattctctgtcctatctgctgggaggaggaatgtgggctcaggaatcagatgggcctcgactcctacctcagctatggcagcaacacagtgatggaatgggtggtggtgtgtgtgtcaattctggcccccgccctgggtcaaatggtaggacagatgtgttgaaatcagaggccatggctgttggacattcgaggccatacaaaattcagcagagagcagaattgcatcttaacctggcaccacccagtgttgaaagagtcagtcaagcatgggttggcaactccaccccatggagctgctggcattagagcacagaatgacaggtctgcactcagaaaccgggggcggtactgagtatcctgcacaggctgtgtgggaggagcttctgacttgtcagatgtgaattcctgctttgcctgctttctgtgagaggtccttgcagtcatgagagaaacagctcctccgggcctttccaccccaagccccgtgctgctgctgtgctccttctcttgtgcctgcctcaaggcttcttggatttgggggatgagac

SEQ ID NO: 50037 - DNA, 1071 bp, Homo sapiens
tagtcttattctccccacaccagccagtagtcattttcatatgtaagtctatttaattattattaaatagactattagtgtaagtccattgccctttgggtaaagtgcaaattacgtaaccgatgaggggattgacattgttaagactggcataggtataatagagatgattcttaatattattaacatccttagcaaaacaacccattgtactatcttctgttttcaggtggtgtcatttgtgaagaagaatgttctagtaactgggggatttttcggaggctttctgcttggcatggcatcctaaggaagatgacctcatgttcattgttcctggttttttccagccagcagcctctacactccatcataggacatcgagtccctcctcctcttctcccatgccttcttccctgccatggcaaatctgagtggcttctctaagcatctgctggtacaagtcaatgtggcaccatgagcttcatggtggcagaagagacaatagtccttagctctcctcccagtacaccccctacttggccagtctgtaggccaacaagaaggttcctttacccccatgcaagacacttatgagaacacattacaagatggctgaccgtggaggatgagtggatcctgaaaggttgtcccaaactgttgatttggaaaagaaataagcacatagataaccttattgtgtgctgcatggaaaggaactgaatacatttgcctttaagcatgaaagattttggtatcttggtgtctactttcttttttagttggttttacattacagaaagctatttaaatgtgttataattatgccgacaaaattggcagcataattactgtaattgaaaaatctgatattgtccaggaatgctttctaccgtacaggataatgtatctcatggctgtttccaaagggtttatttattgtaaaacaagtgatttaggtgggaaagggaagattttggatttttattttgtagaaaaggttttaagctttgaaatgtgaatgaaatatccttatcaaaacattaggggtggccataactcctctgtgccact

SEQ ID NO: 50038 - DNA, 1052 bp, Homo sapiens
catctcaaaaccataatggtatgagcctctttgctgcatattttgctataagaacttattttttttcactttttattatggacgctttcaggaatatataaaagtagagaatatagtacaataatccccctgtgtatctatcactcactcacaacaatcatcaaattatagctctgctggtttttaccagttattgtgaaacaaatatcaaaatgtcattttatcatatttcagtatgtatctctaaaaggtaagaattatttctaaaaatcataaatacctcatcatatcagacattaacagtaattacataatatccaaaatctgatcagtgttcaaaatttcctcaagtgttttatatttagtttgtttgaatcaaaattcatgcaaggttcacatcgtatttgcatgatttggataagtctcttaaccttatagatcctcctctatttttttttttttgcttgctatatatttatatctctatatatattgatatagacatatgtagtgacactgagtcatctgtttcctgcttccccacactctgcctctcctgacatctgggtctctgggttatgccatatatggtgatagtggctgcagccactttacctgtgtgacttacccacagcaatgggatggtaacagcaaagctaaccaaagtgctctgtgcccctttgggttgcatgtggggagactggccacccaatgcctctccagtggggtaggggttgtcttttggtgcatctgtttttcctgtgattattggtgagggcagcaaagattagcaggtggttgtaaactaccttgagtaggttgtaataaatagtctggcctcagactgtattctgattgtctgaattaagatctgtaggtaggtccctcctgaagttttttcccagctggctgcctctacgactgtgagggtcatggttgaggtcagtattgcaggttggcctcatcctgctagtatgagaacggctgtgagttctgcccacggtgtgaggccactgtgaccacttgggattgtgcagagctggcatggaggt

SEQ ID NO: 50039 - DNA, 1152 bp, Homo sapiens
tcacccattttacttcctttcaatttggtatcatggtgtagctattctaaaatgatcctgctccctaatgccctcagaataaagccccaaacctgcagcccttcatggtttgcttatttctccagccatgttctctctctgtcatatgctcactctgcctacagtttcctttttccttataccacctggccaatgtctagtcatttttgaagatgaagatcaaatttaggaatccttctctgataattctcaacccccaataccatcccagttaagcattcctcctggaaacttaataaaatcatatacttcctttttgtaatacttataacattatattttaatattttgtttttccactaacattgtaagatccttgaaagaaggtatgcttttttattactgttcccatggtgttcagtaaatatttgtttagtgtcccttcagctgtagatttcaaaactactattttaatgcatacattctgacctgtgagctctagcatactctagagcttctttgtcataaacttagtttggttggttggtcttagcttttcaattgaagtgtaacatacagaaaagtacacaaattacaagtgtccagctcaatcaattttcacaaaatgaaaacacctatgcaaccacaacccagatcagctccatgaatttttacaaggtgaacgcctgtgaaactgtactacatatcaagaaatagaaccttaccagccctccagaagcctcctttgtgactcctctcaattgttatgcccttgtttttttcccaaaggtaaccattatcctaatctctaacaacacagattaattttgtctgtttttgaattttatataaatgggaaaatacggtaagtacaactttgtgtatggcttctttcactctgttatggtagttcttttttattgctgtgtaatatttcattgttggaaattaccacaatttacttatatgttctattgttaggcatttgggttgtttccaatttggggctcttatgaataaagctgctatgaaaataatccttacataagcctctttttgcccatgtgaatgcatatcttttcagtatgtacacagaagtggaattgctgggttatcactttagtagaatagtttccaaattcacatccttgc

SEQ ID NO: 50040 - DNA, 1111 bp, Homo sapiens
aaaactagcagaaaacatagggaaaaagcttcatgacattggatttgacaataatttcttgaatatgacaccaaaagcacagctaacaaaagcaaaatagacaaatgagactacatccagctttaaaacttatgtgcacgaaaggaagcaatgaactgagtgaaaaggcaacctatggaatgggagaaaatatttgcaaatcatatatttaataaggggtcaatatccagaatatataaagaactcctacactcaacaacaaaaaaatctgattttaaaatgggcaaaggacttaaagtgatatttctcttggtcaacaagcatatgaaagagtgttcaatatcactaattgtcagagaaatgcaaatcaaaaccacaatgagataccacctcacacccattatgacagctactatctaacaaaatcagaaaataacaagtgttggtgggaatatggaggagttggagcccttgtacattattgttgagattgtagagtggtgcaataagcctgtagtttctttaaaaacctaaaaatagatctactatatgatctaccagtctcacttcttgggtgtatatccaaaagaattaaaagcaagatctcaaataggtatttacatacctatgttcacagcattattcacaatagtctagaagtaaaagcatcccacatgtccattgatggataaatggaccaacaaaatgcaacgtaacatataatggaatactatacaaccttaaaaataaaggaaaacctgttacaacctacagcatgaaagaaccctgagaatattatgctaagtgaaataagctattcacaaaaggacagatgcagcatttttctatttatataaggtatctaatgatcatagatatacaaagtagaatggtggtcaccaggggccgggagaagggagaaaggggagtttcagttctgcaaggtgagaatgttttgaagatctgtttcataacaatgttaatatacttacattactgaactgtacacttaaaatggttgatagtaaattttatttttttaaccacaattaaaaaaaaaaacccaaatggacattgtaaaagtggaaaatacctaaaattaagaaatcac

SEQ ID NO: 50041 - DNA, 1036 bp, Homo sapiens
gggtgacatctttaatgtgcatgaagaaaaaagctatcaaccccagaattttatattaagacaaaccagacatttttatggaaaaaagcaggcagaattaatctggagaattcactacaagaaatattaaaagttcttcagactgaaaatatatgattttagatggaagcacaccctgactacttgggtgtggggaggggagggcttgtaatgccccaccatttgtgttccatctaggttgtggtatggggactagacatgttctgctgggatggggaagctagatcttaagctgccttaccaccatgtgccagtggggcctcacagtgccaggggccttcaacctgaattctccactgaacctgctggtaggtagagtttaggtgtatttggggtgagaagtgggtagaggtagattggttgggccttagtaacaaacatttctgtttctcccactctagcatgagcatgtgaatatttgtgaatttcttacctatttccccccaggggagaaaatgggaagtgagggccactggtaaacactgagttagaacaagtgagtaatcccacctacataatgaatgtgatggagtcattgaagagtctgtagttcctcttctccagacttttgtgattaatttgttcaacctcactggcaacttcttgactgaagacagtattaattagctatttcccctgactggggagcagacgtaaggaccttgagctctcaaggcttctcttaaatttacagaagtggtcttagattctctatggaactagggaatactggctctgcagacgggcttttagtttgctctccagacgaacccagtttgaactctatccactttgaagttgcatcactaaatgaattacagcaatgcttaatctttaaagtatgccatatcccaaacttccaattaaaactgtagagaacttctgattataacaactcagggtttaaaaactgacctgaactgattgcctcacaggtatgagagaatcgaaatcccaatccatattgtacctcatg

SEQ ID NO: 50042 - DNA, 1050 bp, Homo sapiens
tcacttgaaggtcatactctatctctggggataaaatctgcatgaactacttagctgatttgaaaaccactagccttgagcatatggaatgtatatactatattgtccctaatttcccacagccactgttcttctctattctttttctttccctataggaaagatgaaaatatccagtgtaaagttacttaagctaaatcaatttcaaagaagaaaaacttggaggactcattttacctgacttcaagacttactataaagctatagtaatcaagatagatggtattggcagaggaacagacacatacgtcaatggaacagatgagagaacccagaaataaacccatataaatatgctcagctgattttgaaaaagtgaaaaagcaattcaatggaggaagaatagcctttctgacaaattatgctagagcaattagacacccatggcgaggagaaaaaagaacctctacttaaacctcacatcttatataaaatttaactcaaaatgtataacggacttaaatgtgatacataaaactagataactttgaaaaaagccacaggagaaaaatcttcaggatcttgggctaggtgacaagttcttggactttgccccgaaagcacatccataaaagacaaaatctgatatattggacttcttcaaaatttaaaaacttgtgatttaagaagaggaaaagataagctacagattgagatgaatttgcaaaccatatatctgatcaatttggaatatataaagtgtactaaaaactcaactgaagtcaggcatggtagctcatgcttgtaatctcaccactttgggaggccaagatgggaggagtgcttgaggttaggcgttccagaccagcctgggcaacatagtgagactcttgtctctacaaaaagtttttttaaaaaattaactgggcaccatgacacacaccagtagtcccagctactagggaggcaggaggatcacttgagcccaggagtttgaggctgcggtgagctgtgatcacaccaccacactccaacctgtgtaacagagtg

SEQ ID NO: 50043 - DNA, 1046 bp, Homo sapiens
tggtcttctctttcttatttctgttattcatttctagtattaatgcatcttatagttttgcatgtggatttcttcatttaacataattctaaaactttaatatgttgtataggttttataattttagtgcctgtagtcccagctacatgattcactaaacaacaacagcaaaccctggggagagggacatctgatttccagagccaccacattataacatcaaaatgtccagttttaaacaaaaaagtatgaggcatgcaaggaaacaaagtacggcccactgacaggaaaaaaaagtttataaaaactgtcccagacaaagcccaggtcttggacttactagacaatttaaatcaacagttgtaaatatgctcaaagaacaaaaggaaaccatgaataaacaattaaatcaggaaaatgatatctcgccaaatagagataacaaagataaaatttttaaaaggaacaaaatagaaattcaggagctaaaaactataataactgaaatgaataattcatgagagagacttaacagcagatttgagcaggcagaagaaagaatcagtaaacttgaagataggtcaattatcagagacccaagtatcaaaaagaaaaaagaatgaagaaaaacaaacagatcctcagagacctgtgggacaccatcaagcttaacaatgcacccacaatgggagttctagctaaagaaagaaggggcataaagaagtaatggccaaaaactccccagatttgatgaaatctatgaatctacatattcaagaaactctaagtattttgagagggataaacccacacctagacacttcatagtcaaaatgtctaaagccaatgacagaatcttggaagcagcaagagaaatgacttatcacatacaactgaacgtcaataatattgacagccaaattgttgtcagaaatcatagaggccagaaggcagtgggatgacatattcaaagtgctgaaagaaaaagtgtcagtgaagaattatatgtccagcaaaattatcctacaaaaatgaagtaaaataat

SEQ ID NO: 50044 - DNA, 1072 bp, Homo sapiens
ttcaaggggcaggaagctccctgggatggtgagaccagaaaggcacagaggctgaaccctcgtgatggcgctaggtcccaggttcgctagcatccgagagaggggattgggtcgctccagaggccattgcgaaggctgctgccagttctagggtcggggtggggtcaggctaggtccctattcctagggctttagcaccgctcactcacaagaccccttttcccaggaggacgtatgggtttttcctgtcgctccagcttctctttcgcggcccttccacgcttgtcacttacctgagcgcagccaatcagcacctagaggttgggctactttcggccaaaggagaacggggacttgtgggggacgctccctgcgcaccaatgaatgtgcatggagatggagaggcgggcctgcaagtgcgaacaagccaatcacggaatcccggcggccggcggcccgggaggcagtcgcgcgctcgcatccccaagatggcggccgttaaggacagttgtggcaaaggagaaatggccacagggaatgggcggcggctccacctggggattcctgaggccgtgtttgtggtaagaggcacgctgttccctggcatcttggcttgaggccttggactgcccctttcttcccggctcccacccaggcctcgactgttggaaggagctgagccaagtgttcagggagggggcgctcggtctgctctcacccctcgcacctggacagattgagctctgctgggggcccgcccggaagaaacgtagctcgagaaggccgtagaagagaacggggtgcggggccgggacgaggggcgaggggcgaggggcggcgggtggcagggcagggcggcctgagggacctccgggctgccgccggttttcgtccccctgctggttggaaaaggggaggtggtgaggagctctcgactcagcatggatgctggagacacagtacaatgaataggcagaacagccagtgctaagatgtgaaaaccgggaatatcactttgtctgttgaaggaatgcagtggtctcgggaatgttgcctcgggaaatggaagaag

SEQ ID NO: 50045 - DNA, 1057 bp, Homo sapiens
acaaactgggtggctttaacaactgaaatggactgtctcatggttctggaggccagaagtccgtgatgagccccagaatcagggtcgattccttctgagagctgtgagggaaaatctgttctagcctcctctcttagctttggtgttcgcggacagtctttggcatgttgatgtgtagaagcatcactgtgatctccgccttcatcttcacatgtgtgcatgcatgtgtccaaatttctccttttgaaagaccttatctccaaataaagtcacattctgagctactgggggttagtagtccaacttattttttgttggggagacagaattcaatccataataccttacttccacgtaaggtcacattcgctagtataaggggttaaaacttaaatgtatcttttttggggacactgtttaacccataataataccctaattcactgtcttgcttctgcccttgctggaattcctaaagtctttccagcacagtggtcagattaatcctttgaaatctcaatcaggtcattccattattctgcccaaaatctttgaatggtttcttatcacattccgaggaaaagtccaagttctttgagtggctgacaagttcctatacatcctggtactctctgttacttctctctttttttttttttctgagacagagtctcactctgttgcccaggctggagtacagtgttgtgatctcagctcactgcaacctctgtctcccgggctcaagcgattcttgtgcctcagcttcctgaatagctgggatcacaggcacgtgctaccatgcccagctaaattttttggtagagacggggttttgccattttggccaggttgatctcgaactcctggcctcgggtgatctgcccaccttggcctcccaaagtgctgggattacaggtatgagccaccgtgtccagtctctctgttcttctcttacttcctcgcttggccacacttggacttcttgccagacttagagcatgctgggaatggccctgcctcagaacctttattctagctctttcttctgcttaagctg

SEQ ID NO: 50046 - DNA, 1598 bp, Homo sapiens
atattcccaagtcaaggggtgtttggattgttttaaaatttcttgtacagtgagcggtgctgtagtaaatatttttgcacgtatagacttgtatacaaaggcatatttttgtatgctgctttgaaatggaattgttgtgtctaagagtatgcacatttaacatgttgatggatactatcaaattgctctccagaaaagactaccaattttcattttctccaaccgtatataaaaatacccttttattaacagtctcacccacatttttagatttttgctagttttataggtgaaaatagtatcatcttataggtttttgtatgacaaaatgctcatttgtatttcctcttctgtttcccttcctgattatgttgttgctccatttttctgttggattctttttctttttttttttgatagacatttaggtcttctttatatattatgtatttcggatgcacagtcttctcttaatattgcagatactttttctcatctgtcacttgtcttttgtggtagctcttagaagttttaaattttaatgtaatcgactttatcagatatttataattttatcttaacagtgtactcctttcaccaaatctgcaaacatttttttcctaatatttatatacttaaattttttagaaaacttttttgttaaggataacatggaaagataagcaactcctcaggataatgggtgagtgacttccaaaaagagggcctcccaatggccagtaaacatatgaaaagttgtcccacttcattagtaaacagggaaatgcaaattaaaagcacaatgtgatctcactgtgtacccaccggaatggtagggtgatactaagtgatggtaggacatggaatagtgagaacactgatttactgttggtgaaggtgtaaatggacacagccactggggaaactggcagtatctgttaaagcagaacatatgcattgcctatgccatagcagttccatgcctgtctctatctctttctgcctcttgctgtatataagaaatgtataaatattaactaaaagaaaggtataagaatgttcatatcaactctgtagtaaccaaaacctggaaacaacccaaatgttcatcatagtcgaatggatgagtaaatcatgatgtgttcagactgtggaatactatacagtacagaggaggaatgaactgctgctacacgccagcactgcaagggtgattttcacaaacaaggttgagtgaaagaaactgcatagcaaattaccacaaactcagaggcttaaaacaatatccattatctcctagctgtataggtcagaaatccagatgggcttggctgggtcctctgtgcagggtcccacaaagccagaattaaattgtcaacagggctgtattccttactagcatctctgggggagaattagatttcagccttattcacgttattggcaaaatccggttctctgtggttgaggtccctgtttccttgctgcctgtcgtccaggagtcagtctcagcttctagaggccacctgcaatccttggctcatggtcctttctgttttcaaagcagtgatatgactagtctttcttacactttagat

SEQ ID NO: 50047 - DNA, 1060 bp, Homo sapiens
aatacagtagaactccctaaacatttgtctcttaatttaatttggaaaagacattttatttccagaatgagacaaattttatttgctctagaagtagcaccaatctttcttagtgctatctgcttatccaatatttcttattttttgagacagagtctcgctctgtcgcccaggctagagtgcagtggctcagtttcggctcaccacaacctccgcttcccgggttcaagcgattctcctgcctcagcctcccgagtagctgggattacaggcacatgccactgtgcccagctaatttttgtatttttagtagagacggggcttcaccatgttggccaggctggtcttgaactcctgagctcaagtgatccacccgcctcagcctccgaaagtgctgggattacaggcatgaaccactgcgcctagccttttccaatatttcttattaaatatcttatagtttttataaaatgttcaaccctaaaagaaataagtaacagaattttaaaaattccgtggtgcaaataaacagcagactgatgaaacatcttgttctcgcttttctgccttaaaaattgcatgaattcatttttgtttctttccactgtggccatttaagcctccatcctcagcttcctggctctacgggaagaaccccctgttcctctcattataaacttcctccaaactattctccatttataacccatcaaagcctttgaaatcataaattactctctataatctcttctttttacacttagaataagagaaaaataataataataacaaagtaccaacacttttccaagtctcacaaagccctaaataatcctgtccttgtccaaccctctggctcacgctgtgccactcctcttttgttcccagagaaaaggtaattttcttgaacagtaaataacagacaagatgaatgggaaaatatcccattacacccttatgctcaagagaaaatatgacaagttttgatgagatccttctggctaaaaagttgctaatgataatgaaaacaaaaggggatattacttcaacaaatgcaatt

SEQ ID NO: 50048 - DNA, 1077 bp, Homo sapiens
aaaaccaaaacatgacatctaccctgttaaatttttacgtgtttaatccacattgttccccatgagctctgtcttttattttacacccatcaaacagcaagtccctattgtccccccttcttctcagtccctgggaaccaccgtcaaccaccccctactccacaaatcagagaagacacaggtctgcacacctgggtcttaactttcatctgaaacatttttagttctcaaggacatcacggagaatagattcatgctttcatgtctagttataaatgtctggctttgagccggctgcatactcagcttttaaaatccccttgggggcaatgtctcggaaacccactggctgaaaaacaattcataatgaatcaggaattgtgcggaggccgttttaaaatgagtgccttgaaaaaaggaaaaaaaaaaatctacaaaaggcaaagtttaaaaaatgatgtcattccagtaagtgaggaatgaagaaaggtaatttggtctacagagttcagagttcttgttattttacactgggcttgtttttaattgaactgatgaataatgaccagaatgcctgaacatctagagctggaaaaagctggccctggagaaggtacatcattcgttatttgtgaaagtcagctgcggtagtcagtacaggatacagtagaagtatccatttcactgtggacagatgtttagatgccttttcttttttcttgggatttttctttttcccacccaaccccactctaccttttttctaagaaaagtatctggtaacaatccaacatgggaaacttctgcttctttcaagaatataacctttaaaataatgggtgcttaacaagacattctccaagctcctatttttcataactttactgtggccacaatgagaaatatattgtgcatattttacagaaccatccggactcacatacatgcaaacgcacacacgcccctaaaactacagctgaacaagacaatccaaacttaacaatattaatagtgtagaaacagggttatcagatatgaatttattaatcatggttacacagagcactgtttcatttc

SEQ ID NO: 50049 - DNA, 1030 bp, Homo sapiens
atcttaacaagaggctgtctcgggtatcgctttgcagagatggacaggaattgctggagttttttgttctgttttgttttgctttgttttgcggcagagtctccctctgttgcccaggctggagtaccctggtgcaatcgcagctcactgcagcctcgaagtccttctctcaagcgatcctcccacctcagcctcctgagtagctgggactacaggtgtgcgccaccacacccaattaatttattttttatttttattttgtagagatgaggtctccgtatgttgcccgggctgatctcaaactcctggcctcaagcaatcctcccaccttggccctgcaaagcgctgggactgcaggtgtgaggaactgcagtatggggagcacccgttttctgtgggcagtgacatgcacactgttacatgtgtgtgcaacaaagttatccttcaatccttcaaatactgcaacgcgtgggacacctgcccactctaaccactgctaaaagacaaagctgttgacacgagaactcagcagaaaacaaaatcacagagctaaggtttccattccatctgctcctgctcacaccaaggcgctaaacaacacttcaataataaatatgtgttacataagcataacagaataaatatatgactataatatgtaaatagattaatgtatatttattacatattaatgtaataaatacattaatataatttatgttaatatatatttttaatgtatttatgcaatacatgtatattaaatttaatatatacaatatatgaatatgttacattaacatacaatatatacacaatatatattaaagtactatatattaaagtgctgtatatgaatatatgcatgtactatattcatatacaggactttaatatatctacatattatacataataagtatactataatatatagtataggtgtataatatatatataatgtatatataatatgatttatataatatatatttatatgtttagtataatgtatagaatttttatatat

SEQ ID NO: 50050 - DNA, 1042 bp, Homo sapiens
gccgcatcactgctgtctctgcctctgtccccatgtggccttctcctctgtgtgtgtgcctcctcttgagtctcttatgaggatacctgtcattggatttgggcctaccctgttccaggatgatctcatctgaagctccttaattctatctgtgaaaaccctgtttcccaataaggtcccattcacaggttgttggggtaagatcatggatgtatctttttggggacctctcattccgtccactccactgaattttgttaaggtcaggaagtgatttggaatctacaggagaattatttttgctcatggacatttctgataatcaatgagggtgtcatttgaaagctccgttttataaggtatttccgttgctagcatacctgaattagaatatcttaagtcaaaagaagctaaatggaaaacatgactttgagccaatatgagtatctgtcctgatcaatatgagaaaatctcagaagtacaacttgtgccacggacatgtaagtgtctagtatacacttactggttgatgaaatggtttggctttgtgtccccacccaaatctcatgtttaaatgtaatccccagtgttggaggtgggacctggtgagaggtggttggatcatgggagtggtttctgacagtttagcaacattgccctagtacagtctcatgatagagttctcaggagatctgatggttttaaagtgtagtacttccccctttgctcgctttcactcatctgccaccatgtaaatgtgccttgcttccccttcgccttccaccatgattgtaagtttcctgaggcctccccagccatgcggaactgtgagtcaactcaatctcttttcttttcttttttgttttttgagacagagtcttgctctgtcgcccaggctggagtgcagtggcgtgatctcggctcactgcaagctccgcctcccgggttcacgccattccgctgcctcagcctcctgagtggctgggattacaggcgcccgccaccacgcctggctaattttttgtatttttggtagagacag

SEQ ID NO: 50051 - DNA, 1203 bp, Homo sapiens
tacttcctatttatctatgtgcctatccatctatttatcatctgtctttctatgtaactgtttacctccctacctatccatctatcaatcatctatctacctattcatctatctgcttttctatatatctatgtatttatcaatcatctacttacctacctatccctctatctctacctttctgtctatctagctatcaataatctacctacctaccggcctgttggtcttttgaattttccattactctttgctgagacatgcctacaagtcatatagaaccaaacttctcaatatgcaccctagcccattatgtcctaggcaaacccaaaaggttaaaaataacttaggcatattgatcagcgtccacccaaggaaaagcaccacattttccttcggtgataacactgaccacacgagggcagcattgcctgaggatcgttgtatcctgtagtctaatggttttaaatagagtgaggttcgtgtgccccaaattttattgattctaggatagagtagactattattagaatacaatatactattaggacataatattgttagaatacaacatagaactattagactatagttaaaacaatattagtctcagggtacgctgaagttaaaaatacataaaaataaatttaaaaagaatagaatattacactcttagaatgactgtattcgaattatataaagttaccagaattgttaataggctataacattggaatatttaaatatattagaatacaatagaatagaaaataacctaattgtaatgtaataaatcattaggctaattgaaaatgaataattaggccaggcaccatggctcacacctgtaatcccaacactttgggaggccgaggtggttggatcacctgaggtcaggagttcgagaccagcctggccaaaatggtaaaaccccgtctctactacacatacaaaaaaaagccaggcatggtgcctgtaatcctagctactcgggagtctgaggcacgagaatcgcttgaacctaggaggcgggtaggttgcggtgagccgagatcgcaccactgcactccagcctgggcaacagaggtgagactccatctcaaaaagaaaaaaaaaaaaaagaaagaaaatgaataattaaattaaatgaataaccgtctcccaatcaaagcccagtctgctgacctgtgcatttcatgaggc

SEQ ID NO: 50052 - DNA, 1087 bp, Homo sapiens
aaagaccctattttcttttcttttttttttttttttttttgagacggagtctccctctgttgtccaggctggagtgcagtggcgcaatctcggctcactgcaagctccacctcccgggttcacgccattctcctgcctcagcctcccaagtagctgggactacaggcacccgccaccacacccggctaatttttttttgtatttttagtagagacgcggtttcacctcgttagccaggatggtctctatctcctgacctcgtgatccgtccgcctcagcctcccaaagtgctgggattacaggcgtgagccaccgcgcccggcctcaaaaaccctattttcaaataagacgccattcacaggcaccaggggttaggatgtagacatatttttggggggcaccattcaacctagtctatccctcaatctcaatacatcccctgggttaaacatgaaatgtgtccccttcttcccccaaatcaaagcaacccaaaagacccctgtgcacctgcacaccttgcctaagtcggcagcactcactgcgtagatgcccaaaccctaagctgtgatcatctccaccctccctcttgcagcctaattgagcccattctctgcccaagcaccttatgaacaggactttaaccctccatctccaccaccttcccattttcactggaaattttacttcttaaagaggccttccctgaccccttgaccaaggttagatgcatcccaatgttctcctatggatatgttgtttgaagtcctcaagtctgaacaaactcatgtgaggtcacccaagttgttagacttactgtcattaatgcttcctgccctccttccagcccgactggaactaaacaaaactaaatgagggaccaaccttgtgttgttcattgcagtttctcggaggtagacagcacctgagacccaggaaaatatcaatcatgatggaagtgatgcattcatttattatattgactccttttttttcccaaaagctattttgtgttcaaaacctggactgcataaaccacttcattgtggttatggagtgttagaagccgacacctaatcaaagaattcag

SEQ ID NO: 50053 - DNA, 1022 bp, Homo sapiens
cccagcactttgggaggcccaggcgagaggatacattgaggccaagagttcgagaccagcctgggcaacatagcaagactgtctctacaaagtttttgattttttttttctttttttttttttttgagacggagtctccctctatcacccaggctggagtgcagtggcacaatctcggctcactgcaacctctgcctcccgggttcaagcgattctcctgcctcagcctcccgagtacctgggactacaggcgccctctaccacgcctggttaatttttgtatatatagcagagacggggtttcaccatgttggccaggctggtctttaactcctgacctcagtgatctgcctgcctcggcctcccaaagttctgggattacaggcatgagccaccgcacccagccgcaaaaagttttaaaattacctgggcatggtggtgcgtgctggtagacccgactacttgggagactgagacgggaggattgcttgaggccaggaatttgagaccagcctgggcaacataaggagactctgtatctagaaaacatatatatattagctaggtgtagtggtgtacgcctgtggtcccagccactcaggaggctgaggtaggaggatcgcttgagcccaggaggtccaggatgcagtgagctatgatcgcaccactgcactctttgctgggccagagcgagaccctgtcttcaagaaaataaaaggatacagccacacacagagggatgaccatgtgaggacacagggaggatcgcttcagcctgggaagtggaggctgcagtgagctatgatcacgccactgcacttcccaggctcaagcgatcctcccgcctcagccccccgagtaggtggggccacaggtttgtgccaccattccgggctaattatttgtagaaatgaagacttcctatggtgctcaggctggtcttaaactcctgagctcccgtgatcctcctgccttggcctcccaaagtgctggtactataggcatgagcaactatgcctgga

SEQ ID NO: 50054 - DNA, 1051 bp, Homo sapiens
tttcagcttttcagcaagctgaggccggaagatcacttgagcccaggagtttgaggatgcagtgagctaggattatgccactgcactgtagcctgggcagcggagagaccccatctctaaaaagaggagaaggagggaaaatacttctccttctcagacccaaagtaaaaaggtttctggtctcacactgaccagaaaaacattgatatttacttaagcaatattaaaagggtcactgctttagaacaggattaaagagaaagtaaaatcaacattgagataggaggacagaggccatcaactgagttctgatcccaatgaagacgagaaaaggctacaactatctaggttaaatatctacttgtcctagaaaaagccttttggcagcaacataaaattcatacctcttagtttttaaattcctatggatgctgaagcaaataaccacaatttgggtggctgaaagtaacagaagtttattctttccagtattggaaaccaggaatctgagatcaagttgtgggcagggctggactccccctggaggctctagggggtgttccttcctgcctcttccagttcttggtggctccaggtgacgctgtcataggacaaagggccccgggtgccgacctcctcagccgcagcggggcagggccctccacaggaggtcggcacccggggccctttgtcctatgacagcgtcacctggagccaccaagaactccgcgcagggctacccctgcgtcctgggtctccccggggggcgctcgaggaggtggagcttcccccgcagccccggggagtctccccgaccggccaggtgccttccctggaaggctgacggctcctctaggaggccgccctccaccactagcacacaccacccccaggactgggccgcccaatgtcacaaaacctcctgtgggtcacctcgcctgggggacctcgtgcgccctcccaggcagcgaccgcagggacacgggcctccatttgcccagcggcagggttctaggcgtggaatgtacacattgctcccagttcgcccgcc

SEQ ID NO: 50055 - DNA, 1801 bp, Homo sapiens
gcggcaggagactataatcccagctatttgggagattgaacccagaaagcggaggttgcagtgagccaagatcacttcactgcactccagcctgggcgacagagtgagactctgtctcaaaaaaaagaaaaaaaaaaagcattgaaacatgcgacatccacctttttgtaatagttcccatagcctacacaaatgcatatgaaatgcttaatattttgcttgcactattcttttctgctggaagggtggttctgactaaaaaattttactttcccattctttgctttttcattaatgctattttctttgctccagggttatagagtggaaagtcccacaatctttttcttctctattttcaggtagatgcattttattactatattctatctatccatttattccatctatctattccatttatcatctacctacctattattatctatcatctatgtattccatctacctgtcattgatctatctatcatctaccaatctacatttttgtcttgtagaaaaacgttgacctcttggcgagaatgcaaagaagggaacgcttgcttatacgctgttggtgagaatgtaaaattgtacaatctctatagaaaacagtatgtagatttctcagagaactaaaaatagatctaccctttgacccagcaactccagtaatggttatctacccaaaggaaagaaattatcagaatagacacctacacttatatttttattacagcacaattcacaatagcaaaatcatggaatgaacctgaatgttcattggatgaagaaaatgtggtatacacacaccaaggaatactatgcatctataaaaaagaatgaaactatatcttttgcagcaacataaatggagctgcgggtcaatatcctaagtgaaataactcaaacagaaaatcaaataccacatgtcctcgcttataagtgggagttaaaaaaaatgggtacacatggacctatagaatgacattaacagacacaggacaccttaaaaagggggaaggtgggaggggatgagggtggaaaaattacctatctggtattatgttcactgtttgggggttagaaggccaatccccaccgctaggcaatatatccacgtaacaaacctgcacccttatgccctgaatctatttgtttttcaacattgacttccatggtcactatttgtgaaatcactcctcatgaaccaggacttgcatgtttttttgtttctcaggtgaactgtcacccctacaactcagcttgcaaccagccctggccaccagtttccccacactgagctgaatatcggacatgcccatctcagacattccagcccattctgaaattccacatcgattcacctgacaaagtctgaagttccagggcaatttatctggaaaagcttacctggaatcacgtgtcatttcaaccaacaactgttgaagaggacgtggcattaaaaccaagggtatcaattatttataagggctgtgtgctggttggtccaagcatctctccttcacgccatcactcctttcaagagctgcctctgttttctaatttagcacaggaatttagatgcccctaaataagtaggcatccagtatctgcccacaccagttttagtgagagtacatatggagacactaccaccacccctgctctcctactgcataccccaccatgccaaagcatggtggctcacacctgtaatcccagtgctttgggaggccaaagaggaggaacacttgagatcagaggtctgagacgagcctgggcaacatagtgaaacctc

SEQ ID NO: 50056 - DNA, 1035 bp, Homo sapiens
ctgcgcccagcccctgctgcactttaagcagagagaaaaacactgtagtcataagagctattaaatacagtacataattttaaaacatttttgaaacacagaaaacacatacttttttgatctcaggaaggaggaggagttagtaggggaggcttgcacccatccatgcttctgagcgtgcactcacacatgcatgcacactaccactcattcacatacactcacacacacttgcactcatgccctttacactgtgcacattcagatccacaccatgtacactcatacactggcaaacccacacatgcatcacacacctacacttgcactgtcacacgcacatacacttaagcacgttcacaccctcatggttacactcacacgcacagcctcacatatgcacactcaacactcatacatacacatttacatgctctcatttatacacactgatacatccacacaccatcacactacacacacttttacatgctttcacacatacccgttggatatggacacaccaacaagcactcattcccacacatgcttgcactgcacacactgacacactacatgccttcatagttgacacacacttccatgcattcactcacctttttgcacactcattcacactcccatcacaacactgacacacttctgcctgtcctcacacgcctacacacttgccacacacacactgagtgttccatgcacactcacatcctgcgcattcagtcactaacttaccctcatgaccacacacacacagactttcaaatgcactcatccacagacacatattctcatatgcatacgcacttgcacacaaccctcgcacgcttgttcacactccctgacatgcagtcacactagccatcactcatgtgctcacacacatacacactcacaccccctttgcacacacacttcccccacccactcaccccaagcccacctgacaggtgacacactttacctgcgggctgggatggctggtcctctgcctgggcttcgaggttccttgggggc

SEQ ID NO: 50057 - DNA, 1344 bp, Homo sapiens
tgccgaacaggctggaagatgcatgtctgtgtgtcggcatgatttagtgagcaaatctgatgggaacgcagccgtttctttaggtttggtcagtaaaaccaatggcagtgcgctcttggctgacgctgccattacagagggtgatgttgagaaaggcagtccctggggatgcttctggtgtgtcaatagcctctggctgctcagcgtgtcctctccctcctgccccttctgaaactcccgataaagcaggtgtgagtcgctgtaagtttgcattatcacatcaaaattttttttccaacatattttattgtagtaaaatatacatagcataacatttaccatcttagccatatgtaggtgtgtggttcaggggcactaaatacattcacgatgttgtacggccatcacccccacacatctccagaactcttttcatcttgtacaactaaaactctgagcttcaagttggggtaagcggggcgggggtggggactaaaactgtccccataaacaccaactctccattccctttttccccaaccctggcagccactattctactttctgtctctatgattttgactacgctgctttcttcacagaagtggaatcacagaatatttgtctttctgtgactggcttatttcacctagcacagtattctcaaggttcatgttgtagaaagtgtctgaatgtcctttaaggcggagtaaaatttcactgtgcctaccacattttgctcattcattcatctgtcaatggacacttgggttgcttccaccttttagctattatgaataatgctgctgtgaacacgggtgttcaattacctccttgagaccctcctttcaattttttggggtatatatccagaagtaggattgctagattttaagtggaattttcattttctttagttccttttcagactgttcattgtttgttagtatttagaaatgcagctgatttttgtgtattgactttttttttttttttcagtctcactctgtggcccaggctggagtacagtggcgcagtctgagttcactacagcctccacctcccaggttcaagagattctcctgcctcaacctcccgagtagctgggactacagtcacgtaccaccagtaattttttatatttttagcagaaacggggtttcaccacgttggccaggctggtcttgaactcttgacctcaagtgatccattcaccttggcctcccaaagtgctggaattacaggtgtgagccaccgcacctggcctgtgtatttaccttgtatgctactacattgctgatttcatttattagtttttttttttttaattcttttttaaaaaag

SEQ ID NO: 50058 - DNA, 1029 bp, Homo sapiens
agacacagatgtttcagcttctacttagcagctagcccaaggtctaaagggtacatgttttgagggtaatagaagcaaggaattttatgttctcttgtcataattgatattgtggggttttttttaggctattcaagattctgactattccttggttaatttttaatggatttttgagtggccctcaaatcatttcggagctctgtctactgagatgaaatcacagacttcatgaaccatgggaaatttaaccagtgacatgctggtgagccattgttcaaatcttccaatgtattaataaatcaaccggagacagagacaaaggtcggggggtggggggagagacagagagtgacagagagaggagaaagagaagttcaagactgaacatgaaggatcgaaggatctctggaaatgcctcccagagcagtaaagaggaaaatattgaaaaaacaaacaaacaaataaacatgggttttgaaagaaatagaaaaagtttccattgacttttaaagatgtagaatgtggtgatggaatattttataaggtactgtggaacaaataccaggggtatgatggatgtaattcaatgccagctataagcaaaaagaggcaggaaagttcatatggatgggtgaaaaagagatgcccaaattttcaagcagattggatagtttaatctgatgctcagaagagtgaaatgtgcactcctaaacttttgaaagtttgaaaatacaaagactcaaggtagcatagaatgtttgcaatacctgacatctgagctaagacgtgttaccaacacaatgccccgaaagagtggatgctattgcagagaagagggattccatacaaaataacagacaacattcattcagagggtttctttttcttcttttcttcttgttttatttttatttttttgagaaactgctgaaaatttcactcagagggctgtaatctgtgtaagacaggtctcttgaactgagatactactattcttcatgtgggactcatgatactaaaaaaaca

SEQ ID NO: 50059 - DNA, 1049 bp, Homo sapiens
caatagtaacagtatatttatttaatccaagggagagaacaccgtgggaaacttagccacatggctagcaacacacctagtcagaagagaggatacacttcttgttttcacttaacagatttgattggcatctagatggatcaacttcaccagcatggtacaacttcacacttcatttggcgtgtataaacacagcctatagtttcccagtttgagttttctcctgggcagctgaatgctacagagtgcagtaattggactgacatctacactgataacagaattgtctgcagacaactgctcatcttttcaaaatgtttacatctctattggtggtctgtttcctctctacttggtctgaaacaatttatgagacatttaacaaacaataataaatgaaccctattaatatactcagatggggttcttgacttctattttctctgtgaaaggatgtctactggtagatattaagcggttagttatgaaagcagctttcatataaagtggataaaatatttttgtaatctgtaatagaatgagaccccccctaaaaggggcaaaaaggtagaatgtacagtcagcatttgtgattcatgctcaggttggaaaaaaaaatcctttctttcttttttttttaagagatggggtctctctctggtgcccaggctggagtgcagtgtcgtgatctgaggatcatcactcacagtagccttgagctcctggccttaagctatcctcccaactcagcctcccgagtggctgcaattacaggcatgcaccaccatacctggctaatttttgttttaattttttgtagagatgaggttttgccttgttgcccaggctgaaaaattatttaccagagcatttacttgaattctgctagaagtgtttaaaccttaatttttctgattagtgtttttgcttaatggataaacaactatatgatcttaggttatgtcagcatataatgcaatttgatgtaatggcaatgtacaagaataaattggttgctccatccatctgattgacaactagtttttata

SEQ ID NO: 50060 - DNA, 1095 bp, Homo sapiens
accttaacgattcctctgtcattctaactgaattgtaattcatctgtttccactgatgcaggacagtcctttgagtagtcttggttctcccctcttttttttcttggagttcttaagaataactatagaatgtgctgggaatgcaacatcttgagataagggggagttacctagaacagtccaggctctgttccaatcccctcatagaaataggatgtccttcaatgctttagcccagcgggtcccatggccccaggtgtgaaacccagggcaggctgatttatggggtctcttagcttcagtgcaacttgggcatgcacagaagagacccccatctacccggggcagcttttctgagccttggaagagtggcttgctatgaagtcccagcttctattgcttcttgctgcctagttgaaagtaacaaacccactttacttactctgtgcatgagtgttctgtctcactggatgcagacaagtgggtcatcagtgcacagtgaacctgcttcacaaatgagaaaactgagacccagaggtatggaatgacttgcccaagatgccatagtgagtggtaggatttaagcaaagaaccctagaatgttgctcttacattggactcaatgcatgtgatgtacacgtgtgtgtgtgtgtgtgtgtgtgtgtgtgtaattgtgctgtctgttacatcttcacttccagaccacatgctgaatggcagagggaggaacaacaacaacaaaattcaaggccattctgcaaaatcaacacatatgatcccgctttaatgcaagcataatccaatcttagcacagtaatatggctcacggacatttcacccaaaacactgcagtgcagaagtctttttgagcattatcctccttggcctctgcctttttccttcactgcatgtagaacagtaaccatggggtaacatggtcctgggccatgaggaatggatttagacttctccagtgattgagggtatatgttacatgctcttaagtttttatttagaaaagctcttttccatctaggaggctattcaatagacacttttcaccatgaaactgaccatggaaaattatttttcaaa

SEQ ID NO: 50061 - DNA, 1074 bp, Homo sapiens
gataaatcatgtgaacccctaatatgatatgatgaaaagtgctcctcactgctaagatcttcttccccaaaacctataactctagtttaatcatcagaaaatatcagacaaaccaagatagagggactaagacaaaatatgtcttagtccatgtgtgctgctataacaaaataccttagactgtgtaatttataaacaaccgacatttgttgttcacagttctggaggctgggaagtccaagatcaagacatgacagagtctgtgtctggtgaaggctcacctcctggttcataaatggtgccttcttgctgtgtcctcacatggtggaagggcaaaaggggggaacagctccttaccacctcttttataagatcattaatcccattcatgagggctccaccctcatgatctaatcacctcccaaatatctcacctcctaataccaccacactggcaactatgtttcaacatgtgaatgttgggagaacatattcagaccacagcaatatcaaggtcacacaaaacaaggaattctgagaaactcttacagtatagaggaaactaatggtgactaattgtaacagtgtcctggattgaatcctagaatagaaaagatcattattggaaaaactgtggaaatcctaatacagcctgtaatgcagttagtagttctgtaacaatgatggtttcatagttttgacgaatgtgctttggttgtgtaagatgttaacattaggggaagctaagatatatggggaatctctgtactatcttcataacttttctgtacatttaaaattatttcaaaatagaaattttactctaaaaaaattactaccaaaggagaaaagagtcaaggaaaagaaaattgttcctaatccactgtggactgtacaaatatatgtaatgcccattgaacacttactttctgtgatattccattttctcaataatgggtgtttccatatagcaggattggagatgagcttattgagtccctaaataaaatagtgatccaggaatattctgggatgacttcagttgtagctcctgtatttaacagttatcaagag

SEQ ID NO: 50062 - DNA, 1039 bp, Homo sapiens
cttaaaaagggtggagccagccgggggcctttaaaatgatgctgaaatgaaaaaagaagaacagaacatgatttatgaagatgagaaccggaaagattgtataccacaacgcagccaaaaaccgtgaacaaagttatttctaaggaatcaattaaagacaatattgtttctctgaaatgagaatttaaagaagcaatataaggctttaaggaagaactgataatacattaggttagacgggaatgaaaagtgagtgggtaaagcctcagaaataaattactaataaatgagaatgaaaagggagcagacagagtcttggaaacaaattagaaacaaatgagaataaaaacggaataggcagagcctcagaatctcagagagagagacacaaaaagagaccaaaatcaaaggtcatgatagaagcagcaaaaaggagatgagacaccactgaaagaatttgaaggatggttttgagaagaaaaaatgagcatgtgagatggaaaagaacaaaaagtaaaagatggaagacagagatagagaaaaagagggggatgggagggggtggtagggaagagatcaaatatctataacactaaatgccttgcatgggttaaaaaatgaatggaacatgaaaacaaattttcaaagatacaattcaaggtgaaattcctgaaatacaatgaaatttgaatctgcagacagaaatagcccaagaattacaaggctgtgtttatattgaataattaacaaatatcccaataaattcctggtatttgaagttatggaaagaattctgtggatattcaaaaaaaacaaaaacctaggaggctaagatttctttatgtgacacatgaaatgctagaagacagtggggcaagatataaaaagtccttgtcccttttgtgttgctataaagaatacctgaggctggataatttataaaggaaaagggatgatttggcttatgattctggtggctggaaagttcaaaattgggcatctttgtctggtgatggccacagcctgctcccactcatgg

SEQ ID NO: 50063 - DNA, 1032 bp, Homo sapiens
aaagcagatcttcaggatggctcaaaatattctggttctttatgagtctcttgaatagataatattttgtacacataagcaatattatttttttctccttcattagccacacaatatttccatggattgtaattgttttcatcagaaaaactgttatccagatagaattaattcaggaaatactgtttacttacatgacagtcattgtagatgtacaaaactgaataagaacataacttagggtattttgtctgttaaactttagtcatgacatgttggggttggtttcgagatctttttccagcaccatggaaaacacaagggacagagagaaatgttggaattcgcagtgagatcattgtgttacctgttccgatttaattgctcctcaaattaactacatttttttctgtacatcttttgacctaagttgtttgtgaaggattaagtcgttgcctccctttccttggttcccaacagtatggcaggggcttctcacagagtccttttgaaactgtaaaactatcacccttgtattaaagcattggatattcttcattgcaaaatgcccataattttcaagttctacgttaatttcaacaacatggtatatgaaatgaatttttttcatgaaaatattttcaaatatttaccaaaatgttaataattatttctctaggggacaaaatgtattttaaaaactacttgagaattttaatattccctaatctctgagcgaagatgaaggcttgggaagcatgaagtcatattcattcactgcttatttcaaaaccgtgtgaaagggatggtgaattcatccttcacataggcaaagtcacttaaaatgatgtattttcaaaattcactttaggaaagaattggcagtattccatattcagagtcaaaataaactgagaataaatagataaatataaagaatacctatctgtttgtaaaccaacagttaatactgtacatagtggtaaaatagtcattccatttaaaagtcagaaatgaactgtcttagtcttt

SEQ ID NO: 50064 - DNA, 1050 bp, Homo sapiens
aaactgtgtatgcatataagtatatgctttatgtatgcatatgtatgtagatatgtttatatctatcgtctgcatcactctcctcagtgttgatgtcaacatgcaatgacaactgataaagcgagatggtagttctgcctggtttgcagtctgagtgggaaagtcctgtttttgatgagcactccttgttagctaacatttaaattctttttgtgacctcagaatgtctctggatctttcctcattgactgactctgtgccacgtcatccatagtttattgttagtatgaacacaactgtaacatttacctggtatctacatccttacctgcattggaaaatgtttgctacctcacaacaaccatttgcctcctttaagaacactgatgggctgcactttttggatagaaatagaatttgatttcagaatgtatgcttggtgagtctcagtgcccaggaacacttttggaataatttatcagacattgaacttctgtgattaatcgcttttatagatttactcagtctttaaaattcgtctctgatttgccagagaaaaacggtggtagccatggaaatcgggagtgaaggagcactgcttcattgtggctcagcccttcctaggggcctctgccctttgatgtccttgagctactcttcagctctggaagttgtggacaaaccgtaggaatgtatgtgtgcgtgtggtggagtgattgtctgtgaatgacaggccctggctattgattgatgttgcatcaatttagcaaattcatttcctcattcttgatggcctgaatatatgtctgcacttttaatgctcctcttaaccagttgtaacatcttaccatttccctaacaaattgaattagtttaataaaatcttttgacacatgttgatatttgtatgagagtcatgattttaccttaaaaagaaaaaaacagtcttccaagaaatgtaaaatatatatgtgactaattaaattttttaaaaatcccaattagtactccaactgtaaacggatatttatatattttaagtgagccgtc

SEQ ID NO: 50065 - DNA, 1047 bp, Homo sapiens
gtgagacttattcactaccatgagaatagtatggggaaaactgcccccatgattcaattgtctcccaccaggtccctcccacaacacgtggggattctgggagctacatttcaagatgagatttgagtagggacacagcaaaactgtatgaccccctttaggtgagtgcaggtgtattgggtgccttccattatctctttgggaacagccacagtcagctactgatttcccgtcccacacacctgtcttgctccttggaagcagcctcacgcaaatagagaataaaagctgctttcacaacttagccaagcagtgttaccccaggggataatccatctcttcctctaccccagtccacatttcacaggtggaccctgcacaaagcttcagaatccccggagaaggtgacggatattttgaaatgtcatttgacatttaagtgcctatctctggtcccagataaaaacagtggagggcatttagaatacaatcaagtcataacttttaaaaaggcaagggcagaaatatcatgaacaggtagtcactgaatgagataacagagaaaaccaacttggacagtctaagtggagtcatttcttctcgcgtcctacggtgaccagtgtctcacaggagaaagaaaccagggggcatcagaggctgttggaagggaggtgttgggacggactactgtggcttgcctgggactgtccagggtgtagcacggaacatcctgccccacagctgacccttcagttccaagcaaaccgaaacagctgggccaaccaagttccctctgtgaaagtaaggtagcattcacattccattgtcacatggattaactcacttaatccagggttcagccctgttgggataagttggctaatatgatattttagccccagattgaaggaaagaatggggtaatggaaagaaaaagggagggagggaaaaagaaaaaagtcattgtgctggctacagcacagaccactagtagttaagactgtgtgtgtgtttcagtgttttctactgaaaacgccaaagaatgca

SEQ ID NO: 50066 - DNA, 1024 bp, Homo sapiens
gccaggccccacatccagcacattctcgctcttctctagcccccacagccaggtcagtcttctagcccaggctccatcagcatctcaggttagagaaaggaaggcaagatgccttccacctctgttttccaggattgagaatatgctcacgcccctctctatctaaaggaaaggagagagggatggaccaggccctgtgttgccctcacaggtgccctgggcgccattttgtcatgagtggtcagcagagcccattgccgaggggcctagggagggtgccctcacagagctggtcccttcagttctgaattaagcagtagcctcaatgccatgtaagcaaccattcctgcaagaggataggcatttaaggtgaaatctgcctcatctgtcgttatttacaggtaagattcagaatagttcaagaaaacaaggcaaatgaattgcatttgcattgacgtgagtcatgccacattcagctactctttgtgaaaacgtccccaaaatagattcctcggagtgctgctttgcgggaccttcatcgatttgctctgaagataggtgtccatgcctgagaggcctcagtgaggtttcaactacacagttatccatggcagcacttctggaaacatttctgtgctaattgtacatggcaggtccccagttcctcatttaatgggaggaatctcctttttctggaaaatttctctggactgctgtgtcacagaacattctagaaaccccttacctcatgaacattctactactagacaatttagaattgaacgttaatatgggcatgggaggccagtgaaaacaacataagcctcacctggtactgcaacacatctttgtttgggaaacactgactttgcaaccacagctataaacaccggcttttatttcaggagtcagcagttactatatttgcaggaaggagaactgagggcatccctgtgaaaaccagaaaataaatccatcctgaagggcattggctttgtaggcctctcatcccctgttgagtagg

SEQ ID NO: 50067 - DNA, 1070 bp, Homo sapiens
tccttacacttcttttctttcattgaacttgcctttgggcttggtgtcccttctgaatttcctggcacgagggcacttgcttaaaccaaatttcactgtcagaggaaatgtgtttcctctaccctcttaggtgcagtgattgggggcctgtaaatcagactaacaaaagacagactatcaagagtaaagatagatttgtatttacatacaacgaaggagttcacagaaaaatgtgactcaaggaggcagttagaatttcggatttgtatgtcatcttaacatggatgggagagaggcagaaggacacacagaagaataaacttttaggaaaacttttaggaaaactaagtgggccgttaggagactagatggtggataagatagttttataacaacatcttttggggcgatttctcatctaggtgtgacaggtgctgacttcttatctttggtgataagactcacacttccctggttgtgaaactcctgagcattggatgtatgagggctgagggctgaattcttctggaaggctttccttagaaagggaagggagtgcagaagccttctgttcctgtacttgatgcttactgtcttcagctctaataaccctcatgccactgtggcatgttcctcagtccatggaggccccatctgcttctccccaacaccccatcattactcccctgcccccttctctgaatgcccagcacccagcactaataagaggccctctgcctgccgagcgcacgtggcatccttgtttctaaacaaccctgaggtgcccggcccctggttctcaggtcctgcctttatccagcccgagtagccttacgtccgtgtccagaacactagccttggggcatcttgctctcccagatgacctcggtgtccctcagtcttgttcccacattagctgccaggtgccacaatccctgtttctgactgcatcctcgcctcctcacctcgcctcggggggcatttcatcctggcatctgccgctcctgactgctgaaaccacagacatccgtttcccacgctcctctgcaacgtctccctctgctggctgc

SEQ ID NO: 50068 - DNA, 1020 bp, Homo sapiens
aaggtgggaggatcacttgagctcaggagttaaagactagcctgggaaacatagtgaaaccgtgtctctacaaaatataataatgatgatgatgataaatttgccaggtgtggtggcgcctgcctgtagtctcagctacttaggaggctgaggtgggagaatcacctgagcctaggaggtggaagtttcagtgagccgagatcatgccactgccctccagcctgggtgacagagcaagactctgtctcaaaggaaaaaaaaaaaatagagagtacattctgggtggtgacttagggatacaggtgttctgtgaaattctttcaactctgctgtacgctggaccatctctacagtgcaatgttgggggaggcagctctgcctagtgtgacagtcagaccaaaagttcactcaggcacaaattagagcatcataggggaactggggatggcacagggcctgagataaatgctcagcgtttttacagagaagaacagagggtgggattagtgctgaacagaacaagtccaacaggagtgcagccaacacagaatcaatcgtgaggactttggaaaccaagcagaaaagtttacacatggtacaataggcatttgagctcactggaaattcttagaaggacacattggccatgtctgtgttttagagctcagtggagtactgggtgacagattagaaataggcagtaagggaggaggaagtgccaggtgtgattccaatgtgatttccttcagggaacttatagttcaattagaaaaaaataagtaatgtcaaaagttataggaggcttaggagaaagtgaaattaagaaaactgtcgctgggcatatattcatatcaacttgtaccaaatttgaagaactttttgcatctctgtgactctttcctagatttaaaaaaactgaaaaaaagatgtagctagttaaaaatacatgtatttttctaatacctgtaactgcatgtgacatttacacaaagtttcatcttaacttatccttatcgtaca

SEQ ID NO: 50069 - DNA, 1050 bp, Homo sapiens
ttgttgggagaagtattacataaacgtcaattaggtcaggttgcttgacagtggttctgaagtctgctgtgtccttacttcttttctgtctacttgttttatcaattactgatagaggagttttaaacttccttctacgtttgtgtttctccattcagttctattggtttttgctttatgcattctgaagctctgctatttgatgtttacacatttagaattatgtcttattgatgaactgatctatttgtcattatgaaatgtccctatttatccctgatgatagtcattcattgttctaaaggcttgtttgttattaatgtaagtaacctggctctcttttgagcaatagttatgtggtatgtagttttctatccttttatcttcaatctatctgtgtagttatatttaaagtaggtttctgtagacaacatgtagttgggtcttttgtttttcttttttattctgatagtgtctatcttaggtgtgtttataatacttataaagccgttacataaggtcatgatctgctaattccatctgtctctatcatttctgtgtctatttctcctgattgtgggtggtatttgcttctttgcagcatggtaatttttgattgaatgttagacactatgaattctacacccagtggagtgctagattttgcttgatttcatttgctttatttaactttgtcctggaactacattatgatctgtccatgccttccttttaaaaatctttagagggtcaggtgctccagatatctgttaccttatcctgaatgactgtaggtgttcggaaaaaatgagtctgttgattgttttgtgtaacaattgacaaagtagggacattaaatcatgacattattaaaataggcatgattatacaattatttaaaataattttaggccaggcgtggtagctcatgcctgtaatcccagtactttgagaggctgaggcaggcgaatcacctgaggtcaggagtttgagaccagcctggccaacatggtgaaaccccatctctactaaaaatacaaaaattagctg

SEQ ID NO: 50070 - DNA, 1088 bp, Homo sapiens
tggccgctcctggggtagggggtgacctcgggggagtccacaagaacagaagagatacagatgggagaagccatttcaaaaggaaaacagcacctgtggaggattccagtcagccagtgagtttgcttctatacagcatgaagccaagcttctcatggctcacaagcttcagagaggaattgtggctctatgagttgagcttcttattccccagctcatctgtttgctttctggatagggagaaccattgggatttttaaaaggaggcgtgtcagaatgcaacctgcacttggggagaatcctctgggtttgtggcacacaacgcctgcagcctagaagagatgggccagaggaaggccagggtgatggtaaaagacatgcaccccccttgactgggccatgaggtgtccagacggaacattctttggagtgtgtgtgtgagggtttttctggaggagattagcatttgaattggtggattcagtaaaggagattttcctttccagtgtgtctcatgaaacacatcatttttcgcatcatgaaatttgtcactagaggaatgaaaggatgatcttaagtagggagaatatcccttcaggataaaaaaaaaaccacaatcatgatatgcttttttttccattggagacacagtctcattctgtcacccaggctgcagtgcagtggtgctatcatagttcactgcagcctcgaactgctgggctgaagcaatgctttcacctcagcttctggcgtggctaggactgcaattatatgccaccacacccactaaggtttttttctttttttctttgtagagacagagtcttgatatgttgcccagtctggtctcaaaagttctacctcaagcagtcctccttcctcagcctcccaaagtgctgggattacagacatgagccaccacactgggccttttttttttctttaattacacaaattacacttgtttcacacggtacaaaaatgtatagcattaaaattggaagcccttctaactcccactctcctactccctggagataaccgttactcagtgtttaactatttaaggtacctcatttcaccccttg

SEQ ID NO: 50071 - DNA, 1032 bp, Homo sapiens
ggaaataggaaaataaatgtaactaaaccataatggggtacaatataaaggaaagtaagtactgggatgaatatcatcatagattgtttattctttaatttgtactaatttgtacatttgtatatgtacaattaagcacttcttagttaagattgatatatttttaaaatcacaactttatagagcacaagtcttacatgaaaacataatgccaggtcagtggccctccacttgagcacacattcaaatcactgagagggctctgtaaaacacacattgctaggtcccaccccagcttctgattctgtagatctggggtagggcctgctgtgtggtttgaacgtttgttctctctgaaactcatgttgaaacttaatccccaatgtggcagtattgagaggtgtggggtctctaagaggtgttgggtcatgaaggctctgccctcatgaatggaccctttcgttcatggattaatagattagtgagttgttggatgaatgcgttatcaaaggagtgggactgctggctttgtaagaagaggaggaggctgggcactgtggctcacacctgtaatcccaggactttgggaggccgaggcaggtggatcatgaggtcaggagtttgggaccagcctggccaacatagtgaaaccccatctctactaaaccccatctctacaaaaaattagccaggcatggtggtgtgcacttgtaatcccagctactcgggaggctgaggcaggagaattgcatgaacctgggatgcagaggtttcagtgagctgagatcacgcctttgcactccagccctggctacagtgcgagactccgtctcaaagagagaaaaaagaaaaaaagaaaaagagagagagagagagagacctgagctagcatactcagccccctcaagatgtgatgctctgtgctgcctcgggactccatggagtccccaccagcaagaaggccctcccaaaatgtgtcccctcgacgttggacttctcagtccccataactgtaagaaatgaatgtcttca

SEQ ID NO: 50072 - DNA, 1022 bp, Homo sapiens
gcttttgtaccatttggtctaaattgtatctctattgtagatatcatatagttagatcatgtcttttttaaatccattcttcaatctctaccttttaattggcgtttttaatctatttacatacaatgcgattattggtaagacaggatttacgtgcggcatgctgctgttttctgtgttaagtcttcttgttaccttatttctttattactgccttttttaactttagatattttttagcgtgccattttaattattctgtcctttactgtatttcttagtgattgctctgtggactatgataaacatcttaaccacttattttaagtagttcacaaacctctgctcctatgtagttccgtttccgactctcttatttctgttgctgttgtcatacaaattacatgtttataccttgtttgcccatcaacacttataatttacttcacacaaaatttgatttacaaacaaaacataacgtttatactgtctttaatatctcccaaggggcaaaagcaaagcccagttgtgagccattgccttaaagtataaaaaataagtgttacagcattcttgtcctttatctcattttaaggtaacttagcacgatttagaaagaacaccagagacgtttttttaattggttattggataatgagaccccaaaaaaccctggataaaaaatgttccatttttaagtgtttccaaatctggcttgatagtttccagaacaaaaaataaagtaaaactttataacaatttttggtataaatacttcaagttagaactttgattcattaatctttattcaaatactgaaagtatgttgagaaggaaaatatatacaaactcataacgtaactctagtaataatctcaagtgagtttgacctggggagaaggtctgttcagagaaaggtgcatgtaatcgggtgatgagaatctgaatttgagccagctgtatccacacagtctttataagtcatccctaacactcagagcaattgcgcgggatagctgttt

SEQ ID NO: 50073 - DNA, 1076 bp, Homo sapiens
atcccctcaggtatgagaatgctcagggctcaaagacagagaagagctgtacgtcacactgttggggctggcagcaaaatgctgagcaaccttgggctctacaacatgtcctccatggaggtcaggctctaggcctgttctgttgactgctggagtctcaacattcagaacacgggtccaacatggcatgtgtattgacagagaagcttcaggtaatttttatgtccttgaatgaatgggcacatgttacatgacagagcagggactagatggagccaatatattagatccccttctctccacacctcattttctatatagtgcagccagtatgagaatataaaatggaaaggaagaaggcatatcattttgtatgtgctctatgatctttaaatgttattaaatgttggtaatgaaatgctgtggtataactaattatatcctagcacctctttcccatatacttgcattctctaattatgttcaaagcaatggttgcccgaaggctaagggtactcggtcctttcctcccccatgaggactatgttttagcttgtaatttcacctgcaggagctcacaaaccagctgcatttgagtgcaattatactttattcatagtgactaataacagaaaagagacatcgtgggggtttgggctggagatttataatctcatataaaaaatacgaattcttgcttatttatgggttgagcaccttgggcccccgctgtttcatctgatggctgcctgatttttatccgcaaaatcattcattagtatctacactagaatgtaaacacagaatgtaagataaatttgttgtgcagtacttggatagttagaacacatttccccagatagaaacattaaaactagaggttattcactcccatattcacacaacctttatgcacctgaggaggttccgaatgtccctgaccatctcttatttcttatgggaaagtgtttgggtaccagcttggaatgccaggagtgtaattctccagggcagcgactgccgcccgtgccattgggtccctagccctttttcatgctctgctttctgatgagctt

SEQ ID NO: 50074 - DNA, 1028 bp, Homo sapiens
gcctactatttgctgtcatctataatgggcattggggtgcaaggatccatgtgacactaaccccccacatggtccagtagtttattactgagattgtcatgctcacaatactctttaagtgggcaaattgtttttctaacctttaaataaatggacatttaccaacctctgtatatatttcattttattacttaatgaattaatttttaaaaatatttttaaattataaaaactcatacatactttctgtttggtctgctgtgtttgtggaagggaagatagaaagtactggttttatagcttcaagagctttttatactggtcacttgagtttttaaaagcgatgggtgtcttgaaaatatgattttgggctatgctgtaagaactgcacttaactgatgcctggaagtaagttaaccttcatagactatagtttaaaacaaacagcagagatcctttcttttactttttaaataaaattattagcatcaaaatgaaggcttggaaatattaacatgattggagatgcctgctggtactagttctatgaaatgcaaaacttcatatagttgtagaaagtctacaggtagaatacaaatgagtgcatttgggggcactcacttcctttttcctttctatttctatttcctctctaagtctattttatggcttggtgagacaatctttcctccagagggtgatatattttactattttgttgccaaatcccactgcctctcttggcttccaactgtagcaaaaatggtttgggcagggagaaagaaaagttaaaaaattttacaaacgtaaagattcagactaatttgtgacctatagtttccttttgccatggataaaccaagaattaattgtacttcagtctgtttcttttcaaaaagacccgatcatagagttaatttaatatttccacaaataattaatatatcaaatagtgaaacttcagacctctggaaatagatttatacaacttctcacaaataaattttcaacattttgcatccagtagc

SEQ ID NO: 50075 - DNA, 1059 bp, Homo sapiens
tgggctcaagcaatcctcccaccttggcctcctagagggctgggatgacagatatgagcccccgtccctggccatatctcttggtcataaaatgaggtgggttttagagccagtctggcaagctggctgaccttgggcatgtcattaaagttcatggtgcaagcaaaggttagtattaataactcatcagggagaagtatgtgcaagggccaaacttgagtctgatgcctagtcaggagaaggcagaggaatggggagaacacaaacaaacctaagccagtctcccaaagacaatgtccacatgtccacctgagacctttttgtgtgtgtggaacaagaaacaagtttttgtgtgtatggaacaagacagcgttgcccagagagctgcctcggaagtcattatcagggatgggtttcatgttatatgcaggaaggtagccccttctcctctatgctggctcccctgtgttcagtgggtgtcaagctgatgtctgctcttgttcatgttttccatgatgttctagtgcatttctgcctacatctgcctgagaacttggccaaagtgtgaaagtgtccctcctccaacctgccatctactctcttttttgctttttgtttttgtttttctctaaaaacaagctgggcgcagtggctcatgcctataatcccagcactttgggagactgaggtgggtggatcacttgaggccaggagtttgaaaccagcctggccaacatggcaaaatcccatctctactaaaagtacaaaaatcagctgggtgtggtgacgcacacttgtagtcccagctactcgggaggctgaggcaggaaaatcacttgagcctgggaggtggaggttgcagtgagccaagattgcaccactgtactccagcctgggtgacagagtgagaccctgaaaaaagagaaaagaaagaaggaaggaaggaaggaaggaaggaaggaaggaaggaaggaaggaaggcaagcaagcaagcagggaggaaggaaggaaggaaggaaggaaggaaagagaaagaaagaaagaaaagcaagcaagcag

SEQ ID NO: 50076 - DNA, 1042 bp, Homo sapiens
catgatttataagtaattcatccattgttgctctagaaggacattaaagtggctatcatctctgatgcaaaggcagaaatggaaagaaaaaagaagagaaaaaaatgagagcctgggaaaaagataaaaaaagaactcacaaatagctacataaacaactagtttcaaaacaccatttcttaaatggccaggaaatagtcctgagatttttgagaaaccactgaaggcttccagcagggtcccttctagtgataatgcaggtggatggatgagttaatgatttaaacaattagagatttgctgcaaacttccatctgtcactgccccctggaatgcagactcacagttctaattggagcctccagcattgaaggcggcatgagttggtgtcactgatttgcttcccctgaccactgtcattctcatggtaagcgttttctgccctcacgctgagaacttttatcaaacatattagtgtgcatttgggtgatcattagcctgtggtagctgaaacattccaggttattttagcctagaaactagcctgtctgctgaaagaacatgcaaagcttcctgctaagctggtacacaatcaatatataagggaaagaacgggttcctatttagatttaaatccaatatgtgacaagttaatagctcagtgtgtttctgcttttccatgtcaattttacgggtgtgaaagactcttccacctgctataaacttcaaaggaaaaacatgcggaaggggaaatgcacctccgtgtaagtctttccctaatctcttacgattaatttcttcttccatctgatgaaagaaaatgcaaacgaaatctcttatttggttcacagttgaagacgagttccataaagctgcctttagaaagggaatctgttttgaacatatgaaaaccatctgagtcaagatgcattacatggtgattacagtctgacagatgttttgaagttgtaatgtgttcatcagaaagcacgcagagcagggatgagcaccgcttgtttgaagatgttgaggtttattctgg

SEQ ID NO: 50077 - DNA, 1035 bp, Homo sapiens
taacataaaggtaaacctaaacagtaatagtgtttgttagtattcatgaaagtagattgtcccagtataaagctaaccaatgaaattttactacttcataaacattttgttcttttaattttcaaggaaaaaatagggacctcttcaaaataatcaggatagtcagagtccctttttgtttggaaaaggtttctgaaacataaaatctttgttgggttaagactttggattttaggccaagttacagttttcagcaatttcagacatctgctttatgatgttactgaaagcgttcccccaccacattaaacccagcttttgggttgtacagtgatgtaaagtttattgaaacatttttacacttgctttctttgaccacaatagtcatttttttgtaacatattcaattaaacaggaacagtataaaggcagtgaaattgatacgattctcatttgaatctactgaatgccttaattgttctcattcgtggctgactgccattgacaaagatctaggaatatgagtacactatcctacataatagaaaagctaattttttgttttattactactgtaataatattaagtacctaaagagagttataggcctcttggggcccagaactcagagttcaaaatgacccttctttgattggatcaaaatctaatatttggctgtggcattatccagaagtatggagtttattatagctatgttcaaggaaaaggtaaggtgaaggaagatcagaagggatatatagtaaggagattcccatgttactaaactatttgtggatgttttcctgcatcatatgcaaatgagaattggtaggaaaacagagggctaagaattagagaaaataaatttggggaggagggatggattgtgcctcttattgctctgctgaatctccaaatataaacacacacacactcaaacccttctatgagtcctaaattacattcttgcttcaagctggctttttcaaatctggcagtccactggcgaaaatgtttgcaggttagagaaaaaa

SEQ ID NO: 50078 - DNA, 1052 bp, Homo sapiens
gatcttttatagcaagtttgccaccccctgttctagaccagtgaggtagccaccagccagatgtagctcccaagtgtttgaaatggggctggtttgagttgagatgtgtcataagtgtaaaacatatcagattccaaagacttagtaaaaagaaagaacaaaatataaaatatctcatcagttttcaaatattgattgcaggtggaaatgacaattttattaaaattaacttttcttggttctattttttttaatgtgactactagaaaaatttgaaatgtgactcacatttgtggctcacattaggtttctattgatactgctgatctacagcctggaatttggaggatatgtgacctctaggaaaagcagaaagaggaaagatggggaaagagagaaaacctcttgtatttgcaaatgtctttctaaagcaataaaatattttctgatttggctcttcctcacagaaaggcatacgcaaaaatgggttaggtggtctatggagatgatcgtagatgagttctcccagaagcagactctgactcagaatttgaattgggaggtgatccaggaagcacctggagggagaggggatgcaaacagggaagagattgaagaggaaagagggttaatgagcaggttgttgctgtggacccatgtgctgcctcccaattgcgccctgtgggagattttgtagacagaggctcagagtggttccacccaggaggtgaaaaagctgggctgcatatccaccaattgccagtaattgccacttgagggctgctcctaggaacatcagcttcttcttactctccccagcacctgccttgcctgaagccaggtaaggccctggggtgaaaaggcacaggtgcttgcaggaaaaagccatgagcaagctggagaatggtgcctcccagaggcacagggttgggcccttctagtgtctggaactgtgtccaaactaaatgttccatcttctaattcataatttcaacagacattcatgtagttctctggtgaatgtgttcattttctcatttgatcttaacaat

SEQ ID NO: 50079 - DNA, 1073 bp, Homo sapiens
taaacacttgttgatggacatgtgcagaattgatgcattagacgagtgttttgggattcggaggaggaagagatgaatctgcttttgagtagacaataaaccttgcttcagggtggtgggatttaagctgctttgacagatctgtggattatgcatcaaagaagagtgaggtgctctgcaggagtgagaccagcagagacctgtcggtaggaataggcaagacagctttggaattttagacaatcctaactagagcacagggtgccaaatggggagccaggaaagaggatgttggaagagtcacctggagggaaggtcttgaaagtctttaaatgcaaggttaagggtttaggccatttttaccattttctatagagtaatagtgaagtgttttttttttttttttaagagagagaggttaatgtatattttctgaaataaatttcatgtgagaatataagaatggatagggttactgtgttcatggaagaaataaaagggggaagagacattcacattactttagattttgtggtctctcttttaattggcagaaagaagtagtatcacaggtcaaaaaccaccaccctgtcaacagaaacatgtaaaattgtgagattcaaggtcctgccccttaaaactaggaagaaataggagatgtcgttgctgattggctcttaggtacagacacaaatgtgattcttttcctgcttttctagtgcagtaagacacagtggggacaatgcatggttatttcttctggctttttgattcacaataaggagaatgctgttcaaacctccgaatgcccactataaaccaaaataatgttttagagccagaagcaaccttggagctcatgtcattccatcctcattctgcagatgaggaaagtagggctgagagtagtaaaagaagttttccgcaatgacctagtgggttagtgactctgaactaggactagagcacagttcccagctgtccagttttgtgtctttcctgctacttcctacagcggttaacagtgccagccagcacaggcaggattgccttttgagtggttctgaaatttc

SEQ ID NO: 50080 - DNA, 1034 bp, Homo sapiens
aagcacattttacctgagccaccccggtctggtcctcgccacccgcccccacttttgcctctaattgtggttgatgtcaggcagtcgttgtaaagggcttacaagcagtttgtagaatatatgtaaatcaattccagtttgcggccgctggaatgtatcgtgcaggatgtatctcgagcttttagtgcctctaccctatgctttgggctagaataaagacagctgaatgtcctgaaaaagaatttcacggggcctcttatctcattttggtttcgcattctgagcacttactgtgtttctggcggagaaggcggaaccagcttgaaatgagcacagacagtccttccagaaaaatgcaaatttgtttttctgttctagcagtttggaaactgtattgcttctggacgtgagaaggcagccctgaaagtagtgagcggagaaagggctgggggattacttaaatgagtctttgaaaagaattctaaaccaacagcttcttctgtggctctggggcatgatgataaaattccttatcagtccaggaagaggtttatagctttgctgttaagcaagaaaaggaaagaaaaagtggatgtaggaagccaaggagagggtgtgatttacaactcaatcaaagttatggaagaattttatgtcaatatttaaatatcaagaacaatactcatataaggagaaaacaaggctggaaaaacatgccaataggcttggaagggcagggatttcaagaggaatgctattgcttttaccagctctgaataaatctggatgggaaagttagcatctgtatcgcaaccggaaaagctcttcactttttcttctaagtgggttgggtgctcgccaccctgcacactttgggggaagtgagctttccatttaagagcgcaggggaggggtttcgaactttctgtccctttcccacagccttgggagatgaagcagagcccccttcgaatggtcagcgcaaaccctccgccttcttgccccctcgcttgttcgctcagcaagcaggcttg

SEQ ID NO: 50081 - DNA, 1038 bp, Homo sapiens
ataaaatacattaaatataaggaaaattataacaggtttttgctatgttgcaggataactttaccttacaactatattacagtaaaactttattaaaactattgagctagccaggcatggtggctcacgcctgtaatctcagtactttgggaggccaaggcaggcagattacctgaggtcgggagttcgagaccagcctgaccaacatggagaaaccccatctctactaaaaatacaaaattagccgggcgtggtggcacatgtctgtaatcccagctactcgggtggctgaggcaggaaaatcacttgaacccaggaggcggaggttgcagtgagccgagatcgccccattgcactccaacctgggcaacaagagtgaagctccatctcaaaaaaaaaaaaaagtattgagctagccacttttcctaatctacatacaagtgtctatctaaaaactgcacaccgtaaaaagatctagacagtgctttaacatatttgaagactgtatttgtgattatctgacttaatttgtagactctgtgatgtccagaaatttattttgcctcacagagactaagggtgacaccagcaagaagtacaacataattactcaggaaaaaggggcaagctcaagtaactgctccagggaaagatcagccccttctatcaatacagggccagagaaaacaagtgatgagtccaatgtgagcctccaaacaaattttacagggtcaaagctccaaactgcagccttcagtttacaatggaacggtttctcaaaaggacaactccttatagaaaataaggggagagctgcccagagatttagttatttaatgatggttaaaagtgctgaggccagatggtggaataaaagtgtttataaagttttccctagatagaagatatcagtcccatttatttgcacaactgcagcacgttttgtcaatttagtctgttgtgcatccaccttggtggccccttcccagggccaacatcatgttgagaaggaaaaaaatcatttttcctctaacctct

SEQ ID NO: 50082 - DNA, 1031 bp, Homo sapiens
ctacatttctatgacaatttgttcacaccaatataattatgactgcattagcacttgccctgtaaaccacatgattcaggggtttatgagtaggtaataaaaactcacttcaggctgaaacttgtctcagacatggaaccttgggggtggggacagttgtaaatggtcggtatgggttagggccttctgaagtttgtggtcattagtctcatttattgttacccttctacagagccaagactatgtgctgtgggatttatatctttcatcatttagcaaaacacaggacctttgccaagtttcatcagcattcattaattctttcaacaaatatttgactgcctataatgggccaggggcaggtgaacagcccagagttcatgttctcatacagcttctattctagtggacagagaagtggcagggaaggagggagcaagagaaggagaaagggagcaaggcaagaaggggaggaggaaagaagagaagaggaagggaggatgagatggaaggaagaatatcagatggtcagagctttacaaaggattaaaatagagtgaattgtggctactttagaacagtagacaaggacagtctctgtggaggtgacctgaatgacaagtcagccatgtgaagggcatgccaggcagaggcatgagctaggatgctcctccaaggcttgatggacaggaaggcccataggctggtgcagaaagggcaagggcaagatatggcccatgtgatagccaatggagctggggcctctaagcccttctaaacaggggttaggagcttggttttttaaggaggggaagggcatgggctgatttcagttttaaatagatctctctggcaaatgtgggcaggagagggagcagggagaccagttgggaggctatggctgaaatcgggatggcgacattgtgaacttgcttgcagggcctcatttgcaatgtcctttcagggaacagaaaacagctgaggaatgtccaaggagtgaggtgcaggctgatatcctcctcctgctagaa

SEQ ID NO: 50083 - DNA, 1035 bp, Homo sapiens
gcatatgtaataaaggacaccttctgagacactgaggaaaaatagaagccgagctggcctctttgttctagacaatgtaaagaaactcgctcttgcgttttgacaaggagcgtatgtctatttatatatatggcgagaacggtgaataaaggctttatgtcaaaggtattgtggtcaattgagttaaaatctggctatattctatatgtgtacaaaaatctcaatctgaatgtaattaaacatggaaatgtgaaagtgtttaacagacttgcagggaaattttaattatacttgggaacagccaattgtaagagacaactgggaaaggaaaaaaaatgtttcagctgagttctggggcataggtaaaacttttgcaaagaaagtcaattttttatagctgtcaaaagtgatttggaatcaggtaaaaaaatttatttttattttttcatggtgatgtggttttttgagttgaattaacttggataattgtgttgaatgatttgactgctcgtctttcaaaggaatactgttgttttctgtcatatacagactttatcctgagttttgggagcaggtttgtgctactgactgcaacaagtggcacaaagactcaatttcagatttctgatattatgaaattaattgcttaagttaatttaaagaaaagtaatcagtgcaaacaaggagatttgagaaaatgaccacgtttttaaaaaatgcaagtcatagtccattccctagtgagactattgatttcaaacaggcattggcaactgcctagtcataaggacaaaagctatggccaattttctctaggatctttgactctagaaagcataactttcgcaaggacacagtttaaatgaaacttgttcacctctgtgagaatgaaacatagaaaagcaccgtgtataatacaatagacactttagtaaataaaattcttaatagcacaagccgcagaacagaagggacaatgcaaatgttttaaagtttatcttttcagtgctgctcagaaaaatatgagtcttgaca

SEQ ID NO: 50084 - DNA, 1035 bp, Homo sapiens
ggttgtcctttgcattgtaggatgtttaacaacatcactaatctctgctcacttgagacgaggagcacatctccccagctgtgataaccaaaatgtctccagacattcattccccaatgtaccctgggtgcaaaaattattcctggttgagaaccactgctggaaactgaatcagattatgtcatcgtctactcaaaacactctcaatttcttcccatcacatttggggagaaaatcctgaagtcctttccatggtctacaaagcccttaataaactggctcttactcccttttgacttcctctccttcccctgtcactcattctgctccagccacctggcctcactgatgtttccctaaggggccaagcactcctcctttccaggaccattgcacctgctgtttcctttgctcagaatagtcttctctagtacattgcataccctgcttcctgctttccttctagtctcctcacatgtcacttcactgatcaaaaataacacctcaatcactttcaatcctattatagtgccatagttgtcttcattggacttactaccacatgatttattacatatttatttctttatatgtttattgtctgtctcccctattagaatgtaaactccaagaggaaaagaacaaggactttattttataaacccctttattctcagtgcccagaaaagtgatctgacatatatgagacactcaatattcatttactttaaaattagtgcttgagatgattctgcacattatgtaactacttggagattactaataaggaggatatcattaatataattggcatttctaaaaatactacaatttaaggaaatcttcacttgtcagccacttttttcacatggaggaaaaagaaatgtggtgaggtgaactgagtggtgaataatgccatgtgaggcttcacttaggtcatctggggagcccagatttattgattctgatttcaggcctcttgtatccatattgcattgctttttacagaattgtttacatgtgatattgttcaaa

SEQ ID NO: 50085 - DNA, 1044 bp, Homo sapiens
ccgttcggtgccactcaaaaagcaggatcataagggccagtaccagtgggataatgaattggctcaagggacagtagccatccctccatttctgttttctttgcctttgaaatattttcagtaatacctgaccacacatcattgcctcatctctttcttggagagctcaagctatacccttcgcctcaggagtgtcagcacagtttcagtacaatatatatggcacatgccacactactgagagcaccaagagagaaaagcaaacctctctagggctgagggagtcacctcaactgaatgatgattacctacctgtggactataagctccagaggtggcttctgattccagtttacttagctaatcagaacatggtgcactttctctctctctctctctctctctctctctctctctctctcattaattttcatgtctaatccataccagaaaaaaaatcaggcctgtccttaaattacttttgtactaatattacgactgttactactgttaccataactatgagactgttgctgctgatactatcaacttagtgctgatacttctgctactgctactactgtggctagggatactatgactatcatagccacagttgtcattctggtagcttttactctatggcatgaaatcagcaagacactttccatacattattttatttaatctttatatcagctcttttggataatattagttatccctacttgagagaggagaaaatcgaatcttagggaggttaagtaaatttcccagtgtgacagagattgtaggtagtatagctgtggtatttgaacctagatcagtttggcctcaaagtccacacttttaactgttacagggccccaagctggaaaattcctcatgagctgatagcatctccttccaaagtactggcaaatgttgctaatagatttcacctctcttcctgcctaagcccagatacaacctcagaatccttttccagttagagccaggacagccactagagaaaatccatcagatttggcatgttgagctaaa

SEQ ID NO: 50086 - DNA, 1041 bp, Homo sapiens
cagcaagtttttgttagcaattttcaaaagggagggagtgcatgaatagggtgtgggtcacagagatcacatgcttcaagggcaacaaaagatcacaaggcagaaggtcagggcgaaactagaatcactaatgaacttccatgtcccgctgtgcacgcattgtcagggttcaagagcagagaactggtctgactagaattcgccaggctggaatttcctaatcctagcaagcctgggggcgctgcacgagactagggcgtgtttcatccctatctacagctgcataaggcagacactcccaggacggccattttagaggccccctctgggaatgcattcttttcccagggctgttaattattaatattccttactggggaaagaattcagtgatatttctcttacctgttttcggtaataagagaaatatggctctgtcctgcccagcccacaggcagccagactttaagattatctcccttgttcctgaaaatcgctgttatcctgttcttaaggtgcccagatttcatattgtttaaacaatttgtgcagttaacacaatcatcacagggtcctgaggcaacatacctcctcagtttatgaagatgacaggattaagagattaaagtaaagacaggcataggaaatcacaagaatattgattggggaagtgataaatgtccatgaaatcttcacaatttatgttcagagattgcagtaaagacaggtgtaagaaattataaaagtattaatttggggaactaataaatgtccatgaaatcttcccaatttatgttcttctgctgtggcttcagctggtccctctgttcggggtccctgacttcccatgacacaaaatcatgttgcccttaacacttccctctgttattcaaggggtcatgcaaccctgagagcaggtcaggtgcctcaatataaaggtccaggggccatggaccctgacacagtcagaacctgtgtctctacatctgggaagatataaccatcagactaaggtttgctgtccttcaagcattatcccct

SEQ ID NO: 50087 - DNA, 1050 bp, Homo sapiens
cactaaatatagaaaggaaaaatcagtactagccactgcaaaaacataccaaattgtaaagactgttgacactatgaagaaactgcatcaactaatgggcaaaataaccagctagcatcataatgacaggatcaaattcacacataaaaatattaaccttaaatgtaaatgggctaaatgccccaattaaaagacacagactgcaaattgggtaaagagtcaagacccatcagtgtgctgtattcaggagacccatctcacatgcagagacatacataggctcaaaataaaggaatggaaataaaggctcaaaataaggcaaatggaaagccaaaaacagcaggggttgcaatcctagtctctgataaaacagtctttaaaccaacgaagatcaaaaaagtcaaagaaaggtgttacataatggtaaagggatcaatgcaacaagaagagctaactatcctaaatatatatgcacccaatggaggagcacccagattcataaagcaagtccttagagacctacaaagagacttagactcccacactgtcaatattagacacatcaacaatgaaggaaaacatgttaagggcagccagagagaaaggttgggttacccacaaagggaagcctatcagactaacagctgatctcttggcagaaactctacaagccagaagagagtgggggccaatattcaacattcttaaaagaatttgcaacccagaatttcataagtgaagaagaaagaaaatcctttacagacaagcaaatgctgagagattttgtcaccaccaggcctgccccaaaagagctcctgaaagaagcactaaacatggaaaggaacaactggtaccagccactgcaaaacatgccaaattgtaaagaccatcgaggctaggaagaaactgcatcaactaatgaacaaaataaccagcaaacatcataatgacaggatcaaattcacacataacaatattaaccttaaatgtaaatgggctaaatgctccaattaaaagacacagactggcaaattggataaagagtcaaga

SEQ ID NO: 50088 - DNA, 1380 bp, Homo sapiens
agacttgaagtttattctctaaggatgataaacagatgatctttgaattaggcaataccaggtacaactaaaacagagataccaaacagaaaacatggggactaagataaaccttatgtataggacctaagatctctagccatcttccctcatatagctcagtaatgttggcagccagatatatatgttcttcttaaattctagaaattttatattgaaatcttttactactgatttccttctattttctctatcctctattcatagaatttcaactattctaaaacattctcccccttctatggagggggtcaaaggcatcttctttgagaacctatcttccaagagaaataagcacaagacactcaaatcaaaagttttccaaatattatcctagagagaagagcaccattgagaagcactccccctgccatgagctcccagccttctttttagcgcctgcctcactcttaaatatgagcagacagccaaggactgccagacgtttatgaaaaaaaccccacctcactttaaatgccaatacaaatagaaagaaaaacttaataataactagtattaatatccctagagaatatgaatcaatgaagaagtagatactataaaacaaatatccagtgaacatgaaaccttagaaatagacaatatgatcgcataaactattggaagataccctgggcacagtggcccacacctgtaatcccagcactttgggaggctgaggcaggtagatcactgaggtcaggagttcgagaccagcctggccaacatggtgaaatcccatctctactaaaaatataaaaattagctgggcgtgtggcaggtgcctgtaatcccaactacttgggaggcggaggcacgatagtcactttaacccaggaggcagaggtcgcagtgagccgagatggtgccactgcactccagcctggacaacagagcaagactccatctcaaacaacataaaaaatcaaaaaatatatattggaagataaaatcaagagaatctcccagaaagactagaagaaagagaagaaaatagataatattttttaaaatagagacttatctagaatgttctagaataattgaagttctggccgggcacggtggctcacgcctgtaatcccagcactttgggaggctgaggcgggtggatcacgaggtcaggagatggagaccatcctggctaacatggtgaaaccccgtctctaacaaaaatacaaaaaaattagccgggcatggtggtgggcacctgtagtcccagctactcaggaggctgaggcaggagaatggcatgaacccagaaggcagaagttgcaatgagccacgatagcgccactgcactccagcctgggcgacaca

SEQ ID NO: 50089 - DNA, 1045 bp, Homo sapiens
ggtgacatgaaaatatctctggcatagcccaagcatggttgttatggtgtagagaaaggctctattgcattcagccattcaggggctcaggctccattcatgttatggctccatgccctgagaccttaggattcaactggattaactacaaacaaatggtagaaaaagtaaaaaggagcatgaagaattgtgtatggggggtcgggggtggggacgcggtaagggaacaggcctagaagtggcaggcatcacttctacccacattatgtgggtctcggaattcagtcgtatggcctagttgcatcacagagaaggctgggaaatctataacattgaggacatgttttgttctcctaggaggacaaaaaagaaaatggggtttggtgagttcatagcatcgtctctgataccatgtagttcactgtggtatggcaccataaaggtccctcatgttccccaagtagtctctaatggcaagctgattcttttatccagtttgaatcaaggttgaatgacaaccttaattcctgttaggtgagaataaagtatcatgagtcatttagcccccatgatgaaggctttcagagaaggtcttgttaaagggtgggtggggaaaattcctagggatatgaggggtcagtggggagtgaagtgagatactgtagagtaagcgaaaaggttgaccagttactccttacctacttacaatggcctgaactgctgagtgtgcaagagggacagttttaaaagctgtcaggccacaagctttctaactgccatcagcataggttgtttttcccatcctgtggcctttggttgggttctctaggaaacagactctaaaatggaaatttgcatgcaagtaatttattggagaatgctcaatggatggaaggatgagaaagagggaggagttaaaatggtcatgggtcaggaagctttagcactgggatggctcttcaaagttgtcctgccttgaggcaagggggccaggcttttggatccctctctatttgacagtcactggatttgagctccttccagg

SEQ ID NO: 50090 - DNA, 1045 bp, Homo sapiens
tggaaaatctagaggaaatgggtaagttcgtagacacatacaaactaccaaagtggaaccatgatgaaataaaacacctgaacagaccaataacaagtaactacattgaagccataacaaaatgtctcccagtaaaggaaagtccaagactcaatagcttcactgccaaattccacaaaacatttaaagaagaactattaccaaccctacacaaactatttcaaaaaatagaggaggaatatgtccaaactcattatatcagaccaatattactctgatactaaagtcagacaaggacccatcaaaaagagaaaactacaggccagtatctctgatgaatattgatgcaaaaatcctcaacaaaatactagcaaatcaaattcaaccataccttaaaaagatcattcatcatgaccaggtggtatttaccccagggatgcaaggatggctcaacatattcaaatcaatcaatgtgatacattgtatcaacagaatgaaggacaaaaaccgtatgactgtttcaattgatgctgaaaaaatttgataaaattcagtatcccttcatgactctcaaaaaactaagtatagaatgaacatacctcaatataataaaagcccatagctagtatcatacttaatggagaaaaactaaaagtctttcatctaagatctggaacatgacaaggatacccagttcactgctgttattcaacatagtactggaagttctcgctggggcaattagagaagtgaaagaaataaagggcatcaaaactggaaaggaaaaagtcaaattatcattgtttgctgataatatgaccttatatttggaaaaacctaaagacttgaccaaaaattattagaactgataaattcagtaaagctacagaatacaagatcaacatacaaaaatcaatagcatttctaaatgccaacagtgaacaatctgaaaaagaaattgaaaagtaatcccatttacaatagtcactaataacgtaaaatacttaggaattaacttaaccaaagaagtgaaagatatctacaa

SEQ ID NO: 50091 - DNA, 1877 bp, Homo sapiens
taacatataactcagggaaacttgatattccatggaccatggactgggagattcaagtgaataagaccttggggtccaggagatggggaggccaggcctaactgacagaggcttatactttaagggtgaatttattaaacaaatattatacaaaatacaatgagctgataataaaacattctttgttcttaaatttatatatgtgtgcttgtgtgtactaatactgaggcccttaaaccactaagatttaggattcttaaacaaaacagattaggtaaagtttgccttccaaagccaaggggagaggggtggccagggaaggagaatgttctggctggaaaggagacaaattctgagtaaaggaagctgaaggacaaacacttctactcaggatttagcattggcaggactgtttggtgtgtaggaatttagaactgggtcagtattatttaaaggactacaaacctggttttaaatttaaaaggggtgtgggggtggagcatggcaggtggtgaaccaaaggaatttactatgatctgaaaaataagcttaagtactaactccactgtgggcagggaggcaagaaccttcccttttttgagttgaagataagcctcttcagtctaaactttcctaaattccacttcttctttttctataaaacaaggtgaagtactttatgctagctatcaaaaatcattgactgtatgttgcatgaatttatgaatttattatgctagaaaagtgtttcttggctacttcatatgtatataagctttctccctcaacacagtttctgctttttatttttggaatctcacatagcctatatcttgttttcagagtagatactatcactgtgggtggctgagttctcatctatatgcaaccaaggctaactggctctctaggttaccttgatgccacccactgagagtcctttctggatttagtgatttagtgctgcttattttcaccttctctcaggatggagcctcagaatagagaccaggttgaaaatcagtcttttacttagaaccatgaaagcagatactacatcttatccgtctatgacctggtgacccagaagccattaatttgacattaccaacatacctccacacaaagactttataatcttcagtgtgagaattaaacaaacaaacaaacaaaaacttaaaacaactttggaggggagaacgataacctaaattttaagcataagaaaatccctaacaaaaagatccaactaattgccactggggggcgatggaagttcgtgaactgctctgctaatccctgaggcaactgagcactttagttggtttatttattcaaagctggaatttggacgtgtgacccatcaagctcagggaaattcctggatgaggaacacagtcctgggagaaacctaccaaagatggaattagcaccttggcgaaccgccttcagcgcaaagaactttctttccttgtgtgtcttaagaatttacttcagttcccttctgtctgaagcagaggaagccaagttaaactgtgaataagcacgacaacaaagaagagttcttatttatcactacctgcaaacacatgtaagtgcacagtttaaacagcattcagacatctcacagccactaggatcagagttttggtgtgagtaggcctcagttggtaactttcctgaggaaaggagggaggttatagaatttatgttaggaaattctgagtcatagataacactttaagtgacagttaaggaatctagtgagagggactttggacaggtttagaaaagtaccctatggaaacaaaggaggaaaaaaaaagtatcttcactgcaagagtaatattgcagccacttggtggcgtgttgtgggc

SEQ ID NO: 50092 - DNA, 1051 bp, Homo sapiens
ggagggaaatgaggtgacgagtaccagtggtcttaaaatggtctctgatgcgataattcctcatttacacccttaagaaaataatcagagctgtatatacagatttttgaatacatctttttctaaacctactatttataaatgcaaaggcctaaaaataacccttttatgttcaacaatgggataataaacacataaattcagaggcaataatatggtgccaatgtggtagagtgaggagaaataatcttttttgaaaaatctttaatgccatgagaacatatttaggataatatttagaggggaaataggctacttaaaggaatcatttagaataaattaatatttttaatgcatatataaatttgatatgcatttacataatatcagaagaatagacatataaatagtaactggttaggactgcttggtgggatttagggtggtttttttttcttcaaagtcttttgtgtttccaaactattgacagttcgcatttattatcagtatactaaggaaaaaaagccattttaaaaatagctctaggaaactattcaaatctaaagcttaagcatttatatttcatgctgcttatgagaagaccagggacatgtagcagttgcttgtttttttctttgtaattctagtcattctatgtgactcccctgtagcaggcagaataatggtcccctaaagatttctacactctagcccctagaacttgtgaatgtgttacatggcaaaggggagtttgcagatgggattaaaggtataggtcttgagatgggaagattatcctgggttggcttagtggactctatctaatcatataggtccttaaaatcggataaactttttgggctgtggtcagagggagatctgacggcagcaccagaaggacttggcccgccactgaaattgcctttttcaccttttgcagggaattctggtagcctgcagaaggtgaaaaaggcaaggcaagaaaatctcccctaaatcttccagaaggcatgctgtgcagctggcaccttgattttaacgcagtgagatt

SEQ ID NO: 50093 - DNA, 1121 bp, Homo sapiens
cttgttgggtttccacactcagtccattagctttagatcacaacatttttgtccaatcatatttctgcacagctgtccacactttgttgaacctaagcataaaaatggccagtttgctctgtatctttgggtcttcattctaaaggttcccttgtcacgtaaaactatgatctcaaataaatttgtatgcgttttctcctattaatctaatctgtctcttgtcagtgattttcagagaaccttcagagggcaaagaggaagttttcccatggctccgaccctgtgaaaagaatgcactggagacagtgcttgttcggggcgctccgctggcttcttggacaattgcgccatgtgtgctgctcggccagcggcggcggcggcccagtcggtgtatgccttctcggcgcgcccgctggccggcggggagcctgtgagcctgggctccctgcggtgcaaggtactacttatagagaatgtggcgtccctctgaggctccacggtccgggactacacccagatgaacgagctgcagcggcgcctcggaccccggggcctggtggtgctcggcttcccgtgcaaccagtttgggcatcaggagaacgccaagaacgaagagattctgaattccctcaagtacgtccgacctggtggtgggttcgagcccaacttcatgctcttcgagaagggcgaggtgaacggtgcgggggcgcacactctctttgccttcctgcgggaggccctgccagcccccagcgacgacgccactgcgcttatgaccgaccccaagctcatcacctggtctccggtgtgtcgcaacgatgttgcctagaactttgagaagttcctggtgggccctgacggtgtgcccctacgcaggtacagccgccgcttccagaccattgacatcgagcctgacatcgaagccctgctgtctcaagggcccagctgtgcctagggcgcccctcctaccccggctgcttggcagttgcagtgctgctctctggggggttttcatctatgagggtgtttcctctaaacctacaagggaggaacacctgatcttccagaaaataccccctcgagatgggcgccggtcctgtccatcccagtctctgccagac

SEQ ID NO: 50094 - DNA, 1022 bp, Homo sapiens
cttttataagtctcatgacaataacaaagtataaaagcaaactgttttttccccacaagaaaaccatctatagaatttacagaatgaaatgtcagcattctcgatgccatatgcaaatgttaatctgtggttgctcacactgtcatctaggacgaccatcgtcatctgaaccagttcatagctcatgctgctctcgacctcgtagatgagaacatgtggctatcgaacaacatgtacttgaaaactgtggacaagttcaacgagtggtttgtgtcggcatttgtcactgcggggcatatccttaccttcttagtaaaggtaactaactaaagtttgggctcacaaaccagaagaacatggaacatagatgccaggctctgagtctgtagacttcacagtcaggtgaaaatgtaagtttccatttatggggctacttttctttttttaggggggaaaaacattttgtttaatagctaattttaaaactaagtctcatacacaaaaagagtttatctggaccctatcaagggtgattttactttattttacagttattttctaactttgaaagcttatgttctctttatgataaaactaagctaattttaaacccagtttatatattcaacttttccatcacaaatacactgcatgtgactaatttgaagaatactgtatcaacgaactggttgctttttgtttttcatttctaagaaagattatgccttaattatttcacatatgaggtttattatgcttcatgacataagacaagaagatggaataaagaacttctttactgatgtttatgatttatatataaaggtatggtatgttctataatttttaaattctgatgagaaaggattcgacctttgtcaggaaactggcctattgaagtaactcccttaggctgcagtttacctttcagactagctttcccccatcagaactatctctggcaactccctccgcaggtaagtcttcacagccaggtgaatatgtatttaggaacacaactt

SEQ ID NO: 50095 - DNA, 1019 bp, Homo sapiens
tacatttaaggttaatattgttatgtgtgaatttgatcctgtcattatgatgttcgctggttattttgcctgttaactgatgcagtttcttcatagcatcaatggtcttttacaatttggcctgtttttgcagtggctggtaccggttgtttctttctatgtttagtgcttccttcaggagctcttgtaaggcaggcctggtggtgacaaaatctctcatcatttccttctctgtaaaggattttatttctctttcacttatgaagcttagtttggctggatatgaaattctgggttgaaaattcttttaagaatgctgaatattggcccccactctcttctggcttgtagagtttctgctgagagatctgctgttagtctgatgggcttccctttgtgggtaacccgacctttctctctgctgcccttaacatttttttccttcatttcaaccttggtgaatctgacaattacgtgtcttggggttcctcttctcgaggagtatctttgtggtattctctgtatttgctgaatttgaatgttggcctgccttgctaggttggggaagttctcctggataatatcctgaagagtgttttccaacttggttccattctccccatcactttcaggtacaccagtcaaacgtagatttggtcttttcacatagtcccatatttcttggaggctttgttcgtttctttttattcttttttctctaaccttgttttctcgctttatttcattaatttgatcttcaatcactgataccctttcttctacttgatcaaatcagttattgaagcttgtgtatgcatcatgaagttcttgtgccatggtttttagctccctcaggtcatttaaggtcttctctacactgtttattctagttagccattcgtctaatcttttttcaaggtttttagcttccttgagatgggttcaaacatgctcctttagctcagagaagtttgttattaccgaccttttgaagcctcattctgtcaactcatcaaagt

SEQ ID NO: 50096 - DNA, 1072 bp, Homo sapiens
cttataaatttgtttgagttctttgtagattctggatattagcccttcgtcagatgggtagattgcaaacattttctcccattctgtaggttgcctgttcactctgatggtagtttcttttgccgtgcagaagctctttagtttaattagatcccatctgtctattttggcttttgttgtcattgcttttggtgttttagtcatgaagtccttgcccatgcctgtgtcctgaatggtattgcctaggttttcctctagagtttttatggttttaggtctaacatttaagtcttttttttgtttgttttttgttttttgagacgaagtttcactcttgttgcccaggctggagtgcaatggtgcaatcttgactcactgcaacctccacctcttggattcaagcaattcttctgcttctgcctcccgagtagcagggattacaggcatgtgccaccacgcccggctaagtttgtatttttagtagagacggggtttctccatgttggtcaggctgatcttgaactccctacctcaggtgatatgaccacctcagcctcccaaagtgccgggattacaggcttgagccaccgtgcccagccctaacatttaagtctttaatccatcttgaattaatttttgtataaggtgtaaggaagggatccagtttcaggtttctacatatggctagccagttttcccagcaccatttattaaatagggaatcctttccccatttcttgtttttgtcaggtttgtcaaagatcagatggttgtagatgtgtggtgttatttctgaggcctctgttctgttccattggtctatatatctgtttcggtaccagtaccatgctgttttggttactgtagccttgtagtatagtttgaagtcaggtagcatgatgcctccacctttcttcttttggctgaggattgtcttggcaatgtgggctcttttttggttccatatgaactttaaagtagtttttttcaattctgtgaagaaagtcattggtagcttgatggggatggcagtgaatctataaattacccttgggcagtatggccattttca

SEQ ID NO: 50097 - DNA, 1070 bp, Homo sapiens
agggtgatgcccataagccactctaacttcctgcactccctttcatttctctgtggggctcaccgatgagtgagtatatttccagaacatcatttctgacatcatccaaatcctctaaagcagccttcctttaaaaactccaaccctggaatctaatctgcatttttggaacgtttgcaatatgctgaagtcagagctactccctttgctgtgccccacgtgcctgggcaccagcccctcggctccaccacctgatgtgcaagtcatgtcagtgtcctcccaagattcctttcacttccccaacttggtgcccaagggggatctgcactgggtctagtgcagcatcccccctaacgtgctttctacaagagggaattggcagcaatgctaggcaaggcgattcagaatcagcgactctacttttttgctgaataagacactgcagatctatttcgctgatttatttacattattctgcatgtccttggagagatggcagaaggttaagggacagcatcgattctttcagattcctcaaggctcttgcagatttcccatggtcctttgtactacaaagtgggagaatcaagcatcagatgaccttttcaatgttactctgttggttcaatctgtaacaactttttctcttgtcttcaccaacctctcactgctttccacaaaaaatgaaccatggcctgctattatttgttttcaattctgaatataataagatatcataaattgctttcacgaaagtactgatttgattatcacttatgatacaaattatgaaactgcaacatgagtgttttctctctgattcctttcaccatttcactgcagacttgaaaagggaccagaatggaccaaaaagaaattatttctttgttgttttgccaaagacctttcctttcaaaatgcacacatcctggagttttgaaaactgctataattatcacaaggcagtctttctgtgggaagaaagtgagtgaatttcccattaggagatcatggttaaaataatctctcggctctgggaccaaatggaactagaaagtgtgttcaaaagc

SEQ ID NO: 50098 - DNA, 1026 bp, Homo sapiens
ctggggagctttaaaaactactgatgccagagccccaccctcagagattctggtttaactggtctggagtgtgatctgagcctagggagttttttaaacgcctcagatggtctcaatatgcaccattgtggttatattgcagctttacaggtgtaagaatcggatttgttctcttaaaagggaagataagtcttctttttggtcctaggtcaatctgagctgagttcttcagcccttgaagaaagagcatccttctaactcaccagttctcaaccaggggacatctggcagatgcgtttggttgtcacaactggagttgggggtgctactggaattaagtggatagagtccaggggtgctactaaacatcctacagtgcaacagctccccacagcaaagaatgaaagggccccaagtatcgatggtgctgagacagaaaccctggtatagcttacctcactcctgccctcaaaaggctgggaagttcaacacttccttcttcaatgactattgagagtaactaactaatagtgttacaacaaaggggtcccaatccagatcccaagagagggttcttggatctcatgcaagaaagaattcagggcgagtccatagagtaaagtgaaagcaagtttattaagaaagtgaaggaataaaagaatggctactccatagagccattttatggttgtttcttgattacatgctaaacaaggagtggattattcatgcctcccctttctagaccatatagggtaactttctgacgttgccatggtatttgtaaactgtcatggcgctggtgggagtgtagcagtgaggacaaccagaggtcactctcatcaccgtcttggttttggtgagttttagccagcttctttactgcaacctgttttatcagcaaggtctttatgacctgtatcttgtgccgacctcgtatctcatcccgtgacatagaatgccttaaccatctgagaatgcagcccagtaggtctcagcctcattttacccagctcctatttaaga

SEQ ID NO: 50099 - DNA, 1048 bp, Homo sapiens
ctccactagcattaacagaacatatgtattctacatttatataaaattaaatgattacatatatttattatatattatgtatttcaaacttgttttttattttgatgtatttcaatttagttttctttctaatgctatgtatattttttcgtgcatttaagaacattgttctgtaaaggagatctggagggttcagctgactgcccagggagtctaagaagccctgtctaactggtgtcttcataatggggagaacctccccttcctcaaatgatcctatccctctcctcccagccactgaggggcagtcatctctagctctacggagatgcccccaccccattttcccatatcatattccacccagccttcaaagccctgcatgagtccacctagtcctttgttcctctggctccaccaccctggctgccagacacaggcattcacccccggcccgtctcatggggtgttctatttgtttagtttatgtttcagccctagtgagagtcagttctggaatccaatggatctgtgattccttgttggaaggaaccacttctcttgcgctgagtaacgcattggtgttggatgacggtgttcatgatgacgaacttatgctgtcctgaccatgcctggagactggccctgcattggagaagatccaagagtctgcgtggtaaaatgataatgaacgtgagcttaggggcagaatgctgatgtgtttattctgctaactatgtgctttgggcaagtgcctatacttattctccctgagcttcaatttcctcattggtaaattggggattatacttacctttcaggatgacatcaagagtaaataatatactgactctaagaaaagtgcctggagtggtgcctggtgcatggcaaatgctcagtacctgtgaggtagtatttgcctgggctggttgatggttgggcgctgggggttagcctggtataaatcgagattttgaggtggtcctgtgaacccaaagatgccttgagaccctgcgtgggagacagatggaaggagatgtctaagcct

SEQ ID NO: 50100 - DNA, 1035 bp, Homo sapiens
tgcaatgctaacatgaagatcggatatactagtatcattttatggtttagagagtggactttggagtcagactgccagatttaaaataccagttacttctaaattaatgtctgggccttgattttctgatctgaaaaactggagcaataaaatacctcctttgcatgattgagtgttaaatagtttcatacatgtgaagtgcatagaacaattcctggcccatggaaaatagtgttttaactattatgtatatcatccattgaagagtataaggtgctatcaaaagcttttgttacaaatgctgttttcagtttgccgttactttctgggtctttgaacctccttgtaacatgttatataggaatgtaaatgtgccacatggtagcttcttaatgcttagttgtcctgcataaattaatcccctttagaaagtaaattacttacaatttagaatggcatactcatggtctgttctttaatccacctgtataattggttcttctccaaagatattaacaagcttgacgtcgatgctgagaaattctagagcagaagagcagactctcccttcactgttatttgtgttcctctctctccaattccttagattgtaggacgaagtaaatcacaagggccagtgtcttgtttagaaaggttttgtcataccgcacaggcggcctgcatccgttttcagtggggtggtttaacttgatgaggctaatgccaagatacagtactcagagtccaccgtgtttgacatagtcatcaacggtcttccttttggacttctttttggatgaggggaaatgtgcattcgcccagtggctctcaccctgactgtacagtggagtcacctagagagctttaaaaatgccgatgcctggccccactcacagaggttctgatgtaattgtgcagggtgctgactgggcttggggatttttaaaagcttcccaaatgattctgatgtgcagccagggttgagaagtgctaggatggcctgcactgagtgatatggaaaggatactttttgaa

SEQ ID NO: 50101 - DNA, 1032 bp, Homo sapiens
aatttagaattcatcttcttagctgtaatcaaatctaaccagattaagcccttaaggcaaccttcctgcacgttccgtccttagtcatgtcttcattacgtttgttcatgtgtttgagagatgcaggagttggaagagaaaggactgatttcccccttgtttagagatccgttttctatagccattgatctctgccattcctacatcccagcccccacaacctagactcctccctgcaaatggagactataagtcaatgttttctgagacatctgaccatacttgcaaaatagttccagcgcaaaaagaacaagaacattggaagcgagggtcagaaggagcctagaaaacctgctatattgtatgtgcattgggtcactgttttagatttagaaatgtttcacaatgtcttcccgaaaagaatgtttaaatggtggattttaagatgggtgcttaaattcaggcatctgttccttcacacaatgggcaaagaatggaaatgtaattagcaatgtaagtcaagctcttaagataatgtgatttgatgcagtactttatattttcctttttgttttctcatttggcatattctgacagtttccatggtaattaaaaagaatttgggaccttaaagggatgaatttccatcctatgaattcttaccattttgcaaagccactgtaccggtttactaaaaactgttttgagctctattatatgatgtcacaaatatttttagatgttttgtaagaggcacaaatatcgtaaactcattaaaaattgttattgaagtataatatgtgtacacgaaaagtgggcaaatcataagtgtacagcttaataagtttttataaatgtaaccagcagttatagattaataagcagaatattaccagccccttagaagccgcctcaggctgccttacagatatacctgatcaaggctaatcacccctaatttctgtcagcagagctttgcactttatataaatggaataatacagtatgagctcttgtgactggtgtggcttg

SEQ ID NO: 50102 - DNA, 1035 bp, Homo sapiens
ctgggactgtaggcatgagccaccatgcccagctaatttttttttaagagatggggcctcactatattgcccaggtggatctcaaactcctgggctcaagcaatcctcctgcctcagcctctcaaagtgctgggattacacgtgtgagccaccatgcctcactctctctcccccatttgagtgtgggctagactagtgactcacttccaaacaacaaagtacagaaaggggaaaataacagcttttggaagaacctggcagataccatattatccatgtgatcaaggtcaacatcaccagtcgtaagttctgctgatgttgtggacaacctgatatgatatgatgagaagggagctttacctctgtgggattctcaaaacccataaccccaatttaaacatgagaaaaatatcagataagcccaaattgaggggcatttgacaaaatacctgaccagtatgagtcaaaatcctcaaggtcacaaaaggcaaagaaagactgagaaactgtcacagaggagactaaggggacatgacaactaaatgcaatgtgggatcttggagcagaaaaaggatattagtggaaaatctggtaaaatctagatacagccggccgggcgcagtggctcacgcctgtaatcccagcactttgggaggctgaggcgggcggattacctgaggtcaagagttcaagatcagcctgggcaacacggtgaaaccccatctctactaaaaatacaaaattagccgggcgtggtgacacatgcctgtaatcccagctactcaggaggctgaggcaggagaatcacttgaatctgggaggcagaggatgcagttagccgagatcacaccattgcactccagcctgggcaacaaaagtaaatctctgtctcaccaaaaaaaaaaaaaaaaaaatctacatacagcccgtagctttatttaacaggaatatgccaatgtaaatttcttggttttgacacatgtaccatagttatgtataatgttaacaatgagggtaactgagtaagggtgtata

SEQ ID NO: 50103 - DNA, 1087 bp, Homo sapiens
atgtgaccttatttaaagacagggtctttccagaggtaattgaggttaagtgaggtcattacagggatcctaatcctatgtgactcaggtccttataaaaagggcaaaatccggacacagagacagacacacatgcagtgaaaacaccatgtgaagattgacattatgtcgccacaatccaaggaacatccagaaggtgggagaggcctggaacagatccttccctagcacctttagagggtttatggccctgccaacacctcgattgcagacttctgacctccagagccatgagacaatacatttctgttgttttaaaccacccagtatatggtactttgttatggcagccctaggaaaggagtacaatcaccctgggagaattttctttgtccccaaatgcaatctgtgactgggacataaagtaaacccacagttcttgtcatctgtctgaaaaaactgtattacttatttgttttactgtgatctagatagcaaaccatcataaaagggaattttatgaaaacccttgcaacttccatcttgaacctcattttccagtattcatattattgctggcaacagtgtatggaggcagctgtggcagaactgcttgaatcacagaggtccagcctcactctaccactcgctgattagaggttctcgtcctcctgtaagccccctgccttcaccattctttgcctcagttgcctcacctatgaaataggatcctaattagtgggtagtaattatgaagaatccctaatgggtagtaattgtgaagaatccatgagataatatgagaaaagttatagaatggtgcttggtaccaagttggtgcccaataaatgttattgttacagttagttgctagtaacccatcctttaacatggattattaaccataaattggtttttctctgataccgtttgccttgattagtgcttgattgagattctgtacatatatatatatatatatatatatatttttttttttttttttttttttgagacagattcttactctgtcacccaggctagagtacagtggcgccatctcagctcactacaacctatgcctccc

SEQ ID NO: 50104 - DNA, 1214 bp, Homo sapiens
atcccccaaactagcaatgttctttccagacatggacagttctctatctgaaattccccttttcattcattgaacacctatttgctctcaataccaaattcaagtacctcctcttttataaagcctagagctacttctttttcctcctcagtgaactgagttctcctgtaccacgggccctctagagaaaaataaaggtcatcactattagtggataccttagttagcccccctagtcttttgtaaagatttttggttcactgcctcataatctgggagaatcctgtacttgagaactactcaatttttttgtaaagctggaagatgaagctcaagaggagaatttcagaagatgcccaaccacagactcactggttggaaggaagtatgggccataaccatgaagtgaacctgaaattactttagcagtcagaactccctggcaattcaggtatatccaatattatcaacatgtatgatttatgcgcctttggttttatttactgaacactgcagacactgagtaggagagtgccttaggccagggattctatttggataagttagatgtcactatccatccatgttcggtattaggcatggaaaagaaaactttttataaatgggatattggtactgaaatagtggtaaagtagaagaaggtgggatagtaaagttgcaggttagaatgctgataagttaacaattctcctttgaatcaccctctactttgtacttagcgcagtgtcctatgcataataaatgcgtgatacatgtctacatgtaaataaatccacttactcaacattaaatatttattaagctcctagataaacagaaagtgcacaaaaacctggggcttcaaagataaattcaattcaacctgtaatagaaagggcagcagctgtgttacaaatatattcaataaagtattgcagatggggaatgagtgtccctgttgtcattttctaatgacttatactcccctccatcctaggttatatataaggaaaggtagtgtttgtccaagtcctatttggcagcaggataactttttcttcccctaaataacaagaatgataaaattctggctgttttctattcaagaaaatgcagtgaggagtcaaatgagatgatacatatggagggacttcatgaattttaagtgaatcacaataattagcagataataataacttagttcagttcttaat

SEQ ID NO: 50105 - DNA, 1131 bp, Homo sapiens
tgaaaatgcagtggctttctaaatttgccatatgcatggtcgattttgaatgtcctaatttccctaagaaactctaagtttcacttccaagcttttagatggtctattgtatatttcaattgtaatattttgccctttaagatttttagtttgacttgcagtatttttttaattaatactcactgcctttccatcctgagttaggtaaaaacagagatgagcattgtcataggctgaattgtgtcccccccacattcatatgccttaaccctcagtacctcaaaatgtaaccatatttggagataaggtctataaagggttagttaagtttaagtgagggttggcccctaatctgatatgactggtgtccttatgagaaaaggagaaaagagacaccagggatgtgtttacacagaggaacgaccatgtgaaaatgcagtgagaaggcagatatctacaagccagggagagaagtctcaaaagaaagcaaacctgtcaacatctggattttggacttctggccttcagaactgtgagaaagtacatttctgttgtttaaaccactcagtctgtggtattttgttatggtagccctagaaaacaaatataaactccttgcatttgtccttctggtagcctatagaaaggttagaacagacacacaaaataatttgtgaataaggtttggtctactccttccagatcaagggaccagggccccatactaggagtgtaggctgctaccaattttaaaccaaaactactgccatactagggagggaatgggacaagggcaagtgggaataccacaaaactttcctaccatttcgaagttacctttttcttgattttgtggacatttggttgctgtaaacttttgactgttttccagagttctgacaaaattggttctgacagtttctactctttttgagagcttgagctgtctactgtgccgttttgttgatgtcaccctccctttctccaaaactttaatacacctatgtgaactatggtgttcctgaaaataaatagtgtgtgtcattatttcccaaacttatttgactatagatttttttgttttttagatagaccatccttttcgtggaacacatttcaaagatagcaagc

SEQ ID NO: 50106 - DNA, 1037 bp, Homo sapiens
gaaaagttaagagatcaaggtcacgtgtttacttagaagcaaagctgacattggaaccaggtttccatgtatccagctataagtatgttgttaatgactatgctgagctattgaatttgtgtgtgtgtgtgtgtgtgtgtgtgtgtgtgtgtgtgtgcatgcttgaatgttacagaatggcagaattattgaaatgagattttgtatattatgcttaatggcaattgaacggaatagcctgtacttcctttactgaagcaatcaggaacacatttgtgcaggtgattacacaataccattaaccatgtaccatcctaccaaatacattcttgttatggagaatcacatttatgagaccaaagggacttctgacactctccaccaactttaagattcaaatgataaacaagaaaccacaaaagtcaaatattcatatacatcctaccctgcagaatcaggcagctctacattagtggagaaatggagatgcgaacatgtgcagccaatggaggcttacctgatactgtagagcactttgccatttttcgaaatccgtagcaatttgttgtcagtggtgacatcgtggaagttggcacccttctcattggcaaagaacaaatctggtttccaaatggagtctagcatggatgggtccaagtccagggagtcatctgggtactcactgtacgccagccgtgaatcattccactgttgtctcagaaaaatattcactcggtagtcctacagaaatgccgtggacaagtgttactgattaccctggcacaggagttctatttgcatttctctctcattcttctccctgatttgatacagctttggtgtccgagtaaaccaaactgtgtataccttggtcaaaataaaccatttagttctattaggagaggggacaaaagggagaaagaaaaaggaagattcaaccaaaccagaacaccaataaaacgggttgacttggttgaattttttagtgtttaaattattcattttgggatgaaataatactaaagctgattttgcta

SEQ ID NO: 50107 - DNA, 1046 bp, Homo sapiens
ctttgctgcaacatgaattgtgtgtgtttgtgtctttggacttgggttgaagtaaatgaggaattaatgtgggggtaggaaatgacagcactgaaacagaagttaagagccctgattcttgtcctagctttcctacttactagctccattgtgacgtccttatcaacaaaacaagggtgttggattagatattttacaaggtaacttcaaatttaaaaaaaatccttctataaaagtcatatttctgactaaattctcagaagcaatgggatttttaaaaagaagacaatatcagcaaagatactgtgggcatgtgagatgagctgttcttcaaaaatgctcaccttctccttttttctttcatgttgtccaccatatcccatgatgtcctgacctttattccaactcacaatattaaattcaacaaatattgtttaaacaataatatgtacaaccttcaagactcacctcactatttcagtatggattcaagtatggattcattgtaagtaatgtgaatttagaatttgactctctctgaatttagaatttgactctttccccatcccagatgaaggaccacatgttactcagtacttgatctctattctctggattattgactttctctgaagaaggtttacaaatcaaaatgtatactcttgtcagagatgatcaataattaatggggcaggtcaacaaacaacttaggaaaaaacagagagtaagataaaacattagagaatgaatattaaagaaaaatggacagaaatggatttggtactttttcatcaacaaagattgtgtcctacatcactggataaaaggtttattaacactgagataaggcctttccttcctatttaaaagatttgtttgaattttagtcaaggtaccccaagtgttcataaggatgacacttacggagttctggtctactgccttctctttttttttagacccctaccttttggaatacagatatatgaagtattaggaaaggtgatcgtgcttgttatgaaatcagtggactgtatatttctata

SEQ ID NO: 50108 - DNA, 1024 bp, Homo sapiens
ctgaaaatcctgttactttggaggcatcagcaacttatggtgacacatatcaaagactttagtggcatcagggttaggtcataaaggggacaaagtagatggcctttttctacttgcttcaccatgcttttgtgtatccactgcttatctaagagaaatgcctcttattctgtcttattccatctcatctcatgcccctcattcttacatcctcctctggccaaggtccttatgtcttgttctcaaagcaattatcccttcctgccagaattccttttggggtgatggtctacatgggcataagatggaaagaaattcaattttctgattaaagagtgattcactataaagatttaatgactaataattttaattttctcaggagacattttcatttcaatgaaaagcttaccaaatcaggctattttttgggcggggggagaaaggcaagttatttggcattttactttgaaaggttgcctatgctgtattgataatgagattttgtatgacacacacacacacacacacacacacacacacacacacacacacacacactttggtttgtctttccattaggatgttgggggttggtcagtatatagggaatgagttgtaagggtcctttctctttaatgacatactaaaagaaccaggtcattggttaaaacaagcagggagtcatttcaacagtggtgacttacaactctccagctgcattgtacaggtctggacatccatcggaaagttcttcaagtccatgggacaggataaggtcaaggtgagtcttagcaaacaaaaaaaaaattaaaaaccatttttaaatctatgaagtccagttgttgagaaacaaacaaaatacacttggcattaagcaaagtgacattgattcaaataatgaaatctaagctccaactcagggcagtgctttttgtttttaaaatgaagaacagtcactgataaattttttaaatattgtagtatttcaccataacctcttactctctatttttcatcttcc

SEQ ID NO: 50109 - DNA, 1050 bp, Homo sapiens
gtcactgatactttagctgtctattaaattgaaaaatacacgtttgtacattccaggtctaatagcatagcatatagtactgagaatctatagaatcctccaggggcagagaagacatagccaagtgagggtatttaatggtagtgagtggggaaaaattgactcatatcttattcagaccctctggaactgaacccatttaatcaactatctgtaaaaaaaacacacacgtgtatttgtgcatatgtacatagttgcccccttggtatccacaggggattggttccaggatctttgcaaatacgaaaatctgtggatgctcaagtcccttatatgaaatggagtaatatttgcatataacctatgcacatcctcccatatactttaaatcatctctagattacttataatacccaatacaatgcaaatattgtatagttgttatgctgtattggttattttttttattgttgttttgctttctttgttttttaaaaatatttttgatccatggtttgttgaatctgcagatgcagagcctgcagatatggaggactaattgtatcttgtacacacatacatatgacaaactttggttaatctcattgacagtacaactataagtgaatagtgagccatccaaagaacaggacatcttctattcataaggccctttatgcattttctaatataacctctcatgccatggagcagtcttttctactacattatggacagggaacagtaagaataaaaataaccaggatgagatgaataccgacgatgtagaaaaactgggctaaacaatttatataagtactgcttcatctcatcctcatttaatttttttaaggggtagataataatgttctcattttataaatgatgaaacaaacttagagaggttgagtgaagtaaaggctctaagatttagatcaaggcctatgtttcaaaatatgtctttgttcatatttttattattattatactttaagttctgggttacctgtgcagaacatgcagttgtgttacatagatatacacatgcca

SEQ ID NO: 50110 - DNA, 1140 bp, Homo sapiens
atccaagaacttcataagatcctgattatgtacaaaaaataattgtttccaacttctttcagaaatactgggaaagtcgtttaaattagctggggatatacctgattcaaggagcaatcatctttattttttagagctaaaacagatatccaaacaaatctttaaaaactcctacaggtatcagtcttactgttttcgtagttctcttactgcaatctctagttagaagcattctggtagggggaataaagcaagaccaaatgtggcaaaactatgtatggcctctttcgttttaaattccaagcatgtcctgggtttgtcagctgcttgaaatggtccagctggtcttagttgaccagatggctgaaaagtaaggagaaatttccttatataggaaataggccatcccagttaataatggcgaaagacaatgcctctggatccttgcttcaaagagacagttctggacctgtcagagtcgtctgcacacctaggtcattctagctatcccagtgtttgctttcacttctatagtctctgggcttcagccacaaatgaggactcaagacacacttaggagtggctataaatcatctagctgtgataacaaacatggagtaaaggaaaataatcgtttaatcttattttgccatgtgcaaagcctgcctgatgtctcagtcttccatcttccattcaattcatcctcatacttttctgagggtgggaaagacaacatgcagcctttagtctgccactagaggctttatgctctaaacggttaaaagaagtattgccagcacaatagcttcttgggggttggcagagatgtatgtttaaaaaccaattttatagcttcaaagggaaagataccgatgaaacacatatcatgctggtatttgattttcctgtatttagagaagggattgaacttctgaaaaacaaaaaatcaagaacaaaaacacaaaaagtattggttggcaggaagataggaaattaacttggaatcaataaacacaagtttcttacttgaaacgtgtttaaaatgtgtgaagcatgtttgaaatgtacccagatttttttctagaaagccttattttaaaagtgtagcccaaatattatgagtagaaggtcctcattgcc

SEQ ID NO: 50111 - DNA, 1124 bp, Homo sapiens
tcttcttccctcagccacatgtgtgtggtcagattccatttttgctgtcttcattttctcagtggacatgacagctcatttataattctgcagttatttactctcattgcaattcaaaagatttatttaaatgctaactgcttggtgtttttctttaaagaattgcttggaaactatgtctgtgaaacattatacattttaaaaaatgatttctatgacgatactagtgattccaggaggatttgagaatactttattagcagctttcctctcttctcaggttaaacttgacatagacaattttgtctgctgctacataatagaacgcataagcttttaactcatttcctaagctttagtattcattttaatattatactgatttgattttaacccatttatttactccaaattccatgcaaaatgtattcaaacataaagattaattcacttaattaaccttttgattaaaaactaaaaccccagtacttatccatctggattctctcctcgaaacagattgtggagaattgcaacttagaagttgtatttcaagtggctgctaatatggtcaaatctacattatgagggaattaacgcacataaagttgaaagatctctaaccaaagcccttgttgaaaaataaaggtgctaatataaggaatgaacattttcattccttgtcagtaggctagtctttaaaccatttctgtaggacctcaatgtctatttgataagtccaaatggtttgggcttgaagtggatgttttcattactaaccatgcaatatttttgctctgctgctgggttctatctctgtgctagaaacaatgagaattcaaagttgaatgggatataatcactgccctaaatgtgaagattgtctagtagaggaacaaacagaagtgcaaaaataaccataatataaggcagaataaaataaaagaccaaagacaggagcttcgcaggtctacaagaggaagacattatttctgccttggtttatccaaagaccttacattttccttatttttctattacactccttagtataatcaacataccagccaaacagaactatgtacttcttcccaaaatcttcagtgcttactcatcactgttag

SEQ ID NO: 50112 - DNA, 1039 bp, Homo sapiens
gggcaggtaagagaaagtttcattgagagtagattcttgagccgaattttgtaaaataagtggttatttctcaggaagatatgcaatatgactatgaactcaagctttggaatcagaaatgctggggtttgaggcctggttaagtgtataactttggacaagttgcctaatgtctatgtgactcagtttcctggtaatgaagacagtgcctaatacagaagggggatcgaatttgataatacatataaggtaattagaagagagatgaaatagaattaaagttattttgtgtaagtccatgttgttatattataaatgtttaatgtgcattgccagagtcaaatgacatgtgaaaaagaggagacccattatggttacattactcataatcatcatcatcaccaatcatcatcatcaagcattgttcctttgagggctgatattttaacttcaagattttgcaattaaggtttctataattgggacacaaatctatggaccctagatggactttggcagctgaactgtagaaataaaaccatgatatctgaaacaaaatggttcaagaagcaagagagcaacaaaattaatgccactcagccccttggctggaaccagagactcaaacagtttggaatcagagccatgccccaacacccaggacaccatgcccagagggctggctctttgtgctgatccctgttttctgagcagttcactcaaaggggaagagacagaagcaggagagtgcctaaatggacctttacatcacacaagagagcaggagtaaatttgctgaactcaaggcactgcctagagaagtaaatattatctctgtatgtgtttggtctcacgatcctgctgatcctaaagtaaaatattactatattggaaagtacagaagttgagccaatgatgatgacactcttggtttctgttacttttgtgctgccccaatattgggcatttatgcctgcaggtgatttatgtttcccataagtgctctaaagctttgatacttttaagacttaaatacgga

SEQ ID NO: 50113 - DNA, 1052 bp, Homo sapiens
tgtcttcagttattttgtgtgtgtgtgtgtgtgtgtgtgtaatcttttctagtaattttggcatgattgttatgcttgctttatgatttagaagtttttctttcatacattaggttctggaattgacaaaacaaattagcatcatctactttttcaaggtatactagaagtcttctatgaatccatctgcgcctggaatctaatgcaaaaattatatgatcagctactgatatgctaaacagattttgcaacattcaacctaaattcttcatgaaaatctttaataatactaattcagggaaaatatatatacaaaagccaaaactatgtttaatggggaaatatagaattatgactagtaccaggaacaagacagggatacctacattagcattattatgcaacattgtactcaaggtagacattaaggcacttaggaaaaataactaaaggtatacaaattagaaaggagatggtaacatggtagctacttgtgaatgatatgacagtctatctggaaaactcaagagaaccaactgaaaaatctactactactagtataaatatttagagagttcagtaaagtagtaaaatacaaaattaatatgtggaaattaataacttttattcatacaaaatataatgaaaaataacaatagcaacagaaaaataataaaatatttatgaataaacttaacaggaaatgtgcaagaacacaaaagttgatttgaacaaatgaaaagacattccgtgctctgtcatagaaaagttcagtatcctatgttttaatccttttataagttaactttgtaactgtaatgtgttggtaataaatatataaattgtttgcctgttgacagagatgcaaacttaggtactgtgcccatagtatatgtggtcagggaagactttaaaacaaatcatatatagcattcatgtaaatctattcttgttcagaaaattaaataaatatttttataactcatgtgtgcctaaacctttaaagcctgaacattcatatatattttgtttggagcctggaatgcttatca

SEQ ID NO: 50114 - DNA, 1052 bp, Homo sapiens
tctggagatatttttgattgtcacaaccagggagcagtgctattggcatctggtagttgaggtcacggatgcttctaaacatcctattatgcacaggacagcatccaaaacaaagacttatccagtcgaaatgctaataattctgaggttggaaaaccctgagagagagaaagcaaaaacaaaaacaaacaaacaaaaaaccgaggtaactatatccagtccagtggttctcaaccagaagtgatgttgctctgaagaacattcagcagtgccagaagatgtttttggttgttccatctgggaagtaaagagttgctctggtttctagtgggttgaggccagggatgctgttaaatacccaacaatgcaaaggacagctctttatgacaaataattacccagtcccaaatgttaatagtgttataaggtggaaaaaccctggtctacactcttctcccagcatagaaacatttcccacattttatatctgtttatttccagataattcttcaaggagtagaccaaattccatccccaaggtgataatttctttgcctattctagcccacggtcgtcttgcccatctttagaatttgtaacgcacttaaagatagaatcatccagtttagtcttcgcttcatgcatatgtgttttatccacccaactaaagtataggatacttgggggaatatagatccagtaatgtcttctgtatccatgccaccaaggacaagtttttgtgcatatagtaagtgtccctgtaagtttttgttgactgtcaaattttccaagtgctatataaattcaaattcctttcacaattattgctttatataaagggtaagctacaaaaaaaaaagacaactaaaaagaagaaaaatgtagttttggtcttttagagatgatagttgttgatatccaaattactctggatttattttcattaacggaaaggagaatacttattatttagatgactttataacttatgtagtttgcaaatatatctggcgggaaagtagaaccagtcaagtggtttagagtttcatggt

SEQ ID NO: 50115 - DNA, 1080 bp, Homo sapiens
cagaactcagtgagctcatacccacataaactcctcaatataagcaatgtctcacaacaaatattcagctttacatctaggtatttgcagcattaatagggactgtgaaatatttttgttttcattccaacagagtagcatataactattacttcaccagcaggattaatttatcaaatattttctggaacagattttgaaaaatctttctctctctactgtacataaaatgttaactttagttctcaagcaatattgttacaggaggtaacattcttcatatcaaagggtatgtttctctcccagagtttgaaatggaaaacaggtgcaagccttttgatagcctctatgagattgggttataaaccagaacagtgctttccaagcatgtctgcacaccagaattgcctggggagctgcagaaatacagaggctggtgcccctcctaacattgaggtttagttggtgtaaggtgtgtctaaggcttgggatttttaaaatatccccaggcgattctaatgtgcaggcaagtttgggaaccacaggactggagatcttgagctatgcatttcaaacctgaagtctctggacagtgtaaagcttagaattctgcactaaagtttaagttgagataatgaggccagtctcactggatttatcatgttgcaatctacatgggtacggcataatttacataaagccagagcaattgatgaaaaaaagtcaatcagatcagtgatgtacacgcacgcacgcgcgcacacacacacacacacacacacacacacacacacacacacacacacacacacagtcaatatttagaagaaccaggattttaaagtaactttgtcaaatcaagtatatatccccaattagagttgccagataaatacagggagcccagttacttccgaatttcagataaacaatttttagtataagtatgtcccatgcaatatttggtatgtgcttatactaaaaattgtttcttgttatctgaaattccagtttaactccatgatatgtatttttatttgctgaatctgacaatcctccccaattttaaaggcctaagct

SEQ ID NO: 50116 - DNA, 1030 bp, Homo sapiens
gctgttccatctttcacttggaggcagtgacccatcccataaccgctaaaattaaaacgactttcacgagtaacgtcttcttcctgacggaataaagacagaggaagcacagattggttgtcagtcaagttagatggaagatgcttaaaattctttagaagtaaaaggataaatcacagttaactggtggtgtgggaggcttttggaatagcgagttctctttcaagttcaactcaattattcatggaacagatacagttgattaacttttcagactgagaaattaagggtaagaataatgactgtggtcattttaattaattaacaaacagaaacacctacattatattcagtactgactttcccaaaatctagtttattaatccctagatatgaatagagattttaaagcagttctccaaatcccagtgttacactgtaagtctatgaagaggaccattcattcattcattcattcattcagaaaacatttactgagcctgtgctgtgtgcctggccctaaggaacctatagtattgtggttcattcacagcgcaattcccccattaacattaggtttaatgttgatgttacatctaaggtgagccccttatatatatacctgttccccctccagccctctagttcatctcatttatatagcagagattaaatattcattaataatttaatttttccagtgttgatttttaacattgattatttggctggtgaatcatttctaccatatttaaatgtgtcattttagctgatgtcagtgatatttgtatgattatttctacataaattagataaaagtctgaaaaattgtatttattccttggtgtaaaggacaaatagccttagagaaaaatgtatgggatctgggtatgtgtttgggtcaaaggagggggtcaaacggtggggttgaaaaggtggggttgaaaagctgggattgaaatgacttaactgtaaacagccatcaattgaattatcttcttctgtaactagattactgccttccacaata

SEQ ID NO: 50117 - DNA, 1004 bp, Homo sapiens
aaatgttaagggcagccagagagaaaggttgggttacccacaaagggaagcccatcagactaacagtggatctctctaaagaaaccctacaaaccagaagagagtgggggccaatattcagcatgcttaaagaaaagaattttcaacccagaatttcgtatccagccaaactaagcttcataagtgaaggagaaataaaatcctttacagacaagcaaatgctgagagattttgtcaccaccaggcctgccttaccagagctcctgaaggaagcactaaatagggaaaggaaaaaccagtgccagtcactgcaaaaacataccaaattgtaaagttatataagttaattggtggcttctgaatggttacccttaagtttcattttgtttctctaacataggcatttataagaaatagtccaagttaacttttgtttatgtttgcaaatcaagcaaggttaaggtcatttatgaggactaactggctttgtcttcccaaggattcttcaggcctggtctccatttactttaacaggacacatgctctaaaggtaaaattgtttggttaaaatttcagtttctctttttgatgagacaggtcttcaggcaaattattgccttctggtatttattttaaacatttttttgaaatacagtagatatacataaaagaatattaaaatacttaatactcatttctcaaaataaacatattaaaatgtttaattaaaaaataaaaccatgggtcctattcaacatagtattggaagttctggccaaggcaatcaggcaagagaaagaaataatgggtattcaaacaggaagagaggaagtcaaattgtctctgtttgcagatgacatgattgtgtatttagaaaaccccactgtctcagcccaaaatctccttatgctgataagcaacttcagcaaaatctcaggatacaaaatcaatgtgcaaaaatcacaagcattcctatacatcaataatagataaacagagagtca

SEQ ID NO: 50118 - DNA, 1033 bp, Homo sapiens
agtcctgatccttgcacgtgaagggtctccttgtccttggtttcatcatttttgaggacctggagctactaatgagacttcagtgtgtatgaggactgaccaaattgtctgttccatgagcagccctgggctctactgcaagagggccagtgtggtacacacttcacaaagagcaccctagagctttgcactcctctttgaagctacatttacctgcttatgaatcatttgtgccaaagtgataatgtcctttctaaatgctagctcatagtctaaaaacatctaatacacgcttccatcatcttgggaaactatatattacttgttatttttaaactgcatttgcacccagagtagaaatagtgcctcttttctcatgtgggagcatgtgtaacaaagcaaacgtcattttccctccttcaaaaatgaaaataaacgcctttgaaatggaattttgttggtctttttttcaactcctgtatcttttgggccattcaatcacacaaaatcttgactctgaagatgttattaatgcggtatgcacaattttaaattatttctcttaagcattttcaacagaaatattctgggctctcttttgacatttatttcgtcattcatgagcatggatcagtggtaccatgaccttttactttccaggtttttcttttcttagtgtggatatagtgaaactgtatatagtctgaggagttaagaaacaaattgtgctggatgttcaaactctaatatgataggtgatcttgggcaaggagtttaattcatggagcttctgtttatctgttgatcaaagggtgtatattgactctttgtgatctgggcaccttggattgttgttaggatcaaatgctgtcataggcattaaacatgttgatattttgaaaacactatgtaaatatgaggttatagtgttatctttaattcttctactttataatctatgaaaaaatatattgcttgaatcattcaaattatacttaaaaaaccctaaattggtgaaaataagaaaaggttt

SEQ ID NO: 50119 - DNA, 1029 bp, Homo sapiens
cactaagaggacctttttgcctgccttgatgtgttccgtgcaggtactttgtagtctgccgaccctgacatgtgagcccattttaatgataactgagaccacaagaggaaaaaaaagatccatccaaggctttcctgagatcaataccataattacattttagaccctccaggtattaatcttctattttcagaaaagcaattccattttcctggcatggtctcttagaaattatactgcttctccatggctttttaattttttcccctgaggggaaagggaaggcaagccttttccttttcacctccttccctcctacagccattctctcttttaaattgaatgttcattgatgctctaaaaatactacacacagagaaagggttgatgtgagaatattttataatattaacagctgaatataggctgttttagtgctttctggaactccttgcttgcattatttcatttaaaaatattgtgtttgctgtctaaaaataatctttgttgaatacttcttatggactagttattgttctaagcacttgttctgaattaactaagttcagtctcattagaaccctgtgaaataggtactattttaaacattaggactccaaggcatagagcatttggaaccatcgcttaaaggctcacagttgttagaggcagaaagaatgtttttttcccagggaattttactccggcacctgcatgctcagtcaccaagctatctctggcttaatctgtatgtattttacactagggccagggaatctataaaaatattagacacagttggtgcctatacttggttgaatagtgtgtacccaaaattcatgttcacctagaacctcagaatgtgaccttacttggaaataggatctttgcagatataattagttgagctaaaatgaggtcatactggattaacatgggccctctaaggtgtttttataaggagagggagttttagagacagacatacagagagaatatggccatgtaaaggcagaggcagaagttgga

SEQ ID NO: 50120 - DNA, 1050 bp, Homo sapiens
ttgtgacaaatggggttatgtctttcatagaatgagtcctaaatagatacaatgttagctccataatggcagggattttggtctgctgtattcactggtatatcccaagaacctagaatagtacctgccacatagcaggcattcagtaagcatttgttgagtgaacagaggaatgcatacattcttataagaaataattgtttctgtctcctattccatctattagattgtcacttaatatgcattaataatagcacaattctacctgtcaaagaatgttttagattgtttacatatattcttgatctaatctaatcctcatgatatccctacaatgtaaggaatctgaggcttagaggaatttagtaactattccagtatcaccagactaatgattgaccctaccatgtcttcaccatgttacctctgattagcatgacataaataactgcagtgtcaatgctacagaaaatggcacaaggagctctaatcatcactcatataataagcagtcatcttgcaaacatcataaactgaaaggtgaaggacttaatccaagccatttccaaacactgagtgtgagggagcatgacgactcatcataaaagcagaaagacaacccttattcctccctgctgggttgtctgttgggagtcaattttattaaactgaaattactttcattgttataattcttatattattaagtgtcattaattgttggcttttcttaatttgttattatttttattattttttgtagagggaggtcttgctatgttgccaggctggtcttaaactcctagtcttaagcagttctcctgccttggcccctcaaagtgctgggattacaggtgtgagccaccgtactggcctaattgttggctttctttgtccaatttattctttctgagaaaataacattctactgaataatggcaggcaaataaaatctcttccttgtgaaagcatggggtccctttgacaacctgagacaatataccccagcagttaagtcaagggcactagagttcactgtttggctttgac

SEQ ID NO: 50121 - DNA, 1027 bp, Homo sapiens
ctccctaagtgctgggattacaggcgtgagccatgtgctcagcctagtgacttgtttctaacatgagaatatggtagtgactgtgtgtgatttccaaaacttggtcgcaaaacatattgagacttctatttggttttcttttttagatcacatgttttggggaaagccagccaacctgccatgaggacactcaagcagccctaggaagagtcctaccttgcaaagatctgaggcctcctgctaacagccagcaaggaattgaggtctttgtgatggttaattttatgtgtcaacttgactaggccagatatttggtcatacattattctctgtgtgtatgtgagagtattttcagatgagattaacatttgaatcagtaggctgagtaaagcagattgccctcctaatgtgggtgggcctcatctgattgattgaagacctaaacagaacaaaaaggctgagtaagatggaactacttctgcctgactacttgaagtgaaacattggtcttttccgaccttagaactccaactgccagcttttgggctggaatcaacaccaccagctctcctggttctcaggtcttcagacttggactggaactatatcattggctctcctggatctccagcttgctgactgcagatcttgggactactcagcttcgataatcatgtaaatgagccagttccttataataaatctctctctctctctctgtgtatatgtgtgtgtgtgtgtgtgtgtgtgtatatatagacgtgtgtgtgtgtgtgtgtgtgtatatatgcacttagaattgcctttccagcaatatatataatatatattatgtaacatatataatatataatatgtaacatatatattatataatatataacatataatttattatatataacatatataatagattatatatgttatatattatatatgttatatatataatatatgttatatatataatctattatatgtgttatatatatagaatcaataggaaaaaatatataaaaccaac

SEQ ID NO: 50122 - DNA, 1040 bp, Homo sapiens
gcatgctttctgtaggcagtggcagttctcctgtccagtctgctgccactggaccaccctgtatgtaagtttgcctcaaaaaaccctatggctcatttgctagctctgggtctcttctttggcctctcaaacctggtgctctccttattggagtgtgtaggggtccagcatgacatccatttatatgaagttctagaacaaatgtatgactgggggaggtgttaactagaaggggtcatggaaactttctggaatgatagaaatgttctatatcttgattggggtggtggttacccaaatgtgtacatttgtcaaaaattatcaaactatatcttaaaaatctgtgcattttgttttagtaaatttaccttaacaaataattattaacaaaacatcaatgtaaggaaaaagtagaaaaaatataattagttgaaaagaaggcaagtaaagaggaaataaggaactagataggccaaatagaaaacaaacagtaagatggtcgctgtaagttcaactatatcagtaattacattaaatgaaaagggactgaacattccaggtaaaagaaacaatttgttggttttatttgtgcatttcttcatgtgtctgtgctgcattcaagagacatattttaaagagtaagatacagaaaggtaaaaagtaaaagggtagctgggcacagtggctcacgcctgcaatcccagcactttgggaggccggggcgggcggatcacgaggtcaagggattgagaccatcctggccagcatggtgaagccccatctctattaaaaatacaaaaaattagctgggtgtggtggtgcatgcctgtaatcccagctactcgggaggctgaggtaggagaatcgcttgaaactggaaggctgaggttgcagtgagccaagatcgcgccactgcactccagcctgggcaacaagagcgaaactcgtctcaaaaaaaaaaaaaaaaaaaaagtaaaagggtaggcaaaaatatagtacgcaaacattaacccaaagcaaactagcatagcgatattaat

SEQ ID NO: 50123 - DNA, 1049 bp, Homo sapiens
aatgaattacaaaggcagtccaattaaagttaacactggcaactttgaaaatgtctgtacagccaaagctttcccttgggggctttgaaataacaccaccagcgctcttacagttgaagtgtgattcagggccagtgcatattagtggacagcacttagtagctgtggaggaagatgcagagtcagaagatgaagaggaggagaatgtgaaactcttaagtatatctggaaagcagttggtccctggaagtggtagcaagtttccacagaaaaaggtaaaacttgttgctgatgaagatgatgatgatgatgatgattttgatgatgaggaaactgaagaaaaagcaccagtgaagaaatctatacaagatactacagccaaaaatgcacacaagtcaaatcagaatggaaaagactcaaaaccatcatcaacaccaagataaaaaggacaagaatccttcaaaaaacaggaaaaaactcctaaaacaccaaagggacctagttctgtagaagacgttaaagcaaaaatgcaagcaagcatagaaaaaggtggttctcttcccaaagggaagccaagttcatcagttatgtgaagaattgcttctgggtgactgaccaggaggctattcaagatctctggcagtggaggaagtctctttaagaaaatagtttaaacaatttattaaaaattttccatcttatttcatttccataacagttgatatctggctgtcctttttataatgcagagtgagaactttcccttccgtgtttgataaatgttgtccaggttccattgtgaagaatgtgttgtccaacatgtctgtttagtttttaaagatggaactccaccctttcttgttttaagtatgtatggaatgttatgatatgacatagtagtagcggtggtcagacatggaaatggtggggagacagaaatatacatgtgaaataaaactcagtattttaattaaaaaaaaaatcacccaagggcttcttaaaatgtttttctgatcttatgccccacctcaaagaaagatcttgatcca

SEQ ID NO: 50124 - DNA, 1220 bp, Homo sapiens
ggtttcaccatgttggccaggctcatcttgaactcctgacctcaggtgatccgccctcctcgacctcctcccaaagtgctgggattacaggcatgagccactgtgcccagcctcagttctcatttctcctgacagccattctcatattctcagctatatcctctccagtaggaagagaaggaaatctttatcaatttatattgttctaggaatctttctgctagaaacaactgatttaatgtcatgggactgtttaggaaatacaatagtattgctatataaaaagagatgcacgttattattaattagagcttataacctttccaatgataacatatgtactaaaacatgagtggttgccttttagtatatactaggaatcaaaagacaaactttctaacttcattctaacctcattaaaaaacaaggtgatgataattttagtaggtttttttgtaagcctgatgagatgttttaagatttagaatgactcaatttggttatgtcaagtacaataatcaaatcatcttacaaattatcccaataggaaatcaatatgctttaatacttgaaagattctggtaaaagtagtaaaaacattgggggtgtgatgggggtcaggggtgatggtggtggtagaatctgaaggagaccaggaccaaatgtgttcttaatagtctgcaaaatcttaagaaaaactcaacatgcagcacatgtgttatgcccaggaatggtggatagggcttggtgtgtaggctagtcaggtgtttcctgaagccagtgccagctggaaggggaattagccagtaaatataaatagtaggaaaaagaattatccacaagatttaggaaaagtgttaaaattatagcccacacttgcataccaattttctatggcatggtggataatataaatagtgaatatttattgattattgtgtgccagacactgatctgaatgtgtagcccatgtgatccttacaaccctataaaactgtgcttcccaggatagtagctatgagtcatataggactatttatgtttaaatcaattaaaatagaataaggttatacattcagttccttagttgatcctagtcacatttaagctgttcagtcacataaggctagtggctaccatttgatcactgcagagaacatttccaaaatcacagaaagttatattaggcaatgatgttataagatgtatactattaacta

SEQ ID NO: 50125 - DNA, 1696 bp, Homo sapiens
aagttaagatactaaaaatagcatattgcttatttttaaattaccaatgcaaccaaaagatacagatatgccaaataacttacaagtgaattttgtactccagtattttttttaacttactacaaactagaaaagccgaagttgaagaaatgacactcttgccactttcatgattcagttgtgtctttgcatctacaagcatatgttattgaccactgccctggtcacgactctgagactcccctcaaaaacacagtcctcccaaatccactctgccaaattgaaaatgaattttgttttggaatgtagctaaggagatgcatgaaaacaccttgatcctgtactcttgttgcaaattatttcaaaaactgtagacccttcaagaattctaatagtacacaagtgactctcctattgtcctcagagcatctctttataccatgtagaattgactactcaattgtttctagtgttagaaaggaaaaggtgttattaacatacatctctacctgctctccccagtagaaacaaaaacttcaactctcttggctagaaacctgtgtaaaactttgctttctttttcctttctttctttttcctttttgcctaaaacttggacaatatcagaaattgagaggattccattttcttccttgtcttctaaattacaaagatgttactttccattctaagaatttgggagtgaaagatctttcatgtgtaagccatctgaagaattttaggcttctgctaaagacagtgtggtgcaatggaaagaatactgatacataaacactattcttaattcttcaagggtttgttgttttccatttttggactttctatattggttacttgcattgctttactgcctcaacaaaatagccctgtcctgtaagatcctactatgatgaatatctttgcaatgctaatggtctggtcactttctagggccttatttcaatgatcctgccttgcctttttattcagtagggtgtcacactattcaggtcctgaactttagtaagggcagtaaattagacacctaccatgctttgactattcagattttttgctttgctacacctgtgagcaactatgctggacaaccgtacctgtgtgcataactctggctcataatggccttaggttcagctagaaagtttctgtagcatccttaacttaaattattcatttccccacagcagcagccacttaccactaaatgtacaagcagtgctatggtcagtaaagcatgctattagtaatcagtcaaaatatttaacactagatagcaggtcagtcaggagtgagaaagaagtgcagtctattgattaccttttccacatctatttcactttttttcttactgaaactctcgttttgtccagggaacttcctttcccatagttcatgtgattggggaggtgaatctcatccctagttccagaggttaatcctgactaatctaagccagttagtgcaagacctttccctggcagctgttattggtctggggtggacacaagacctaaattgggtctaatcagactgaggggaagggcttggttctttggtgaggaaaagactgtcaggctggaagtaggtggcccttatttaaaaagttgagagttaccttataatcacaaggcaatcaagccttagaatgaaattgacacagtggaatgcaaatttt

SEQ ID NO: 50126 - DNA, 1065 bp, Homo sapiens
ttggtggtgccccaggcatctgacagaaacaaacagaaaatcctgtctggaaacacacattcatcctagccctcataaatctcacaagtaatttttcaaagaaaatgagctgtccacagaataactaagcacataaagaaaaaaggcatcgtgagtaattattcacagaaaataaccaaacagcatctctttcaagcaaaaacacactgaaataaaaaactcaatagatgactttaagagttaaagagatgaaagagatacagagcaaattagtgaccccgaatatatgagaaaaattatccaaaatgtagcacagagacagggaaaatatgaaaggctttaaacaacattaagggaaggaagggaggaatggaggtggtggataagagatagttgaatatccattttgtttcaagtatccatattttaacagtagctttcaatgtaggtaataaagttctaaatgctggaaggccttttagagatgaacaagcctacctttgcaccattttgcacatgacgtaacaaatagccagaaaggttacgtgacttgcagagctagaactagagtccatttcactgttctttctcccctgaaatttgtattctaatcagttactggaaggggagatggggagaccaggaccttagagaatcttgtacacatgtacacagatgttcatagcagcattgtttataacactgcacaactgagcataacccaaatacccatcaattggagagtggagaagtaaatcgtgggtagtcatatgatggaatactgtaaagcaacggaaggaatgaactacagctactagtgataacatgggcaactctaaagcctgatacatgcagagtgattccatttataaaaggttcagaagcaaaacacacaaaaaacttaaaatactccttaagaattcatacaaaggttgtaaaatttgaagacaggcaaggaaattatcttaaaaggccagggtagtattgactccaggggagaaagggcaattatgattgtggagggcccctgggcagctcctggaatgctactttttgatttgagtg

SEQ ID NO: 50127 - DNA, 1050 bp, Homo sapiens
catttgtgtaatgtaagcaacattgggaacctcgcaagggttcagtgatagttcctataaactattagcctagtttgtaactgtccactattatcaaggaggtttttgggttttttttttttgagacggagtctcgcactgtcaccccccgggctggagtgcagtgacgtgatctcagctcactgcaacctctgcctcccaggttcaagcgattctcctgcctcagcctcccaagtagctgggattacaggcgcccaccaccaagcccagctaattttttgtatttttagtagagacaaggtttcactatgttggccaggctggtctcaaactcctgacctcgtgatccacctgccccggcctcccaaaatgctgggattaacaggcgtgagccactgcacctggccaaggaggctgttttttgtacctctacagcacttaatggacactgcagttgaatgtgtggaggcttgtttactaaaagtctgacacagtctggttataaaaaacagtgtcttctgagtgctatttgaaaacctgtccactaatcaaaagtgtcatttatagtagggaatcattaaaaaaaatacataaatacatacccccttaaatagttaatatttgaattaaactcaaaatattaatacacactgagttgcccgtagtttgatgtaggattgcaggctttgagtgctgggccactggtttcagctgcatcttgcacaccctccttcataaaacataatctaccattgctactttgagtttcttttgggtggggtcagaacttaaaggcgtatgaactgatatgcttcaggagttttaatttgttttcaattttatacagtagtttaggacacccctcatctgccaagaacttttttctgtgacattcctttattggatttttcaaactgttcagcttagtttttgtggatactctttttgtcagtttatatgataattaaattactcaacacgacgataacaagtacaactgacatcaaacagatgtgtgaacaaacaattgattcttgacaagcactgaat

SEQ ID NO: 50128 - DNA, 1035 bp, Homo sapiens
cagcatcctcttcaggagtctcctctcctctattcttactcccttccagttctttatatagtagcttaagacatctctttaagatgaaaattggatctggttcttcttcaatgtgttctcattgtattttaaagaaatcctaaatgccatactatggcctatatctgattgaatctttcctaactttctaaacttatgtcattcgctccagcaaccactttatgtctgccatgttgctctcctctcagtttctgaatacttcaagctctttatggcttcatggccttcacacatgctattctcttttttctgcccagaaatctcttaccctcaactcttcttattcaagtcttcactttaatgtaatctccctagtgaggacttcccttactctcctcattttattttctctctctgcatcctatttatttcttttctagcaagtaccacattttaaagttttatatttaatttgctaaattatcttcttcactagaaagtaatacttcacaagggttgagcagaactgttattcagcaatatatatccaatgactagcacattatagattcttaaccaatattttttgaatgaggaaattaattgataaatgaatgaaaagttaaataggttaatgagcagatagtttactgaaagagaaatgcaagtggccttaattaatacatacgatgcccctaaaatagtgcctggtacatactaagccctcaacatatttagttattgctatttttatattaataatagttactattattttaaaattaataataataatatcacccaaactaatagtcaaatttaaagagtaaggagataccaatttctgctttttaaatgaactacaatgaaaaaaaataagatgatcaacattttgatgagatgggcactttttaaaggtagttaccaagtgatttgacaaaaccaatttggatgaaagcaagttagttagtataacaagtgatcagatgatgatttgttcaagaacagatactgctagatgtgggttgttgagat

SEQ ID NO: 50129 - DNA, 1035 bp, Homo sapiens; identical to SEQ ID NO: 50128

SEQ ID NO: 50130 - DNA, 1035 bp, Homo sapiens; identical to SEQ ID NO: 50128

SEQ ID NO: 50131 - DNA, 1627 bp, Homo sapiens
ctatataataatatcaaacaatccctttaagaacttattagagagctatgtctgaagtctgttctgcaatatctgttgctgaataataactctttcaaagcattaatgctgagtttatatagttcaaaaattctaatattcattcagttttaatacctaaatacttatattttactagtgatggcattctaatatattaagtcctcatttaaatacttgatactttgttaactgtggcattatatttctgaattttaaaacctttaatattggtaactattgcatattcttttaataaaacatgcagcatatttttttataaaaggaaaagaattcattgtttatatctagagagcataaagcctaagttaagtaagttattaaacaataacttcacaagatgttcaaatcgatttatcactgaaagaagatctatgaaaatgtgttttgaccaaacttagtattaggcaggtacacagataagattttccattcttaacattctcactgtaatgcacgacatttgaagcacctggatgtgctatcaatcaggtgggaaatttagcattatatattggaagcattgagaaacattggtctttcatttctatttttttttcccctcctttcctcctcctgccccacaatatattattcatctggttttaatgctacataaatatgcattgtctcatgcctgtttgtgttggatgccttgtgctaagctgtaacaaaatgttgcttcttttgctgtctgtatacagctgcttgctttaaattagtagattctgaaatagctttccttgcatgtctaaaataaaagtattgcatgtacttcgtctcatgtgaatgactttttcttttccatccctcataaaataacgttttatattttcatttttctaggcaaattttttaaattgtggttaaaaacacataacacagaattcaccatcttacgcagttttaagtgtacagttcagttgtgttagttaagtttattcacattgttgtgcagcagatctgcaggactttttcatctggcagaactgaaactctatacccattaatcaacaattccccatttctccctgtcccccagcccctggcaaccaccattcgactttctgtttctataaattttactactttagatagataatagtttttctgggtagttttgagctacaatttcagtgtgaacatgtgtaagttccattttatattatcaccacaatttattttaaaactctacctgtgcaagtctcacaagaataaaatgtgtaaataattctttgaaactaggccttttagaaaggacacatattttcaataatgcatatttgataagcagtatgattctctacaggaaatgctatataagattgcaggcagtgagcacatggggaaaagtctgaccagctccacggagtagctgtggggcatttttacatggagaagctgagaatgtaaactgtagaattcaatggaggcattatttaattgatacattcaaggctacatgaacctttaaactacttaacattacatggaaataattattttaaatttttcttgaatatttatgagatttagatgtcattctcagtgtatttaatgcttaagg

SEQ ID NO: 50132 - DNA, 2134 bp, Homo sapiens
cttggaatacttttccccaccacctattttaagctagatttttggagggatatggtggggggtggtgatgtagttggatttatttaaacacacacatatataatgacaaaggaaataatagtatggctttttttctgtaaagtcaagcacttaccagtttttctctgctccttaattttatagagccagaatgaagaatggggaggtttgtctgaggatatcttatgataaagagcagtctaaggctttagtccctttgatccccaacttatttattggtaactactaaatttaccatttttgtggcatggataaaatggagtgctatgcaaatactgttgcacgtgagatgatttctaagtccttgcttgatccgtgaagatcaaatagttaaatactgggcatttgggctttaacccttagcggttgatgcatgatggtgttgattagtgctttgagatgtgtcaacctttcttttttatactaacagcatcattttgaaatttgtggtgttgtttttcttttgagctttgtttgctgttggtattttttctcactaaagtaatctgtgaaatgcaaaataagtgaggtaccaaaagcaagcataatactcatgaatttgcttttactttgagatgatccactttatgaatagatttactggatttgcagttgtttatctgcctcatctagaaagtggtactctacggaggattagcgctgctaaaattgatttgttttagtgctgggggctgcatgatatatcttagtactatgctatatttttgtgaaagtaataatctgtgggactgcatacaaatggaaaggtaagaatcttaggagaaaagtgatttcttttaaaaaatgaagcttttgtaacttaaaattattttaataagtactttttgaagtattgaataacatatcttttaatatgaagttttggactttttaaaggtcagctcttgatataattaagaatatttgggctgagcacggtggcccaagcttgtaatcccagcactttgggaggccggggcagttggattgcttgagcccagaagttcgagaccagcctgggcaatgtggtgaaaccccatccttacaaaaagtgaaaaaaaaaaagactagctgggcatggtggtgtgtgtctgtagtccaagctaattgggaggctgaggtgagaggattgattgagccctggaggtccaggctatagtgagccatgatcatgctactatataccagcctgggtggccacagaacgaaactttgccgaaaggaaggaaggaaggagggagggagggagggaaaacagaaaaaagaaagaatatttgggcatgctagtccaacttgagaatatcttaaattgttttaaaaaaagagatgcttccaaatatgtacaagaatgtcatttaacagcaaaaagcattttgatataaatcctcttagatttgcttaaataagacaaactcgtgtaactcctttgtaattactactgttcatgttaaaaccttcaagcctcttttaaagttaacaagactatagtcttttattgccagcgtactttagtttttttataggtaaacttaatcagggtttattataacaaattctggacaaatgaagtttgattacattaatgcttgaaatggaagtgcttgaaaggaagggcagaaagcaggacaaatgttgcctttcattttacatttaataagaaacaatttggccaggcatggtggctcacgcctgtaatcccagcactttggaaggctgaggcaagcggatcacttgaggccaggagttcaagaccaacctggccaacatggtaaaaccccatctctacaaaaaatacaaaaattagctgggcgtggtggtgcacacctgtagtcccagatacctggggggctgaggcacaagaatggcttgaacccaggaagcggaggctgcagtgatccgaaatcaggccactgcactccagcctgggcgacagagtgagactctgtctcaaaaataaataaataaataaaataataatttggccagtgtccttactctctggttctcaggttgtagtcattttgctttatgtgtttttgagccttttttcttttcatacttttcaaaattttga

SEQ ID NO: 50133 - DNA, 1032 bp, Homo sapiens
aacttcttaactcttggactctgtgaggaagggaaagctgtttgagaatctcactgcatcagtcactgactgggacagttgtggggattgcttgaagttgagatgacatcatctggatagacatctactaaatgtgagacaatgcattgtacacttaatgatcttgtagttatcagaagagtggttaaggtgcctgcaaaagtgaagtattagattggcagccctggtgccatctactcttcagtagtgaaatgaacacagaccttttgccttgtgtgtacagtttgccacagtggtttaccaattgattggaaatgttattctggaggtttgtttttaatatcaggtgcgctgactataagcatatactctactgttgtaaaattggtttttaaagttagtatctccttattttgctgttcactaatcagacttttttaaaaattaggtcaaaaccaggattagaaattgggaatttttcatataggtcttcccttgatcactttcatattttgtcacagatctgtattctgctctgtcagaacctggcatttcttccaagtttttctatcattttctgattaattacattggctttaaaatgtatttaaagttattgaagttcaacttttaattttaatatttttcctggagagtaattttttgtttgtttgtttgagatggagtttcgctcttgttgcccaggctggagtgcaatgacacgatcttggctcactgcaacctctgcctcccgggctcaagcgattctcctgcctcagcctcccgagtagctgggattacaggcttgcactaccatgcctggctagttttgtacttttagtagagacagggtttcaccatgttggtcaggctggtctcgaactcctgacctcaaatgatccgtcccccttggcctcccaaagtgctgggattaaaggtgtaagccactgcacccagctgtgcctggatttttaaatgctactgggaaattgctatgggccttagaatatgacagcaatgttaagtttacct

SEQ ID NO: 50134 - DNA, 1065 bp, Homo sapiens
tttatgtcagtccctttaatgtttagttttcttaaatcagggaatcttatgtgtcatttatcagtttcctcaaattcaaagttctatttaatgagcatgggttagggaggatggagagttggaatactctattctcttttaaatagacaaacaaaaacagtaacgatgggaaagagagggagcactttgttaaagttggcattgatgccctgttttgtcttccatgacttattcccttcacaatgatgataaatgaacacatgtgaatacctcctctcaataagactgcagtagctccaccattttaaataacttactgagtgtggaagtcaggtagagtagacatgcacaaactcatgatatatatgccaagtgagtttgtatgatacagtggaaaaaggcctggagttaaggtcaaaagatcaggtttcttatcccagtactagcacttgtaggcgctgtactcttaagcctcattttttttttgtctttttttaatctgtgatcaaggatgaaagatagtacttgctgttgaaaacatcaaataagatgaaatggttttaataatgaaattaatgctgttgtgtgaatactagttattttcatactaaggagcaagaattcattgagtctcaaaacaggttgtgttattctgtatacagtattattttacattaatgctacgagcagtaactgcccattgtgttttctaaaaatcatttaagtgatcttcagtgaaaattataatctccactgaaatgttctgtgtttagcctatcttaggtttttattttctttcttttcaaaagccttaagtacatgtaaaccattttaaaatgcccttttaatcctcctcaaaggacttgctatgcctcagggttgaagttttgcttccttgggtcaagcataacatgattccatatgctagaatcctaatttgaaggagaatataagtttcccaaccttattccctcttctagggtaaataaactacacttcagttcaacagtgtagaacttggtaaatttgagaacaggcctctgtttcccttaagtgataggaact

SEQ ID NO: 50135 - DNA, 1341 bp, Homo sapiens
gaattctccattcttggttctgccatctatttgtctcttcctatgcagatactatacaatgagttttacagtaagttttaaatctggaaaggtatactatccacttaccatttttctttaatttttctttggctttattttcttacatttattcttccatatgaacttgaaaactgtttcaggcattaaaaaattctcatcttcccgctgatttgaatggattttatatattagttttagaagaattgacacttgtctttccttccagaaatatattctaattttccattatttgggtcacctttttttccccatgaatataggtaatcaaaacttgactgcccttatgttcagtgttttgtgtcttttatttgaatatctgaaggtaatattcactttacgctatatgtaattaaacaaggaaatagtgcttgtttaatcacttaatattctaaacatttccaacattttaagtgtaacattttgaatatggaaattcttcttgctctgtgactactgaaagcctctgattcaagattagttggagagaagaaaaagtattaaaagtaggttaatcaattttatataatttttattaaaaaattttttgtagagatggtgtcttactatgttgcccaggaggaacttctgggctcaagcaatcctcccaggtagctggaacatggggtgtgccactgcatccagcacaattttatataatttaacagatactcagtgtaacctttgaattggttatacaccattgtctcttatatcaatccccttttccaggttttgatttcgtcatacagcaaagcaatggcagagcaggtttgaaatttgaatcagattatcttcatattttctgagtgaatcaggattacgagtccatccagaattactcaacaatggaacttctaacatccttctctcccccaactgaggtggtatggggaagaaactcagtcctggcagacaggtggcttggtaacccaggtcccagtggcctcacatgtcccagcatattcctcctctgcctttttgcctcccttaacaaaccgatccaagtcatgtagcaggaagggagacctctcctaatttagctgaccaggctgagttcctaaccataaaaggaagaaccaaaccatttatctctttgagtgatgctttctgaggttgcttaagcaagactctggcattcccaataaggacctgaccaaattcagctgcctgaagacaagatggactccagtgccaacctttcatcaactttttcttcattatactttcactgtaatacttaactctctgcccaaggtgggtcttatctgccattttctg

SEQ ID NO: 50136 - DNA, 1029 bp, Homo sapiens
caaggaaatgaagttccctcagtcctttggcccttgtcacttgcgttaggggacatgccctagtgggtcctgctgccctacctgtggcacagcttaaaccctaccctgtgccccgagctagtataatggggattctggcttcaccttgaaggatctatgtgccaagtaagtcacttgaacgtccttgaccttcatgtcatctcagataggaagttgagtgcaacttccaaatcccctttcttggctaattctatgacacaaaatgttgcatagaacgaggaaggagtctccatttgagcagggagagtgcatgaataggatgtatcagcttttttggctgttgttttttttttcctccaaatattcttcagttattcctatgtaccagtagaagggatttctctgaactaaagtctaagtaggaggtatctttctacttgattggttttaaggatatgttgttttatatgtttatctaacatatgttgtcttttctgccagttctgaatcttctatctcctctccttattctagtgctccccccacccccgccaccacctacgctgtttttgttcaaaagccagagaaggaagtgagcatgcaaatcaggaaacagattgtctttttgcctatgcagatttgtctgtgattttgtttatttattaatattcacttagcatgtttagagtaaaatcttccttttctagtctatcagcatagggtttctccaattgttccctttcctcaaaaaaaaaaaaaaaagtaaaatttcacctgttagggaattcagactttttttttttttttttttgagacagagtcttgctctgtcgcccaggctggagtgcagtggcgcgatcttggctcgttgcaagctccgcctcccgggttcacgccattctcctgcctcagcctcccgagtagctgggactacaggcgcccgccaccacacccggctaattttttgtatttttagtagagttggggtttcaccgtgttagccaggatgatctcgatctcctgacctcg

SEQ ID NO: 50137 - DNA, 1032 bp, Homo sapiens
aaccagatcacggtgcactgcagtgtggatggtgtggtgccagacacgaatggaattaatagtactacagactaccgtgtgcttttaccaccctgcctgggtggtattctactgtttactatgaaatataaaactcattcaaagcagactaagtttttgttccattgttcttatattttatggcttccaggggccctttatgaaggaaataagtatagtagtaatactgctttggggaaaactgtgttcatgacaatctgtttttaaaacatgctgtttcacaggaaacggattttaatataaagtattgtaaggaactcatgcatgctgggaatcctaactatgccattaaaatctttaaattccaaccacctctttctgttaatggagaagaaatggtttaacagctgccttggggtagcgtaaaggtgggctatatgaggcattgctataccctttccctagcaccttggaatatctgttttcttatgttgggaatttattgggagccagaagtccttgacaagcaaacttcactatgacaaacctttcgtttgtcaagagccacatgttggctgggcacagtgggtctgtaatcccagcactttgggaagccgaggcgggcggatcacttgaggtcaggagttcaagaccagcctggccaacatggcgaaaccctgtctctactaaaaatacaaaaattagctgggcatggtggtgcattcctgtaatcccagctacttgggtggctgaggcacaagaatcttgaacctgggaggcagaggttgcagtgagccaaggtcacaccactgtgctctagcctgggtgccagagtgagactgtgtgtcaaaagaaaaaaaaagggggggggtgccgggtgcggtggctcacgcctgttattccagcgctttgggaggccgaggtgggcggatcacctgagtttgggagtttgagaccagcctgaccaacatggagaaaccctgtctctactaaaaatacaaaattagccagacgtggtggcacatgcctgta

SEQ ID NO: 50138 - DNA, 1043 bp, Homo sapiens
ccctgtctcaaaaaaaaaaaaggcttcctagtagtttctgaaaaaactgactgattgctagtgactcctgagtgagatatagtatgtctcagagagaaggaaagacctcttaaccaagctctgatgctggcattggaattatagctgactagtaggcttccatgacactgagggaattcctacgtgtatcaaccacaaattggtacattccttaaggacagccagcatcttatttatctttatctccctggctcccttacacacaggggttgtttattacccattaaagtaatgaatgcaggtagcaggggagtcaaatcttgacacatttcagagagttttctgacagagggtggtgactatgaattaatccagtgacagacaccaggattccagaggaaccttgcacttcaactcctctctgcccagctccatgagattagtgagctttgaaaagcaaatgactactctgatgccaggctctaatgtgagctgagttggggctgtatttctgacaaacaagattactgcttgtaatcaaccctaaacaatgtgacaaggaatatgaacactagaataatgacttcctttcccagaagttggcgctgatgatattcaattgtatggcacgtgtacggccaatgtctttaaagcatggagtgtaaaaatccttgcctttgagttaagcgtacctgaggtgtaacctccgcattctgcctagcggagaatatttatcttttagggcctgggaagttgcagtaagactattattttgggatttacagctagtgagctaaattctcagctacttcattatctacagaatggcagcagttaggaagaccaatttcacctggttttaggcttgtagtgggcagttcaagggcacaatagcttcaggacagtattttttaggtttttatgagctatttaaaaatacatgcaaaatcaaaataagagtcttgtttagggggtccccccaagactgcccacactttggtgatttgctgaaagtaatcagaatatagctgtactcatagcta

SEQ ID NO: 50139 - DNA, 1026 bp, Homo sapiens
tctagtaaaaaataatgccttgaaatagggtcacagcctaaagatattgatagccgcagtggatggatgactagagtgagcctttttttttttttttctctttttgagacagagttttgctcttgtcacccaggctggagtgcagtgacaccatctcggctcactgcaacctccgcctcccaggttcaaccgattctcctgcctcagcctctcgagtagccgagagtacaggcatgcgctactatgcctggctaattttttgtattttatttgatgtggggtttcaccaccttggccaggctagtctggaattcctgacttagggtgatcctcctgcctcggcctcccaaggtgctgggattatgggcgtgagctactgcacccagccgagcctaacttttatattcaagaacaattcctctttttttcttaataacctgttaattccttaagggttatgaaaactatgaattcactttttctgaagtggagattataggtttgaattgatttggacaaaagtactggtaatgattatttgccctacttataagcagtgtgttcctagaagttcccttcctgtgttctatgtgttgtcttcatctgcaaaggccttttcctataaaagggctaatgacagtgtgtgtagaattatcaaagctgattcaagggtccttagaaatgagacattttgaggaagagggagagatttgttaaaggattcaaaataattaccctgatttgatcactatacattatatgtattgaaatatcactatgtgccccataaatatgtataattattgtcaattaaaaaaagaaagaagattttttctaaactgtattatctataatcctgtatctgagtattaactgcatatccatggtcttttccagacttcatcaagattagtttttatgtagtcttttctggtggcatcactttttcctgtatctggtcttcctgtctatgatctgtgcatatagtatttaatcgcgttaaggaggcatattctgctgattcat

SEQ ID NO: 50140 - DNA, 1840 bp, Homo sapiens
ttgataccagcctggtcaacacagcaagacatttctactgaaaaatttaaaaaatcagccaggtgtgatggtacatgcctgtagtcccagctactgtagaggctgaggtgggaggattccttaagcctgggaggttgaggcaacagtgagccatgattgtgccactgcactccagcctgggtgacagagtgagatcctgtctgtaaaaaagaaaaaatgctgtcatagaaggacaatattacatagtttaaaaaattacggtatggccattgaagtccttctgatgtctttacatattagcagcttaaatatttgaatacatgaatgaatgaatggaagtattgcttcagaagcaggtttaagaagtggaaagaagatactcagtaatttgtggttttatttggcaaatcaatattgagtaacatggtcattttttcagctctttcattatttgttggtcctgtgtctgctttttatttctcattatccttttccttaccaaatatatttcgtgatcattcgaaaaacttgtgagaacactcgacttactcttgttcagttggaaatacttcaaactttttgtaactgccatgatttaaaattgccaaggagattgatttctactggaaagagttccatgaaataagtaggacatttccaagggacattgatctaatgctgattgtaactcacaggaaggggttccaggtggattttaagagcactttacagctttgaaacacttgtacacttccacacttatagaattttccctgactctgccttatatcacctacaaactgaggactggactattgggactgtatttctccctgatgtttctcagctctaaaattctagggccttatttacattggagaacaaatgggaaatctaatagaattccttaaaagcttcccgccagtcttgagcatttatcattccatgtgtctttgctgtcttgtatatattcttcttgtttttattatggattctttgactttgctatgcaccaatatagaatatgtattaactcactggttggagtaaagacaggcattttatttttagttataagattttacacaaaaatattctgattttggcaatgcattttaatcaagattttagaaaattgccagtgtttttacacatatgttctgttttcctgggaggaagtaggcgtttgtgcttaatcataacaagaactatctttttttaaacatcttttaaaaaatatttcagatctacagaaaagtggcaagaatagtgcaatgaacaccagtctgcctttcgactagattcactaattgcgaacatctccacatttgctttctctttctctggacagatactttcctccacccctgagtcatttgagaatcaattacaaacatccagatgcttcccccctgagcacctcagcatctgtctcctaaggacaaagacattctcctatgtaaccacaatgccattatcatagcccacgtcaaatctctccaattgttgaatagcatcttaaatcatcttttctctcaaattaccactagtgagctaaaatcaaatggggtgtttattatgttttgcatctggtttttttgtttatttttttgaagccacttcactgtgtcactcaggttggagtgcagtggcgtgaacacagctcactgcagcctcaacctccatgggctcaggtgatcctcctacctcagcctcccgagtagctgggactacaggcatgtgccaccatgcccggatacatatatatatattttgtgtatttcttgtagaaaaatacaacatgggttttgccatgttgcccaggatggtctccaactcc

SEQ ID NO: 50141 - DNA, 1043 bp, Homo sapiens
cactactgggtatatatccaaaagatatgaaattattgtgttcaagaggtatctgcactcatgtttgttgcagcattattcatagtagccaagatacagaatcaacctaagtgttcactgatagatgaatagataaagaaaatggaaaatgtggggtgtgtgggagaaatggggagatgttggtcaaagggcacaaacttgcagttataagatgagtaagttctggagatctaatgtacagcatggggaccatagttaataatactgtaatcccagcacttcgggaggctgaaatttgcttagagagtggatcttcattgctctcatcacacacacacaacagtaactacgtgaagtgatgaatatgttagcttgctcgtggtaatcattccacagtgtatacagagatgaaaacatcttgttgtacaccttgaatatatacaattttttttttttgtcattctgtgactcctacaccttcttactccctttgtgaccttgggtggactcagcatggtgaccaaagactttcatgatctgaagtgggtgtgccctcttcattcctcatacttgacattccaccccaaacatggtgtacacattctttaaacagccttgcatttgggcatgatgtgtttgcttgggctgttttctctctttctgaatgcccactgctgcccctttcctgcatgctcccctcaaggttctttctacagagcccagttgaaatgctacttttttgatgaatccttcccctgacctggtcccaaacttactgacttagaatctcagaggtctggaaatttgtgtctctcatggcatcttgtatagtgccttgcccataataagtactttatatatgttggagttgaaatagataatgtatattaactctgcgaggggctaattgatacctagaatgaacataggctaaaatgagaagctagcatgagctagatatcagaactgaacaaaacacacaccacaaataataaaaactcaaaccatagactaacgttggttgggaatgaagatatgaaaaa

SEQ ID NO: 50142 - DNA, 1064 bp, Homo sapiens
gggttgagctgcagtgagctgtgatcacgccgctgcattccagcctgggtgacagagcgagaccctgtctcaaaacaaaaccaaacaaaacaactttgtagcatgctccagacactgttcccaccttgctttatatactgatcattccacatcaatgtgcagggatgtcttcggtgtgcttgctctgctgtatgctatatggctgcatccttatttatttaaccagtctcatatttagtttgtgtccattattttgctgctttaatttatgctgcaaattagtatccatgtacatatatccttgcacccacgcgcgaacacatctgcagggatagattcctagaaggggagttgctaagtcagaggatgtgtgcattttacattttgatggctcctatacacataagtgagatgagaacaataaaagctaattgctattgaacgtctttatggcctgcaatgtttgttggagaaaaatagccttaagagctagcacttgtatcgatgtgagaagtcttattaaaaaaaaaaaaaaaaagactaaggagatagaatcataaggcagcaagcaccatgaagcctgcagagttacttaagcttgagcaaataacagttactttgtggggactggtcattctggctgttctagctaggaaagtaaacagtttggaaaccaggagccttctatagggaatatttactcctaagatctcttcataggtcatcatgaccctcctttggcatgcatgattagtgctatggctgttgatgaaatcaatagagacactggcatccagaacagttccaagagaaagtgtctgttatacacataaaaagagaaacagatttttccctaagggttaaggtagactctttctgcgtctcagagtgcccaggagagaatgagtaaaatttattttattgtgtcatttctctgcttaatccacaaggtgaaattgaaggctctgggactttgcagaatacttagggttctatagcaactctggttttttgccctgcttcaaagtagtctcagctgccttctagatggtacataaccaaga

SEQ ID NO: 50143 - DNA, 1030 bp, Homo sapiens
aaaaaagaggatttctgtaaccctgttaaatatcaatcaggttacaaaaaaattaagccagctcagccatattggacacttctcacctatggaacatgttccgtctcttcagcctcctaacattctagctagctagcatgactgcacccataactataccgaatgagatttagcatattgtttcagggggacaaaattaaattccttttgtcactttttttttttttgagacagagtcttgctctgttgccaggctggagtgcaatggcgtgatctcggctcactgcaacctctgcctcctgggttgaggtgattctcctgcctcagcatcccgagtaactgggactacaggcgcgccccaccacgcccagctaatttttgtatttttagtagagatggagtttcaccatgttggccaggatggtcttgatttcctgacctcgtgatctgcccgccttggcctcccgaagcgctgggattacaggcgtgagccaaagataaactttttaagacatttcctattgaactattaaggaaattcaagatatgacaaagagtagcagacacaaaggcctacatacagaaaatgactcacttctacatagatttctcctcttccaatttttagatgagaagtttgttgttttttttgagacagtctcgctctgtcgcccgggctggagtgcagtggtgcaatctcagctcactgcaacctccgcctcccaggttcaagcaattctcctgcctcagcctcctgggtagctgggactacaggcacgtgccactacgcccagctgatttttgtatttttagtagagacggggtttcacgatgttggccaggctggtctcgatctcttgacctcatgatccgcctgcgtcggcctcccaaagtgctgggattacaggcgtgagccactgtgcccagccgagaacaaggttcttgtacacatgtgccccagcgttttctttctttcctgaagtgttatataaaacaggcaaaacgtactttgttgctttttttgaaagcc

SEQ ID NO: 50144 - DNA, 1054 bp, Homo sapiens
atggtttcaaaatggaggccctgaaggttattgcaactgggctttgacatttatcaaaaatagtaaatggagcccagtaggtttttatgaatgtttcactgagaatggtttgaggtcctggaaaatagtatatagtaatttctcactgatttcaactctggtatttgtgatggtttggggatggggagtgagtataattgctattcagttggcagtacttaacatttcctaacagtatagaaaaaattttaaatgctttttaagtttcctgcccagaaaaggagtgctttctcaatcttgatgttagcagagcccactatctccctcccatgcctgattgaagcatcacgcatctccttggccctttgaaagcttatgtggtggtatctgcccatcctcattcttcccgtctgagtccttcagtgctcacttcgtcatttttctatgaagcattgccggatttagcaatggttccctgtccttgctctgaatccaacatttgtctcctcccattatttggccgatagtcactcatcactctgtcatttacgattttagttctaatgccagtactcatttttggcacacttgtactttgtccatgagttttatttattcattttttctgtgaacctatggagtatattgaatgtccacaagttttcaaaggtaaagaaggtccttgagagcaagccctgcacacagaagatgttcactaagcccaccttgtaagaatgctccagacccttttattttgatgacggctttactgagatataatttacataccacacagttcacttctttaaagtgtacagttcagtggggagggagtgttcttgggttttgggggttttttttctttttttgttcttgaagtcagtggtttttagtatattcatagacttgtaaaactatcaccacaaatcaattctagaacattattcatcccctccaaaagaaactatagctatcacctcccaattctcttcttcctccagcccttggcaactactgtgctactttctggcactataagattgggctattctag

SEQ ID NO: 50145 - DNA, 1767 bp, Homo sapiens
cttttcctctgcacctcacatggaggctgcagccacatactcttctgtttgcttatattttctctcttgtgtttacctcaaacttatatagttgaatagttttgtttgtaatgaaattattttaaataagatgttagcatttaaattcaatctcttgaccgggcacagtggctcacacctgtagtcccagcactttgggaggccaaggcaggcggatcacttgaggccaggagttcaagaccagcctggccaatatggtgagacccccgtctctactaaaaatacaaaaaaaatgagccaggcatggtggcttgcacctgtaatcccagctcaggaggctgaggcaggagaatcgcttgagccctggaggcggaggctgcagtgagccgagatcgcaccagcctgggtgacagactgagacactgtctcgagggaaaaaaaaaaaaatcagtctcttatagcccttgttcttttttttttctctccttctctcttagactgtttgtctgtgggatataaacgcaggaccaaaagaaggcaaaattgtggatgctaaagccatctttactggccactcagctgttgtagaggatgtggcctggcacctgctgcacgagtcattgtttggatctgttgctgatgatcagaaacttatgatgtaaggtggaaaattcagtgggatcttgttaaatgggtgacctgaatgaccatcagtgattgctgcaggctgtagtttgattttttttttttaagttatggctttaaaaaacagctttaggtagcttactcctgtaatctcaataccttgggaagctgaggcaggaggattgcttgagaccaggagtgtgagactctacacaaaatttaaaaacaaaaaattagttgggtatggtggtgtgcacctgtagtcctagctactcaggaggctgaagtgggaggatcacttattatttagaaaaaaagaaaactaggtatggacatgtgaaggaacatacttggtgtggtggtaaatatcaaaattgagatccagagtgatgccagttggaggtcgaggaggaaaatgatttcatcaaggtgtggccacagggcttcattcacttataatcttataaagaaatacctgaggcaaatgtgacaaaatactgggcatttgtcaaaactagttttaggtatcagattgtgacattattctctacatagtctgtattttgtgtacacttgaaatagttggtaattaaaataggaatctaatttaaaaaacaggactaacagccctagcttgttctctgtaggtttcgaatgtatcatttagtggtcgaggtctgaatcaccagctgtgtggttggtttcttcatgaaggggagcacatagtggagctagttgtggagtgcagtgacagtgatgtgaggccgaatgtgagtgtgtcatccctgggtgccgtgtgcctttacctttgtgttttagatgggacaccaggtccaataccacctccaagccgagtcacttggtggatgcgcacactgccgaagtcaactgcctctcattcaatccctacagcgaatttattctagccaccggctctgcggataaggtttcgaagtttttgcattatttggtgtttataaaacccagttctcttgtgccttaatcagatatttgaaaattcttaggtaaagcatagaaatcattttcacttgttatttttctttagaccgtagctttatgggatctgcgtaacttaaaattaaaactccataccttcgaatc

SEQ ID NO: 50146 - DNA, 1311 bp, Homo sapiens
aatgttcttgtttgctgtatttgcttagatgttctctacttgtattctttctgctaacatgttgctacttcttggaagttaccgtactttttatatgactttgttactttacaaggcctttttcatgattatttaatactatagtcttattcacacaccagatgggcggagaggttaaccttggcactgcactagcagttaaaccaagtatgctggcagggccaatgtatgtgtgtttagggacaggtaggggttagcgtgggtttctgattgatttgaggatgcttctgacttcagactcaaagggtgttcatactgtggagggttaaaacctttcctgttttgatgaatcctaaaataagatgctaattcagtgcagtacttacagtgagttgtatttgaactaaaaagctattggtctgcttattatatggttacttgaaatttcagtgaataactatatcatcttcataactgaaagaggacagttgttttagatccaaggtggaactgaattaagttgcataaggcagctaccaatattttccagtgcaaatgggctttaagaataaattgatgtggcaaatgaacccacatttttgggttttctctatgcatgtttctgtctttgtcttgtcagtttgtgttgtattctgccaggtcaaaatctgttaggttgattgaactaagtgatttgtgaattttaatcctgagtgtgtgtgtgtgtgtttctttctcctcacattagaatttggtggctttggttctgtaacaggaaaaattgaatgtgaaattaaaatcaatcacgaaggagaagtaaaccgtgctcgttacatgccgcagaatcctcacatcattgctacaaaaacaccatcttctgatgtgttggtttttgactatacaaaacaccctgctaaaccaggtatgtaataatagagttaggtcattacttgagcagttttcttgattcaaactggtaatgtttttaaggtcaaagtagcatactttataatatttaaaggtttaaaaattgctttgggggtcccataaccatcctcaagttcagggatttgccagaactacctaaaagcagcttatactaacagctaaagtttattacagcaaagaatccagagcaagagtaggaagaaaaagatacacatcaggggaagtccagaggggttagctacaggcgtctgagtccttcccatccagggccacgtgggacatgttttgtctctagcagcaaaccataggaacatgtgctaaatgtctctacccagggcagcccatttgagtttcagaatctgg

SEQ ID NO: 50147 - DNA, 1030 bp, Homo sapiens
tgactacctacatttgagggaatgaaataagatcatgcatgttaaagtgcctggtgcagcataagtacacggtaagtggtgactgatgctgattctcccaccccttcctgttcagaaataatttgtcaggattgaaatagctctgtttcttcatttggatttcaatgaaagctacttgctgaagttttttttaaaaaaatgttacctataatatgtaatacttaggaatgtaacaaaatgctttaattaaattatttaatgtgtatcatggtgttctttgtatacaaagctgttgtgggattgggttgtgggatgtgcagtggcttagagaatgtaagaaaatgccaagcagcctgcattcttggatgttgaggattgttgtgtggtgctttgcagggttcagtttggggtataaagggactgtgttttatcaccatacagaacagtaaaaatgttgactattctcaatgcctgactctgaggaacaagatcctactccacctcataggcctttcttctgctgacttacaacatgcttcataacgattacttggactttcttagctattgtccttcaattgagttaggtaattgtccaaataattgatttggctggctggcttgctttcttgctttcttgctttctttctttcttttttttttttttttttttttttttttttttttgagacagtctcgctctgtctcccaggctggagtgcagtggcaccatcttggctcactgcagcctccacctcccgggttcaagcgattctcctgcctcagcctcctgagtagctgggattacaggtttgtgccaccacacccagctaattgttgtatttttggtaaagacagggtttcactatgttggtcaggctggtctcaaactcctgacctcgtgatccgcccgcctcggcctcccagagtgctgggattacaggtgttgatttggcttttaaaaggttttatttaagtatctctaagaaatttgttttaattagatagttatttcatatctcttgttgaa

SEQ ID NO: 50148 - DNA, 1042 bp, Homo sapiens
cagctggtccctgcattagactgcctttctcattcacttgcaccttttctagtaggaacttgaccatgtacttttaaagtgtattaaatatggggtcaggcacagtggtttatactcctgtaatcctagtgctttggaaggttagcttgagctcaggagttcaaggctgcagtgagccatgattgcgccactgcattctagcttagccaacagagtgagaccgtgtctctcaaagaaacaaaaaacaagcatcttaaatttgggtgttgcggacatataatttaaagaggattaaatgaaactctaacctaaaaagaggattttgcaacaagttataaaaataataagctaattttggctgggtgcggtggctcacgcctgtaatcgtagcacttcgggaggccgaggcaggcggattgcctgagctcaggagttcaaaaccagcccaggcaacaaggtgaaatcccatctctactaaaataccaaaaaaaaaaaaaaaccgggcgtggcagcgtgtacctgtagtcctagctacaggctacagggaggcagaggcaggagaattgcttgaacctgggaggcggaggttgcagtgagccaacatcgcaccactgcactccagcctgggcgagagcgagactccatctcttaaaaataaaaataattattataataataatctaatgtatataaaactgctcttacagtggccgggttctccatatgcaaacattgatttctatacagataggaatttccactaggcttcccaaaaatctaaatataaatgtacagatgtgggaagagtagagaagaactaaatgatggagacttggaagcattgacgtttacagccacaacagattgaaaaatagattaagcatcatatactcgggtattcaagttctggtttggagcatcgtgtgcatttgcctctttggtctgttaagcagatttaaaatgtattaactaaatttaccttttgggggatctttttgacccactgtaacataatagaaaacagcaggggctttaaacttag

SEQ ID NO: 50149 - DNA, 1076 bp, Homo sapiens
caaagattcaaatgcaagtatagtagtacctccttatctgagggggatacgttccaagattcccccactggatgcctgaaactgcagatagtgccaaaccctatataatttatgttatttttggattggatccctgagccagctaagagactcacaggtggggagcatctacagcgtggagactctggacaaagagaagattcatgtcctcaacaggacagagaagacagcacaagattttatcacactcagaacagcacgcaatgtaaaactcatgaattgtttatttctggaacttttcatttaaagtttttggactgtggttgacctcaggtaactgaaaccaagctctgaaagcaaaactgtggataagggggagctgctgttgtttatttggaaggtggtcttgggagatgctggttggaaagtggagaaggagagagaaggaagctgctacttcatgtgtaataggcaagttcccactatggactcctgcggagcaattcctttggggactctggaggatggctgaattcactccagagttatcctcctagagggatgaggaagctgggctatttctccatcaaatctcacatctgtcattgtttgagggctgcttccagggacattaactctacagcatttccatcttgccctgagcaccagccaagtgcatcctcgaagagagttatggatgtttttcagttggcagcctgaatgtagagggaggaggatatgcaagggtgccaataggatttgctacaggagctcacaagcacagggagggcattctgctccaccctaggaagattcttcagtccctaagttcagtgtggggagagtagaacagtgtggggagagtgaaaaacactgaggttcgatcaaaatgcattgctgctctcatgcagggtattgaggtgcaagtgtcaagggcccggatttatttatttatttatttatttatttatttatttatttatttatttatttttgagacagagtttctctctgtggtccaggctggagtgcagtggtgcgatctcagctcacggcaacctctgcctcctgggttc

SEQ ID NO: 50150 - DNA, 1029 bp, Homo sapiens
aaggtacatcttacatggtgtcaggcaagacagtgtctgcaggggaactgccctttataaaaccattagatctaatgagacttattcactatcatgagaatagcatggaaaaacctgccccattgattcaattacctcccactgggtccctcccaggacatatggggattatgggagctacaatttaagatgagatttgggtgaggacacagtcaaaccatatcggggcagaagattatttccgttgtgagcacttcaagatttagaaattcaagcagttcctgaaaaggagaatgagagacgctgtgcagactctgatatttattgatttgtttcataggctcttatatgacacatgtggcaccactgtcttatgcactttatacatattaattcagttactcttaataacaatcctacaggcagttactatgaatagcaccatttacaaatgagagtaccaaggagcagagaggttaggccacttgctcaaagtcacacagcttcatagttggcagagttggaacttgaatccagatgtctggctccataatgcttgcatttcaacactaaagtcaagggaaaatggtaagatttcgagatcgtatgtcttgagcattcccagaacaggcagatcaagactatttattctacggtttcaagatctgtccagaccattaaccacaatggcattaaaatggtctggacagacctggaacccctgtagtattcttgattggtaacatggaattattctgcctgttcaggaaatgctcaagacatctgattttgaaatctcatcaactcctctttactctagtggctttgaaattaaaatatttagggagaaaacttccaactctcccaacagcctgagtaggcgctgacatgtaaataaatggtcttgtaagaagtggtgtgggtgcttggacctgtgagagaaagataaggaagttttagttttgatcatcagtacccacaatgaaggatatgagacccagtgattgcaatttagtagggcatggagtg

SEQ ID NO: 50151 - DNA, 1040 bp, Homo sapiens
tccctggagccacaatgtcatcctaacacactcacacaaagaaattgaaaaggacacaaaaaatggaaatacactccatgttcatggattggaagaatgaatatcgtcaaaacaatcatactgcccaaaatgatctacagattcaatgtaatctctatcaaaatactgaggtcgtttttcacagaaatagaaaaaacatcttaaaatttgtatagaaccacaaaagaccctgattacccaaagcaaccctgagcaaaaagaagaaagctggaggcatcacactgcctgacttcaaaatatactacaaagctatagtaaccaaaacatcatggtataaaaacagatatagacccatggaacagtatagagagtccagaaataaatcccccatatacagccaactgattttcaataaaggcaccaagaacatatgttggggaaaggacagtctcttcaataagtagtgctgggaaaactggatattcatatacagaagaatgaaactaggaccctatctctaaccatatacaaaaatcaattcaaaatagactaaagacttaaatgtaagtcccaaaactataaaactactagaagaaaacataggggaaatgcttcaggacattggtctgggcaaagatttttatggctaagactttaaaagcacaggcagcaaaagcaaaaataggcaaataggattatatcaaactaaaaagtttctgtacagcaaagaaaacaacagagtgaagagacaactccttgaatgggagaaaatatttgcaagatattcatctgacaaggaattaatatccagaatatgcaaggagctaaaacaattcaacagtggaaaaacaaataatgcaattaaaaaatgggcaaatgatctgaatagatatttctcaaaagaagacatacaaatggccaagaagtatatgaaaaaatgctcagtatcactaatttttatggaaatgtaaatcaaaatcacaatgagatactatgtcaccccagttagaatggctactatcaaagacaaaaaataacaa

SEQ ID NO: 50152 - DNA, 1062 bp, Homo sapiens
cccttcttcataaagcttgtctcctctacttcagtgacatctctcatatccatccccttttttccatttccttgttactaccctgcttcagactgtactaaccccttctctggtttagtaaagcaggcttctaactggagtcctctttccagtttctcccctctggtgtagctgtccagtgagtccctttgaaataaaggtatgatactgtgacatgcttgcaaaaagtatacatggagaagcagtggcatggagagcacaggtgttggagtttgtcagacctgggttccaatcctggccttgtaatctctgctgaaagagtataaagtctgaccggcctacattttaattcagttcctgctgttaactagctatgtgcccatagacaaagtactgagcctctctagttctcagtttccttatctgcaaagtggatacctctttggttgtgaaattgaaagaaagtatatgtaaattcttagcctgcattatgcctggcatgaagtaggagcaataaaaggtagctgttagaactagggggaagaggaagagtgaggtttcatgttttcatgtgatattatcctttttttttccttcttcaggagaggtaggaggtcatccaaaatggtaggaaatttggaagatggctaggaagggaagggccacctgtgtgggaagaggggtgtctgtgtattgataggttttctgtttctaagagtaatttggggaaaaatacgagttggagatgttgagagtacaatttcctgatttctttttttttggacacagagtctcagtctgtcacccaggttggagtgtagtgacaccatctcggctcgctgcaacctccgcctcctgggttcaagtgattctcttgtgtcagcctcccgaatagctgggattgcaggtacctgccaccacgcctggctaatttttgtatttttagtagaggtggagtttcaccttgttgaccaggctggtctcaaactcctggcctcaagtgatccttccaccttggcctcccaaagtgctgggattacaggcctgagccaccatgccagg

SEQ ID NO: 50153 - DNA, 1034 bp, Homo sapiens
tataagctaagaatttttttaatattcttaattggttgtagaaaaataagcaaacaaagaaacaaaaaagggctgggcgcagtggctcacacctgtaatcccagcactctgggaggctgaggcaggtggatcacgaggtcaggagattgagaccatcctggctaacgtggtgaaaccccgtctctaccacaaaatacaaaaaattagctgggcgtagttgggcgtagtggcgggcgcctgtagtcccagctactcgggatgctgaggcaggagaatggcatgaacccgggaggcggagcttgcagtgagctgagatcgcgccactgcactccagcctgggtgacagagcaagactccgtctcaaaaaaaaaaaaacccaaacaaaaaagaatgtacgacagagaccttatgtggccttcaaagcgtgagatatttagtttctggcccttcctggaaaaagatagctaacccttgttctatagctcaggaccagagaaagcagatgatagtgtgactcagagatggggactgacattctggacatgatcaaagatcaaagggtgataaaagaaggtatactagttaggggtttttggtggaggtggacagttgggtgcaggttgagtagagagtaaagcaaagccagaagaaagctaatggattgcatgaaaatggaatatgggcttgtggatagatgtcataatgagaatgtaaagcctgatcagttggtttgaagcaaagataacaggtaaggaagttggaattggagaaaggggacatggttggttgtcttggagatacaagagtttcagaaattgccaactacagccattttaggaaatagctgaactctccagtgataaggtcaggatgatgaagcatccaagagtacgatggtcagattccttaagatgaagacaggaagactatgtatgcagaaataatgtgtgttaggttactggactttttcaaaaaagtggaagtgagcctggagtatgaagtagatgatggcaatgaggtaaaaagaggctggt

SEQ ID NO: 50154 - DNA, 1023 bp, Homo sapiens
atgtattgccttctctgtggttcctgtcctgtggaaacgtgtctgtcacttctctgtggcactgcagcaatgaagtgggcactatggagtttgtctccctgagccatggatgcctgctccgagggcccgttgtcaccctcaaagctctcccactgcagtggcacaggcgccacgtgcgggtgacagctgcccctcatgggcacttagcgcacactaggtatgcctcaggggcttctgtgtctccacgtggtgaaggcttccgggcagctctttataggatgcctgactgtgtccccactgtgcagatgagactgaggcccagaatcagtgttcatggcagggccagacggcctcgggtgtgtccttggcaccgctggcattgagtggggattagcactccggcagtctgacccccaagcccgtgctcgccctgttcggcctcctccttatgggttctagctttgggggtgggactgcctctcggggggcagggcagagtgcaacatggaatgaagtgatcaacccaaagtatgcgagtcatctcacatgaggaaacagacaaggtggactggaggaaccgtgttcctctctggcgagtggtgttctggcatttgtgcctaggtcgcagggccgcccttcgagatggcgcactttccctggggcacctgctgcgtggcttctgaggccccaagctgtctgtcttgcagaggtccagcaccccatcctcgcccactggcacgtcatcctcagactcgggaggacatcacatcggctggggtgagcggcagggccagtggctgcgcaggagaaggctggatggggccatcaacagggtccccgtgggattctaccagagggtgtggaagatcctccagaaggtaagccgagacgcgagctcctggggaagtgaaccgtccccttactgtcctggcaaggcatggtggcacctccaggcgagcaaacacacagccctgaggatggcttctctgcctcagcgctgttggcacctggggccgaggcatt

SEQ ID NO: 50155 - DNA, 1050 bp, Homo sapiens
tgattgtttgagacaagagtatcactctgtcgcccaggccagagtgcagtggctcgatctcagctcactgcaacctccgcctcctgggttcaagcgagcctcctgggttcaagcgattctcctgcctcagcctcccaagtagcggggattacaggcacccaccatcacatccggctaatttttgtatttttagtagagacagggtttcaccgtgttggccaggctggtcttgaacttctgacctcaggcaatctgccctcttgggcctcccaaagtgctgggattacaggcgtgagccaccgtgcccggctcattctgatttttgatacttcaaatatgagctgtttttctctttgaaagtgtttaggatcttctctgctcccggcttctgacatctcagtgctgcaccttaatctctatctgggtgtgttttcatccattgtgttggatacacactgggcctttccaatctggaaatttgtttttcagtcctgtaaagttttcctaaaaagtttcttgactcatttcctgcccaacattttctctgttctttctttctggtgttcctatgattccaaagttgacttcctagagaagactttatcatttttttccctctgttttccatttttctgtcttgtcctgaaagccattgtctcaactttttgttccatcccctcaatttagccacttttgctatcatgttttaaatctttgttccccaaattgtgtctgtttttgtttcacgtttacaatataatttcttggccagacgcagtggctgatgcctataatcccagcacattgggaggccaagacaggcggattccttgaacccaagaattctggaccagcctgggcaacgtagcaagacactgtctgtacaaaaaaaaaaaaaaaaaagattagccaggcgtggtggtgcatgtctgtgatcccaggtacttgggaggctgaggtgggaggatcgcatgagtccgggaggttgaggctgcagtgagccatgatcatgccactgcactccagcctgggtgacagagcgagaccctg

SEQ ID NO: 50156 - DNA, 1051 bp, Homo sapiens
gttttagagtaagcaggaaggtaacacttctctaatccagtcgcccgtgtgaaacttggctcatctctgaaacagcactcggctgatatcttttaagctttacaggcaccaggaggcctcggacatagggaggtgaaccatcaagtccctctgaaacatctgttcttcttggaacgcatgtatggaattctgtgtatatttctgttaaaaggtgtggaagaaaatactctgcctgggatcctgcaggtgcccaataaatgctccttgcaccaacttgaatatgctatcaccttaagattcatttgcaggacttggcaaattccttagagccctcacagcagagcacctgaatgagtctgtgtaggtcactggcccctcaccttctgtggaatgagcccccttctggtttacaggccccaagtagggaagacgtacccaggtattatgcttaagcaccttgagtgatagagggcttgccctccaggaataccccttccatttttgtgccctctactgtcacaaggcagaggtcttctctgtagtgtctattctctcatcttcttccatcccctaggatataccagaagggccccaagagaatgctgtggaccaggcacggtggctcacactataatcccagcactttgggaggctgaggcaggcagatcacctgaggtcagaagtttgagaccagcctggcaaaaccctgtctctattgaaaatacaaaaattagccaggcatggtggtgcacgcctgtagtcccagccatttgggaggctgaggcaggagaatcgcttgaacttaggaggtagaggctgcagtgagccaagatcataccactgcactccagcctgggtaacagaatgagactccgtctcaaaaaaaaaaaaaaaaaaaaggagaatctcactgtgtagctcagccctggtgtagcctttccagggctcagggaggcttctgtttggtccctgatggaattccagttgctaaaacttttggagttgaagcccaccctttcttctcacatcctctcaccccagggacactcct

SEQ ID NO: 50157 - DNA, 1038 bp, Homo sapiens
caaggaaaacaactgacaatatttgttgccagtgataaaatttaaactttgaattgaaatgagattttggggaaacttttttttttttttttaaatatacagagtttctctcttgttgcccaggctggagtgcaatggcacaatctcggctcactgcaacctctgcccccgggttcaagcaattctgcctcagcctcccaagtagctggaattacaggcgtgcaccaccacgccccgctaattttttgtatttttagtagagacagggttttaccatgttggtcagactggtctcgaactcctgacctcaggtgatccacccaccttggcctcccaaagtgctgggattacaggcgtgagccattgcccggcattttggggaaacatgtatgagcttgtgagtcactgtgagcttgacttaaagctcctaatacttgacttaaagcttcctgatacttaaaaaacttttctgatgagattggtggtgatattaacaaatgtggataatgaaatatgtcaacatttgggctaactgcataactcactaaactgatgtattccaaatgaccaatgcttgatgttataaaatcacacatgggcaaatgattcattcaaagctcaagatagaccaatggattttaaaacgtcagagtacataaagctcattgttatgatttcagattccacatttcaactggcgtttaagaaaccgtccacttgttgagttttgattgtatcaaataatattcttaattatccaaaaagacttaaaatagttctccctgcatatctgtgtgaagctggattttcttcatatacttcaactgaaataacgttgccacaaagtgaatacagaagcatatatgagaatatagctatcttctattaagccggacattaaagagattttttaaaatgttaatcactgccattcttcttgttacttttttgttttgaaaaaaaatttttttaattttttgtagagacaaggtctcgctattttgccaaggctggtctcaaactcctggcctcaagtga

SEQ ID NO: 50158 - DNA, 1044 bp, Homo sapiens
ccatccaacttggggaagaatgtggtggaagtaaatactcatagtagtaccacaatcataggtgtaagacaaccatctcacatttgaagtcttaatatctaccacggtgtcaaatagcagggagaaaaatgaacacttcagaaacacccagacatgatcttgcataactttggtgcaggtagtttatttgggaggtgatcccaggaatcaggagtgaaggagcaggcattaggaaaagagagaagggagaaggcattaagaaaagaggaaaagtcattaacaggtatgttattgaggtcaccactgtaggcaatgggggctcacaatggctgactttttaatgctgtttttgatatgtatttgggtggacattttagcatacatttgtaagacctgttaaggcatctatctgctgtgatcggcagctataactactcctccaaactttgaaatctgagtcatagtcatccaagaagtattcttgagtctttgctctgttgactctgcattagtcattttgccttgttactttcagatccattccccatccttcccttactctgtatcacagggacctgaccccttgcaatatctttcatgtctccttgccaactggcttccagctaggttcggccagtgggtgtcagtgacaggagattggagtgcaagaggaaaggggaagtcagggtatttctccccctctctcggtttggctggcatctctaatgggggctgtgcctcttccatgattccagtctcactggacagaccccttccaacatcccgtggcctgaactcctgccttgtggctctgttcatcggtatctggtaatattacctcccccctttgctcttccagaatcttcctgctgttgctcacctctggattgctccagttcttcatctttgcaacatttccctgtgttacattcctgctcttgaactacctgtcatgggttcccaactgatctctgactgacggagatttcttaaggatttcattagtcattgcaaaaatattttaggacatcaaccacaaacaag

SEQ ID NO: 50159 - DNA, 1082 bp, Homo sapiens
cccaactacttgggaggctgaagtgggaggatcgcttgaacctgggaggtcgaggccacagtgagctatcattgcaccactgcactcgagcctgggcaacagtgagaccctgtctctagaaaaataaaatagtaatatatttttagaagcacttatactggctttcttgatattcctcaactattactggatcctgtggctttccagataaaactcagactcttttactaagtgttcaagtccctccctatataatcctgccccctcccttcctctttctcttcagccctcagtgccagtcaggctgtcctcttactcgcccctgagctgtccctgcgggagctcctgtctaccctttcatttccatccttgttccttttgggatttccttcttccgattatccaagtcctagcttttgcaaagtcatctttaaccactccttcattccttccgctgagtgtctgtaggctaccaattgcctgtatcatgcacagaagaacatcctaagaatgcccatacatgacttgtatgtttgtagctgtaggagctatggaacagttacccactcctgaacaaatgcctgttgattattacataaaatgtgttgtttacttaactagtaaatgttcctcccaaatcaagaagttctctaaagccaccgtggaatagacctgccattggggaagtctttggaaactcatgtggctaagctttctgtatatgtgcagcctcctgcaggtggctgtgggttagacaagactcttgagtctgccctggctcccatttctgtgcctgaatccaaaggccgactcctgctgtctgccactatcctctctgcatgactttggactcatgtctcctctgaagtacacttagcctttctatgcagttggatgtgatttgctggctttcatattctcctaccctcttatgagaagcctccagtggcttcctgtctcacgcagagtcaaagctgacatcccgagggtggcctagaagtcctgcatgatttgcccatgagctctccaacctcctcttctactcccatcccgctcactccactgtagccatatttgcctct

SEQ ID NO: 50160 - DNA, 1073 bp, Homo sapiens
acctcagctagtctctgtctagttttgttgctgttgctggctgattaatatttatttatttatttatttatttatttattgatttttgagatggagtttcgctcttgtcgcccaggctgcagtacaatggcatgatctcagctcactgcaatctctgcctcccgggttcgagcagttctcctgcttcagcctcccgagtagctgggactacaggcacctgacaccacgcctggctaatttttgtatttttagtagatattggctttcgctatgttggccgggctggtctcgaactcctgacctcatgagggtgatccacccgcctcagcctcccaaagtgcttggattacaggcgtgagccgctacacctggcctttggctgattaattttaaaagcaattttagtttgatatttccatcactaattttttttttttttttttttgagacagagtctcactctgtcgcccaggttggagtgcagtggtgtgatctcagctcactgcaacctctgcctcctcggttcaagcgattctcctgcctcagccccccgagtagctgaaattacagacgtccgtcaccacactggctaatttttctacttttagtagtgacgaggtttcactatgttggccaggctggtcttgaactcctggcttcaagtgatccacccacctcagcctcccaaagtgctgggattacaggcatgagccaccatgcctggcccctaatttttcttaataaaaacttttaatacatgtctagagtcataatctaggtctccccccaccccaaaacagcccctgagatacgaatttgggggcagatagtttatttgggagatgagcctaggaagtttcagaagggagacagggaaatgagatagggaaaagaagaaaggcagtagagggtatattaatgagcagatgaccactgtgtgggaaactgaggctgtatagtgttgaggagtttggggaggctttatagaacattctctatagaacaacatatagagttgtctcatccagtggacgaggaagctggggacctatccactaactctcagccatcac

SEQ ID NO: 50161 - DNA, 1052 bp, Homo sapiens
tggtcacaaattatagttggaagatcataaatataaataactaatgtggtctcttaaagaaaattgatttggagtcacattctatgataaatttatagtctaaaaacactttaattttattccatgcccagagagtagtatagatactttattagtttatgagaaacaaggaagacatttaacttttagctactgcatgtaacttttgaggagcatcttgtacaaattctctccctgtgaatacgaaccaagattttaaaattccattttctcccactaagaaaaccaagtcaattggaattattttctctgaatattagcaacttctttctgtctaaaagcagaaaactatagtcacttgaagcaggaatagcacaaagaaatcaaaggttaccgtggaattttccttctccatagatttaagaatttacatgtatagattttcttaaaaatctgatacagtaagcaaaacgtgatcctatacaacagatcagttgtaattattcacaaaaccaaagcattctttctttataaaaggattccatctgcagaagttggatttagacccgttttttctggtgaccataggtatagtttcatttgacatccctggggtgtctctacagtgacatctactggtggacagtgggttttcgtggttctgatgtacacagttgtatcccattagcctatttctcttccccggagttgtcatgttgtgctcttcagtgcttctagaaattccacttgaactaatttgatcagggagggtggtggcctatactctgtgagggctttaaaattgctcagtagccgaaatgggccgggagagcgtgtcatataggaaatgccaagagaagcattgattcaagaagtgtctggaagtcagtcagtgcaaaggcactggtgggtcacaggagtatgggaggtccgcaaggatgcaggatgggcaacaggaaaaggcataagcccaggaatagatgacaagcaaaggagaggacaggagagtgcgaatcttcagactcaggcagccacagtcacagtgctggact

SEQ ID NO: 50162 - DNA, 1050 bp, Homo sapiens
tggcataatctttatgttatttgtcatggtttttttttctggatctgctgcctgataaatgttttattttcattcactcattcagtatttattgagtcctttctctgggctggccactgtgctggttgattgaaagtgaagcgtgcacatgggtactgtccttgtgagcttagagttaggcagttaggtctggcgtttagggccatggagacctgccagactcttctgaaaggacacttgatataggcctctccaagtgagtggaggcaagggggctgttcagtctgcccataccccgcttctcccctatctttgtgaggctggtaaaagctaggcacatcctgaagcatttgggcgccaagaccttcatggtgactcctctcccttcgaccaaggaatcttagcaagcataccatcttactagacatttgccaccttattggttctgattgaggcagtatgtttttttaattgacagataaaattgtatttaatgtttacaacgtgatgcttttaagtatatatacattgtggaatgactgaatctagctaattaccatatgcattacctcacgtcgttatttgtgtggtgatgggcagtagggttttgaagactagggtaaaatctagatcattcttttaacaaatgggtaaagcatgccttctaattcccagtcatgtcttgggggggggcagtaaattcactcaggtgagagctactccatacagtacttttctagaagctctgtgttacataagctattaagggaagcacttccaccaggagagtgaagttgtcagtgatgagtggactgggcatggcacgctctttgggacatgcacgctctctggggccccatgggcatctctctaatcccccacaagcagccgccatctctttgataagtcttttaaccttgtccttatgaagcagaaaacccaatttaagggaaacaatagtcatacccgtcagacaaagtaatacctatagctgaaaagtgattgtataacctaacatttaacttccagaaaattcaaagtataacatcc

SEQ ID NO: 50163 - DNA, 1105 bp, Homo sapiens
ccctctttccatacttgactctttggaaaaagggtactctgtgcccctcccacttaaagagtggggagtttcattctacctccttgagggaggagtatctaaagaaatgatttggaatccttctacacaggagatttgtttattctcctccgtcctagttgggttttgataagggaattttttttatctgttctctgaattccaaatgctaattctgtagcacttgtattatatttgtcatttactacctagtgacatcacctacatttgtgtgtgtgtgtgataagtaaacagatttatgtcttatttacccaaggagattgtaaatttcttgaggactgggacagcatcttatttaaagccccttacagagttagatacagtgcaggcagttaataaatagtaagcaaatggtttttaaattagtttaattaaaaatttaaatattaaccatagttaactgaaacaggtcatcaaagtctaagcatatgagaaatgtggtaagataaggatactgtttacttggcatcctgatttgtgaaattgtcctgaacttgtaattgtggctaatatgatatttactgtgtgccaagcacttttgtaagtactttacatatattatttaattttccagacagccctgtaggttggtgccattatccccattttatagataaggaaactgagatgaacaaaggttgaataagttgttcaggatcacaaagccaggaagtagctcaactgggattttgatctcaaacactccggctccagagttttgaacacttaaccactgcgctctagattcattgaagtggtgattaaaatggtatctcttttgggggaaagaacaaaattgtgatttaaatatttcatttcaacctgttaggatgctcctgatgacatggcagcaatgttgctgtatttttcctagggggagtatttccataaagccacggctgtttttccttcttctgtgtgtgtgtgtgtgtatgtgtgtgtgtgtgtgtgtgtgtgtttatgagtaatttttgtgtagtgcaactaattgcatttaaaatacaggcatgttcatgattgatatgtcatatacagactatattct

SEQ ID NO: 50164 - DNA, 1024 bp, Homo sapiens
ggagaattaagttgtattttccaagtagaacgttgtgaagccattaagatggtaaacacagaggtttttagatatgtatttgttatgatactttgcattgtaatgatctgttatattctaagctgagagcttttcaatggcagggacctgatttttatctatttttatatttgtggtacctagaatagtgcctgaaacctaatctgcactttaataaatgcttgctgaataagtaaatgaatcaatggaaatacaaaaagagttttttgcaaattgaacaaatcagaacacaaaattgcatacactaggataaaaccatgtaaaatatatctatatgcttgtgatcaaagactgaaagggaacaagaattgaaaatgcttctgtcatagaagataacttttcttttaatattgtaataatgcattaagaaaaaccacaagtcaagacaaggaaaatgattaatacatttctcagaaatattgcccacttttgcctgcctattggctgcagagaaactgaacgttgattgcttaaaggagaaagaggagcactcgcagagctgttactggatttgcctagaggctgataggcctttgccatcatctacaataccagcctcctttctattattcgctgccagctaaatcctgttcgtcattctggacttgcttcaaataggaaaaaggaaaaaataaccatatagtctatgatatttacataaaacaaaacgtaaaggctggccttttaatccaaagttttaaaatacgatcaaaaactccccattgttccagtttacttgttatattgcagagactgggcccttgtcactgtataatataaaatctgtccttttctcttatagtgaatgttatataaatgctaaatgtagctcctctctaattccactgatgattaaaaataaacagaaaaaagcaataaacaaaaacccctaaatcacagagagatcaaagcaagaacataatagttttgcaatactgtaggattaatctattaataaaatata

SEQ ID NO: 50165 - DNA, 1101 bp, Homo sapiens
atagccctgctctacggtttagtaaagttaattcacagggggccatacgtttgtaagaggaaagcagttagaggcatagattagcattatttagtattacagatgcttcagactacaaagttgatggagaatgagttggtcaattaattgaccaacttcgacacaccaacaagactgcagggtctaccatctttccatccctatagcatcaacaattccagatggcattgacttttgtttgtttggtatatatatatttttgttttgagacagagtctcactccgttgcccaggctgaagtgcagtggcacaatcatggctcactgcagccttgacctcctgggctcaagcagtcttcctgcctcaacctttcaagtaactggcactgcaggtgtgtgccaccatgcctggctaattttttaattttgtgtagagactgggtcttgctgccctgtttaataccatgttgaagctttaactccctttccctccacctttcaggatgtggaattcattagttcattcatttgtcgagaatggattgagtgtctactcaaacagacactgagctaggtgcaggtatgaaggacaagtaagagaaggtcattggcccccaaaggaggcaacaggcatgtcagctgacaattgtttggcgtatgtctgtgtccatgtctgctttgtggcctctccttctctgggtgtgtaattctttccactgtgtttttccagctgtgtctttcattcttctgctgggccatctcctgcttctgggacccctccccattgccattctgcatatccctgacaccgagcccttctccctggatccctgtcctcatcacatcttgttctacgcttctctatccagaagcctcctctggtttcttattgcccacaaaataaagtcctcatctttagcttggcatccagagtccactagaaactcactcccaatctgccttcctggtatcatcttgcgttggtggaagaagagggctgaagaccacaacttatttaacccatgtaccctggacaagttattgaggcttcctgtgctcatcataaagatggggccagcatgctgaacctcctagagttggc

SEQ ID NO: 50166 - DNA, 1050 bp, Homo sapiens
agattaaaatgtcagttctgtcttttcaacctgaatgcctccaacagctacattttagaaatttctgaaataattaatgtgtactcatatgttcacccataaatcagaccatgggattactgatgaaaggatgcaaacttgggggtcagtcttggaaaattttgactgaattttaatcttcctattgtgaacatctatttcatgttgaaaactcagcatttcctgtttctcctaaacatagacaccacaataaatagtttgtatctatttcttttccttcaaaaagatcacagttctttgcctgtattatctagctccaagataaattaaatgccagctgaaattgtttggtgtatctaggatgcccatggtatgtgccatttggttgtgtggctgagtcagtggcgttaggtggagtttagcctccccctgagtggttattagggttgtggatggaatgtattgaattcaaatctctcatttataaggcgaggtgtgaattgtagaatgatccgattaacttgggctgaaccccagatattgctgtgtgctttttttcccccttcaacatgtcatggaggcttaaaacagtcacccacacgccctttccatatttaaccttttggaggtgctgtcttattgctgagccagggtggtaatagctgactggcttaaatggacagacagcaacaagatagctgaggagggtaatagatcctgccattctgttcatctgcgtttgtgtctgggtaaaattctcattaagttgcagccagtgtgtgtattttgtgtgtctgtgcattgtgtttgcagtccattagaaaactgatacccatgtggtgccttggtattgacaggtttcctgtgtgtgacctaaaaccattctgcattttcatttgtcaggttttcccgtgtgctctgggttcagagcaaattaacttccaagtcaacagaaccaccgaagttctgcttgaactaaagctaagctactctactggtgtggggggagggaggatgttgatcattagaggacaagggcaagttgagaaa

SEQ ID NO: 50167 - DNA, 1025 bp, Homo sapiens
gtcaggacctagctgtggccagaaggcaaggaggctgtgcatgattacttaagtttaaagaaagggcaatggccagggtggtcgctcacgcctgtaatcccagcactttgggaggccaaggcaggcagaacatttgaagtcagcctgaccaacacggtgaaatcctgtctctacaaacaatacaaaaattagctgggcatggtggtgtgcacctgtagtcccagctacttgggaggctgaggtgggaggaacacttgagcctgggagacagaggttgcagtgagctgagatggtgccactgcactccagcctgggcaacagagccagaccctgtctaaaaaaaaaaaaaaaattttgttttttttttttagtatcttcttaattatgtatagattgtgtacatatattcctgtactaattgaagatcaagaaaaccccagagaagctcctacgctgttattattaggcttaacaaacttttgaaacacataaaattgagtattgtatgactttagacattggtggaaaaatgaagacattttcttcatggttcaggtacatagttttaaaatatcttgctaatcctgatggttccacacttacaccaatgtcaggggtggaaagaaacccatattatgaatgatcttgataactgagtgtttgggggccatctccccgtaagatctgatgtgtcttccccatgtggtgggcaaagagctcccagcagaagctgaagtggcaactctatcattttctttctttctttttttccttttctttttttcttttttttttttttttttttgagacaaagtttcgctcttttccccaggctggagtacagcggcatgatcttggctcaccgcaacctccgccttccggtttcaagcgattctcctgcctcagcctccagagtagctgggattacaagcacccaccaccaagcccagctaatttttgtatttttagtagagacagggcttcatcatgttggctaggtaggtctcaaactcctgaccttgtga

SEQ ID NO: 50168 - DNA, 1027 bp, Homo sapiens
aatcccattccatgtgtataaactgatggcttagacctattagtccattttatctcaggccttcgtgccttcaaaaaaagagtgaaggcctggagactctggtttcttccagtgttgctttccgtttcccttaaatgagggacatttttgctcaagtagggttcctgggtgaggtaccatttatatgactcttcatcccaagctttagcatcagagggaactttgaaggttcttccttagagagaaatcttagtctgaacagcatccctgcactgctttggctttttgccctcctggagaattcgttcttttggcagttattagaccaccacctagactcattaaggatgcatcattaatctaaatgccctggaaccttcttgagcctgaaattgaatatgaacctatttattcccatatgccttaaagtccaccaagaatatttagacagatcttatctggactcctcactcccctgccatattgaaatgctggagtgatcactcatggctgggaggtcttgcatttcctcatctgtagtacagtctggtgattatgctatcctatgccatgcacttcctgcctccaacaaaaaacagctttggggagtggtggcggtggtggggatcctagatgtgctcctaatacatcctctgcttccacttaccagaatgatagtggcttccctaaaactgcattggctctccagctgcctacaaagtagtcagattcccaagcagtagtagaaaagtacagaacggaaattcttcctcattcatcatgtacttgtcatattccattgtggcaccctaagtcccttttactgtgtttattttctcttggattctgtgcttgggctggaagataaaggggtgggaggaatgtctgttactacctggaataaggcttgtctttaatccactagcattcagaagtacccccaggaagcatcctctgctcaccatagaaagttttcagaaactcctgagagtctgattatatactagattggaacaaagaagctagt

SEQ ID NO: 50169 - DNA, 1025 bp, Homo sapiens
aatagtaggctattaaatttctacatggaagaggctttctgttttttaaattattgttaataaattctagtttcattgcattataatcagacatattgtttgtaatatttccactttattgaagtggaaatattttttctttgtgacctaatatatgattattttgatgaatgtggtgtgagcagttgagaagaaactgtattcattagtatcagagtgtagagtttgataaacattagtaagagttactctattgagtatgttgtttagattttaggtctccttatttttggttcacctaatatgtcttgtacaaagaatgatgtattaaagtctcctattattagtgtgtttccagtgtctcctcgcatctcttgtagtttttgtctcatgaaggtgattgctgtgttatgtttatataaatacatatatttatatgttatatcttcattgtggggtgtggcttttgggattaaaaagtgtctttttgtgtcacagttaatgctttaggacatggattctgctttgcctgagaccagggttgccattcctagtctttttttttttttttttttttttttgagatggagtcttgctcttgttgcccaggctggagtgcagtagcacgatctcggctcactgcaacttccgcctcccgggttcaagcgattctcctgcctcagcctcctgagtagctgggactataggcgcgtgccgccacgcccagctacatttttttatatttttagcggagacggggtttcacggtgtttgccaggctggtctcgaactcctgacctgaggtgatccacccgccttagcctcccaaagtgctgggattacaagcataagccaccttgcccagctgcctactctccttttgtttccatttgcctcgtataccttttccagctatttatgtatttacttatttatttagagactgtgtctcactctctttcccaggctggagtgcagtggtgtgatcttggcttactgtaagctccgcctcccgggttcaagtg

SEQ ID NO: 50170 - DNA, 1031 bp, Homo sapiens
aaaaatcaaaaggattatttacactttggcatgtaaagattatatcagagcaaatggctcttaattcaagcagagataagacatgcaaggtacaacactgtccagtagaactttctgtgatgttggaaatgttctaggtctgaactgttccatatgatggccactagccacatgtggctgttgagcattgaagacctgagtttttaattgtttctaaatttaaaaaaattgaatttatatcagcacatatagtagtagcttctgtattggactgtacaattaactagctgttgactaacctcgacagattaggatcaggaatgaggaaggagtttcagatctcaaacaaagttacttcaaacccacctactcttggtttctcctgtacaggctttgatatttggcacttgtcattcaaccactctcagatgctggtaggccaccaagaacagaaccagcagttagctccttgacactgtatcaggtctgtaggacagtgatcgaactggtagacaagacttgttcctggctccgtggtggccctggagtgcccacagtcagccaatcctctctgtcctgtctcagcttttcaacttggcacaactgaagagtaaaaactggagccagggtctttagtttcacaacttggttggagaaaccagattgacttacaagccattaccaaaccattagataaaaccagtagctagctatgcaggatttgggtgagctgtgggcagagcttttccagcaaaaggttggcagggacctcaaccacaccctaggccagagaaccccgtggcaggaagtgaggttggtgggggcattggatgcctttgctgagttaatcgtgttccctgttctctagcaagtactcagtaaaatggataagtctcagctctttcattctagcttgctccttacaaactgcggcctcagacattggcccctagaactcagttgcttgtctgtacaatgagattgtacacaaggtgatcttactggtgcgttccaactctgtgatgctgtga

SEQ ID NO: 50171 - DNA, 1031 bp, Homo sapiens
acagctttatggctggtcgtggtggttcacacctgtaatcctagcacttcaggaggctgaggcccacagatcgcttgcactcaggagttcaagaccagcctgggcaacatggcaaaaccctgtctccacaaaaaatacgaaaaattagctgggcgtgatggcacgtacctgtagtcccagctactttaggggctgaggcgggaagattgcttaagcccatgaggtcgaggctgcagtgaactgagattgtgccactgcactccagcctgggtgacaaagtgagagcctgactcaaaaataaaaataaacagctttatcatctgtataaaattcatatgccatatagtccacccatttaaaatgcacaattcgatggtttttagtatattcacagagttgtgcagccatcaccacaatcaattttagaacatgttcaccaccccacaaagaatccccatactcactgacattcttcattcccccggcctcacaactacccatctgtctatatagagaccacgagacttctgccgggacagtcttcagcctttggtgcagacacgcgttgcaattgcctagaagtctgtgggtgggtcttcatgcattagaggtttagaaaccaatattctgcatactctgtccttcaggtctaagacgcgcttttaccctgaagccttgccttttcacctcctgtacattcccactccacagggcctgcaaagcgctcagaacctgaatgtaatgtacacagcggtctgcagttatatactgcacatgttcattttagcttcccagacagtaatggccgctaattgttgagcacttatgtgccaaccctcatagttctgggggttgcctgggcttattggagaagttctgctgctccatttggggtcacctggagtccctcatgctggtacagtctgctggtctgctgggagctcagttgggctcgaaatgtccaagatggtctctcattgtccaggtacctaatcacagagagtctgtcctggactttctaacagcgtggc

SEQ ID NO: 50172 - DNA, 1034 bp, Homo sapiens
cttcgtaagggtaagttttatttatactctttggactcccatgaacttttgcacactgctttgtgtttttggtttaccctaaactaccatcctttttatctttgctttttttcttcctattcagaaaagagcaaaatgtgaaaagacacaagactctcaggtatagaatgaactgagcaatttggagaatgtattggactttgtcctctcttattcccccctcctagccctgcaagttgctaggtacttgtgaggcagtgtactggagaggggagagcatggatcctggggtcaaagggcctttgcccccacccttacttggccctctacctgcaggtgaccactggcacattctcctgcttgtctcagcttcaggttcttcacctctaagatggggatgatgaaaacagtacctgtcatgcagaattgttgggaggattgataatttagatgtttatacatgtaatgtacttagatcagtgtctgctcttttcacttgatatccagtactatgtaagatagaaggtgcatgtcttctgtattctgtatttcccatttcttttgcgtgcagtctttgattcgtacaatagaaggaacacgtagaatgtatatttgtacattcatgtcaacatagtatttgaaattgctaccaaactcatttaatttggcataagactaacagatgaagtctctcatttgcttgaagatattttacaaaataccaactgttctatatttctttagaaaaagattatagttattaatattgatacctctgataatattttattcttaaatcttcagtgattccttttactatagattcatgacagctaattagtactaactgatttagaggtttcctttcccatcatatggaatgatgtaaagaaatcagatacaaactactgcaattagaaaataaaatatgaacaactttcaacaatgtatacaattgattcttttctaactttataacattttaaactatttattcatatgactcttttccaaaaatttgctgtttttaaaac

SEQ ID NO: 50173 - DNA, 1199 bp, Homo sapiens
aaagtagtaatgcccataagtgtaaatgctttactgcacttctgctgttactgtaattgaatgaaattcaaacttaatcttttggcagtataaatttatttagtgattagggtgttactcttaaatctgttttgggctcttcttttcaaacctcttttaactaaaatgtagttcagaaaccacctgtgtatttcaacccaaaaacaataataagtcagatgtggtggtatgcacccatagtcccagctactcaggagactgataggggaggatcacctgagcccaggagttcaagaccagcctgggtaacatagccagactttgtctctacataaataacataataacgttaaatttgatgcaaagatggaatttcggaatacctagagcagttgttcctgaccaagaatactcacactgtgagttaaattactaatattatagacattttaacatgtacacaaaaataggaagtgagaaataaacatgttgttctgttattttcttaattttggagaccctgagccaagaggagtcttacgactaaactgttactaatattttgacaatagaattaacaattctattctttggtaaataagagcttgcagctgacatgtggattaagcgccaacccaaacattttgacatctgagcaggggtagaaggcctctttaaaaaaaaaaaaaaattaaggaacctaaccagagaacatgcatggatatgaagccgcatgcaccaagataatgggttgagaatctaggcgtggtcaagattttctcagtaaaaatttctggatctgggccaacgcctcctcagaactggacccagctggctggctggaaaagggatggtaaagagtgattattaaaggagttctcttgaacattttgtaaaagttggctctgtcacctgagaaccctactctttgagacatttctccaggtggtttatagatgttttaactataaccagattgactcaggagaattaggtcagtatcacactgaacgggatcaatcatatcatgcttcctgtgtctgctcccatccatgagatacaaaaatctcaaattacaagcattaaaggaaggagacagtaaattttattaagaatattttgcataacatgtaacattacaaaggagatcatcacgatttacttatagcaggccagaattataggaatttcttcttcaa

SEQ ID NO: 50174 - DNA, 1040 bp, Homo sapiens
aattaggtacagttactgattttgtttgtttgttttgaaatggagtctcactcttttgcccaggctggagtgcagtggtgcagtcttggctcactgcaacctctgcctcccaggttcaagcgattctcagcctccaaagcagctgagattacaggcatgcaccaccatgcccggctaattttgtagttttagtagagacggggtttcaccatgttggtcaggctagtctcaaactcctgacctcagatgatccacccacctctgcctaccaaagtgctcggatttcaggcgtgaaccaccatgcccggcctcattactgatttttattaaaaagttatatttccattttatcgttgtataatagtatcccataggattttttaaaagcaacatttcttggttttcacccttccaaatacaaaagtaatgaattcttaacgcagaaaacctaaaaataagtcccttataacctcatcaaaggggaaatgtacttgacatactgttctgtaggcctgcattttcacttggcagttattatttttggctctgttgtatcttaagaaaaaacataattttgttatattttacttaagcatgaaagtcctgctgaaattacttagcatttctgatctaagaaatgttaatgtatataggaataggactagcgcttcctggttcattttcattgcttaggggtaatcatgatttgaccagatctttctgattgatgagtctatctgatgattagtgaaccagctattcttaaggaaatacgttgttaccatatttccttgtatgttgagaagtatacctgaaagttataatagcttcagaattagtgtaattagggccttccttactaaaaatacctttgcaaacaaaagaaaatggtaacacagatactcccatcttgacttagcagtgacactgcaggaattttttttcataaaatattctttatagttattgtcttatataaaaggaatgctcttatgatgaaactttgagtaaattacagtgctgacttatgagtatttctt

SEQ ID NO: 50175 - DNA, 1328 bp, Homo sapiens
gcctctaaaatagcagctgacttgacttgggcatacactgttttattattactttttccctcacttcagaagaaaggctgcctttgagttgaccaaccatgttgaggtggtagatgggtgctaaactcactgtagtctgagtaattgacttccacaagtcatccccactgttgagcctttcaaaatgaagtctcagtatatttacaaattaatggacatcctctctggggattagtcatattctaattcaacaaagacattgtttgaagtttgtttttgtttgctaaatgaactaaaaattatgagatttgcacctaaaggtactgaggtaaaggagagccaaaagtggggtagtcaatctacttattcagaatgagtcgataatttaaacatgtctaatagcagagacagtatattatagaaatggcattacattctctgagatctgcttttactgaagtggatcaatgatgaaactagccaaatctgagcatcagaaggctttccggtctacctgatgcatgatctctacagttctgagaagcagaactataaaacaatgtaaaacaataagggcatatgtctggtgtgtgtgtggggggtgtgtgtgtgtgtgcacgcacacgtgtttataaaggtagcagttgtaggaatgaatgagattgggggtgagggggtgcatatgtatgtctatgaaagcctaatcatttctgggcaatgatgtaaaggttttacgactgacctttgtaactatgaagttttctacacttgacctgagctcagaaaaaagaaagaaagaaagaaatgtcatcatagagtcttagttctagctctgccgttaactaacttgatgtttatcactcccttatgtttgtttatagttttactatatgtatttattcccaactggtgcaactttattctcttgacagttttatgtggactttaagttgctgttatcaaaagttgaacaatattccatacccttttcctttctccccgctagagtatgctcaggtaatcaaaatgttgggaaatggacggctagaagcaatgtgtttcgatggtgtaaagaggttatgtcacatcagaggaaaattgagaaaaaaggtaggtgtgatttgttttactttaatataaaattggttaagggggaaaatccctctacagtttttaactgtccatggacttcatttttggaaattcccaaaagacttaccttggtaaacagtgatttacctataagtaaaatagcaaggtctgtaatggtaattttatacaggttctaatgttaaagaagcatttgtatcacttgtattgtattcctg

SEQ ID NO: 50176 - DNA, 1022 bp, Homo sapiens
tggcacgtgcctgtaatcccagctactcaggaggctgaggcaggagaattgtttgaacctgggaggcggaggttgcagtgagccgagatcacaccactgcactccagcctgggtgacagagggagactctgtctcaaaaaaaaaaaaaaaaaaaaaaaaaaaactgtatagagatgaggtcttcatatgttgccctggctattctcgaactcctgggctcaagtgattctcccaccatgacctcccaaagtactgggaactaagaatgtgtcgtatagttcagagggaattgagctatggttgacagttctgtgatttagttggcagttctatgattagcatttctggtagtgaatggtacatataatatgttgagtagaccatggacatttgaaggatgagcctgaggcccttatagacctctccattctccagtgccattagcatataacttcgtaaactacaataaaatgaaactgaacagttaactgattttattagactgaagaatattgtaagtgccagaccaagatacatagcactagtcaaataaatcctaactggatcgtttgccctttcctgttacttttatttcgagtcatttcaaacctacagaaagttgcagtattagtgcaacaaactcccttaaatccttcatctgtacacacacatataaagaaatatatatgtgggattttttaattttttttttgagatggagtctcgctctgtcgcccaggctggagtgcagtggcgcgatctcggctcactacaagctccacctcccgggttcacgccattctcctgcctcagcctcccaagtagctgggactacaggcacccgccaccatgcctgggtattttttttgtatttttagtagagacggggtttcactgtgttagccaggatgggtctcgatctcctaacctcgtgatccacccgtctcggcctccgaaagtgctgggattacaggcgtgagccaccgcacctagccccatatgtaggatttcttcaggaccat

SEQ ID NO: 50177 - DNA, 1025 bp, Homo sapiens
agaaactggtccagaaatctgttagtaagtgacccttaaaataagttcgtttggccgagtgcagtggctcacacctgtaatcctagcactttgggaggctgaggcgggtagatcacctgacgtcaggagttcaagaccggcatggccaacatggcaaaaccccatctccactaaaaatacaaaaagtagctgagcaggatggcacacacctcaggaggctgaggctggagaatcgctagaacctgggaggcagaggttgcagtgagccaagatcatgccattgcactccagcctgggcaacagagcgagactctgtctcaaaaaatatatagtaagttctgccgggcgcggtggctcacgcctgtaatcccagcactttgggaggccgaggcaggtggatcacttaaagtcaggagttcgaaaccagcctggccaacatggtgaaaccccgtttctactaaaaatacaaaaatcaggctgggcgtggtggctcatgcctgtaagaccagcctggacaacatggtgaaaccctgtctctactacaactacaaaaaattagccaggcatggtggcacacacctgtaatcccagctacttgggaggctaaggcaggagaatcacttgaacccaggagacggagattgcagtgagtgaagatcgtgccactgcactccagcctgggtgacagagtaagactccgtctcaaaaaaaataaataagttcatatgaaattggcatatctatcaaattgttcacatatctacactttaaaattgccatttgaaatgtgattgatgaagctgagcatggtggcccatgcctctaatcccagcactttgagaggctgaggtgggagaattgcttgagcccaggagatggaagcttcagtgagctgagattgcaccactgggctccagcctgggcaacagagccaggccctgtctcaaaaaaaaaataaaataaaaatgtgattgatttctacaaaaaaaaaaaaactgtatagctcagttgttttaggaattatc

SEQ ID NO: 50178 - DNA, 1009 bp, Homo sapiens
aatgcatatgtgaactgcattaacataagtttattttctaggacaagggagataatatgacctttactctgcattggtcgtttgagggttgaaatgttaattacatgcaattccatataccaccctttaagatgatttggagtgtgttcagagaagaagatggtgatgagtcttatctgtcttaaagaaatgtttgaaggaacttaagttatctagaaaagataagtttcagggtggattagagtcatagatgtagatttacttcctgtgactttgcagatagagtacaggcaagttagtcatcatttattagtaatcctcttaaagagaattcacagctgaggaaagttgctatataatgaaaaatttcatgtagcaggcagtactttctcagagatattatagtgcctagtgaggtagtacattcttgtcctggtagtattgaagcgtaagtaagaatggagtagaaagagttgaaacatattatgtgtagtaggaacagaagactgttgagatgccttatcaattcaaagattttttaaattccaagatcaaaaggactttacagagtattttatcctcatgaagctacctcaccttagtaataatgtgcattggtacagctctttaacatttataaagttctttcttctgaattatctcatttttgagcctggtaataatcctttgggtagataggacaagtatccttattttgaacaggtaaagtaataggctaagagaaaatctgaattgcctcaaatcataaagcttataagcagcagcctagggctctatccttggtctgcgaattccaagtttagtgctgtttctcctgtaccagttttctttaaaagtaagttataagttgtgacacttgctttgcatacattaaaaattgcagggaacagatggttcttaaattttattcctatgaaaaacgtacgtgtagctcaagttagactgagggttctaaacgccaaacaatggggagtcatgggggcaagtc

SEQ ID NO: 50179 - DNA, 1090 bp, Homo sapiens
gcttccttctctaccctcccctgttgttagctgggtcctttggggagctgagcttttggctttatagtgcagcaacaaagaagtttgagtcagccctctgctttcctcctccctgtcatcagtggggcccagcagggaggtgagcttacacccctactcagaggcagtgaggtgatacaggttggtgccctactttcattgggactaagagtggagctgaacttccgtcccacccatctgcaacaaaacagtgtgagtcattgctccacttttgcctgggtgatgttggtgcggcccagagggaagttgaacatacacactccacctcaacaggaggactgcctgcttcggggaaaaaaaaaaaaagattaaataggaaagagtcctataatctccaaatatccattagacagtaaaaaatcacttataccaaaaaccaggaaaatcgcaacatgagtgagaaaagacagtcaacacacatcatcactgtgataattcagatgttgtaattatcagaccagaattttaaagcagccatcacaaaaatgcctcagtgagcaatcacaaacactcttgaaacaaatgaaaaattagtctcagaaaagaaatggaagccataaggaagaaccaaatagaaattttagaactgaaaaatacagtaacaaataaacttactacatgggctagatagaagaatggagatgataggaaagaataacattggagataaagcaatagaaatgaacaatagagaaaaaataaactggaaaatgaacagagcctcaagagcctggtgaacattaacaaaagatttaacatttatgtcatcagagtcccagaaagggaaaaaagaaactggacctgaagaaataatggctgaaatttccccaaattttgcaaaagacataatcttacagattcaggaagctgactgaatcccaaataagataaatgcaaagtaatccactcctagacaaaatcaaaatcaaacttttgaaaatgagtagttattgtctaatagatacagagtttcaattttgcaagatagttctgaagattagttgcataatgtgaatatacttaatactac

SEQ ID NO: 50180 - DNA, 1064 bp, Homo sapiens
cctcgacttcctttaaataacaggtacccatgatgcactgaaaaatatttaaaaaatcaactatataagtattttattatagaaaatgaggcctttgtgtgggagatcatgtttagtgaatgtgcagccatttttaacctcaaagattatgtagtattctatagtatagtacatagattttatagtatttctactatatcaatattatataggtttcttattttatctatagggaaaatgctctattaaagtataatcattgattttgaaaaaaaatgttttattgtttcttttccttttcctgttttatttttaccacctttcaggtttttttctttcccctaagtgaagatctgaggagaggacaggtattgttacatgtcaactgtcaagtaactgtgacccattactgaacacttcattgttttcagtgattatgatagaggatgtcagttttgtaaaatctagaaaactttgctttattttggcagcttgatcctgtagtaatggggtagattcaaaatgtgaaacttgctggatgcatttaaattttattaataaaacttttatctaattgcaggagcaaatataggcagactttgtcttctctttagtatacatttctggaaaccacaataagtatatcttatttttaataagacaggtggcataattggactgtgtactcctgaccaaggacttgacatttgctaaattatagaatgaccaaaaatacagatcacttatctagaagtctgagttgcagaacaattgtcctaaagtttttaaaaatttttattactaagaaattcataccattgtgataattaacaagatttgctctacagttcaatgctcagggacatgtgatctgccaggctgtgaatgatgggtaaggtcacacttgcctggttgacccagtgcagaatgggtgctttagacccaacggttcagattataatgaatgacacactgacatggtggtggtctcactggtaatgcctgcgtgtgatagtgctcagttgtttatgtgctttggtggataacacattttaaagcattga

SEQ ID NO: 50181 - DNA, 1054 bp, Homo sapiens
actctgcctagtgctctttatactacactatgattaaacttcttccaattagatttttgctagaacctcactaggcttaatcaaatcaatgtgagcagatgggaagtaaaggaaatccattcccactttattccttgaagcctgttaataaagtacagaagaagcaacatggggctctttcttctatccttttagtcaaaattatgttttgtcctttagtaggtcacgatacgatatatgaaatatattttgaccaaattaatcctactctgtgtcaattagaaacaagatgcattcttgcaactttaccatttattatttttaaattttttttaagttttctggtatatagtaggtgtatatatttgtggtataccttagatgttttgatacaggcatgcaatgtgtaatgatcacaccatggagaatggggtatctatcccctcaagcatttattctttgtgttacaaacaatccaattatactgttctagttattttaaaatgtacaattaaattattgactgtagtcaccctgttgtgctatcaaatggtagattttatatattctttgtaattatttttataaccattaaccatccccacctccccccaaccctcaacccccgactagaggtttcccagcctctgataaccatccttccactccatgggttcacttgttttgatgtttggataccacaaataagtgacaacatgcggtgtttgtctttctctgcctgacttatttcacttaacataatgacctccagttccatccacgtttttgcaaatgacatctatcatttattattaaaacaaatccatagtgacagatatattgttactcctattttttagataagagtcctgaagctcagatgacacagctgataacagggaagccaggacagaatctcattgttttgaacaccaaaacccgttcccttgacaacttggctatactacactattcgaatgttgcagatactgtggtaggtatgagtctaccattgatccccaatcctttctcacaaaggaagtcagggaattac

SEQ ID NO: 50182 - DNA, 1077 bp, Homo sapiens
tgactgtatctccttgaaagtagaccttccacctgcagtcaattttgatgttgcagccccagctgacatcttgactacagcctcacgagatgcactgggccagaacctcccagctccgccattccagaattcatgatctacacaaaccgtgagtttgagaaatgtttgttattgtttaattttgcagttttggggaaatataattaatatacatacattttgctattttaaagtgtatagttcagtgatttttagtttattcattattattcgacaattaccacgatctcattccagaacatttccattaacccaaaatgataccccatacctcttagcagttactgtcggttctccctacttcgtgttacctgacaaccattaatctactatctgactctatggatttgcctattgtggatatttcttatagatggaatcatgctgctgtgaacatttgagagtaagtttccatgttcaattctattccagtcctaggtaaatacacaatagaattgaacataggttcacatggaaacttactctcaaatgttcgtagcagcattatttatatgcagatcccccatatatgtgactgtctttaggtgtctctggattcaaatccacctcgttattctcagagagttttcatactggacaatctccagtgtgatatcgtccacacacttttaagcctgggtgtttagtcttgtgggttttctcagggagcctgttttgtaaacttaaatactcacttagaaacgtcttggtatttgttggatattgatttcactacagcttcatgaatctaggcaatgtgactgatcagtacaggtagcgcttcattttggtgatcaccagtttctcgtgttatattcattttgctattcatatagcaacatgtccgtcctctaggctctatgcgtggcatggactggctccatgccagtccagaaagcctgagcccaagtttgtgtgttaggcagtagaagcaccttgagtggtttgtttttatgtaggcccccggcctgagctgatgagctttcacagggactgggtggtcactggtccagagct

SEQ ID NO: 50183 - DNA, 1126 bp, Homo sapiens
cctcatgtgatctgcctgcctcggcctcccaaagtgttgggattacaggcgtgagccaccgcgcctggcctaaaccttggccttctccagagccacagttgtctgagtgtattgggagtgacttgcaaatgtttttacttttcaacaagagaaccatggcattaacagggtttaataaatattcatttgtacaggactataagttttcggagtcgagttttaccctctaatgcagtgtggatggagaattcaaaactgaagagtttggaaatttgccaccctcaggtattataatttagtgagaaatccgaataggatagcttccgttcatgatatttgtccaagatttgacacacctttaaactggcctttgtcctgtggcattgttaattcctctgttctgtatacaaaggtggccataagttttgtatttattgatatttatttatgtcctgtaggagcggaacattttcaatcggatctttggtggtttccttatgaggaaggcatatgaacttgcgtgggctactgcttgtagctttgggtgagttacatgtaaggcagccttaacttctgagaagcaatttatatcaccccactgaaatgaaacatttcggaccagtctgggtgtgtgtgggaatatgttatgtttttgaatgaataccacactgataccagctgaatttgatcttcattttagaaggttgtttctctgactttgtaagttcatacattaaaaaaactactgagaaaatacagtgatgatatgtagaaaggaaaagatatagttattttggccctaatctgctcacgatggcgtctcttaccatttctcactggtaggatcttttcccccttctctaactttattcttcgttcatttttattttgcttcagctagttgttagaggaaacaattgagatcatctgaattttgcaatataccccaaattctgtcctttcccccaacagtggttctcgaccgtttgtggtagcagtagatgacatcatgtttcagaaacctgttgaggttggctcattgctctttctttcttcacaggtaggtgtgtgatgagagatgacatacaacttttttttttcatttgagcctagaagtttctatatc

SEQ ID NO: 50184 - DNA, 1086 bp, Homo sapiens
gaggccaaggtgggcagatcacagggtcaggagtttgagaccatcctggctaacatgatgaaaccccgtctctactaaaaatacaaaaaattagccgggcgcggtggcggcgcctgtagtcccagctactcgggaggttgaggcaggagaatggcgtgaacccgggaggcagagcttgcagtgagccgagatcgcaccactgcactccagcctgggcgacagagcgagactctgtctaaaaaaaaaaaaaaagacaaatattaatctgtatacgaaagtacaggaattgaatatttatcgtgaaaaagtgaagctaaaatatttaagagagaggcttgttagctgtgtgattgaagaataaacagatccaaaaccccaaaccctccagcaagaattttggtcttagtggaccagcagggattgtattgcaaccaaataagatgactggtgactaagaagttcaattagccaatgagtatgtgctcatatttctgtgttctgtgcaattagatgatttgacttggtgaaaggataaggatttgttctaacagcacagtgtcaaaactgcatgtagattttacagaatactgtaaatactgagaggctttctctgaatgctgtcattcagaagagaaacctatagtagcttggtctgtaaagaaaactaaaaatatctcttttttttgttgttagtcattgcttattcccacattaggtggtgagaatttactagtaaattgaactggaatgagtgacagtatctggggttctgggttttttttgtttgtttgttttatttttgtttttgttttgagacagagtcttgctctgttgcccaggctggagtatagtggtgtgttctcggctcactgcaacctccatctcctgggttcaagcgattctcctgcctcagcctcacaagtagctgggattacaggtgcctgccaccacacccggctaatttttggatttttagtacagacagtgtttcaccatgttggccaggctggtctcgaactcctgacctcaagtgatccacctgccttggcttctcaaagtgctgggattacaggcatgagccaccac

SEQ ID NO: 50185 - DNA, 1045 bp, Homo sapiens
tgtcacaatctccgctcactgcaacctcctccacctctgggttcaagtgattctcacgcctcaacctcccagttagctgggattacaggcgtgcaccaccacgcctggctaatttttgtggttttagtagagatggggtttcaccatgttggccaggctggtcttgaactcctgacctccagtgatccacccgcctcagcctcccaaagtgctgggattacaggcatgagccaccatgcccagccttggatatagtgttttcattcttgcccaaacaatatggcggcttgcagcatccagctgaaggaaaatatcttcttttcctccctccctccctccttctcccttccctgccctcccctccctctctccccttccctccttctccctccccttccctcctccctccccttccatcccctgcatccctccctcccctccctccttctcccttcccttccctccttcttccttcccttctcgtcccgtccctttctcttctcttctcttctcttttctttctgagagatgatctcactctgtcacccaggttgtagtgcagtggcatgatcagggctcactgcagtcttgacctcctcaggctcaagcaatcctcccatctcagcctcctgagtagctgcgactataggcatgcaccaccacacctgactaatttttttttttgtggagaccgggtgtcaccatgttgcccaggctggtctcaaactcccgagctcaagcagtcttccttcttcagcctcccaaagcgctaggattataggcatgagccactgcgcccagcctatcttgtgtatctttgaaaatttactctcattctttttccttcctcaacgcattaattagcaattgagttatttaaaaggaccctatgtgtctcttatattttcttgattattttattttgttccttttgaattttttttgctttggtcatttccaagagctccttcctgttctttgaatgttctttttttcatagaattatttttttcttttaatgtagtggcttttaaaatttatttga

SEQ ID NO: 50186 - DNA, 1058 bp, Homo sapiens
acaaccaccactcctgtgtctagaagggtaatgcatacagctctcacaactgtcaacaaatacttcttccttgaacatctcactatttgtgatccagattgaaaatatcaagacagaccaaagggtgtttttgcagaacattaatcccatgaaatgctctgttgggggaggtgttcagtggtcacagtaatcttgggaaacactacacttctcttcttggagaatctcaaccaacattagcctattaaaggctcccagaagtcctgctgttaactcattttgattttgtttagctcagtataaaccaaacatttcactgtttgtaaaccagtcaaagagctgaactctttttcatggagtatatgtgatccgtgaatgctctggaaaaagcctcgctaaggattaactgaaagaaaacaatgcaggtacttgggagcctgaggcaggaggatagtttgaggctgcagtaagctatgatcacgcactccagcccaggtgacagtgagatcccgtctctgaaaagaagaaaaaaaaaaaaaaatctcaagactactaattcaggtactctggtctacaaaacaggacttcctcctgcagttgcagttagtttctaggtgaagttaacattttgcaaagatgacattaccttagggattttacttagcaaggaaggtcccactttatcctaagattaggatgaatttgttttaattttttttttttgagagagagtcacccaggctggagtgcagtggtgcaatctcagctcactgcaacctccacctcctgggttcaagcaattcttgtgcctcagcctcccaagtagctggaattacaggcacccaccaccacgcctggctaatttttgtatttttagtagagaggatttcaccacgttggccaggctggtcttgaacttacctcaagtgattctcctgcctcagcctcccaaagtgctgggattacaggcatgagccaccacgcccggccagtataattaatttttacaactggtatggtttaaggagcagtgcttccaagaaggccaagtaaggagc

SEQ ID NO: 50187 - DNA, 1055 bp, Homo sapiens
ctttgtagaaaacaaaagaaagtaggtgatcttagcaggaaaagcagttttagtaaagtgagcctaagatgatcgtattagtcagctttgataatttgtttgcagctgatgctttttcctttggttaaattctttttcttgtgttcttaggttaagacatcagaattttatagatactcccgacagctccgttacgaagttgaccaagcattgaattactttcagaatgttcaccagcagcctttgttggatatgaagtcaagccgcatccgttctgcaaaaccgcaaactacagtatttcgaggaatgattggacatagcatggttaacagtaaaatacttctcttaaagaaaccaagagtctggtgggagctagaaggcccacaagtacctctgcgacctgactgccttgctatcgtcaataattttgtgttcctgttaggcggggaagagctgggcccggatggtgaattccatgcttcttccaaagtattcaggtatgacccgagacagaactcctggctgcagatggcagatatgtctgtaccacgctctgaatttgctgtaggtgttattgggaagtttatttacgccgtagcaggcagaaccagagatgagactttctattcaactgagagatatgacatcaccaacgataaatgggaatttgtggatccttatccagttaacaaatatggacatgaggggacagtgctcaataacaaattgtttatcaccggtggaatcacctcatcttccacctccaagcaagtgtgcgtgtttgaccccagcaaagaagggaccatagaacaacggaccaggagaactcaagtggttaccaactgttgggagaataagagcaagatgaattacgcgagatgctttcacaagatgatttcttacaatggcaagctttatgtcttcggtggtgtctgtgtgatcttgagggcctctttcgaatctcagggatgcccttctacagaagtatacaacccagagactgatcagtggaccatcttggcatccatgccgattggtagaagtggccatggtgt

SEQ ID NO: 50188 - DNA, 1029 bp, Homo sapiens
gacgcggggcgccgcgggcgcgggacagccttccccgcccccccttcccccccgttcccacacccgctcccgctcccgtggcgccggaagtgacgcgttttgggctgaaagatggcggcattggcgctcgaccagggggaaggtaaacacccgccaggccacgggctggccccctcggggcgccagcaggggccgaggggggggcctcccgggccagctccccgcccccaacggcttcccaccctccgccctctctcccagcgtggcggccttccgcgtcaagacgacagcgcactgggccccctgccggccagccccgcctccctgggcgggccccgggcggctcccgcggcccgcagggggcgcgcggcccggagcggcccccggctcgtggccccgcacgccccgccccttccccgcccctttcccgccttcctccacccccggcgtgggtgatcccgaggctcggcgcgcttcggggcagaagcccagagacgccgtcctcgacgcttcctcggctggtgcttctgtctctgcctgctgccccccagcccttttccccgcccgcggccccagtcggccctcccgccgagccccgtcgggtgctgcgaggcccccggcgttggcaaggtcggtccgggccccgacgccgcgccgcctcgtgcggagcccgactgtctggtttctcgactcagcgctgtcttctttcccaggacttatccagagggggctgcaggcgagcactctcgtgccccgccggagcgacccggctcgtgccgggagcggctgctcgtagacgtccgaggagcctgccgagtgccgtcccggcgcccgaccgcccacccatcggcccgctggcccggttcttcctgatgcagactgccgtccactagaggctggacaggaccccccgaggtacgtagccgcccctggccgccggcctgcggagcccgggcttcgcccgcggccccgagctaggcacgaattcgccggccctctctgcacggacccgagtcaaacatttggtag

SEQ ID NO: 50189 - DNA, 1045 bp, Homo sapiens
cccagcactttgggaggtgaggcaggtggaccacttgaggtcaggagttcaagaccagcctggccaacctggtgaaaacccatctctactaaaaatacaaaaattagccgggtatggtagtgtgctcctgtaatcccagctacttgggaggctgaggcaggagaatcgcttgaacccgggagacggaggttgcagtgagccgagatcatccctctgcactccagcctgagtgacagagcgagactccatctcaaaaaaacaaaaagatcaaggaaggcacagtttgttttctggctccaactagtgagtgccatcactgagatgggtgtgccagggaagtagagtttgtgagagttatgtctgaggtgccatggggacttccacttggaggtgtctagttcatgtttggttggggaactcaggagagagttctgagctggagatatagatctgggagatagcatggaggagatggaagtgaaattgaggcagtgaaatggatgagagtgaaattgagatagtttctggactgagaaggaagtggatggagatggttacctaggaagagtgcctcaggataatcccactacagggctaattctagaaagtaactgaccctgagccatcctatcaggttcttagagggggaaaatagaggagctgtaattaaagctattagactcctccttctattcatctgtctctacatgaaatctggttaagctaatctactttatcccagaatcttcccaggttggaaccctaagaaagactacttaaagggccaatagaagaaggatcatgaaaagaagacagagaagtatttctcaaataactgggagatcaagggaccaagggcagggtaagtttcatggagggaatgtccaatagaatcaaatgcagtagagagatcaaatgagttaaggaggaaaagtttcctttggatttagaaagaagaggtcagtggtgatgtttcagtgaagtggtgggagcggaggctggatggcagtagattgaggagcctataggtggtagggaagtggaa

SEQ ID NO: 50190 - DNA, 1022 bp, Homo sapiens
ctccatggaattgtgatagctgcacctttcttaaccacccagcactaaatcgctgtgagcagtgcgagatgccacggtacacctgaattcagaaaagtctgcgccaggttgaaagtgaaactttgagcactaccagaagaaaaggaaacctcgggactctattcatccacccagccttttcattttcgattgcacagcggggaggaggaatggctttgtggtcgtcgttgtgctcacgaaaggaaaaatggggaggtcttttttttctcctttcttaactcactacagagtgagagatagaaagggatacttgaaactgggaaaggattcactctgtgaaagaatgtacacacagaagtcaagagctcttctgtggtggaatcccaattgttaaagttactgctgagtggcccttattttttaaagtagtactttgaatcatagtatgaaatgctacagtttatgcaaactgtgaattcccagagcagacttacctggtcaccgctctctggaaaaccaaggctccccgtgcttcttcccattgcttcctactaaagaggacaacaggaaaaagcacctagaatatttggggggggggggcaaattaattaagggtatttgtaattgctgcttttttcaggggtaatttccaacacacatacatgcacacaaacaaaatgttttaaaatgtgatttgtagcagtcaggaactaggcatatcatgcctttgtttaaaagtacaatcagaggtggtaagatgcctttggcttgtacagtgtgattcatcgagctctatcaacactggtaactaagacctacttatgccacataagagatgcatttttttaagttactgcatgtttttattaaggccattggttttcaaaataacaagtccttacaaagtatgattttataaatgatattctcgtaaaactgcgctttgccagtagcacagtgaatgtatgccaaatgcaagtccattccaaaatccatttggaaatcttgagctcagctgtggt

SEQ ID NO: 50191 - DNA, 1044 bp, Homo sapiens
tgaaatatgagcagttaaatttttttaaatgttaatatgtagttaaaacttgatattctctaaatctcggggagaatgttaatatttttaactaaatcttccaggtaacaggtttgtgctttcatgactattttgggaggaatttcttcaaaaatgtgtcatgtacttctttgtctttttgacttgccgatttgtaggagttttttactatatgctggaaatgagcccttgctggttgtaaatatcttctcccactgtgtggcatgctttttctatttcatggtattctcataagattacctccaaggtattctctcatcttctagaagctttgttgttttggctttcacatatagatctagcatatacctgaaattgatttttgtattttgtgtgaggtaggggataataccgtcttttcctatatggatagctaattttcccagcacaccatttccctgctattgtcaggaatcaagtgtccatatatctgtggttctgtttctgtgctttctgttctgttcctttggtctgtttgtctctacttgtactgatgccacattgtcttgtttattatagttttatcataaaacttgatatctagtagaacaagttcttccacattgtccttcgaaagcatcttcgctattcttggccctttgcacatttctttgattttaatatcatcttgtcattttccacacacacccacaaaacctgttgctactctgattggaactgcatggcatctagagagcaatttgggaagaattgacatctttatcattttctaattcatgaacatgatacactacgccatttatttaggtctttaatttctttcagtaatggttgtgattttctccggaagattgttcacaacttttgagagttttatttgtagatatttgatattttttgatattgtaaatgtttatagccattattttgtttgtttatatctttatattgaccttgtatctaataattttgctcaacttttagtcatatatctttagagtatgtatttgatcttttactatg

SEQ ID NO: 50192 - DNA, 1021 bp, Homo sapiens
tacttgacctcgagcccaactgcaatgttatatggaacacactttggtaaagaaattcaagtctgaagtaaactttgaaaaccagtctaggagatagcatagttgactctctactgtagttgttgagaagcctatccgttgtgtctctgggaacatcagaagataaagctataacaggtgcccacgtaggaagcctggatttttcgcacaaaagtaacttttcatatgctctagtggtgaagcagttaccctgtagacccagaagccagaatgatttagtctgaaaaatctaaagataggtattaaattaactctcatgatcatagaaaattctttgcaccatttttgtagaatatcccaccgaataacttggcttttcacccaaaccaccaagaaaaattgccaccagtgacttgatgcaattaacttgctatcgggagttctttcttgtgaaatgattgaactttgaaagatgtttaccaaagacagcacctttagcttcatcacaattactgtggaatctttctttgtaagtagttagatgcaaaggccagttgttgcttgaggcctctcctggattgtgattttaaagtgtatcatcaacacatgggaagatatttctccctctttatcttatgacagaaatgcaggtatagctttcatctcaaagtaagattaaggtataagttacaaagatgtgtagctactatatggtcctgtgtaatgctacttgaggaaggctgttcctttcctggcactgaaattttagagcttgcataatcagtatatcaacctcgtgtggcttggtgcttagcaagtttcagcttctagagcccatggctaatggagccatccaggagaatgttggagagataggtctgaagccttagaagagaagtcttgattaaggagtaatgagttgcgggaaggggtcatggttgtggcggagatggaagcctggggagaggacagagacctcctaggaagagagtttgtgtaagaagaagaccaaggacctcct

SEQ ID NO: 50193 - DNA, 1052 bp, Homo sapiens
atgtcaggggcagtgaaagcaaatgagaagtgagatgatttatatttattgaactaatgtccggtatctctttgacagagttgaataataatcagttgtcggtgtcctttctgtagtgttccacattggatgggtgaagaagtcctgatagtcgattattgatcacataacaaggtcaatttatcataactgaagtgcgatcgatttgtgggtgcaaagaagaaacaaattctggaaccgaataatgtttatattgcttttctctttggaaacaaagcagaaaggggcctttctgcttgtaagataaacatttcttcaatacactatggaagcgctttgaaataaagattccgaatggttcaaaagcaaaaatcatgttgttgttattgttgttttcttttttcctgttttcttgactactcattgtaaatgctaaagtctttctttatgttttgtgttttagccacgagactcaaacaacttgctgggaccatcccaaaatgacagagctctaccagtctttaggtaaggacatggccatgtttcctccaagttaaatgacaggtgacctttaggataaagtagtttgcagtgtgaaagttacttgctatataaatacatcactagattgtttcaagggtgaaagcagtggcaccttcctatccaaaattgacagtcagctttctttttatcagaggttccttaaaaacaagttttagaagttgattgattcctaaaaattcaatatacctgagagggcctataggtctttgtagttctctttggtgcctaaaatgatggaaaaacagttgcaatttatggctatttttttttttcttcccacgaagatagaaaactgtttcaggtgcttgttgatttcttccgtgtgaaaccaagacaacccttttgccaaaccacaaatgttgtgtaaaggaattttctgccgtctttccggtgctcacaattcctaaggcctggcgggtcattaatgtgaacatttaaatgatttctttagtatggcttgttttgtgtttatgtaagagcctgacagt

SEQ ID NO: 50194 - DNA, 1026 bp, Homo sapiens
ggagatgggacattgttgttacacagtgtgactagtaagggcctgtgtgagcccttgtacatgtgggcacacatgtgtgtgcttcctctcttcgctcttcctttctccctggtgcttatatcacatctggatgacctttggaaatagaggaggcctgaatgcagggtggtctcaatagaaggtaacctttccttgctctgcacttatatatggaattggtatacactcactttccgagctgagaaatgcctgagaacaagcaacactttttccacgaagctgcaagctgcagcctccttgtgctgtgcatgtaaagtaccagtcctgcctaccccttctccagatcataaaccggcttggtcatggggtgtcctaaaaccccttaaagcatagagaccatatctcctgctcttcttgctctttaagacttgaatgtcactctgttatattccctcaactgataagcccttgttatagtcctcaaatgtgagttgtctctatggaaaagtaaaactgaaataaacgtatttggaagacagtgaaacagcacttcacaagtgaacattttcttgcaaattgatttcagtagccctcactgttcaatcactgactagtaaatattacagggatggtctttgaagttgtacagtttggatgatttccatatgtctttatgaggtttatgattgtgttccatttcttaaaccaacttaaacggttgttttaacttattttttttaaacataggtgataacatgtagtgtgttggttttgctctctaggaagggtctttcttcgccttgattgacttaattacagttggatccacatctatattgtaatcaactaataacagatttgcttttaatagatgacaatttgaggggcacatgataccaaaagcgaccacatattgagcaccaaatggtgccggtcacttacctatttcaactaatcctttaaccctccaaggtaggcaggcttgctttaaatttcaccgccagtagggcgcagagccctaaaatt

SEQ ID NO: 50195 - DNA, 1058 bp, Homo sapiens
cactaatctagaagaaaccagtatgataagcatttatcctttttaaaaacatatttgcttctctctccccaacactaaaatgagttaaatatcaaaaagaaggacactacatgcttcttcagtaaatattctaacatgcttaacaataaagaatgctgtaagaccatggcttttaaaatttattaaaatctactgaaagctaacatctttttcccctagaaaaagcatgctagtaccaaaaggcatgtatcaaaagcatgtaccaaaaaacatgttcaattacaaggggttcatgggccctccaaagccctttcattaattctgtagtaggccatgatcctcaggttaagaatccctactgcaaagtaaattttattttcccattgactttcagtataaaattgatggtgcaatttactattaaatatgcttctttctgacaatattaaaattatgtctagaataatgatgaagggagaaacaaaatgtaaagaatgaagaactgtcttcaaaatgactaaaaaataaacccaacactttgagctaaaaatataatacagagccagcaaatctaccaatttgggtcaggtatcataatcaataaagaactatgtagttttagcaaatttgccaagttttccattagtcttaaatctctaccacatccctaccttacggtgagaaaccttatggcgtgatagcaggaacactctactagccttcagaaatctagtctcctgatgtaatttcaatacatataataagtattatttaagagtgactttggtgcctcgatgatcttatctacctggacattcagaatgaatgggtggggttccataggccaggaagaccctaatttgaactttggaaaaaaaaagagtggctatttctttgaaaatctgttgaattagagaaagtttttgcaaggagagcaaaattataaatgcagttggctccaggtatggctgagagacagaatcctacatggctctgagtttctgatttctgagccaacgtacaatttgtatttgtgtggaagaagcactgaagcattc

SEQ ID NO: 50196 - DNA, 1047 bp, Homo sapiens
ccatagtatccggccgcagtgggccactctgaatcccctcggttgccccttctgtttccgtgtgactcacgcagctttctgcacagatggtatccttctagacgtctgggatgttcgaggcggttgtattgaataccgtgtgtgtattccgggtgagggggcgcgcaaattggggcaaagaaagctacttcaggatatttcgctctgctggggcttgtctccagcgctctctggccagaaaaagcgctggcacaaaaggaggaggtgggtgggtcagagccccgaaccgcgcagtgttccagggggggcggagaaaggagggcaggccccaggcaggaaggagggagggaaagaggcgagaggaggagttttccagcccggccttcgcccgcccgctagcacgcagtcccttggtctcttcggtctcctgccgcccccgggaagcgcgctgcgctgccgaggcgagctaagcgcccgctcgccatggggagccccgcacatcggcccgcgctgctgctgctgctgccgcctctgctgctgctgctgctgctgcgcgtcccgcccagccgcagcttcccaggtaggatcggaggcgtggctgcctcctcagctgggcaccaaagacccccggagtcgccgttgggacccttcgctcgggatagagggaggtgccgggggcgccctttgtttgcgcagaactcctctttcgcagcccgagggtggggatgatgcggatcggggctggtgtctgggcacgcgccgggaagaactgaccatcccatctccaggcgcggggcgccctcgcggcgacgggagccctagcaccttctgcgtccgggcttccagagttccaatcaaacccttttcggtgtaggaggctccacagagaaagtttggccgcagactagtttgctactttctcacccccagaattttgcctctcacatggttgcccactggaggctggcagcttgtcctggaaggagcctctatgccctcccactacacgtcccaggctacccccttggggccgcaggacacgagcca

SEQ ID NO: 50197 - DNA, 1022 bp, Homo sapiens
tcaggagattttacatttaaaaagtttctcagccaggcatggtgactcacacctgtaatcgcagaactttgggaggctgaggctggaggattgcttgaggccaggagttcaagaccagcctgggcaagatgataaaaacctgtctctacaaaaaaattaaaagattagttaggcatggtggtgtgcgccctgtagtcccagctactcaggaggctgaagtgggaagatcgcttgagccctgaaggtcaaggctgtagtaagctgtgattgtgccactgcactccagcttgagtgacagagtgaggccctgtctcaaataataataatgtttcttggacttttggaaagcctgggtctgggagcatcacactgtggcaacactgacctgaagctgagctgaggctggcacccctctccccagttcccatggctccttccctcactggccttgatgctaggctcctggctcacaataaaaggatgtatagaggacacaaaaataagtggacgttttaaatgaactattttccagtgataagatctgggacattatgggaaaaaaaagtccaaacttactgtttttcgacagtcctcaatgcacactaagaattctatcttactttttatggaggggcctctacaaaattatttatacttatatacaaatatatagtatatgctcatgttatttttctctgtaaataatctttttaatctttacacaaaccctctgaggtaggtattgctaatgttatttttccattttacaggtagactataaaatacattcactgggtgccatgctcaggccatgagtgattagattaaggcttggaaagcagtgcttagggctttgtatttaatgcccttcccaccccatactgctgtttccatgattttcagtgtagttaaaacatgaacttacaggttaacttttcctgtccaaaaaaaaaatatatacttgaaattttgatttttctacctgatataacttaaatacaaagttttatgctatattaacc

SEQ ID NO: 50198 - DNA, 1111 bp, Homo sapiens
tagagggccaggggcagaacccacattgccaggaaagaatgagctccgggaaatctgctctgcagaggaatagaatcagaactgtgaaaattaaatatcagatatagatatttaatttttaaaatatttaattttttaagcatatttctcaatttaggaagggagatgtgtactccagagactttggttttctggggaaaagatgataaattttgttcataattaatatatacataagaatagagtgttattgatgtgagcttatgaaccaaaagaaaaatctgcaatgctttaaacattagtgaggcggagaaaaaaaacatctgtgagaacagccattattatcctcaaattaaatgagcaggtttggaaacaaacatgggctccaaagtccagtagaactgagttaaaatcccagccctccactgatgagctgtgtggacacctagaaaagttgtggtggtggtggtggtggtggttgttatttgacctttctgagtcttatttccctcatttgataaaggaagggacttttgacgattaaattacctaacacatgaaacatgttataggcactcagcaaatggtaacctgtatcactctaattatactctgtgatcacaccaaggtaggtgcaaagctacactcatgaatctccaggtcactgactgatgtgcgtgagtttagtcatgtgaacctgacttttgtttaaatgtaacataatagcaaaatataaattggcttatagaaatagatctgtgggaataaagtagattgcaataatgatcatgcttaagtataaggtggagtgaaactattacacaccatacattagtcaataaatgcccctaaatatttaaagtgtgttgaaacgctgatcacactcatgtggttagccgaaaatttaggtgtgttttctgtcactgaacatttccctctgtgtcctaaccttgttatcaaaataaataaaaataattagcacataaggtatagtcgtggatcatgcatttgtttatggacaacaagaaaatcttctaaggaaaaagagtagagatagtaaagaataaatctgaaaatgagaataaaaatgctcgccagcaagatattctat

SEQ ID NO: 50199 - DNA, 1033 bp, Homo sapiens
gataaaaatatatgtgccgaacatgattatttaaaaagtagatttaaaataattaagatggatgacacagaattcataaagaaaaaaacctccagggaaatgagaaactcttaaactcaagttattaatgtaatagctatgagcattcatcttctactgaagagataatcagccagtaatacagaaacaacgttctaaaatacacccatctcagtattaaacctggtctatatgtccacgtttaaatagcatttcttcacatttccctggccaaaaacattttgtgctctttagaagtggtagttcatgcaagcattgttttctagtggagaacactggcctccctagtcactttgagaccaaagcccttcttctggttttgtacttttgagctgtctgaacttgggctagtctcttagctttgcagtcctcaatttcttcatctggaaaattatagaatgagaatgagtgacctaagggattctataggaacagcagttgttcattaccagctagagctctgtcacacccagattttctgcaattcctttttcctcaataaaaaatcttaagtctcgtcaccaaagcgaccccacattcaaactaactagtagttatactaaagtaaacagttatcctaaactactaagcacacactaactttctgtgcccactgttgggcgaacatttatttaatcacatgtggcaggtctagtaccctcaaaaagtttatggagaggagtgtattgtgggttaggggtgggttggggtacaaaagacccaggtctatccaggctttcatcgacagaagtgatttacatgtttgtaaattttatatatcttaggagaaaaaaaaggaagcttaagaatgagaccactttgtccctcatgaattaacacttggttatatagattaaaataactggttccttctttattgttcccatctgctggttgttcaggcttttatagtagtttattactgatcattattgagggaagtgtgagtagtatatatagaatccattgagtt

SEQ ID NO: 50200 - DNA, 1028 bp, Homo sapiens
tattttctgtaaagaaacaagagtggaagcattttattgctgaaatttgctctttgggatcattaacttaagttataatagccatacttttccttctgtcaagccataggttatgattgcagttcttatgtataggaaaagactaccatttattgatagagtggccctctgactttggttgagtatgactttgaattaattactatgctgactttactgaatgatattaatatcttttttagttttaaaattttgtgattttagtgaaaatctttgataaccttttccaatatttggttgggctttaatttatcaagaaattgatagcataaaaataaaattaaacatttggaaattagagactgttcatgggtaggaaagagagacttttaatgaataacaaattgcaaaagaagggaataggctgtggttttcacaaccatagagagataaaggcctgccctgaaatcctttgcttttcctggctttaaggactagtgcaatgaatgaatgagggattagaggattaggaaagtaaattggagaaatgtaagttgagggaagaagtctataaaaaatatttagtttctatttatagtgtctttgacatgttttcaagtttaaaactcttaaaattgaagtcactgaagtgcaagagaatcatactaaattgttaaaatttagagctagtcctcattcgttctatctataatactgaaaggcatggtgaataacagcattcctttgaatatgggagagctgttcgaacacagttgtagaagctcaatgaatattgactgatttttgactgaccatacttccaagcagacacctttcttgtgtctttccttcctcttcccttagactccaggctctccctcttctgggctgctttattgtgctagggaaagaaaggcatgtgcctttagaaatcagttctggcaactgggccttcctctcttagggctcttaaaagaatcatgactttttaaagagcaatagcaagaacagccagaaacggaaagcaa

SEQ ID NO: 50201 - DNA, 1013 bp, Homo sapiens
tgtaaaagtcattttaaatgatatttcttacaataccaagttgattaaaatgtagtacctacccttctgaagtttacagtcaaactataggatgtatagtttttccatgtacaaagcattttcaagtacgaatatatttcatttaatctcccaaccactctgggagagaggtggtggtatctgagattccatatatgcaggcaggtttagaacacagttttattcaaggtgatgctgcgattgagttgcagaatcagaattcgaactccagtcttccagttctaaaagcctgaacaatttctactgacatgcagtttctctccatatacaagaggaagaggaggatgtggtagcaactaataatgaccaggcactgattatgtgttctatgtgcctttgaatgcattaattcggttattcctatgaaacaaccctatcacataggcacttttatccccatgttacaggcccagtgattgaacaacttgctcagtatgactcagtaagtggcagaatccacatgcaaacaaggcagtctgactctgtagcacatactttttgctactgtgctagaccaataactgcaatatacagcagaccatgattggtaacgtaagacatttgatagcagagtcttacgtgagaacaagaaagaaaaaatattatttcttgttaggggcgtcaggacatatttcagagaaagggtggtatttgagattaaccatgaaagatggaaacaactctgagagagacagagatgagggaagaacaatccaggcagagacaaaaacatgtgcagagatatagagacagaaaagtaaatcatgtatttggagattattgcatagttgagtttgtttagaggttgtttgtttagaggttagggatcatggatcctaaaggaatgtaaacccctgaaatgatatgctaaatttggtaggtgcatttttttttttgagctaggtctcactctgttgcccaggctggagtgcagtggcataatcacggctcac

SEQ ID NO: 50202 - DNA, 1094 bp, Homo sapiens
ttttccttttaaacttttaagtcagtttttatgaagttgttataatgtttctttacttttcaatgcacacatgctttgggatacgtttgtttttacttggaacatttgtttcttttcttttttaaggagaaaaaaaaatgagtaaaaggagctccacactttgacttaatttcatacaaagctctgatgacaggccatgactgtagagtggtcagaactgtgtggttggtttgagggagcgaattcggggaaggcacttggtgatataactttgttttgtttacagagtacctgctcgggccaggtaaatgctattggatgtaatccagtagtgtgtaatataaattcaaaccatatccacacacaacaactaattgtatgaaacttttatatcctaatttaaaagctgtgaaattagttttcacgcatcaaaccggattgtttatatgtttaaacattttatgctcttatttaaagaagactttgagctatttttttctgtaccctgtaaaatattgaaaactaacataatatgttgaggttgcttggaaatgtacataaaactaaaattttctgaatcgtgtgtttatgtttgaaatctgtgttttaactttgtaagtaaattctctgcctttgtatttatattttacaaaaattttcttaaaaggcaataaaactgttgaggaaaggagaaaattgaagtaccttgtgtcccatgtattcctaaagcattattgttgtccctgattcttcttaaatggtgctggtgatgtattccctatagataactttagagcaatttatagtctctggaaaccaaagcagactggaggattttggaggagttatactcagaatataatttggagtcctattctgaaagcccaattcttggacatatttcctgtctcttagaaccttctctttcctgtctcctttgatgcttatggaggcttttgcactgcctttggccttgacctatttcagtcccacgtcatggccaactctctaggagtgttttttctgaagctaggcatttgttatgtcacttctgcagcccttctgttgcatggcctgagagtcaaggcctgtag

SEQ ID NO: 50203 - DNA, 1049 bp, Homo sapiens
cctatggttgagcccctattcgccagtgaccaatcatcttgggtgtacttgtcaagagactgctctgctgtgtgttgacagagctgcttgatgagtaacatcctcctcagccctgaagctataaacatatatgccattacaaacagtgatggaaatcataaagtatggtaggttgtatgcaaggaatgtaacaccttccttctcaaaagtgtcactcccaaaagaatggaaggatgggagtggacatgcctgaatggagagacagccttgtgtgtttataatgctgttagtgagggtctgaggagagaagagatcaaagaaatggggatacagacttactctcccagtgactgttgatagcagggcacttggataggcttgaccctagttgtggtcacagctgaatgagcaggactttacccccagaaaggggagaaatggggcttattcagatggtcctccctagatggacagatgagtccagagttcctactgctagaagtagttactctgcctcaccttagaaaggaatggcgatggccgggcacggtggctcacatccgtaatcccagcactttgggaggccaaggcgggcggatcacgaggtcaggagattgagaccatcctggttaacatggtgaaaccccatctctactaaaaatactaaaaagtagccgggcatggtggcgggcccctgtagtcccagctactcgggaggctgaggcgggagaatggcgtgaacctgggaggtggaacttgcagtgagctgagatcgcgccactgcactccagcctgggcgacagagcgagattccgtctccaaaaaaaaaaaaaaaaaaaaaaaaaatggtgatcagagagtaggtatggtgagaaatgaggggtgggagcagaatgaaaggacatagaggctggtccacttgggttggtagttaatattaatagttgggcgcacttttcattttactggaaactcaaagcattttcctttctgttttgtaggccacgaaactggctactgctttcggatgtccttaagaaattgaaaat

SEQ ID NO: 50204 - DNA, 1045 bp, Homo sapiens
cccagtgggtagggggcaggaaagcaggaagagccagcttctgtcctctcttccgggccctttgaagcaacttgccacttggcgttttgtgggttaacttaggtgccgtttgaatgtggtataattaaaatattaatgctttgaaaacataattggtgtatctttaaaaactgaagccgctccagtgatcagtgttaacaatgggcttttcttcctgcactggctacaactgtgtaacgcccgcttcttctcccgtctcccatccgcccgccaccccgtcaccccctccgtatttaggcttgcctgtgttctccggctctccgcccatgaagagtctttcatccaccagtgcaggcggcaaaaagcaggctcagccaagctgcgcaccagcctccaggccgcctgccaaacagcagaaaattaaagaaaaccagaagacagatgtgctgtgtgcagacgaagaagaggattgccaggctgcctccctgctgcagaaatacaccgacaacagcgagaagccatccgggaagagactgtgcaaaaccaaacacttgatccctcaggagtccaggcggggattgccactgacaggggaatactacgtggagaatgccgatggcaaggtacctcttgaccccggcttccctctggggcctgtgcgaacacatccccgcctgcctgcttcccagcttgaggggacaaagctttccttttcctggactcctcccccacaccacacgtcactcccctgtcctagaggagcatgtcttctgggtggcagcgaagtttcaaactagtaagaatgaaatcccttcccccaaaccctcctttgacaggcaccccccacccccaaaaaaagataaggaataaagtgcctctctccacgcaggtttgtcacgtggggaggaggaggggaagcagcggctgttagaaggacacgggcttaaccgtgtgcgctgcttggttttatgataggtgactgtccggagattcagaaagcggccggagcccagttcggactatgatctgtcaccagccaagcagg

SEQ ID NO: 50205 - DNA, 1664 bp, Homo sapiens
gcatagccatggtaaattatgggatgtatgtgctgtgccttataggaccatgatgcaaggagaaagtggtagacggtgtaggactcagccatgttcacatctgcctagatctcatgaccaaaggcacatggcattccactcacagaagggctgtaagtagttgcaatggaagaggaccctgatggttaggacccctatctatcccttcatctctgtctatgcacccatctcctttgccctcaagagtaatttctgtgggtactggtaagaatagccccatttgagggaggtccaagtgaagtgtacaggaaagtgacctggagcctctccctcatagctgtttgccatacgtatcttcggcagtcaaggtgggtgttctttgggattattactggcccatggagggaaaccctagcataaggtttgggggccttcactgaggggaattgggatgtttgccttgagaggctcaggggttgaaggaaggacaataggcctcatttgcggaaagatctcgtttgcggaaagatcttcttgagagcggacaagaagcatctacactgcgtgtgggcaggcatgattgcagtgaaccccagatgcagcagtggagggctcccgataatagttctggactattcaggaggcagaagggggccctgtccggctgaacggggaatggtggggacttggaggaggcatgtgtgtttcgcaccccttatcctagcctgctggcttccccatgaatggggagcagaaggtggtgtgtgcaggggagccctccccacccccactgggcagcttttcctagatggggagccccagagaagacagatggcaagacctccccatatctaatgggggtgctccctagcagagagactaggtccccagttagtcactgcctgttgatgccagtctgtgaaataagtgattacaagtcttctaggtggttttctgtggacaaaatatactggcagtttgggcataaggccaggtaggtgagatataaactcatttcactattaggaagtttgcagtgaaggtcaaaactccaatggaaaactttctccctgagaaagatgccttagacttggttgagattgttacaaatacaggtggctgtgtgagacctggagttcaaatggaagctgtggaagtcaaatccaaagcactagggttgagagattcttaatctgatggggatttgatgggggggggggggtgtctctgggaagggtgccaagacagggcagttcgttctgggtggggccccacactggctaagctgctgcctcattttgacccaggaaggcattgtgacattacctagtcacctctgctttcaaaccacttggctcaaaccctctctcctacctaaagggaggggaaatgagtacactttaaaagtataaaagtaaccttgcatgtggcgcttcgtaacacagtctttacatttttacattgcacccccagcccctcccacagggctttcaggggcggctgattggctccagaaagtcaaatagtatataactaggacaatcagttcacatcttaaactttcataaatatcagggctaaaaatcaagctggtctggggatcatagcgtccttttgtaagtaatttctccagccttaccctctgccctgctgcaccgtgttta

SEQ ID NO: 50206 - DNA, 1050 bp, Homo sapiens
tccgagattttggaaactagcagcaccaagttacatccagatgtccccaccgacaagaacctaaagccgaaccccaactggaatcaagggaagactgttgtcaaaagcgacaagcttgtctacgtagaccttctccgagaagaaccagatgctaaaactgacacaaacgtgtccaaacccagctttgcagcagagagtgttggccagagcgctgagccccccaagccctcagttgagccggccctgcagcagcaccgtgatttcatcgccctgagagaggagttggggcgcatcagtgacttccacgaaacttatactttcaaacagccagtcttcaccgtaagcaaggacagtgttctggcaggtaccaacaaagagaacctagggttgccagtctcgactccattcctggagccacctctggggagcgatggccctgctgtaacttttggtaaaacccaagaggatcccaaaccattttgtgtgggcagtgccccaccaagtgtggatgtgacccccacctataccaaagatggagctgatgaggctgaatcaaatgatggcaaagttctgaaaccgaagccatctaagctggcaaagagaatcgccaactcagcgggttacgtgggtgaccgattcaaatgtgtcactaccgaactgtatgcagattccagtcagctcagccgggagcaacgggcattgcaggtgagcccccccacctgaatttcagttactttaccagttgtcagttttttaatgtgtaaacaggattgggggagtatggtagggcagggcaccaggcagatttggtgaatgaagcttgtggtaatttgaatatatgcaatgtggccagtaagagaacgtgagtggtagcactgaggcgtgtctggatgctttaagttattctgtagattataagggaactccactcaattgctgataaccgatgttttaattattgtgaagggtatctaaagactgcatgacgtttacctatcaattgctttgatttctctgcctgtaagatagcaaatatacctagaagtgctg

SEQ ID NO: 50207 - DNA, 1034 bp, Homo sapiens
cacaccctccccatctgacctcttctcagctgtctttcctctccatccctatccagcacctttacccacttctctccactactagaaaaaggggttaaaccccagatccaaggtgcagcttcgcagctcacagtggaacaggttggtgcttgtaaagtgcttttcatgagtgacttcacacatcttggcacttctggaagcatagcctgcatttggaagaagtggggggtggaggtgggcattgaaaaataaaagcaaacgagcttcatctatagctgcaaagcaccctgaggctctgtttgtcattgaaatcaggtcatttgccctctccacagtgttccgctgccaagggtcagcaacatcagtttcgaagcacttggccttagaggtaaaaaagtccccagctatttcaacagcagcttctagaagtttgatgtccctatactttgcctcccagtctctttttgtttcttaccccagtgtccccttcgttgtacatgacagagaaaccagggtgggctgtaggtaatggtgacccctgttcttcagtagaggcttggtgtgagccgtatggcctttgcaaaggaggtccctgcttttgtaggtttggactgctctttgtcacccaggaggagggcctcctgtgagccagggccattgctcattggccctttccactcctctccatctttggccaggaacccgaagagttaaaagtctttagcttgttgcaatgaaattatggctggcagtggcgccgctgtttgttcaacagacctccacttttaaacagttcacaaaaagttcatggggcagctaaagattataagtgtgtgtgtgtgtgcgcgtgtgtgtgtgcgcgtgtgcgtgcgtgcacgtgtgtgcgtaagtccacagcaggatccaacaatgtgttccccccttttgcttttatgttcagccccatcctccaccccttccctcccaaaacacacacacacacacacacacacacacacacacacacacacacacacacgacagtgaaccgctct

SEQ ID NO: 50208 - DNA, 2584 bp, Homo sapiens
ggtggaaaatggatggaggtgggggaggagtggttgctagaggacatcaactagagaaatctcatcagatgggtagggaaagcagcaccgggggtttatttctactggccacaaggaagacagacatagtgctttggaggaagaaatcctctctcccatcccaggaggaaagttgtacagctgtgatatgtctggtctcagctttgattccagagggtaaaacagggtatgtttcatgatactctgcccatcggttattggtgattttcaaagaataagtatttgtctgctatcgttattctatatcctggtggaaagtttataacgaaaagtaatgcctttcttaagtcataaaatgagccttgtatgcttatttaattaaaatctatttaaggaccgattaggcgtgtaatttgcactaataatgacgattatggaaatgttcaacttaaccaaaaatcataaaggagacattttgatcagtggggcggccagtaagtatttagtgagttgggcaatttccgaaagacaggaggcattccgctgagggctgcagaaagcacagacctgtctggcctctgtgacatggcatggagaggggcagacctccctgtcccggccccggccccagcccggccagaccccactttgctgagcatggaaaccaaccctgcgagtctccacaacctttattctcgtgatgcttcctcgagcttccagaaggagtaaactctcggagagggctgatgagccacacggaaatctctgcgaaatggcggtgctcttttgctttaacaaacagcgctgacaaacgcatgcttccttggctagccttggctggatcccggaggggtagggggagaaggggtcccttgttccggagaaacctgccagctgctgggcttggtgtgaaggcagcaaaggcagacacaatgctgctgttgttggtttgatctctaactgtggattgttagtctggctttaactatgtggtaaggggggaatgtgaaggctgtttacagcgagtgcaaataatgtgacagctgttggcgcgcgagcagcgctgcgcctcctcagcacttacacaaagcgcgcactatgcaggcccatggacgagctgcagaggtggcggccagtttctggccagcgcatccccagatgagagaaagctccacggcacacccgccctccatccccaacacacatctttatgacttcccaggattggggtggggtgcaggatggtttgtatgttgtggtttagggaacttgtggtgaggcagaggtggcgggagaaggcccacggggccgtgagtgtcaccgtgttggtggggtttggccaggatccgttgaactgggtcctcagctgtttatggctgagtttttaagatttgtgaaaataactttcagccctaagtaagcttgttggaaagaatgtgttattaactgaaagctttctggaaattgcagaggctctgaaggccgttgttcccctctgaaatggccctgttattcagacaagttagagacaggcgggtgctgtgttctgtgcactcgacactgtttccagcttggaaatgcaagtgtgcaggttcagtaccctaaggggggtgtattttggggggaagggaggacagattggcttttgattacccacatcccttaaccttttcttccaagccttcccgttttcaagagcacatttgccttcaactgcagcacgcaaaggtgccgtcctgaagcctgcccacagcaccacctactctgacttcatcaactagatgcccacagcaacaggctttctttgagttcctggtaccccgccaggccctgcagagaggcgccagggtgggagggagagcagttggtggtggcagttacccactaggccagtcctggaggttcatggctggcccaagcaggtggacttaggatggccaagaatgtggacctgcctctggaccgtcctggggcaagctgggtgtaaaaattcactcctctcccccatgagtcccaaggttgaagccttccaagccctggcacctgcctggtcctccttgggttttggaagatcatttagggctgactttggtctctgggtgtacagcctacaggatatctgcaaatctacttcattctctcctgtcccccccaccctcagcacctcccctccctaagtctactctctaagttttaacatggacttctacatctagttgggtttccgatggggagctgggagatgcttctggagtgagacatgaacttcggtgccagttctataaattggtctctttttatgacgtgtgccattttctgtaggaatgttgcttgcaaaacgagtttcgccttggaggaaaggcggaaagataaacaagcctgcaacgccaaaacactggcagtctttccctccttccagctctcttaaagcagccgggctgtatttccaggattagacttgtgcatgtgaggagggactcgcgttggctttttttcccccaagcaaatgcaaattagagaaaaataattttctttcaacgatatgcaatgtattagtcacttgttatcgtgctccgaggcaggc

SEQ ID NO: 50209 - DNA, 1094 bp, Homo sapiens
ccagggtataacagtgtagggagatttgtaggatgtagggggaaatggtgaaagactttgagtggaccaggagatgacttagatacaggagaaactgggttcacggctcactgtagaccaagtaacataggtgttaaacactctttgcctcgttcttgggtacataaggcctaaggaagcttttcagaggagacagtatgtgaaaatcaggatttcaaatggcacaattagaccaataattggctcctctccgcaactccaggactgagtttgaccgtggcccattttttactagctgtgtgaccttgggggcaagttatttatggcctttgagccccagtaagttttttcatttgtaagactgggaataattatccacctttaggatctaaatagaatgcttggcacatagtaggccccaaggatgaataattgctttgaatgacttgtcatgttcctataggttgctcctccattccctgctgcccctgagaccccctgagacttgctaggcctgtgtcctgggacccaaggatgcagattaaatctcccctacgagggtattctaggtccaccttcctgggttcccctttccctttgttaccgtagtttgcattctgccttttaaaggattccatatgaaaagacttgcttctcccctccacccccaagtgggatcattatatggttaggaactcatttcagaaccgtcatctaggtacccttcggcaaggcttcctggcattatttcaggggggaaccacggtgcctagaggggcaagacctggttggaagaggtgagagggggtggcctggtgcagaggccagaggtgctgtggtttgtttgatagggattaagtccggatgttatgagggctcaatgtggttttcaataaagtctgccagggattgcttcttttatatcaatatgtatttaaaaaaattactagcatgagaagaaaaccagacctgtatggatccaggctggtagtaagctactgtgatcaggtttcctactcgactcccagaggggaagtcagtgtttgattgaagctacacttggttcttgactctcaggggatgcctgctctgaa

SEQ ID NO: 50210 - DNA, 1027 bp, Homo sapiens
ctgagatcccaccactgcacttcagcctgggtgacagagtgatactgtctcaaaaacaaacaaaaaaaaccccaactctttgattttgttcacaattctgtgggttaggaattctggaacggactcagctgggtacttctcacttgggatatctcattcggttgcagtcacacatcaacaggggctgcagccatcggaaggatatccgagatggcacactcctgtagcaatcagttgatgctggctattggctgggagctctgctgggctgttgactgtggcacctatgttgtgagtctctgccatggcagtagacttcttactgacttctctcagagcaagtgccccaaaaagagccaggagcaagctgcatggcttcttctgcctttgtcttacaagtctcagagtgtcacttctgttgtgttgaaagcagtcacaagcccacccagacttctagaagtagagacagagaccacacctcttggtgggaagagtgtcgaataactagcgggcgtgtttaaaaccaccacggtatctcatggggttgttatgaggattcagtgagatgatcttgctgaagtgctggacaagcatgagttcccctcctccttctaatttgaggcctggaggctaacagggtaaagccagtgccaggtgccaggtctccagtcgcttgcagttgttcatgtctactgggccatagggaccgtttttctcagtcttgtctcctcttctcttctcttctcttttactgacagagtttcgctcttgttgccgaggctagagtgcaatggcgcgatcttggctcactgcaacctctgcctcctgggttcaagcgattctcctgcctcagcctcctgagtagcttcaattacaggcatgtgccaccacgcctggctaattttgtatttttagtagagatgggatttctccatgctggtctcgaacccccgacctcaggtgatctgcctgcctcggccttacaaagtgctgggattgcaggcgtgagccactgcgcctggcctgt

SEQ ID NO: 50211 - DNA, 1037 bp, Homo sapiens
atggtggaggagcaggggagaaccttcagctgaaggctaaagaccctactagcacctgggcccaggcaggatcgaagtgacccaacctgaagctaaaatgacagccggcaaacaagaatgtatgcagatgtcatacaagagccaccagggctttaattgagctctgtttaacccagtggaggaaatcagttgagagggtgaaaacactagctcagggtgacatgtttgtggcaaaagagaccagaacccagagctcccagcttcagaaaacagccagaggaggaaagtgactgctggttagagaaagatccagagtgctcttggtcactgaagaggcctggtattttagtcatttggcatttattaagcacttgctgtgtgcaaagcactatgctggcatcaaagggggctaccagcactatgagccctcaaaggactgagcagggaagactctcccctttatatgtgcctggtgacaaaggccatgaaagacagtgggtgaaggggctggggaatgggaggaggaagccaaccactctgggttccactcttgaagatagcagtttacaggtgggcatcgaggccagagggcaacctgtagcaatggacccctctatggcctccctgagccaaaccctacctggctaagcacctgcgcctgtaagattgtcctcccagtggtgggagtgcgagagaggccatcttcacttccccttccttggagggcctgactttgttgccctaggcaggccaggaaacttattctaatgccaacgaaggaggcaacttttctagctagaaaagcacacgctacagctctctctcttgccctgaacaagcagaagagcacagcttatccccaaaagctcctggacaaatgtaggctctctgggggagctggtaagggaatactgcctcccttaacaaaacaaacctgagaatctccaaggtttagcactgcacacggagtctcccagcagagaagggggctagcttaagtgccccatgcattccacctgccccttggggcgctctca

SEQ ID NO: 50212 - DNA, 1029 bp, Homo sapiens
atctctactaaaaatacaaagaattagccaggtgtggtgatgggcacctgtaatcccagctgcacaggaggctgaggcaggagaatcgctcgaacccagaaggcaaaggctgcagtgagccgagatcacaccattgcactccagcctggctgacagagcaagactccgtctcaaaaaataaaaaataaaaagatgcctttccacccccagtatttttagtgtttgtggtggatgtgatttccaggatatctaacctggcatattgctcgaaatggaggagcatcttgctttattcactgaacaaatcttggagatgtttccatataagtatataaaggatgtctttgttttgtgttgtttaacaaagcttagtatttcattagatgaatgtattaaaattgctgagtagtcccaacttgttggccattttggtttcttctgatattttgctgttacaaacagtgccacaataaagagcctttttatggatgtgccagtatacctgtagaattgctgggtcggaggatatatgtaattgtaattttggtagattttgccaaattgttctccatagaggttatgccagtttatattcccaccagcaatgagagtactggctttttcccacatccttgtcaacagttttatcagcgtttagactttgggtctttctaatttgtagatttttaggtcttttgatttgtaggaattgggtatgtacattagcgaagttagccccttgggatattcattgtaaatattttttccgcgtttttcatttgtgttttgacttgacttttggtaggtttagctatgcaaaattttcttttaaatagtgaaatgtatcaatattggtttttaagttttcctgattttgtatcattgttagattcttctcactcccagattttgaaataatcctcccaaagttttttttctaataccatttggattcctttttttaattatttaaaattttaaatatatttttatttatttattttgagacagggtctcactttgttttgg

SEQ ID NO: 50213 - DNA, 1056 bp, Homo sapiens
aataaagacaagcatcactgttaaaatgagagttctaatccatattgatgtgaatggaaatggattaaatactattaattgctgtgaattgcttcctccttttgcagaaggtatctagaagtggagtttgaactgaagctgtaatgtcataccttgtctgtcattgtgtacattgtgctttgtctgtgtaaagtatacttcatatgctgtcttttatcaccagaattcctccctgtaagggtataactgaggaaacccaaaaggctctggaccgctctcttcttgattgcactttccgattacaaggtagaaataaccgcacttgggtagcagagttagtgtttgcaaattgtccacttaatggcacttctactagggagcaaggtgagatgtttcacacattttgtctttgcatatttctggatttttttggtatcgattactattaatattctcttttaatcctgtaggaccatcccggcacgtttacctgacatatgaaaatctgttgtctgagcctgttggtggtagaaaggtggttgaaatgtttcttaatgactggaatagcattgcacgattatatgagtgtgtgttggaatttgcacgttctctaccaggtacgtgtggagataatctcctttttaaataaattaaaaaaaaaaagccctcaccctttttttaactgaagtgaaacatgcacagtgttccaagcaaaaaaatcaaagtatatctaataaaacttaagtattcctttcacttcagacttcaatttccttcccctaaagacaaccactgttaagtttcttttgtttgcaaaaattttacacacaggtataccatatcataataatagtgcttatttactgtgtggcatacaatattataaacagtttgcttgtgttaacaaatgagttttcacaatcttcacaatcacaatcatgagggtaggtattattcctcattttacagaagaaaacaagttgcagagactaagaactttgcataaagtcccatagctagtgagtggcagagttggaattggaaccctctaaccac

SEQ ID NO: 50214 - DNA, 1481 bp, Homo sapiens
tttttggatgtcttttctctgcatttctttgattcgttcagcagatatgcattgagtgtgactgtgtgtcaggcttgaattctgacatcccctcagaatgctgtgggttcataaagcagaggaatatgggctagttcagaagtcaggaagggtatccctgaggaagtaccagttatacttggactgaaggagaggtgagaattagtcagaggaaagtggggcagaggcagtgggaggtcctaaccagagggataactgctaatgtgaaggcttggagggaagagagagcttggcatttttgtgctgaaaggagttcggcatggcaggagatgggagaaatgaggctggaaatgtacgcaggaaggggtcacatcctttaggcctatgtaaatgtccttcaacaatttaggctttatcctaatggcactaagaagctatcagatgattttaagctaaaactgacatcattagataggtgtttttgaaagctcaacctgatagcaatatggagaataaattgaatgggaacaagactaaagtaatgaaaccacttgttgaagtggttcacattagagttgttggtagctcagagtagggtacgttccacaaggagttaggagagaaaatattcacgagttatgattagattggtgttgaaggtgagaaagaggggaaagtggcaaagatgattcttggttttatcttgggcaaatgatggatggtggcagtgttttctgagatcagggacaccaaagatgtgagtttgaatggactttgctaagtttaaggtgcctgaataccctttgggcaggcagagatgtgtttcaagctcaggtaacagatctgggaaggagaagtagataaagtcatcaccatggtgatagtaattgagctggggtagtaaattagatcaccaggaaagagtatacagaaggagatgggcatagggcttaagttctaatggacaaaggacgaggagccaaaagatgcttagaagtaaagctaatgtggtacatgtgctttaaaagtgacccagtatggacttgcaaagccagaataccatctaagagatcaacctttttggtccaggaaacaggtttctttgcaaaggaggggtacactttattgtttcccagatgttgcttaatgatataaattatataagcaatttttatttattgaattcctctgtctgctaagacatagcagctctgcaatttgagcagtggggctttaccatttgttatctaggaatctgtttccgtggaaggtagatagagctagcaaatagtgtcacataacccatgtgtcattagtgctcactttagatactacagaattgaactagaatagttcctcttcctggctatcttaacaacatttccacaaaaacgttttcaggagagagagagctagtcttaaaatggaaatcagtaggaaaatgcaatacttccaattgcatttggttttgaattgctttg

SEQ ID NO: 50215 - DNA, 1039 bp, Homo sapiens
ctgcaagtcctgggctcaagcaatcctcctgcctctgtctccccaaatgctaggattacatatgtgagccaccacacacagcctatttttagtttttttttgaggaacctccatagtgttctctgtagtggctgtagtacttcacattcccaccaacagcgtgagggttccccttcttccacatcctcacaagcatctgttattttttgtctttttgataatagtcattttaactggggtgagatgatatctcattgtggtttttatttacatttccttgatgattagtaatgttgcattttttcataataccttttggccatttgtatgtcttcttttgagaaatgtctattcaggtattttgctcattttttaaatggagttatttggttttattttgctattgagttgagttccttatgtattctggatattaatcccttgtcagatggatattttgcagacattttctcccattctgtgggtggtctcttcacactgttgattatttcttttgttgtgcagaagctttttagcttgatataatctcttttgtttatttttgcttttgttgtctgtcctttttttttttttttttttttttttttgagacggagtctcgctctaccgcccaggctggagtgcagtggcacgatcttggctcactgcaacctccgccttccgggttcaagcaattctcctgcctcagcctcccgagtagctgggactacaggctcgtgccaccgcgcccagctaattttttgtatttttagtagagacagggtttcatcatgttagccagaatggtctcaatctcctgacctcgtgacctgcccaccttggcctcccaaagtgctgggattacagacctgagccaccgcacccagcccaggccaatgtcttagagcatttttccaatgctttcttctagtagtttcatagtctcaggtctcatgcttaagcctttaattcattttcagttcatttttgtatagtgtgagagatgggggtctagtttcattcttttgcatatgatggt

SEQ ID NO: 50216 - DNA, 1028 bp, Homo sapiens
gggccttaatttctgcttcatctctccggtctgctggcccttccagcccccacctagttccctttatcattctgaccataactttaacttccatctcaccgtctaccctaagagtaggaggtaactataagccagagatcattttaatattttctcctccttgtactttgaacctctggaagtagttttagtttttctgttcctgtggcacgtgggtgggagacaatctaaatggctgggtgtgtgtacttcaagaactgattagctgtgggagaggcatgagagttgtttaggccattgaatcttggactgtgggatagaggttaacagaatgtggcaattcaggaggcattaaggatctttctaggcatcagtggatgtgaatgttaaatggtatagcttatctgggaagaagttgacattggttgctggctatcagtattggaggactagcaaaaagaaacttaaaaatcctgttggagctgtttaaaagcaataaaaatttttcatctaaccaccatgcagcataattactgtaaaacccttgacatacactggtccttttgtatgcttagcttccagttttgtccaccataacacaatgtggagggattattgcttggaaacaggtatccattggatacagggaggctggcaaccaagtagtaagttcttctgcatctgtgaccattttggtcttaaaataatcttttctctgacaccctatgatatagtgtgctaatgtgggacttgggctttttaaatgtttaaggttcatgcaatacattttgaagtattttgaatggagaaaaatgttcttttgttggtttttgccttataaccatactgctggaaactcataaatctaaaaaagagtaggtagctacatgagcctgtagtagctgtttacccagtttttctgaaacattaacgtatttaatagagtcaaagtaaagactattatcacattagaatgaaggtatgcatgtatctaatccgttttttttttttcttcttagactgccaag

SEQ ID NO: 50217 - DNA, 1077 bp, Homo sapiens
ccatgctgaccaggctggtctcaaactcccaacttcaggtgatctacccgccttggccttccaaaatgctgggattacaggcgtgagccgctgtgcccagcctccaaaccttcttgatgtttcttgttagtgcctagcacactgccatcttagagcctttgctttttccctagaaatctgtgtgaattgctttctcattagtcctttaggtccttgtttacatacaatttatcagaaagattttctctgaccacctataaaatagtactctgccccttcactctgtccttcttacttgctgctttatttttctttacagcacttattgccacctgacattattagtttgttgtccattcccaccccatgaggacagagattttgatttgtttgtgactttccctggtgcctagaacaatgcctggcacacagggcttaactaagtatttattgatttaatacatgaatgaatgaatgtttagaattgtcataaatcaatatatggtttgatagaagaaataataactagtgtttgataactcagtagggtgactagtttgcaagaatctactgtacatttcaaaatagctagatgagaataattcagatgtttccagcataaagaaaaaacaaatatttaagatgatggatatcacaagtacactgatttgatctttacaaattatataaatgtatgaaattatatgtactgtgaaactgtacatgcttaatgcatcaataaaaatattgttcaaaaagaattgtaaaccatgggaaatttaataggaaaagttatttttgttcttgatacacaggtatacaacttttttcacttttgattgtggtaattattaattaattagtttgggaacttaccatggaagttcctaaatagtgtattttccctaaaaactgtcaggattaatatgttaatgtagagccagtgttcgaggtatactttatgagtctttagggaaacagttacttcagtaatatgtgatgcttgtgtgtgaactattgaaggtaaaaaggacaaccttggcaacttaggtggttttgttttggtctcagatttct

SEQ ID NO: 50218 - DNA, 1028 bp, Homo sapiens
gcctcttgacgatacgttttaaatgtaagctgttattgcttctaagttaatgcaggagctacatacgttgtgtataaaatacaaatttgaattcaaagtactttttttctggaacttttgagtgtttgaggtcttaatgaagttagtgtgagtaaaatttttttgtaagtagtctgttatttcttggagtatgaagggggtttataaatcacctagttacccatgaaatgccttggggcatgattaagttgttaatcccttcagaataggatcagaatatactaacgaatttcagtgtgtgaagaaaaggcaccgtaacattttgggactctgttgtacatcttataacccaggttcagaaaaagttaatcagaattttattttttatctattgcaagacttcagatcagggttatcaattgagatacattagtatgcagatattaggctctaaagcgtcacagtaatttgtttttagagactgataacagatacttgtttgcagatgactgaaagagtaggctctacttaactcctgtaaaacgtcattctcagttttgatgtattgtacttttttgaatgggacagaaaaaagtagtgttaaagaagcctacccatggctaatgagaaatttaaatcgctgtcaggtttagggactattataatgatatacctctctgcaccatttattgttggatttcataaaaatccaagaatatccatgagaaagtttcatgtatgtgcctatatagagctgtgggaaaaaaaatgttgaaaactgctgctatcggtggtgtaatttgcttttccataggggatttgtagaaattccttgaattgtggttgtctttttactattttaggacttggcttatgaagagaggaacatctgttttattgccgtagaataagtatgtagttatagtcccacaccctttatgtgatggttcccatatttgtatctccagcacagacctctctgatgaactccagactctatatccagatgcctacatttcagtatcttg

SEQ ID NO: 50219 - DNA, 1076 bp, Homo sapiens
tctacttcatctgtgggttccgttcagcatccaggctgggtggacttccatctagcacttagagtagctttggggatagaagcaaataggattctttcccatctcagttgcccagaagcaggctatgggatgggtatatgtgtgtgaccgggagtaggggtgatgagaaaaccttgtctcagctgaccctgtattcacctgatctatgagcataggaaggaaggaaaaaaggcctaagataatactgacataaaggatatttctaagtgaagatccctgttagcttgcttgagctatatatggactttgtcataatgtttgttcctggcttaagtcttcagccacaaaaggattggcaaagaaattgccagttacctctttcaaaaattaacatatgcaagcttaaagagctttcttaccagaagaatcagagcctaggactttaagagttaaaaaactttgatggataaatacaatgtaccagtctccctcaacccacaagaagatgctgtgtgactaaaattcagaaatataatcctagtgaaagccaaccttgcactaaaaaaagaaagaacctttcatgtcaaatttgtctcttacatgcctgtatacacaaagaggctaagagagtcccttcagccaagagagtagagtgctctgtagatgaacctgccttaaaagacaagataaattctgtgcaaattatatctactatttttacattttaattttttcataagggcagtttatgctgggtgccatattgggcatgagtgagatagctgaacaagacacagtccctcccttcaaggagggtacccgctagtccctggggtcttgggtttcccacgtgatgggtacttcaggagcacatgggagggtctcagagctcacaaaggacttcccaaagaaaagagcatcagtactgagttctgaaggattactcagccaagcaaaagagtgagtggggaaggggaagagaggatgggaggttcaggcagagggagtagtaaatcaaaaggccaggaagccagagagagtctggccctttctggaactgaaagtagttcaggaag

SEQ ID NO: 50220 - DNA, 1077 bp, Homo sapiens
gccacaaatggttctgtggttggtttgagagagtacaaatgacatggacactaacttggttttgtccatttctgtgagtcgtcttcttccctcatggtatttccaagctaccacaagagcaagaatcttatcttggccttccctttatagtatgtatgtttgcccatatggaagtttgtattcaacttaagtcaaaatgttcacttgtcttgttgaaaactggaattaataccaaaaaggcatgatctgttgttgcaatagaatccccagaagattcacagggtgcaacttaagctaaagaaaatgcatggtgatacacaggagtgctaatacaagaagttattttcaataacttcttaatacaactccttttataaggaactttttctgaggaattgaaagtcctgactggcattaggttagttcccaaggtttcagaaataactccaaaaattagaaatgtggcccaaaaaatcaagtgaatctagtcatgcatacccagattgatggcataatgtttctgacaagtatgaaatgcatttttctctgtaaatgttataacgtactctgaattgttcatttctcaatcagagattaaaagtaaacatttcaaactgctgtataatgtggaatgaatgtgagtggccacatgggttaagtttaaatggctcagttaaataaggaatcattcccttcgcattagttacattgtaccacatttttatttccaaaaacagtgtaatttctggttatgtactactacagagcagtagtttcataatggcttttttggttttatgaagggaagaaataaagcagactagttacacaaaatgtagcaactgttaagcaaatgctcaagtatactatttgaagaaatgcactgcagagccaggcacggtggtggtgcctgtaatcccagctacttaggaggctgaggcaggaagattgcttgagcccaggagttcgaggccagcctgggcaacagcaataccctgtctatacaaaataaaaataaactaaatagaaatgcacagcagtatcagcagaatgttgcttcacacaaaacgtcagtgg

SEQ ID NO: 50221 - DNA, 1031 bp, Homo sapiens
gttcttctctgatgtatatctcttttacccttactagtaataatatttattctataatagaaagattctgaggtgattgtaacatgtgaaatcttaggtttgtttctcttcagattgggtcagttagtaactcttgacacaggtactaaaaattattaaatacttttcaaacctaatctttaataaaaattaggcagttgggatcttcagcacgataatttatggtaatgtttgtcatcttatacttgatagggttttaatatcaagtcactcttctgggtctcattaaaagaaagaaaaggtatagaatgttagagataggaaagaattgattaatgaatgacacagtcatcacttaaaatatgtgagccttcgaactgcaaaatttttttcatacttctgtgaaatcatgcaagcaagtcagtatggcacctatacagctcaaacctcaaaggaaatggttgtcagactgtggttgttactgttgatgtaaatatctctgtgtttctgtgctggtgttctgtgttaatgaaccttgtgtcttatttcagagagattccccttccacttccagacagtccccagctaatggtcatagcagcactaacaattctgtttcggtaagaactttagctccacacagcaaagtgtgacaattttgttggtgctcacctgccatgagtgttctagttacatgtgttcagtggaaatagtgtcttctgctgatatacaaggctactacagctacaatgcactttactcctggaaaatctttttcaacatttccttctcattaaaaatccccttcaatagttaaatttgaagaaatatagttcaagactgctttggtcattctaaaaatatttctatgccaccccatttgtatgtatgactttgctcaaacctatgcaaaggatgtaaacggaaatttgtttaaacttctaaatattttttaatttgaaaaagataaatgtaagaattttgcagagtaggcatttgggtattcttgggctttgtagttttctattctg

SEQ ID NO: 50222 - DNA, 1043 bp, Homo sapiens
cgtatcaatgttcatcaggggtattggtctaaaattctgtttttttgttgtgtctctgccaggctttggtatcaggatgatgttggcctcataaaatgagttagaaaggattccctcttttctgttgattggaatagtttcagaaggaatggtaccagctcctctttgtacctccggtagaattcggctgtgaatccgtctggtcctggactttttttggttggtaggctattaattattgcctcaatttcacggcctgttattggtctattcagagattcaacttcttcctggtttagtcttgggagaatgtaggtgtccaggaattcatccattttttctagattttctagtttatttgcatagaggtgtttatagtattctctgatggtagtttgtatttctgtgggatcggtggtgatatcccgtttatcatttttaattgcatctatttgattcttctctcttttcttctttattagtcttgctagcggtctatcaatttttttggtcttttcagaaaaaccggctcctggattcattgatattttgaagggttttttgtgtctctatctccttcagttctgctctgatcttagttatttcatgccttccgctagcttttgaatttgtttgctcttgcttctctagttcttttaatcgtgatgctagggtgtcgattttagatctttcttgctttctcttgtgggcatttagtgctataaatttccctctacacactgctttaaatgtgtcccagagattctggtacgttgtgtctttgttctcattggtttcaaagaacatctttatttcagccttcatttcgttatttacccagtagtcaatcaggagcaagttgttcagtttccatgtagttgagcggttttgaatgagtttcttaatcctgagttctaatttgattgctctgtggtctgagagacagtttgttgtgatttttgttcttttacatttgctgaggagtgctttacttccaattatgtggtcaattttagaataagtgcagtgtggtgctgagaaga

SEQ ID NO: 50223 - DNA, 1050 bp, Homo sapiens
aacattccttcctagaaggagttgggtttgccctttcccaagatttaggtttctgtgaaaattcttccagacgtgccttggccagaaagcattctttcattttactccgtgtagacgtgccttggccagaaagcattctttcattttactctgtattcatgctattgaaagttgcttctgtcagaggaaacaaacactgtgattgaggaaatattgatgaattttaaatgacaaggaaattgccacattgacagaattttggtccatctatttaaagatgattttttgaaaagatatgcataagactcatattctgacaagtttcacagaacaattcagaggttattaccaagaggatcccactgaaatcatcagcctgcctttttaaaagaaaaatattgtttagtgaaataataaatatgaagctctgatttttagcaaagaattgtgagtgtttactggattttcttctttgctttttagctgtatgacaaaattaacacaaagtcttcaccacaaatcaggaatcctccaagcgatgcagtacagagagccaaagaggtaagtgatatattttatagaagtatttggcatcatcatatttgccacctttattgaagacatttctgttgcacattaagaggcagtttccctggagtcacaatttgactcattatattcagatttagtatttctaagtttattactgaacatacagaaaagaaaaaagatctctgcagcaatattgcctagatttctagttctggttctgcgatgtaaacttgaatacattaccatcaattttacttctctttttctgttttttaaaaaagcaagttattttacaacacttggtggaaatagacatgctataaaaatttgagttgctttttgaaggtggtaatgtttgaaagttaattaaatttctgtagcaattaaatatactgagttcaaagaagtcatttttgtaaattgtcaaggtatgtggctatatctgtcacaaacttttaaaaacctatttatgatagaaatacaacattgcagaaagtt

SEQ ID NO: 50224 - DNA, 1505 bp, Homo sapiens
cagaagttgtcagtggtgaaaccaggattctaattcagcctaccactaccctttgattttgcactagatcctatccctttttatttgaccacattgacccaacaacttcctcccttcctgcatcatcagagttctctctctgttggatctaacatgctataggttatttgtattatgcacactcttatatagacataataccttctcctgaccctacaaccccctccaggttttgcccctattctttgcttcccttgacagcaactcctgaaaagagttgtatagactactcacattgtccagtttcccattcctttcccatgaacccagtctagtcaatatcacaatcttatttattccactaaaacagctctggtcaagtcactactgaccttcatgttgctaagtccagtgttcaaatcccagggcttcttcttggcctgtcagcaacatttgacatccatccttctgaaacactgtcttctctgggcttctggaacacctgctctcttggttgtccttctacctcctggctgctccttctcagatcctactgattcttcctcatctcccctctcccacctcttcacactggaatgccataggcctccatccttgctcctcctctttttctctgttgaagctgaaaaaactcaaactgctctcacaccacacagcaacaatcaatacagaagacttctgtgaccagaagtgtggagatttcttcccaccaacaagcaagcaatcaactctgcagcagactgcagctgggtgtcctcccaactaaattcaaacactatctacctggagatagcatcagatcccacagattgagggctcagtcccacaaccctcacctcttcagacaccagtcataagtccaggccgctgaaacttctgccaaccaactacaaattggggacaccacagcctcttcctctttggggttggttaatttgctacagcagctcacagaattcagggaaacatttacttatgtttaccggtttgttacaagagatattacaaagaatatagataaagagatgcacaggacaagttacaggagaggaggggagcagagcttccataccctccccaggcacaacaccttccaggaacctccatgtgtacagctattcaaaagctccccaaatcctgtccttttggggttttatggaggccttattactataggcatgattgattaaaccatcggccattggtgatcaacttaacctttggtacctctcccctacccagagattgaggggtggggctgaaagtcccaaccctctaatcctgcctgggtctttgtgaccccatcctgaagctgcctagaggctgccagccatcagacatctttggcgtttctaaggattttaggagttgtatgccaggaaatgagctagaggaccaaatatatatttcacagtatacctctggtcttcaaacctggattccttacattaaaaaaatataggccaatgtggtgaaaccccatc

SEQ ID NO: 50225 - DNA, 1034 bp, Homo sapiens
gaatcagccactgtgcttatctagattgcaggcaacaatgctagtctagcaagtgctgccccctcagtccactcccattcatgttagaaataaattttcggtgccacaaagaagaatcaaatcagcactcccgcaaaaagttttctcagcaaggcaaattaacttccatagaagcgtgcgtctcgcgggtggagcaatggcgagagcacacagaacaaaggaaagcaggggtttttattcctaatgcaatgagtttctactactgtgtcctgtctccattggatggagctggaccacacaatcgaaactggtcttggttggctaatttgaagtgtgcagggagggggttacactggcgggaagggcagttttgggggtaagagctgttatggcaggaggggtaatttgcagagtgagtgactaagggcaacgagcaagaaacagctgtggactatagactggcgggaaggttgtttacttcagtcaggggcaaggagacatgaagaacaaggaagttgagattgagaacaaagaacaagggagttaacatgccaaacttttgaagagaaactgattgtatctgacattcagatagagtaaggttccataggcacagcagaacgagtgggctgtttttaccaccagggagtatagctgcatttattgttagccccaattttgccagatgggataaggcacaagccaccccttaggagtccaccccacaatcagacccttaggaattctgactcaaagtttaaaaacatagttacagtttcttacttaggaattgcccctgcttccagcacttgtagttgcagccctggtcctaggaccaatgcatcaggtaggggaaatgtaaaaaaaaagttgaggtgatgtgggaaagaaaaataaagagtgatcattataccagtgtactcctcccttagcaagaaatgcatagtcataccagcatccttccacacctcctcttcccggatacctcagaaaagcggagaaatctattgagtggggaaattcccttagcccca

SEQ ID NO: 50226 - DNA, 1040 bp, Homo sapiens
tctgtagtaacccaatacaaatattggtgcaaactcgtttgtaaaattgtttgtggatggcttatttgcaatccatctttatcaaaaatagaaacaaaactcaaagttttcttataacttactagaatcaaatattatagagctaaaatagaacttcatgatcatctgtggactgagaccctttgttttaaagttgaagaagctgaggcccagaggaactcactgtaagcacagactgcacccagggttgggtcccagtttggttactaatgagttaacccactctgtttctaattgccctgcactatctccatttgtcaacataatacactgtttggggcatttcataatggatttggcaaatcctgggaagtgccaagtatgcctcagatcaaatgaatagttataaagaattgtgaaaccatgactagtctaaaacaataaaaattttaaaaataaaaaatagaattgtgaaaccaatttttttgttcaggattgtcgaatcagtctgtgacctactaactaaatgaaagctaagtgtgtacatctggggaggaagacttgcatcaagcactccctctcatccttgagtagttaaaccagtgggagtctgaaaaagagaacagaaatctaatttcatcaaacctgagcattttagttatcagtaaatcttcacttaaaatttacagaagtaccttgccatttctcataaacccgcaatgcttaccttatttcatgtttatttcataaattctctatgatgtttgctaatatttctctccaaaacaaaagtgagaactgcctaaagtgtccagattgtgttctgctgctgttcatctttgccttgccaccatttacttaagaacagtgactcatccagggttacatggccgttcattacagagtagtttggcttttagaattcccatcacttttacttcagtaatgtatcatgttccaggaaggaattacatagaacaaaaaacagttttaattaatttagagaagaacagaaatggaatgctatttctaagtgattg

SEQ ID NO: 50227 - DNA, 1031 bp, Homo sapiens
ctttgtctgaaaaacaaaatttgatgtgaatagttacatgcctgggatttataattttacttagagaaatgtatagttcttagattgtaaaacaatttgtaagtgatgattgatttttcctagaaatataatttaaaaaattttaaggcacatgtaaccaattcatgttggccaaagtattacagaagtattttgcggccacaataatagagagttgactggtttttaattaccacattacttatatatagttttcaaaatggtgtctttttgtggctaggctaaaacactcctttataacctaatactattagaagagtctcttttcatatttcagaagttaactcagttctacatgaacaaaaattcaggcaagatcctgaattgaacagaagtatagcaaccaaggacagactccaaaatcccagggtcattaccaaagaatatttaaaatgtcctttcaaatatttaatgttaaactgtcatacttcaataaaagtttacacatgtatgtcaaaactgtagttacagccagatgtggtggctctgcacctgtagtctcagcactttgggaggctaaggtgggaggaatgcttgagaccaggatttcaagaacaccctggacaacatagcgagaccctgtctctataaaaaatacaaaaactagaccgggtatgttggctcatgcctgttatcccagcactttgggaggccaaggccagcctgggcaacatggtgaaaccatgtctctacagaaaaattagccaggcatcctggcatgtgcctggagtcccagctacttgggaggctgaggtttgaggatcagttgagcctaggagttcaaggctgcagtgagctatgatcattctactgcactccaggctgggtaacagaaagagaccctgtctcaaaaacaaacaaaaaaaaactgtagctgctatgcttgttggttagagtgtccttgtgtgtaatttgctatctgagtttttcagaggattttttttaaaggatatgatgttttaatcacaaca

SEQ ID NO: 50228 - DNA, 1044 bp, Homo sapiens
ttcaagtgattctcctgcctcagcctcccaagtagctgggattacaggatgcgccaccatgcccggctaatttttgtatttcttttaatagagatggggtttcaccatgttggccaggctgatcttgaactcctgacctcaagtgatccgcacgcctcaacctcccaaagtgcttggattgtaggcatgaactacctactgttcctagcctaggatttatgaaaactttttatcatttgaaaaacagttatattaaatgatttcctctgtcttaccatttcttttacaattatagcatcttagacaaacatagctggaaacaacttggagaccaccttaatacagctttgagctcagcatgacttgaatgtcttcaaattcattgccctgactccttctggctgaagagcaagggacctagtctcagggatggagcagccatggctatggcacaaaataaagaatatgctcaatgtgtggtcgctgtgtttttgtactgctggggctagggcgaaggagcaaatgaaagtttatgtgtgttctttaggcttctgatctatacgcggtagaactaaagctaaatattctcttttcttttgtgcaatgttctctaaagcacattccagggtttttttaaatcccatcttctattattttgagtttttattacaattttaaatttttattctttcttgtccctcaaaattttaaagcattctttcataccaaaaatagtcaatactagtgaaactcaatggaagaaggggatttttcccttcttgaaccacaataacacggggatacctggcaggtatgctgacaggattgatgtgaaaccagtaccacttttactctggtccccagtcatctttattgcttttccttaacttcaagcctatctctgccactgggctacatgtcaggataagcaggatggtagtgtgaagagatgatgtcatacaatgacatgacttgtggtctctcctaatcttgagatttatagaaaaggtagatgtttatacacatcaaaatgaaagcctattg

SEQ ID NO: 50229 - DNA, 1050 bp, Homo sapiens
ttgattgtacatacctgtgtgggtatgtttcaaaactctatattgtttcatagacttattgatctgtctttagggtaataccacactatcttgattactgtaattttatgtgtctttggattttttaaaaaatagagacagggtatctctctgttgcccaggctggagtgcagtggggtgatctcagctcactgtaaccttgacccctcgggttcaatcaatcctcccacctcagcctcccgagtagctggaactacaggcgtgcaccatcacacctggccaatttttgtatgttttgtagagatgggatttcaccatgttgcccaggctggtcttgaactcctgggctcaaacaatccacccacctcagcctcccaaagtgctgggattacaagtgtgagccactgcacccagccctgtagttttatacgtcttgaaatcaggtgtcagtgtcccaactttgttctactttatcaaaattgtttgcacttttctaggtccttttcgtatgaattttagaattagtttgtccatttcagcaaacacacacacacacacacacacacacacacacacacacacacacacacagaaggcctcctgggatttttattgggattatgttgaatacaggtagtcctcaccttgcatggcactatgttaaatgaaacgtgcatattgaaaccaaggcctcaccatgcacagttccaatattcatgtttcagttaacacagtactagcactgtgcaaagtaagtatggcctatatgtagaataatttgggggagaactgacatattaatgatactgagtcttccaacccatcaacccaatatcattcttttatttgtatctctcatatatctctcagcagcattttatagtttttagtataaatgttttttcaacgttttgtaagaatttttctctgtatttcatatatttgatgctattacaaaatttttctagtttcaatatcctttttttaacttctggaatatataaatacaactgatatacaattgtatatcagtcttgtattctacagtct

SEQ ID NO: 50230 - DNA, 1069 bp, Homo sapiens
cagacagctccattgggcccctaccttcaacattggggatcaatcttcaacatgaggtttcaggggacaaacatcccaactatagcaacccctcttgcaataccatctttaattggcctgactcagagatcacccagtgcaaaaaaagtttcctctgggggcatttgccaaaaacctttagaggtagttgtttaatttcattgctgcctgaggcatagataacagctgggcaaacaaaaagctaacctaaaagcttaaaacaaaaagctagctaatgagatgcccatagaggctttgaaaaagctacaacgtattctctagaaaatactatgttaagaaggccatgcacatatataaggctatgaacaagctcaggaaaaatctaagaaggccttaatttctcacctctagctgactttcaggctacataaacaggaattgaatgataaggtagaaatgtgaactccctgactgagtgttgaaggtatgccctacacatccacaaaacccttgagcaaagactaaactaaataagcagagacttaagtggccacacataaaaaagaatacagactgcagaatgtgttcccccaaaaaatcactaagcaaagagcaggagtaacaataaacagcaacaataaatcctgcagaaaaggagattctgatttttagagttgacacataatattatttaagacactcagttttcaacaaaaaattatgaggcatgcaaagaaacaagaaaatatagctcacactttggggggaaaagcaatccatagaaactgttcctgagcaaacccagatgttggacttactagaaaaagagttaccaaatggaaagtatcaataatgagatagaaactataaaaaacaaaaagagaaaatcaaatcaaaattctggaattgaaaaatacagtaactaaagaggctcagcagcagatatgagcaggcagaataaagaatcggaaccagaagacatgaagataggttcattataattatctggtcttcagaactgaaagataaaagaatgagcaaaatgagcagagcctcagagacctctggg

SEQ ID NO: 50231 - DNA, 1047 bp, Homo sapiens
gctcactccttcattactttgccattgctttggctatataaatgtcttcaagtcctattctgaagacaaagccacccattctattgatccctcatactcttaagcctccttgaacttaatagaatcatgtactcttttcatatccttcctatatggtaggaccacagcgtatagatattaaatgacatccagttggatttgggatattactcatgactttatctgattttggtcggagtttagtggtattcaagtgaaaatatgcaattggccctttatgtttatggcaccagaattaagtttttccatcttctttagcacagcgactcagtataaagttaggaaacaatcaaaattccatctccaccacctctacctttttttcttgcgatgggattcccatgccctctgttgctcatgttcacacaagctttcttgattctgacttggacacattttattataagatgtataatatatgtaataaatagtaaattatttcattatataaagtctctgtgaacagtgcttcccctccctcaacttctttcaacccttttccagtcactatgggcaacacatcttaactcctctgctcttctggtccatttacaaattgttagggtccaaaaatgacctcattcatggcttagcatagaaggagatgctacataagaagacacatattttgaagtaaaatttaacacagtaaaaaggaatccataagttcaaataatatctagaaatatctatatttaccgttacattctttcccaaataaacttatctcttaagcaacagataatttaaaatctattttattctttattctttcctttttgtttcattttattattttatttttggcttagtggtttgtttgctctttgttaattacctcaatattttttcttgttttcctagtgtacttgtattcaaatacattattgagtgaaataggtctttaaagggttatctaagaacctaccatatgctatttatttggataggtcattataatacaaatgataaataaaaagagcccct

SEQ ID NO: 50232 - DNA, 1027 bp, Homo sapiens
aaaaaaacaaaacaaaaaacctgccaaccatgtattatatacctggaaaggctgtttttcagaaatgaagtagagataaagacttccctgtgggagttcatgtcccactagacctactttacaagaaatgctaaagggagttcttcaagttgaaacaaaaggactctaacaacacgaaaacatatgaaagtgtaaaactcactataaaagtaagaatatagttaaattcaaaatactctaatgctgtaatgatggtgcataaatctctcttaattctattataaaagttaaagacaaatattaaaaatgactatagttgcaataatttgttgatatgcaatatatacaagctgtaaattgtgacatcaataatagtggggcagaggagaaaaagtgtcgtacttttatatgtggttgaagttatcaatgtaagatattttataattataagatggtttatgtacacctcatggcacaaagaaaaaatctgtagtagattcacaaaagataaaggaatcaaagcattctcttacagagaaatcatcaaatcagaaaggaagggacaagagaggaagagtggaacaaaggaactacaaaacagaaaacaaggtatcagtagtgagtttttacccatcaataattactttaaatggcttaaattcttcaatcagaagacacagaatgaatgactggataaaaagaaataagactcaaccatatgctacctacaagaaactcactttagttttaaggacacacataggctggaagtgaagtggaaaaagatattctgtgcaaatggtaaccaaaagaaatagaggtggctatatttatataaaacaagatagactattaagtcaaaaactgtcacaagagacaaaaaggataattttataatgataaggggtcaattcatccagacgatacaacaattataaaatatatatgcacccaacatcagaacatttacatatataaagcaaatattaatagaagtgaagagagaagtagatagcaatacaataat

SEQ ID NO: 50233 - DNA, 1040 bp, Homo sapiens
tgtcctgccctcatgtgcataggaggctggggcagccccaagagctagaggtaagctttaataatttccctgggttccttggcagctggctgtgcttaggagccgggtgctacttccagagtagcaactgctgtagaaaagttctgccaaatgtgtagattttgaaccattttaaaggctatagtgttcagactcaaattttttagtaggcagagagtattatttaagggtacttatgctgcagtattggataaggttcgttgtgaaatagatactacaacaaggcctccatgtgacataaacttattggaacttgtgtacttttaaaaccatatgtttaatacatattttgagcttcattaggtcaggattcttggctatcatagtcattgttgtatctctacaacctagagtagtgtctggtacatagtagatgttcagtatatagttgaatcagttcaaacaaggggaagaagtgactgaacacattagaaaaggtaaaatttatggcctataatgcacaaagtcagaagttcatattttcttttagtgctaatatcttgctgcttcaaaaccatttagttctcataatgttcttttgaaataggttagtagacatagaattgtatagtatatgccgaacatagtagtggaatcctgaataatacctggtttccctagttgagatctgtaagaccaatgctctaattagatgaagaaaagaagtttctaaggttgaaatggaatggagaattttatagtgagtggaattactaatgactggcttacttgatctatctaaaacgatttcattgcttgtaaaatggagacagtagactttaactgatagtattgtttgaagattaaataagatagtgagtatgaagtccttggagacttgcaggtgtgcagtgagcatgaattgttttcaacatcaacagtaatttttgagagcttcctaatcagtcacctagctagtcccacccagccttaggcaaagcgaaggggccataggccaaatcctgccgtctgctttatat

SEQ ID NO: 50234 - DNA, 1050 bp, Homo sapiens
cttcttaaaaatactctttttaagttttatgtgttgtaaatagcatctcctagtccacagatttatttttcactttattttttggtgcattttatagtccagaagtatgtaactttagtacagttgaatttattgaccttttcctttagagtttgtgccttttatattttaagaaatcctgaccgagcaggaacccacatccaggaacagagccctttgctcctccctcagaatgaatggagaccagaaatcagatgtttatgcccaagaaaagcaggatttcgttcagcacttcccccagatcattagggtgctgagtgaggatgagatggggcactcagagacaggagatgctgttgaccggctcaaggaggtcctggagtacaatgccattggaggcaagtatcaccaggatttgatggtgctagtagcattctgggagctggtggagccgaggaaacaggatgctgatagtctccagcaggccctgaccgtgggctggtgtgtggaactgctgcaagctttcttcctggtggcagatgacatcatggattcatccgtctcccgccggggacagatctggtggtatcagaagccgggcatgggtttggatgccatcaatgatgctatgcttctggaagtatgtatctaccacctgctgaagctctattgcccagagcagccctattttttcttttttttctttctttcttttttttttttttttttttgagacagagtttcactcttgttgcccaggctgtagtgcaatggtggaatcttggctcaccacaacctctgcctcccaggttcaagtgattctcctgcctcagcctcccgagtagctgggattacaggcatatgccaccacactcggctaattttgtatttttagtagaggcggggtttctccatgttggtcaggctggtcttgaactcccaacctcaggtgatccacccacctcagccttccaaagtgctaggattacaggtgtgagccaccgcacccagcctggagcagccctattacctggacctaatcgagctctt

SEQ ID NO: 50235 - DNA, 1072 bp, Homo sapiens
gccccattcttggtttaatgctttgctgtcactgtctggaaattcttaattttttaacaagaggccccacattctcattttacatgtaattttcttgcaaattatgtagtgggttctgcccaaaactttaggaagaggtcaactacttgaaggtcttaaagaagtctgtgctgggaactatattttgttgtgtatcacattagtaaataagaggtacaaaaagtgaaatcaaactatgtgtacattaatctgtcctccagctacagacttgagatggtgattctgcctcgatttccctgggcacatgatggatccaagcgtaaccagctcacttacctgtggacagagaaaagagaaaccttgttttatttgagggtaaagagaataaaaaatacagagctaggggaagaacgtagcattcagaaacattagaggaaatgagaactcttcttcaccagggcccagaaaaaaattttggaaacccgttagcagtcctaaggtttccttctgtaaatggaaggaagaggtggggactgagatgaaaattcaacagaatgaaatgagaaacagacagggtaaggaaaattagcagtactccccaacagtaggaacaaaattaaagtacacattggagatagtaaagagcaatattcatacagcaaaaaaaaaatttgaatttgatgtcaagagcaaagctgatgctaagaaattgaatggaatgtgaaggacaaagacaaacaaagagagagaagatgatagctgtggaaaaagaagaatggagaatctggagaaccgacatatggataatttgtgttcctaaaaaaggaacgaaggcaaatggaagagaagtaatgaaagtaactgaaacagaaaagttttcccttttttttttttttttatgagatggagtctcgctctattttgcaggctggagtgcagtgtcgcaatcttggctcactgcaacctctgcctcctgggttcaagcgattcttctgcctcagcctcccaagtagctgggaatacaggtgcccgccaccatgccaggctaatttttttttgtatttttagtaga

SEQ ID NO: 50236 - DNA, 1049 bp, Homo sapiens
attgaagtataattgataaagaactgcacatatttcatgtggaaaatttcatgagtttggatatatgcaaacacctgtgataccatcaccataatcaaggtaatggatgtattcaacatctctcaaagtttcattgtatccctttggttttgtgtctgtgtttgtgtatatgttaagaatcacttaacatgagatatacactgtgggtggcagtttttgttcacttctaaagtaaactctgacttcattagaatagtggactggcttatgctctgtcaaatccctaaacatgattgtgatagaatttgactctattcctatttagttacagaaaactactggtgcatgaacaaaaatatgtgaaatatcatggatggggtttggggggacatgtggggccagactttgtgaggttatagaaaatcatggaactggaaagcatctggaagttcttttactcaaagaagcatagattctttcacatttgtgttaaaaacagtgaattagacaattttgacttggtaaagttagcattctggcaatgctgtgaaatcgttcatctctcttcatttacttccacatatagtccctagggtcaaaatttctttctaaaaatgataatttctaaagtcagagatgctttttgggggcaaaatagaattgtccaggtaatcagtttaaaagacagagtaattctactcttccttcagtagaatgacgcacgaagcagcatttctttcatttccagtagaactttgatgcgaatgtgacttttatctctctcagtgtagctttaaacatcaatgggtttctttacttcttggtttggtgtataggttgcccctgttctaaccgtgtggagtgtaagctcttcaaattctaggttaacatttcaagaaatggtctttatcccagttcaaagcaggccttccaacagcaggtggcaggcttaacttttaatagtctttccctccctttaaactctttctcatacctcaaataaatggtctttagccagaatgtatgggagtttttgtttattattattt

SEQ ID NO: 50237 - DNA, 1023 bp, Homo sapiens
cactgtgtgtgtgtgtgtgtttgtgtttgttgttttttgaaatgtatcagtataggtgtcaggcattttactgtctattcactcacatttctttatttgacaaatatttactaaaaggtgactatgatctagtgtactatgctggtacctggggaatctcaaaattatgggactgattcttaccctcaaagagcacatattctcacagggagacacatttctaaacaaattgaagagcaatgtgtcttgtgtttctggctgagaccacagactcagtgatctgggaaccagcccccagtagtatgcagctaactttccagaggaatccaggaaggtcccttagcatcctataagagagctgggccttgcagggagggaagtgcttgtcaggcagtgttcagaagccgaattttgctcctccatcagtccatctgaggagagggaaacttgatgggaagattcaaggaagacgacacaaagaattttgtaccataagaacattgtatgacaaaagaagttctgtacagtgccaaaagcagaggcttggtagagatctgattataaatgaaggttgcaatggtagacatgtgcgatgttgatgcctttagaaaatagcacaaggcttaaaaatgagaccaaatccacagaaaggcctcggtaatagtatagagtagtaatgggttaattgtcactaaataagtctctaagtcatgaattcttgagagaactgactggtttttctactattcacaagctcagagaagttactttattttgacgtccttcttttgtttttacttatcattgatggaatgcaaattattttcctctttcttttatttaaaaacgacaagaattcctcaccatcgttgcacactgctgacattgtatgtagagaatgccttagggttttcttccagagtgtggggagagggacaaagagagatatatatgtacatggatttagggcaattaatttctgaaacttgtccataaaaagactgtttgttacttaggttaaaa

SEQ ID NO: 50238 - DNA, 1015 bp, Homo sapiens
aaggatgacaatcaaagggagccctatttttttgttttgtttttcatcaaatcctcgaatttattccatccctaattccgtggtccttcatggcattcataggggcagctgtgaagaaaagtggtaatgtacctgacgactctctcctgtcggtgtcagggttgcatttactattactgatcccagtaataggatgagtttgatctctcagcatgaaaagaatgaccatattagggatttgtttgttctccagactacagaaagtttgataaccagagtaggacttactggagagataatgtcagaatgaatagagactgtctgtgagaaatttgaacgggctcagtgctgttacctactagctagaaatgggaagcaaggggatgaatgtgaggttgggggcattgagtcaagaagaagatcaggcaattctggagctaggtaaattgggatcattcctggcttgtcacatctacgtgggacatttagactatccacgggctggataccttaggaaagttccttctggctctgggactcactgctctttcagcattgccaatttacatctagtgtgttcttgttagaagtggaaggctcctcttcatttttgagctccttgcgccctgtcattttctctgtatgagagggttttgctattcctttttgagtgaaaacgactcccatagcatattgccattcacactccaccaggtctccccttcacacacacacacacacacacacacacacacacacacaccattctcttgtcctccctgagccagtcctttcaaggttatatcatcctttagtgccaagtacctcccctgacctctttcttcactcatagaaagaggaaccagatttcccctgtgtgactgccatcaatacaaacagcagttttgtttctgttatttcccctttcaacctagtgataaagtttgctgctgctgctctccccaccccgcacaggaagaaagacttccttccttcatctcttgactttgcccag

SEQ ID NO: 50239 - DNA, 1084 bp, Homo sapiens
ccatactccaaaagaccttcccttatttgctatgcatgggtagcagggagattatagagaaactgttctttttcctgctttctttttttactgctgggggagtgatcactttcctacagctcttgtccacctggcccttgaggcgtttggagttttggtaaggtgttaacaaaaattgtctcaggtgccaactaaatttcataagcttatagcagcacaacagactaagacaccacatgggaaatgtacattttacaaaaatatattatacatctaccatgtctaccatgtgccttagaaagttctgggtctggtaatacagcagtgaataaagtccccgctcacatggagggggtaggctgatggtgatggaactcataagtatacggcaggtgttagtaaacactgcggagaaaaataaagctgtgtcagagagagagtacctggggatcaggggtagagcgacgttaaccagggctaataggaaggcctctttgatgttattaggccagtgaggaatcagctgtgggagtgtctggaggaagaggattccaggcagagaaaataaaaaagtaactgcagtagagacgggagcaggctttgtgtgtccaagagacacatcatggcagatcaggtaggactctgttggccacagtaagaagctgtttggaaggtaggaaatgataactagagagagtgaagatggtattctgagagtctatgtgatttattgtagggatcccggagagtcgagccccttgtgcctcataactggagtgtttacaagccgtgtaaggccttcttgcagtaaaatgctacttttgtaatttaaattattatgctatgaaaaccttagcaaagatagataaagttgaactatttgaagcacaattacagctaaaaagcgcaaagtgggcaattcttcctatcacatctactcctcagagagatgtggggtacctgaatgtctaactgtggaatgttttgatttgatttaaatttgccaaaaactcatcttccataaggcatatctttgctgatttttgcactcagtaacaagcagtttagaattttgaactgaagg

SEQ ID NO: 50240 - DNA, 1044 bp, Homo sapiens
tatattattaactataaacaatgtggttatgtaaatgcatcattttagttgatcttttttctttagcctagttctttttttcttttcttttctctctcttttttttttttttttttttttttttgagacagagtcttgcactgtcacccggcctggagtgcaatggtgtgaccttggctcactgaaacctccacctcctgggttcacgtgattctcctgcctcagcctcccgagtagctgggattacaggcacacactgccacgcccggctaatttttttttattttttatttatttattttttatttttagtagagacggggtttcactatgttgaccaggctggtcttgaactcctgaccttgtgatctgcccgcctcagcctcccaaagtgctaggattacaggtgtgagccaccgcgcctggcctagactaattcttaaaggaacagattagatacatacaaaagttgaatttagtatgcttttgtaagttaatataatgattgggacattttgttttcttagctatgctttataacaaaatagttctagttactttcttttaaatggttactaaagtaataacttgctttttaaaaacatagtataactatttaaggtagactatgaagagtaggctgaggtttcattttaaattatctcctctttctgccatggaagagtttaattcccctgatgtgcttatggtattgaaagcccattgttggtgttggtattgaaagaaagcttagtttttctgcgtttcctaaaaggagagggaagaaagatttttaaaagtgaaaatccattgatttttttttttcttgattaggatttgtataatatatctgaagtgagactagagttcttaaagttgagagaaacagtaaatatgtacacgcccggcaaaactttgcagggaacattcagagttcggattacctgaaaaaaatcttgaaagcttcagacattttccagagagtgttagtgcgtgaaagtggtacccatgaccccaagagggtgtccattcacagcctccatt

SEQ ID NO: 50241 - DNA, 1073 bp, Homo sapiens
gtcaatagaagtaatcatgtgatgtctacttatagaagcaaatggaaaaaatttttcttctttaactgctaacaagtatataggcaattttagcaatcttcatttattaatttgaatatataattataactgttattaacagaataagttttgggtaatataggaaataataattatttctttctttttaagccaaattggaagttgaatctacttttggttcctgttctgttactttcaaaatcttaaaatccttaactcaaaagggaaaatgtataataaaacaggatagcagtgctgaaatttctctctcttagcagtggagtgggatgagggtgggggagggagatgaatctagtgagatatattaattgttttttccccctcttgtatacttggataacttttgagatcagttttctcagactagcagctctcaagacttttgcataagtatttattcttaaagaaatagaaagacaagataagcacggctcttaagggcaggtcctccaataagtcaggaaacgggtgatccaaacttgtgaacatgacaagtcaatttgacttaattaaggaatggcattagttttcttgaagcacatgaatttataggtttttagagtcttgaagacagaaaaatggcaacaaagcattaaggtatttacagataatttatattcaactgctagcttatgttttcaactctgtatttcatgtaagtaaatacttggggagaacatgatgatttaataatctggataaatactgccgtgcctgttggaaaaaagcctctaatttttaggttttcctcatccatttaaaatccattgttttgaatgacaaaatgtgatagaaacaggttggaacagtaaatgctagaaagtatatcccagaagaattaactgagaacttcatgttttcaattctatttgccgttctctgttctcaatttgttaatttttaaaagtacatcgaaagtgagtagcattgcttgctctgaattctcctctggggtcattgagagtattcacattttcgtataccctgttaaaagatattaatgccatgca

SEQ ID NO: 50242 - DNA, 1033 bp, Homo sapiens
ggtttgtaaactcagcgtctgctttgggattattttttaatatgtgccagacattcttctgattttcatcctggcttggttgtggctctttctctgtctgtgtgaggctggggtgttccctgttttaaagccgtagttgtcgcagcctgggcgttttctgtttcggcttatggctttttttctcttttcctgaatgagtgtcctttgtgtaaccccagtaattcagaaatcctgcagtcatagggactgccctatcatgtgacttaggtactaggtgctggctgcgattggtcagcagctaattggcgggtccctataagaggtcttgggtcgggcgtccggccactctcctgcctgggctgctgctcaacgggggctgggggtgtgtggggcgggggtggtctgtccagtgattcagccacatgtgatagatgaccaagtgactgctttcttggagtccgcacaccagtggaagactctcaaagtggttgtgaccgacttgatcaaactctaggcttcctgaactggtaactgtcactttaatataggttactgattaaactcagaaaaatgcagcttaaaatctttgccaggaacttgtgtggacttattccctgttcccccccccaccccccttgttctgatttgttttgtcacaggaatgaaatgcagataactctttagaaaacttttgtaggaaaagcgcctcgtgtgatctggaacaaagacgttttataatcagatttatcaagctgcgaagagggagttttagtgaacggaagcagcagcattctgtcaccaggaaatactcctttatccagaattggtaagtgaaaagtggcattgctccctaatagatatcatatgcgtgtgtgggaattgaaaaattgttcacagacccctaacaactgtgttgaacagagaacacataaacagtgaggagttctaaaaaagagcagcacgagaataccgcataaagactgagaagaagccaggtaattaacaaaaatgagctgagtgctatcagtttagc

SEQ ID NO: 50243 - DNA, 1072 bp, Homo sapiens
aactgatcttcccatctcagcttcccaagtaactgagactacaggcgcacaccactgtgcctggctaatttttttattttattttattttattttattttattttgtagagatgaggtctcactatgttgcccaggctgttctccaactcctgggcttaagcaatcctctcacctcggcttcccaaagtgttgggattataggcgtgagccactgcactcggccacaagattgttttttgtttctctcctgaggaactgtaaggttagtactgaaggtgacagctcacccttagagagctgatggtggtagcagacatattgaggcagcagtctctgttccttgcttgtattttttcgcttattcccattcttcagatgaagtgaaagccttagagaaatgaagggactcttctatgtccccacaggtaatagcctcagagacagtattacaacccaggctgtttgtctttaccctgacttgtaactttggtttctgggagcctgacacagttggatcgtttggtattttagaacttacccaagacaggagtggcggtggacaggaagctccatgctggagctccaaaccagccttgaactgaactgttgaatcaggtctgtgtgcatcttcaaactgggctgcgacatggaggggaacagaatggagccttcccccatcactcatttgtaatcccaaccaccctctcttcattttgctggcttttcccccattatgttaccatctgtctccaaaacattgcctgggtaaagacaaactggagcagttgctcgccctcaaacaaaacacagaactacttctcctcactcccattcccccccacactagtgccgagcaccatatttgaggaattccatatttataaagcttgcctgcacctcgatgatgtctgcttgctgtcctttttattattcttcaaatatgttatgtgctgactggaaacgattagcttttgttactgaggggtttgtgggatgcttgaaacagcttcatatagttctcagatggaaatgcatgctgtttgctcctttaagaaatgcaatttcttaatg

SEQ ID NO: 50244 - DNA, 1111 bp, Homo sapiens
caatcatgacctcttccttgaaagcatttttttttcacttggctccttgatgccacacttggtcctttgcctacccagagggtgatccatgccaatcttctttgctgatcctcctggcattgcttcagcctcttcatattcaagtgcctcaggcctccacaacttctgtaactgtcctcactcccaaattatctagtcccttgacattaaatgtcacttaaacactgacgattttatcttggaactctgctcaatttcaaccgttttttctacctctctgcttggatatctgattggcatctcaagcctagcatgtccaaagcttaacttcatttccttctacacactttctcacccctgccatacccaatctgccccatcttggtaaatgtcagtgccatttttaaaattgcaaaatcctagtgctgctattgacctctgtctttagcttctacttcacatcagcaaatcatgtctgctcttcttttaaaatatatctgaaatctgaccacttataatctccactgctaccacctagttcaggcagctgtcatgtcttatctggaggtgatcagttgggtgccctgttccactcttgcctttcgaatcaccctggaaagattcttagatctctcccaatctactcatgtgggtttccatttctctcggagtaaagaccatagcccttgtaaagacaatggcctagaaagtcctatgtgatctgctctcccatctctaccaaacccagtcagtctcatatccctcttcattctcccttgatcattttgctgtggtgacactggcttctttactgtctcttttacaagttttctctgccttgccctctcatttgttgcctagatatttatgaaacctactacttctcttcctttagatctttgtttaaatgcctacttgatcagagaggctttctttcactgatcaccctaaacaaaataagttgctcctaaccctgctcccacccccatgtcccaggattgcctgccttctctatcctgcttgagcactcatcaccgggagcatattatgtagttatttggttatatttccttcctctttagactggacagggaatttgtctcttgttctt

SEQ ID NO: 50245 - DNA, 1050 bp, Homo sapiens
ggtgggattttaccatgttggccaggctggtctcgaactcctgacttcaagtgatccacccacctcggccttccaaagtgctgggattacaaatatatatattttaaaggcagcagaaatagacaaaactcaatcttatttcaggactacagttggtgttcttaaaaggtcagaggaagagctgaatatatctagaggtcaagtacagcagcctgcagggtatggggccagttcaggatggagtgtagaagcagtatttgaggaagggcacagatagaaattcctgatccagctagatttggctctcataaaccctccagtgaagggccgtttcctgtgaagcctgtctcttgctcattgctgtcagccccatttcctctaaaagttggcccacaccttccattgtcctttatggcctctggatacagcaccatctccacacaacacatctgttgcgttctctcagcaagatgatcaagaatttctttacttacttcggcaagtataggatctgctcatttctgggacactttggtttttgccctgaacatctgattaagtatctctcttcagtggttgggtgcctgcagccatctctgtattaccttttgagagttgttttcattctgatgtacaggatccacctcactctgttcatctccgaactaccgacctctccaacctcacatttgactttctgtaaactccagctggagctgctgagagcagagacttgggatatatctcaaaaacctcaagaatacattttgatgtgagagtgccaaagatggtcctagcaaccccaggagtaggaaggcatcactttcagttctgataaggaccaagattctgaagggcagaagatgagaactcaggtcttatcacctttccgaaggtggagatagatgtagcgccccttgccatcctgatatggaagtatgcatataccccctctcccccatttactttgtgattttgatattttttcctctagtaaatccccaagtgaggtctttaaaaaacgtgagaagggaaaagaggatgaaaaga

SEQ ID NO: 50246 - DNA, 1034 bp, Homo sapiens
tgttgccaagaaggttgggaacctgtctgtgacaatctggaagatcccagatcaggtggtctcttctggaattcaaggagatcaagtaactgaatcaaacttgagaattcaacaagaacgtcttgcagctccaattcctgaaaaagccacaaactactggaactcacctaagatgaaattggcaacctgaatagtcctataaccattaataaaacgggattcatacttaaaaatctcctgaaaaagggatcttcagacccagatggtttcagtggtaaattccaacatttaaggaagaaatgacagtctcttctagaataagagggaaaacattctaacttattttataaggccaacattaccctgataccaatggcagtaacaaaacaaaataatgatgacaaaactacagaccagtatcctttataaacatagacaacataagttcatcaaaaaatactagtaacatcatccatcaaatttataaacattcccttcttttaatgtctgtgggatctgtagtgatattccctctttcattcctaatattagttaagttgtgtttcccttttattttttattagttttgctggagttttaacaattgcactgatattttcaaagaatcagcttttggtttcatttttttctattgtttttctgctttcaatttcattgctttctgctttttctttcttgcttgctttggctgtattttgctcttcattttctaacttatttaggtggaggcttagattgttgattagagaccttcttttcttctaatataaacatttaatgttgtaaatttctctgtaagcactattttagctgtatcacacagattttgatatattgtggttttgtttttgtttttgtttttttttttttttgagacagagtctcactctgtcacccaggctggagtgtagtggtgcaatcttggatctctgcaacatctgcttcccgggttcaagtgattctcctgcctcagcctcccgagtagctgggattacaggcacctgccaccacgc

SEQ ID NO: 50247 - DNA, 1074 bp, Homo sapiens
ttttaaaaaatgttaaaacttacattgaaaaaatacatatgccacttttaaaatggaggctttcagcagcatttcgatctatccatatgttatggtttgggccaaattaaccagccaatttcagatctgttttttttttttggaaagcttaggtatatattcacttgaactttctgtcaaatcacagcttgaagaagctatctccaaactgcttttcatgtactggttaaattaaggatgcttctctcaggcagagctcatgttctcctaatttgggctggccatcctttcactggtgctcctcatgctgtgcctccttcttatctgcctctgaagcatcacgctgcctgtgacctttctggtgcccctctgtcttcaagtacctgggctcctggagggcctgggtcagggcctgagtgctcaggagcaggcgggaaaccacaccagagagcccctctcttcctgcccacgcctggagagtcaaggtcagcaaattacctggctagaaagctcccctggggtctctgatcacagccagggcagagaattcttgctataatgattgaaggactcatctctttgcggagaaactcagaaaataacatggatgatactaacctttactcagggctcatgtgtgaggtcgaaggagaagataagaggtttccccgtattctttcatgtgtgtttatttgttaaatatctgtctgttgtgtgccaggctctgaaacagttattacacacttcatctgtactgcaacactgtgaggaagagatgattggccttattttagaaatgaggccatagatacttaagagagcattcaagtcatttgcccaaaatcacattgtaaatgatagagaggatatgcgttaccttcccttttctgatttcaccaagcctataccaagaaaaaacatacagcaaaatggatgttgagtttgagatttcctttcttattcgtatatcagtataaataacaaatttgtttttcaaggcatatttttcattttgcagaattttggtgtaataatgacattggaaaaatatttctgaggttccactttatacca

SEQ ID NO: 50248 - DNA, 1060 bp, Homo sapiens
tagttctctgtctttttaaagatatgatatttaataaaggcatttcatcaagtgattatttcaaattaattatccttacgtcttaaaagatgcagttaccatatggattcccctgttttgtagctgctgcttgggaatttaaaaatttttctgaggccgggcgcggtggctcacgcctgtaatcccagcactttgggaggccgaggcaggtggatcacgaggtcaggagatccgagaccatcctagctaacacggtgaaacctcgtctctactaaaagtaccaaaaattagccgggtgtggtggtgggcgcctgcagtctcagctactcgggaggctgaggcaggagaatggcgtgaacccgggaggcggagcttgcagtgagccaagatcgcgccactgcactccagcctgggcaacagagaaagactcggtctcaaaaaaaaaaaaaaaattctaatgcatgtatgcacatttatgaaatataagtgtgatgtaaacaatgtatacctgaaagaaatgttgtaaatgagccctgtctaaccaccactgaagtcaacaaatacaacatgccagggcccagaagccccctgcttctccttccaatcattatgcatttctcccaaaggtatcctgactttatgaaaaatcacttccttgttttgtttttaaattttgctacctatctctaaattgtatagttttgcttgttgttgagctttctataaatagattgtgtctggctttatttgctcggtatatccagtaacatatttcacatattttattaaatttatttcaggtacttgttctatgttgatgttaacaaaatggcatgtctttcaacattttatttctaacaattgctgataaataaaaattttatttttgcacattaatatattcagcaatcttgataaaccctttaaaattgtagtaatagtggtaatagtaattcctttgatttttctatgaacacaaccttctcatccgtaaataatatcatttttttcttccttctttttcttgccttactgcaatggccaggacctctagtacaat

SEQ ID NO: 50249 - DNA, 1038 bp, Homo sapiens
caggctggtctcgaactcctgacctcgtgatccgcccacctcggcctcccgaagtgttgggattacaggtgtgagccaccgcacctggcctgaaaattctctccaaattctcagatgcctagtcaactcaacgtaagatgtttgcctgggtttagggcaaactatggcctgtggggccgaatctgtgcctgtgtttataaataaaattgaaacacagccacgtccatttatttacctaattgtctatggctactttcatgacgtcaatgtcagagtgacagagatcactatatggcctgcacagcttaaacctttactctctggcccttatggaataactttagcgccctggtatcaataataaagggtaactttttgtatttgtgtgaaattgagaaaagtatctgaagaatcttgattttttttaaagagaaaaaaacagtcagtctaacatttaatagattgttatcttcttccagattacatcaatcttccagattgccttagggccctaatcacaggtcaaattaattttgccccttcaaccaatccttttcaaagtactgaagataatactgtcatcagatgctgacattactacacaaatgcagtatttcatcagtgaattgtgtgtttttatatatcatgttgatgcatgccacttccctcatacagcgcagtgtgtatttttcactggaaccttccaaccttaggctcttccttccctggggtgccgccttgtggtgggctgtgagcccttcatgggcaaactgcatggtttggtcatcgaggaccgtgaatctgctatggagtgactcatgccaaaccctgccaagagcaagctgtcccatcatatacctaagaggtcatgaatcattagactggaacaacctgctggtgaatacaacgtggaaaaaattcctcattctactgattatcaacctcccccgtgccttctctatatatgggcttaagaggaaacttttaaaaaagaataaagaaatgactcattagggctttttggggatagtcttaatt

SEQ ID NO: 50250 - DNA, 1082 bp, Homo sapiens
ctccctactcagccgccatctgtgatcaccagcatggtgggctgcttcctcacacccttgacaccatgttgaatcttaaggcttcagccccttgcttctcttttcttccataaacattcagcccaaatgcactcttcagagaagtcttcaccagcaacctcagttacagctccacagaactttaaaggtccctctagtagccctgatatcagtgctgggatttcacttcatcctctccattttgttcctgcctctagtgggtgagtgccttgtggcagagactgtgtctgatttatttctatgggacttaaccctccgtcagtgctgaataaatgagagagaacaatcattcatttaagtacacttctatagataagtactgctttaagagactgaatgttgattagccacagggaagagaaaagtataagatcagaaacgacttcatggtgtatgttgttatgggaatctatggtattagccagtttattaaatattaaattattttatatgaagtagcacagtgtgataggtagaataatggctctctgctgtggtttggatatggtttctccccagcaaaacttaagctgaagtttgttccccagtgttagaggtggggcctaattaatgggaggtgtttggatcataggggtggatccttcatgaatgggttggtgctgttttcacagtagcgagttgttgctctccctagactggattagttcccacggagaatggattagctcctgagtgagtgggttgttataaagccaggacgcccctcaggttttctgtcttcacaagtgtctctttcctttttgaccttctctgccatgttgtgatgtagcatgaaagccattgccggaagccagggccatgcccttgaactttttagcctgcagagctgtgagctaagaaaacctcttctttataaattgccttgtctcaggttttgttttgtttttttttatagcaatacaaaatggagtaagacaaaatgggctaagacaccctccaaagatgtctatgtatcctaatccctggaacctgtgagcatgttatatggcaaaggggaatta

SEQ ID NO: 50251 - DNA, 1049 bp, Homo sapiens
tttggtgccttgggcaagtcatcaactataagcctcagtttcctcaactagaaagtggatagaataaatagtacagtagctttacctatctcatgtgggtgtttggggaagccaataaaacatttcatgtgtgaaggctctttataaatagtaaagggctataaaaacatcgattatcattaggactaatgatgcagcccttgtcagcagtaaccatctgttgtggctgtcactctcaaaagcaagatgcgaaaatgacccaaaggtatttaaattacgttcaccttgagttttgttcccatatgactgtttttgtttgtttttggtaggtaagctgacactatggttagggtttgagctctgtccttggagccattgaaatgtagagctggaagggacactagaatcaccaaattcccctcttttaagttgtagcttatgaagtttaactgacttacctaagttaacagagctgcttcaaggtataaccacaaagagttttgcttaaactctgatttgtataattaggactataattttgatcaagtaccaaaataatgaaggagatttcttttgctttcaaactttgggattctctattttccttctccctatccccactgatatctttcacttccctcctatttcacagccctctccttccatttggatggtatagcacctctacccacttcagagaagagggtcctctgtctctcacccaaaaccaatcccctacctgtgctcttgattcccacccatttttgcctcctctgggacctaatctaacagtcattctgtctatgacctattttgtcttgctctccctttctgttggttcttcttggtctacaaatgtgtccaaacttgtaagactgtttacttcatcctacataccgcttcttttcaatacttgactattgaaaaggaaactggtaagaagactcatagctttttcaacttcgattaattccttatatggtaatgtacaagtacagggactggtgcttggtagtagctcaggaaagttccttccctccctcctgact

SEQ ID NO: 50252 - DNA, 1035 bp, Homo sapiens
ttcataaaaataacaatatttcaccaagagctttgaccctgaattgatgtgaccttggacttgcctgatgctggaatcagatggctgaactagaagtgaggaggctgctgttctatccccagttagcttctaagtagctatgatgtctgggcacatcctttttattggtctggacttaggtattgtcatctttaacatgagagttggactgttttttgttttctgttttttttaattttttttaaagagacagagtctcacctgttgcccaggctggagtgcagtggcgccatctctgctcactgcaacctccgccccccggggttcaagcgattctcctgtctcagcctcccgagtagctgggattacaggcggctgccaccgcacccagctaattttttgtatttttagtagagacagggtttcaccatcttggccaggctggtcttgaactcctgacctagtgatccacccgcctcggcctcccaaagtgctgggattacagacgtgagccactgcgcccggccgagagttggactattgatctctgaagtctcatcacattctcacactcaagtcttttttttcttttttttttcttttcttttttttttttttgagacggagtctcactttgtcgccagggttggagtgcagtggcacgatcttgactcactgcaacctccaccttccaggttcaagtgattctcctgcctcagcctcccgaatagctcggattacagttgcccgccactacacccagctaattttttgtatttttagtagagatggggtttcaccatgttggccaggctagtcccaaactcctgaccttgtgattcacccaccttggcctcccaaagtgctgggattacaggcgtgagccactgcacccggccttttttttttttttttttctcttcagacagggtcttactccatcgcccaggctggagtgcagtagcatgatcttagctcactacaacctgtgcctccccgggtacaagtgattctcctgcctcagcctcccgagta

SEQ ID NO: 50253 - DNA, 1034 bp, Homo sapiens
ccagtttccttttggcattggtaatttgggctggcctagtggaaataccactggtggtgctatgggatgaggaaggagctcttcagtattggaaaagggaacaacacctttcctcttcatcctggaagctgctgtatatagccttggaaattgggggctttctcattgtgaagcaccctcaagtatttgccattgatttgtctctatcctccgatttaaaaggcattttctaggagaggagagtgtcaggaaacaaaaagagatctgatagattgggactgttcatctatgttcttcctcgccatgtgtgaaaatttaagatattctcctactgagaaacagtagtcctttacccaattataatgtctgtgtgctttcccagctgttacaaactcttcagagtggaaacatgaatttaaacgtctctgatacaccacccatgaaaggaaccttttttgaggactagactacattaggaaaaagtatagttacagtatacaacgcaggaactcagttgaaatatgctaaaacatgtatgaagagatcctagttttcaagaggtagtataataaccatgaataagttctagcttttccagaacttggcttcagtgtacatctgaatgttttagtagagttgttagaagcagttaaaaaaaaaagcagatgtaaatttcacctcattcatgcccatttctactaatcctagagatagagccgtactgtgaagtgaccaaaatgcataaaagaatgggaggcacttacagggtcttaagacccctcatgaccgctaagtgaactctcattgcctcttgccagtcctagattggctgctgacacagttggaggcatgaaaaatccacaacctgagtaatcctctgctgaaataacagctgtgccatttgtgggtgaaaatagaatttttttcctgcccctctggaattttaatttatcttttccaaattttttattatggcatgctcatgcttttcattttattcaacagaagattgagtttttatctcaccatgcctt

SEQ ID NO: 50254 - DNA, 1125 bp, Homo sapiens
gattgggaagaaccatagggaagagctcagtgataactcttctgtaggaaagaatgtggcaaaatatatgggtatctatactttctctatttgtaatccatgcttgccaaatgattctccccctcccctcttctatccccaaggacagtcactgctgttcagtgctgcagctttccttagcccctcaagatcctgccattcattagctttttctcttcatctttttcttgaaaggtctgcattttctgtcactttgatgtcttaaaatgtcccctcccactgccccatgttcttcagacccttcagacccctcaacccccacatctttatagcctgttcccactactatccctcaactcaggctgcaggtatgtatttgttaattgcctcctggacatctccctctggatgtcccacaggtgcctttcatatgaaacatgtgttgttcctctccagtctgcttgtctgctttcccaccctaattaatatatttaccattcctctaggattctgaagtagaattcttggcactgttccggattctcctgcatgacttttatcaccctcacagctcatacttagttggtcatcaaagctgctgagtctttctcctttctctgaaacatctttcatagacatcccctcttccccatattcactaccttgtggttctggttctttaattcccctttaggattgtagtaataacctcccatctgatctccctgattctactcttgcctctaatccatcttccacttgtcatcagctttcttttcctaaaacacagatttaatcatgctgttttttacttaaaaacgatttgtagctctccactgcctacaagaggcattcaaatccctaagcatgatttacaatgtgagactcttcattatttgccttcaatctgttttctctgctctatcatctgccatttcctccccacactccatctgtcctaaactattttccattcctagaacattccttgagttctttcctgcatctatgcttttgcacatgctgtttcttctatttctgatgttcatgcctgtctacctggcaagttactagttttcctttaaaagccagctgaaaagtggcctctttgagccttccttttct

SEQ ID NO: 50255 - DNA, 1114 bp, Homo sapiens
tgcttgtgtctttggcttaaggtgctggagccgggcttacttgtcctaggtagactgtgggacttggaggaggtaaaaaagcttcgcggcgcggttattcgcaattaactccagaaatctcagtgtgtgtctgtcggtcggtctctctctgtctctgtctctctctctctctctctgtctctgtctctctctctctctctcacacacacacacacacacacacacacacacacacacacactcgcacgtctcatggctgcttggatttgccgatagttgttcatgaatttttattcctgtttgttcatttcctgacttttttttttttttttttggaaaaaggacctacctgtattaaaatccgtggggtttcagaaagacccttccgcagtcattcatattcaaatcaaggatagggcattttgatgaaaataccccaccaaactgctgtttggattggacaaaactgtagttcaggttagaattactgttattttaaatagacatcttacaaccttgtggtaaagtaaccttagcctgaatcgcccctgatctttctttgtgtcaatttacagaattctgaattacagatgaacaaagcggtgaagttttcttttaattttaaacgacaggtcttgaaatggctgtaagttgagttctgcgactccatctctttaatgatcggctcagagtggtgtatagttgatgatctgagacttacatatgtttcaatttctaatcaaataatttatcataccattggggagaaggacgccttaggaattttcaacacagaggagaaagaacatttttgtcttttggagcaaatgttttgccactttttccccagatgtccccgttagatgcctagaaaagatgcattgttgacgaataatacatgatttatttctcttttatgtctacaggtggcagtgtagaagccagaccgggagcttccagaagtggtttctgaaagagtcaaatgtacatgagtaagcaagcacaggaatctgaaaaaccacaggtatgtaggacaattaatccacctatctagctttataattattgcattccagtagtactaacccatttgctcttatgttcaatattttga

SEQ ID NO: 50256 - DNA, 1044 bp, Homo sapiens
agagatcagggatgctgctcaatatcctaccatacacagaatagccccccataacaaagaatgatctggccctaaatgtcaatagtgttgaggttgaaaagccttgtgttagcgtctaggagagaagctgtgggtagagtgaagaatggtcctgtatgggaagttgagagacttacagtccgagtaaccttactgaaatcatttcatgttgccaagtctcaatttctgcctttatagtagccccaggctacctctaaggtcctgtccaacttcagcatttccaccacctgccctctgggtagagtggtttaacaggaatccatgcagagaacaagagcagaggggacacaggggctgcaactccccactccagggacactatctcctgtttccaaggcctggagccagttgtgtgtcagaggctgaaatgctgattgaaaccaaaacttccattcaacatgacaaagggagaagggggatctaatttctaattaatcaaatacacgtttgaactgaaaattgggaattaccaacctgagagttaacagttactatttaaggctgatagggcgtatcttactctttgattcaaactgttgcatgttacaagtatttcgtgtgttgtacgagtaaaatggggaaaagaaggtttttgtgggtggaatgtcgggcaattttttaagcacattttgttgtgtatatgttttctttgcagccatttttccttaattcacattttaaagttacctgaagcccatcctcacacacagtggtcccccactaaccaccacgctccccgcctggtgtggcttactagctcgatgtctgaccagtccccaggtgtacgatgtaagtactgcacatcagggttggagtcctggtcaccatgccagggtagtgtcttacgtaggaagaagaaaccatcatactcatgcctccaaatccacagatttttgcttctctaataagctgattagaaatggccatcttccatatgtttatagatttcgcatagtaacagagaaagcttttaccagggtaatg

SEQ ID NO: 50257 - DNA, 1034 bp, Homo sapiens
tttctgggtcctccgtgtttttttttgtttgtttttgtttctccaggctgaaatctgatacccgtaaatctgtcacctaaatctttaacttcaaacagttgcagaggtgcctttcctccagttgctactctgtgaccaccgccccccccccaacccgcccatttttttgtgcttccaagtgcctcccttggcccctgatttccctttctgctcttccttttctgttttctaaaaactcagagtcaagatcaatttattcatttatttgacaaatagttattgagcacctgttctatttcaggcattctttcaggttctgggaaaatatctgcaacaaggtagatgaatctgcatcctgaagggcttggtgacaaggtgataaagggtgagggtggagagtggcagaagcaagagagtggagacactcaggcctcaccagccccactgaagcagaatctgcattttaacagtgtctccagggaatgtgtgtacattttaccattagaaaagccctgatctaggcaatgtatagctctggagagttttaagcagggaagaaaactatctgtgtatcacggtcagagatttgactctggttttttttttgttttgttttgagacagggtttccctctgacgccaaggctggagtgcagtggtgcaatcacagctcattgcagccttgacctcttgggcccgagggatcctcctccctcggcctcctgagtagctaggaccacaggtgtgtgccacttcaccaagctaatttataaaatatttttctagagacagggtcttgctttgttgcacaggctggtctcaaactcctgggctcaagtgatcttaaccctcccaaagtgcagggattacaggcatgagcccactgcctggctgattccctgtttctaaaccctattattaccctctgctgagaaatcttggatccattatcccaatgatatgacaaaggccctgtattagtccattcccacacttctataaagaaccacctgaggctgggtaatttatgaagaa

SEQ ID NO: 50258 - DNA, 1028 bp, Homo sapiens
gcagactaacacaggaacagaaaaccaaataccgcatgttctcattcgtaagtgggagttgaacaatgagaacacatggacagaaggaggggaacatcacacaccagggcctgtcagggggtagggggaaaggggagggagagcattaagacaaatatctaatgcatgcggggcttaacacctagatgatgtgttgataggtgcagcaagccaccatggcacatgtatacctatgtaacaaacctgcacgttctgcacatgtatcccagaacttaaacaaaaaaaaaaagaactgaaaaaaaaaaaaggcataattactttgagaaatggcttgcagtttctcataaagttaaagatatgctgcacatatgaccgagcagtcccactctgggtatttaccttagagaaatgaaaacatgttcatataaaaacttgttcatgggtgttcatggcagctttatttgtgccagccaaaagctggaaagaagccagatatccctcagtaggtgagtgtttatacaatggaatacaacttagcagtaaaatgagatgaagtgttaattcacacaatacttggatgaacctcaaaggtgttacgctgagtgagagaagccagtctcaaaaggttacatactgcatggttccatgtatttaaccttgcaaagacaaaactgtattaatggaaaaaacaaaacaaaacaaaacaaaacaaaaagcagtggttgctggggttaatatgtaggatgaaggtatcagtgtgaagagatagtacaagagagttttgggggagtggtagaactatttggtatccttgttgcagtggtgcttacatgaatctatatgtgtgttaaaattcatagaactgtacaccaaaagaaaaaataattcattgtataacaataaagcaaaaaaaaaattttaagacaacatcagagaaattttaaaaaagaaaggaaaaatataggtcatagatttggggaaaatattttcaaattgtattttcaataagggacttctatccagaaaac

SEQ ID NO: 50259 - DNA, 1050 bp, Homo sapiens
ctgaggcaggcagaacacctgaggccaggagttcgagaccagcctggacaacatggcgaaaccccacctctattaaaaatataaaaattagccaggtgtggtcgtgtgtgcctgtaatcccagctactcgggaggctgaggcaggagaattgcttgaacctgggaggcggaggtggtggtgagctgagatcatggagaataaaagaaagaaagaacaaataaaaagttcacctgagaagaatggctgcccctgggcagaacctagatgcctccagtgcaggtgaatgacataaggataactcccaggtatctggttctcacagggacagggaatgcagagaagaaacaacactgatggggaggagagagacttactcttggatctgttgagttagaggtgtcagagagatggcaagcagaggtttagatgtaggttgtggaacaccatgggagaactctgtgctcaacctacagttgctagaactgctcctttaaagttcctgctgggtgagtgacttttaaaatataacctcttattatggaaggtttcaaacacagtagagacaatagtataataaaccaaatcccatgtacccattaccatgctttgttaattaccagctcatgatccgtcttattacatctataccttccagctacctcttcccatgtcaaggtgattttgacacaaattctagatgtcgtgtcattttattaggttggtgcaaaagtaattgcggcttttgccattactttcaatggcaaaagccgcaactacttttgcaccaacctgatatttgtaaatatttcaatatttatctctgaaagacagtcttgtaaaaatatagctacaataccttatccatccttaaaaaccatagtaattttgtgatatttgtcaaatatccagtgagttcgcatttccccagttgattttttttaagcttcatttatgatgtaactaagggccctccaacagcatttggttgatatgtctctgtgtctcataaatctctcttaatctgtagatttgggtgtaaaacttttcag

SEQ ID NO: 50260 - DNA, 1074 bp, Homo sapiens
cttctctggagacaaatacactcatcagttgagccatttctgcctgaatgtgccatgctgtatttaaaatcagcgtatgtaataacgcagttggcactgttgctctagagtgccatcaacacccacctagatgttgaggtgccctcccttctcacattgcctaatggttccccggagaaccttgagaaccccactgctatagtataaactaaaagaatggctgctggaatttccttacgatgcttttttgcttttgtagaattcaccttcagttagctatgaactctcagaggatagcaattgttgtatgctgtttctggcatatcccctttagtgctttacacagtcttatacatacagtagggtttttttttgttgttgttgttattttaggtaacattttttgaactttttttgttagtttaggtaatgggtgtaggcatttgtttttaaaaacatcaaaaaaagtaactgctggcagaaaatgtaatgaaaagaagatgagcagctgcctgttgtattatgtattatgatagcttagtacctttaaatttttttttctgaacttatttttatttttgagaacagagtctcactctgtcacccatgctggagtgcagtggtgtgatctcagctcactgcagccttgacctcctgggttcaagcaatcctcccacttcagcctcctgagtagctgggaccacaggtgcgcaccaccgcagcaggctaatttttgtatttttttttacagagacagagttccactttgttgcccacgccggtctcgaactcctgggctcaagtgatcctcctgccttagcctcctaagtagctgggatgacaggcatgtgtcaccacgagtttagtgcctttttcagtggaacttctttccttgttctctgatagtgtaccactgtcctacctcagcacatcccacgacactgcctgagctcctttcctccttaccacttacaacatactatttaacgcatttatcttatttttaaacatctttccccctgctagaatgtaagccctatgaagggagggcaggatttttgtccctgttgttga

SEQ ID NO: 50261 - DNA, 1050 bp, Homo sapiens
gggatcttattggagtgattgtgttgatggttgcataacttgttaaatttactaaaaatcattgaatcgtatgcttaaattgagtgaattttgtgggatgtgaattataactcaataaaattgatttaaaaaaacaataagtgtggtgatgcaaaaaaaaaaatgactgtggccagtttggccatttcttgtagaagagtctcagccacctgaaggcttccagatccttaataactcatcaggtccctgccagcacagggaacatcatagacctgtcagcacttaaaggaacaaaagtaatgaacatttacattaaaaaatgagtgtgaaataatgacattcccagaaaaacaaagattgaaatgttaatgtctgttcatttttgcttcagtgatttggtattctgtttttagatgtgtccactttaataatttttatatcttcctgatgacattatgatgaagggtctttccgtctataatatttattgtctagagtttatttcatctgatataaatgtagttactgtagtgcttttatgattggtgttacctggcatatgttttccagtccttttactttaaacgtatgtgtgtgagtgtgtgtgtgtgtgtgtgttttaatctacaacaatggttctcaactgggcaatttagcccccttgtgacatgtgacagtagctggaaatatttttggttgtcatacctgcatggcagctactgacatctaatgaataaaggccagggctactactaaatatcctatgatgcacagaagagctcttacaacaaagaattatccagcctgaaatttcagtggtgctaaggttgagaagccctgatctaaaatgtgcctcttttagatagcataaagtggaatcttggttttttccccagtgtgacaattgctgccttttgattgcagtgtttagtccagtcccctttaatgtaagtattcgtatggttggatttatatctgcaattttgctattattttctatatatttcatgaaagttttgattctttgtttttttttcactgccctccatg

SEQ ID NO: 50262 - DNA, 1051 bp, Homo sapiens
atgtggatccatccttgccttcctgggataattctgttggtcaaaggcaattttccttatgagtcatggtcagatttgagttagtaatgtatttttttctttttcctcaactccatgtccctccattcacaattcagaccaggactagagcctgggcagaggtgtatatagggtaggagctcttctctttctatacagtcagtacaagaacagagaaggcaggcccacttctttttctatacagtcagtgtaagaacacagcctgtggtaagcaccaggaggcctgagttagtaatattttatttagaatttttgccactataaaaaatttgcttatagttttcttgtttttagtatatttaacaagtgttggtattaaggttatgccagttattaaaaggaaatcaggagatttccattttttatgtgttaaaatagcatagacattctcttaagttcgactatatacacatttagaactgatgccttttttaaaatggcaaattttaactattttattttctctgattattgctctacagatttctggtgggggggattaattttggtagtgtatgtttgctagagatgttatgtttttgtgcatctgtgcataatgcttcattaatttaccttgatcatttccatacctgtggcaatagcttcttttttcactcctaaaactgtgcatgcttgtgaggtgtgtgggtgtatatatacatatatatatattttttttcctttctcttttaccttgatcagggttctcatgaatattttgttgtcttcttttaatttcttttttttttttcaacctcccgagtagctgggattacaggcgcacaccaccacacccggctaaatttttgtatttttagtagagacgggatttcaccatgttagccaggatggtctcaatctcctgacctcgtgatccacccgcctcggcctcccaaagtgctgggattacaggcatgagcaactgtgcccggcctactctttttttttttttttttagacaggttctcactgtgttgctcaggctgaagta

SEQ ID NO: 50263 - DNA, 1033 bp, Homo sapiens
ctttcatctagattcaccaatttttgaccttttcccacatttatttttactttatttctgtatgtatatgtgtatgtgtgtgtctgcatacacacatatgtatgcatttattttgggggtgacagtttgagagttaatggcagacacaatagcataatgacagcttactcctgctacccacttcagatagtctttatgttagtcatcactgtgcagaccctaatgaggctgtatgttgagccctgtgtagcccagtacctgtccattaattttttagtgagaagcccgtcagtctcttagagaccccgttattgagtaaccagacgcggatttttggaggaaggctcttgcccatattatttaggggagggtgcctgatttgtatttttattgatattgtagatatcaacaaaaatatatttgtagatgttggtgattaatttttattattttgtcagttgctgttttttttaatgcctgagaatttgtcagctatgatttggattttgttgtggactagttgacctgacctcctgatgaaggctactctggctcaataatcagcaggaatggcatgaacaaacctagaaatttgaattaatgatcatcattctccagtgaaggtgcctggcctaggaatacagatatttgtaagagtggggctggccagtctctttagagattataacgttctggctatatattccaagtctgatgtgggggcagatttctcctacaaagcctgacagctgaagtctttgtaattgtcattggtcaggccttaataattaaaaatcacacatagagttttagccaggagctggcctcctcaatttcttaagagcaaggacattctcctatatcattaaattacactgaacacactcagaaagttaacattgatataatactattatgcagtgtatattctttatattttaatctggaagacttcctcagcatttctttgtttttcatgtctgtgacatttttaaagcacataggccatccgtattgtagaacgtccctcact

SEQ ID NO: 50264 - DNA, 1050 bp, Homo sapiens
gagcaagctctgatgtccatttctcttatatgtacaccagttctgctgggttagggccccacccttatgacctcatttaaccttaattgcctttataaaggcccagtctctaaatacagtcacattgcaggttggggcttcaatgtatgaatttgtggagtgggagtacaattcagtccataacagttgggtaatatttttttaatccattttgaaaacttcttccttttaattggtacattcagtccattgacatttaatgcaattattgatactcttggatttaggtatttaccactttattatttgttttctggtttttctccctttttattcctttgtttctcattttctgccttcttttgggttatttgaacattttcttagattacatttttatttgtctattgtgttttttactatatctatttacagagttacatagttttttttttggtggttgccctgcaaattaccatatatatttaagtttacacaacatgcttagcatcaatattttacctctttaaatggagtgtgtgaaccttaccatcttataagtcccttttccctctcccctttatgtttttgttgtcttatgtattaatattactttcacatacattgaaatttctaccagaaaatgttatttctcttccaactgtcaaatgtattttaaagaactcaaggataatctattctatttacccagatttttaccactttgatgttcttccttcattgttcacaatcttaagtttccttctgatatcaattgcctgttatgaagaactgcctttggcagttgtttcagagcaagtctgctggcaacatagtcttggttttccttccttgagaatgtcttctttcaccttcatttctgaaggagatttttactgcatatagatttttcagtggactgttgttttcttttggaactttcacaatgctgttccacttcttctgcacaccctggtttctcatgagaaatccacagtcatttaaatagttgttctcctgtaaataatatgttgtttttcacttgtcctt

SEQ ID NO: 50265 - DNA, 1052 bp, Homo sapiens
tctctgagtcatttgggagcctgtgtccacaatgtgaggtcctaagccgttttgggtctgtgttccagttatgaagtgtctctactgtttgtggccaactttgcacaaaggtttcaaagctgtttggtgatctgtgtccatgactatcagccatctgaaatctttccggataaggacaaagggcaagttccatgaatggttttgaggactgagtccaggatgtgatattccttaagcatttagaggtctgcgtttagagtgggaagactccgaactgtttgggggtctgagcctaggatatgaggtttctaagctgtttggggtccgtgtccagggggtgtgatctcagttcctcagggtttttgtcatagggtgtgaagtctttaagctctatagagggtttatgtccacactttcaggtctgtggggcctctgagctgtttggggatctgtctcggtgtataaaggctgtgagctattttggggaactctatgtccagtatatgacatctctgaacaggaatctgtgtccagggtgtgagcctctgagtagttttcgggcctgtgttccagcataagtgattttagggctctctagcattgtgtccgtggtgcgaggtctctgggctgtctggtggtctgagaagaggttgtgaggtctctgaactgttggtccatttttgtcccagtttgtgagttctctgagaaattggtggatctttatccctgattgtgaagtctctgagtttcccggaggtctgtaatcagatttccacgtctctgagctctttgggtgtggggttacaaagtgtgaggtctctgaagtgtttggtattgtctgttatcaatagaatagaaatatattgattactaggctgccttggctttgaactgttgaggggtctgtgtcagaaggcgtgaggtcatgtttgagctgtaaacagatttgtttcccaggtatgagtcctgtgagcagggtctgtttccaggctgtgagatctctaagctcttggggtctgcttcaaagacttgagtctaagttgtttgtggca

SEQ ID NO: 50266 - DNA, 1029 bp, Homo sapiens
tgatgtagtctttggtttatttcccaaggtgtgagtgctctgatctattcatgggtatatgtcctggcatgtgaagtgtctggtatttttatgtgtatatgtctcagggactgagttctgtgatctgtttgtgggtataaggccccagatgttagttctctgaaatatttgtgggtgtatatctcagcttgtgtggtttttgatctttctgtgagtatgtcacaggatgtgaggtccccgttctttttgggtgtgtgtttcctagaatttggattttctgagctgtgtgtgtgtgtgtgtgtgtgtgtgtgcgcgcgcgcgcgcacatgtcacagggttgaggtccctggtctgtttgttggtgtatgtccaggatgtgagttctctgatctctttgggtgtgtacgtcccacaatttgaggcctctgaattagttgatactctgcatccagcatattaattctctgaaatatattttggggtctataccctaagtctcagaaggattctgaatcctgaatgcgagggttctgcgctttttctggtctacattccaggggggtgagttcactgggctgttttgcggactgtgtttaccttgtgaggtctctgagctgtttgtccactggtgtcctaggatacgtggtccctgagctcttttggtttcaaagtcccttgacctgtttgggatatattttcaggcgtgaagtctctgttccttttcagagggctcagtcccggggtttgatatatctgactcattaggggtttgttccagggttaaggtctctgagcttgtaatgggtgtgtgtgcgccagtgagtgagttttctgagttgtttgaaggtctataggtgtgaaatttcttaactctctggtggttcctgtgcagagtatgatgtctctgaactatttagcagtctctcttttcaggtgtgaggtgtttgtacccttgtatgagaactctgatgtatttgagtatcaccgccaaactgttttgagccaatgtcccaacaaatgagttatctg

SEQ ID NO: 50267 - DNA, 1074 bp, Homo sapiens
tgatagtagatataacatatatatatattgtgtgtgtgtgtgtgtgtataatatatatacctgatttgttgaggtgtgtatgtgtccaagctgtgaagttattgagctatttgtgggttatttcccttggtttgaaaacctctgacctatttgggagtatgtctcagaatataagctctctgatctctttatgggtgtatgttgcaagatttcaggtctgtgatctatttctggctcttttccctagcatgtgaggtctatggcttgattatgggtctgtattgcaggattgagacctctgatttgtttatgggtatctagctcaggttgtgaggtctctgatctgtttgtggctttatgtctcaagatgtcaggtctgtatacctattctgcatatatatcctgcaggtaaggtctctaggctgtttgtagtttcatgttgcaggattcaaggtctctgatctctttttggttgtgtttcttacatgaggtctgtgatctgtttgctagtgaatgtcacagtatgtgagtgtctcttttgtgtgtatttgtcaaggatgtgaggtctaattcaacatgtcccggattgtaagatacctaacctggtagtgggtttatgtctgagaatgtttctttctgcagtgtgtgtgtgtgtgtgtgtgtgtgtgtgtgtgtgtgtgtgtgtgtgtatgtcccaggtttggagatttgatctgttgggggtgcattttgcagcatgtggggcccctgatatcttcgtgggtatatatcctatcatgtcaggtccatgttttctttgagtgtgtatgtcccagatggtgagttctcttatgtgtttgtgagtttaattccaagtgattgaagactctgagtattttttggtatatgtcccagaatgtgtctctgctctttttggatgtctgttagagagtggaggtgtcttatctatttggaagtgtatgactcaggatgtaaagtctgtgaattgtttgtgtgtgtatgtaggtctctggtagctaatggtaccccaaagatgtgcacttcctaatccctgaaacctacaattatgctaat

SEQ ID NO: 50268 - DNA, 1206 bp, Homo sapiens
tctaaaccttgagctgctgaggtttttacaagactggtaagaatcggtaggacaatgcacagtccacacacgctctcctgatttcagtcccttccccctaatcccacaccccttctgaaagtagaattcagggctgggggaagggaagcaagcaatccatataaatgccaggggccagtgtgggcttgggactgtctcagttggaacttaggaatcatgtgcacatgttgtttaatgtaaatgtatgttgggtttaagaaagagtaaacactccccagaattgtgtcttcatctctagtaaatccacagttttacttcagttgttctcttgagaacatgcataatagattgtgcaccatgaggcaaggatgcacagtgagaaaaaactttgttcctcttctgaaaactgtgcttatgagacgggtttatacatttatgtgagaggcagggtatgagctccagagaaagactttaggggaggatgcagggccccagtagctcaaagtagtctcaagagaaataaaaaatagtttggactaaatgaaaatcaaaataaaacttaccaaatttgtgggatgcagcaaagcagtacttacctagagggaaatttaaaaggcacttatggcttctgctgtactttttcttggatcactgactagtagaagccagccatcattcgaggatgctcaagcagccaaaagccggtaaatttgggggttattttttatgtggcaatagataactcataagaggtgtttctgagctctttgatggtctgtctggagttcgagactttggagctttttcgtggtctgtatccatgccatgatgtctgggtcttttgggcattctatgtttcgcatttttaagtgaccttttggggttctctctctaggtttttagatctctgaattatttgggaatctatgtcccaaagcatggggattctgggctgtttttttctgttcatgttcagaacgtgatcaagtccagaatttgaattatctgagctctctggcagtctgttctgggtatgaggtcactggggtgtttggcagtctgtgtcccaggttcacatccatgcactctttggaggacggtgtattgtttctgtttattctttgaggtatatggatttctaagtcccaggaagagacatcaccaaggtgactggattctgcatccagaacactaggtgtcagctgt

SEQ ID NO: 50269 - DNA, 1062 bp, Homo sapiens
gcatctctcccactcttcctgcttgtttgtctgttccctctgtttccctctctttgggccctctgaccttatgtccacgtgcctcttactagtcccatacccctgaccgtacccagccacatgcagctcaggataaggagcctggaatgctggccctggccctattgtgctggcctgctctgtttctgtgtctgtagggtggagtgacagggctagactagaaggctgtcttcaaactgcccctcactcctgcttacatgacccatggtatagacaggctaaggggcaggcccaggcttgggagttatgctaggaaagagatgggccacaagtgtgcccaccgccaacaccttctcagccccagggtgcctgctgttgctctctgaagagagtgttttgcttccccatcttggtctccatctctttcctctctgtctctaattctgtgttagtctctgcctcttcacagtgctacctgcgtgtatctctgcatttctatctccttttctgctcccgggtctttccttctttttctccggccatctgtctgtctctgtctcttactcgttgagtttctctctctctgtttttcctttctcttcatgtctcttttgtctcttgctctttgtctctgtgtctctgtctctctcttcccatctctccctgtttctccctctcttccctgtctcattgtgtgtcttctgctcactctttcaccactattccctcatcccctcaactccaccttacccaccatgatctccctccagccccactgcccccaacccctgcacctcacacgttggtgagtccagggctgcccacccctcccatggcaggggcccagcctcctcacccccagttatcactctccggacagagataaagtttatctcgaggctgggggatatgaaagctccttatcagctgccccactagagtaagtgttgccccaacggcggcagcaggcagcagctggcaccctccactctccctcggccccagcccctcaccccaggtaacgttccaatcccagccctcaagggagggtctcaccgggct

SEQ ID NO: 50270 - DNA, 1075 bp, Homo sapiens
atccccaatcaagatggctatctcagaagcagaaaaactaccttccctggcaccccaggggaatgaagaagccctttcccctgttgcagaagaaaagccctgtcagggtactggccagggcggggctggggttgggcgctgactggaatctgtccagggtgtagtcacctgttttgctctttatctttagcctcttcccccatctttacccttacatacccatccctctaatttctccttcaacacttgacttacctggcctaccctattccatgttggtttcacttgttccgacctgagttgttccctctcttgccctgcttatttgtctcggttcagtataaactccgccttccgggttccagcggttctcctgcctcagcctccagagtagctgggtacaggtgcataccactaagcccgggtaattttttttttttatttgagacggggttttgtcgttttgcccaggctggaactcctgagctcaggtgatcgcccggctcagcctcccaaagtgctgggattacaggcgtgagccaccgcctctggcccggactcttgccctgcttccaaatgctagctaacctgtgagcctttcgcctgtcccctttgccatcctcagtggtgactcacttgtcttcccttatgtgcgtcaactttcctttgcattttcacttgtttatcctcacctgctctgcttttatctgctagcttaacattcctgactcgcacctgatgccagtacgccctcaccccgaccccgccaggtcaaagtttcttcgtccccagattcccgtgtgctctccagggggcgaggcctcgctggaagacgggaaagcggaatttcagtccaaccatgaagcacctggtagtttctgatacggaaagggcggcgccttatggagaagctgccaataaagagccgagatgaaaggggtggctgaaccaatgagtctaggagacaagatcgggggatgatctggaaagcgcgatcagtgaagcggacgaacggcaggataaggcgggtctagtgacaggaatgggccgatgaagctctgtagggatggtgggt

SEQ ID NO: 50271 - DNA, 1069 bp, Homo sapiens
gaccagtaccccctactgactgctaatcttccctctctgcttcttggcctacagactgctgtgccctaatccgccggtgcctggcccccaaaccttcttcccgaccctcactggaagagatcctgctggacccctggatgcaaacaccagccgaggatgtacccctcaacccctccaaaggaggccctgcccctttggcctggtccttgctaccctaagcctggcctggcctggcctggcccccaatggtcagaagagccatcccatggccatgtcacagggatagatggacatttgttgacttggttttacaggtcattaccagtcattaaagtccagtattactaaggtaagggattgaggatcaggggttagaagacataaaccaagtctgcccagttcccttcccaatcctacaaaggagccttcctcccagaacctgtggtccctgattctggagggggaacttcttgcttctcattttgctaaggaagtttattttggtgaagttgttcccattctgagccccgggactcttattctgatgatgtgtcaccccacattggcacctcctactaccaccacacaaacttagttcatatgctcttacttgggcaagggtgctttccttccaataccccagtagcttttattttagtaaagggaccctttcccctagcctagggtcccatattgggtcaagctgcttacctgcctcagcccaggattctttattctgggggaggtaatgccctgttgttaccccaaggcttcttttttttttttttttttttgggtgaggggaccctactctgttatcccaagtgctcttattctggtgagaagaaccttacttccataatttgggaaggaatggaagatggacaccaccggacaccaccagacactaggatgggatggatggttttttgggggatgggctaggggaaataaggcttgctgtttgttctcctggggcgctccctccaacttttgcagattcttgcaacctcctcctgagccgggattgtccaattactaaaatgtaaataatcacgtattgtgggga

SEQ ID NO: 50272 - DNA, 1027 bp, Homo sapiens
tccctgtgcccagaatggctgctggatatagaggtcagaaacctctgttggagtctgttttgcccctaactcacaaaaatatcctgtctcctctctcccctgaggtctcacccttacaaaaaaaaaaaaaaaaaatagggagttacttaaggtgatctctcagggcttgttctttggtcttggtttgcctgtctgagttggcttacctatcttttgtgcccgttgagggctggcattttaggatgtggagtcctattttggagcagtgagccagggcttgctctgggcatcttggcatggatctttctcctgggatcatagtggttacagacagccatggtcacagagacatggggtacaggcctggccccaccactcactggctgtgtgatctaggcagattctgtaagtattccaggctggcagcttggctgatacagaaagcacctcccactgggcctggggcctagtaggtgttcagaaggtggcagtgcattttcccagcacataccgatagattctcattcatttctctctctctctcttacagtcatttgctgaggattttggtatcttctattcaggtttcacttctacaaacacaaagtactcctgcttcattttcggaaacacatagcctaacaccaacacaccctccaacatagggttcttttttgttttgtttttaaataaacttaattttagagcaggtttagatttacagaattactgcaaagaggctgggcacggtggcccacacctgtaatcccagcattttgggaagccgaggctggcagatcacctgaggtcaggggttcaagaccagcctggctaacatggtgaaaccctgtctctactaaaaatacaaaaattagctgggtgtggcagtgggtgcctgtaatcccaactactcttgggaggctgaggcaggagaatcacttgaaactgggaggcagaggttgcagtgagccaagattgtgccactgcactccagcttgggcgacagaatgagactctgtctcaaaaa

SEQ ID NO: 50273 - DNA, 1050 bp, Homo sapiens
ttttttttcagcctacaaaggccatgttgacttgtaggagtcaggaaaactgaattcagagttgactctgtcacagactgactctttgtgaccttggacaaaccacaaactccccctgaacctcagtttcctcatgtggaaagcaaagggggtgtgggaatcaatagcatttgaggccaacctgtggaacttagaatgttgttgatttctctgagtggccacgtgtaccctagacaaagtcatctgcccaagaggcctgtggatgtgttcctctcacctgcactctcttgttcttcaagtctggccctgcctgccatatttttccatgaccccgttctagcctacaagggcaagaactctccaggccttggggtagaaaagggaatttccctggtcccccagttcctcctccccaaaggatgttctatgattcagagctcttctctggcatctctgaccctagctgctgctttcttctgcccccacagctgaccaggtgtatggagaccaggacatgcatgaggttgtgcgaaagcattgcatggactatctggtgagaaaatggaggcctttggggaaggggcagggtgggaggatttcttctccacacagaccttaaccttccaatctattctgcagatgaagaatgccgactacttctccaactatgtcacagaggactttaccacctacattaacaggaagcggaaaaacaattgccatggcaaccacattgagatgcaggccatggcagagatgtacaaccgtcctgtggaggtgtaccagtacagcacaggtacttctgcagtgggtaggtgagggaaagatggtgcctcattcgagcctgcccaacctggcctgctgtggatgctccctccttctctttctctgcagaacccatcaacacattccatgggatacatcaaaacgaggacgaacccattcgtgttagctaccatcggaatatccactataattcagtggtgaatcctaacaaggccaccattggtgtggggctgggcctgccatcattcaaaccaggggtgagtg

SEQ ID NO: 50274 - DNA, 1033 bp, Homo sapiens
aaaacttggatcattatcccatgagacaggtgaaaagattgaagcatagaaagggaaatgacatgctcagggccattagccagagctggcctgggaacccagaggtgtccaaaggacacgcattcttttttttttttttttttttttttgagatggagtctccctctgtcgcccaggctggaatgtgcagtggcgtgatctcggctcactgcaacctctgcctcccgggttcaagtgattcttctgcctcagcctcctgagtagctaggattacaggcgtgcaccaccacacctggttaatttttgtgtttttagcagagatggggtttcaccatgttggtcaggctggtctcaaactcctgactttgtgatccacccgctttggcctcccaaagtgttgggattataggcatgagccaccgcatccggccaggacacattctttttatgatcctaggatccttagcttcttagcttggttgtcaactggctggatgaccttggctgtgttccttgacttctctggaccttacctcctccaagtaggagcacgtggccctctgttgttgggagtcttgaggcaggtggctttctgccttctgttcccctggattatcttcctatagggtcctaccatttgctttagagacttctgagaattgcctactccccaggtagctgcctgcctgccattggttcccctgagttaagcaatatccattgcttgcgctcagttctctcccacctcctcttattggggattcatgagcatcattgaaggcttgggtggagtggaggtgggaacctgagcctcagaggtatcctgtggcccaccctgtccctgttatgctcagataacctcctcctggaaacatgactctgcatctctcccttgctccctccctccatgtggctttgactcagcagaaacctctaaccctgaccagggtcctggtgctagcttctgtgggcagagtgaaggccacatggttgtttctacatgggccatgggggagtggcaagggctgtgcat

SEQ ID NO: 50275 - DNA, 1024 bp, Homo sapiens
atgtgtttgttgaaagggtggagtgaatggtctcctctctattctgccaagcagaagaggctcaggcaatgggctctattggactgggaaaaaacttatccctcctacccctctggctcaagtttgtgttttccctgggatgtttcccagaggaagagctgggtttcggggcatcttggacaaaagaaaggcaaagaaagaataggtgggggcctgttaggtgctaggccctgtgttgagacctcaggctagatgtggggtaagcagggcttctggtggagttaggattagagaatgcagcgggcatctgagtcttgggcagtcattgagggtaagccttgggactggctagtgaggacctggcttgtgtagtaactcatatcaagagccgtgtgtgtgtgtgtgtgtgtgtgtgtgtgtgtgtgtgtatctagctagctgttctctgtgtgtgtgtgtgtgtgtgtgtgtgtgtgtgtgtgtgtgtatgtgtgtgtgtatctagctagctgttctccccaaatacccccgacccttggggctagctagtgaggacctggcttgttgtagtaactcgtatcaagagcagtatttgtgtgtgtgtgtgtgtctatatgtatctagctgttctccccaaatactcccgacccttcctcccactggggccttcggtaaggggcctctacttacaggaagagctgaccagggcaggttgaaggcctttccttatcggcactatggctacacatttcccctgactgggctgcctttggcttttctctgtaaaacctcagaagtcctctggcctctcccccgaagtacatggcccttggtctctagaccttatctggaggtttccttggtgcagagtgcataatacatgtgcctgggaaggggactttgtccctgggctttttgctgcccccgtttccagcctcgcctggatggggacagatggcagtcagcttagactgtagtgtgaagccctacaggctgacttcctgccatgtgttgaatagtggaa

SEQ ID NO: 50276 - DNA, 1050 bp, Homo sapiens
ggcgggtggatcacgaggtcaggagttcaagaccagcctggccaagatagtaaaaccccatctctactaaaaatataaaaattagctgggtgtggtggtgggtgcctgtaatcccagctactcgggaggctgaggcagagaattgcttgaacccaggagacggattggaggttgcagtgaggtgggggttgcagtaagctgagattgcgccactgcactccagcctgggtgacagagcgagactccatctcaaaaaaaaaaaaaaaaaaaaaaagagagagagaagtttattctgtcacaattctggaggccagaagtccacaatcagtttcactgcatccaaatcaaagtgttggcagggccacactccttctggaagctctcagggagaatttagaccttctctagcctctcgtggctgccaacattccttggtttatgactgcatcattctaatctctgcctccatcttcaccatcgccttctctgtatatgtggtttccttttctgtctgtatcaaatttccctctgtctctcttttataaggacacttgtgattgcatttaggtcctacctgatactctaagataaccccccatctccagatttaataatgtaagttaattacatctgcaaacactttttttcttttctcttctctttttttttttttttttgaggtggaatctcactctgtcacccaggcgcagtctcggctcaccgcaacctccgcctcctgggttcaagctattctcctgcctcaccctcctgagtagctgggattgcaggcgcccaccaccacacctggctaatttttgtatttttagtagagatggggttttgccatgttggccaggctggtttcaaactcctgaccttagttgatccacccgcctcggcctcccaaagtgctgggattacaggcatgagccactgtgcccgggcttttcttttcttttcagacagtgctggcctctgtcacccaggctggagtgcagtggcgtaatcttggctcactgcaccctccacttcctggactcaagtgatcct

SEQ ID NO: 50277 - DNA, 1048 bp, Homo sapiens
ccagttcagtggggatgggagggagtggagtttggctagttccttgggcatgggaagagggttggaggccttttttcgatgttgtggaaggaagttgactgccatcgtcctggcccccagagtgcggagaagcggaaggccatgctggatgagctagcaatggaaacgctgcaagagaagtcccagcacaaggaagagctgggagcagttcgtctacggcatgagaaggaggtgctgggggtgcgtgcccgctatgagcgtgagctccgagagctgcatgaagacaagaagcgtcaggaggaggagctccgtgggcagatccgggaggagaaggtgggtgggtagatgatgatgcccttcttcctctaaaacctgggaaccacagcgttgctgataggccagtgggtggcatgcatcaggtgcccgctcctctgccttcctggcccatgacagtctgccccatcccaggcccggacacgggagctggagactctccagcagacagtggaagaacttcaagctcaggtacattccatggatggagccaagggctggtttgaacggcgcttgaaggaagccgaggtgagttggtgatgcctggtgaggaacagaggctgattggggccctcatgtcaaaccacagaagcaggagtggtcaggccctggaacttcccgagattttctggacttagggatatccccacagtcccctggctcaatagcagccctctggagtggatcaggggatggccatcagataggacagactgtcacgtgttaaggctgccctgcctttgtgcaaatttggaaaggcacctctttctcctgaaactgtacttctgtcaggaaattaatgcaatacactgatgttattgaacaagaacctgctgggtgcggtggctcacgcctgtaatctcagcactttggaaggccgaggtgggcggatcacttgaggtcaggagttcaagaccagcctggccaacatggtgaaaccctgtctctactaaaaatacaaaaattagccgggcatggtggctggcgcctgtaa

SEQ ID NO: 50278 - DNA, 1026 bp, Homo sapiens
cctggcctcccacaggcaccccaaggtactggcagatgaagacgtcagagtacttcagagtcacacagagaggaggcctacagcttggaagtcatggatcttatagcttgagaagcttggtgctttgttttcattttaaaaattctgattgagtgcctcctgtgtgccatgccctagagcacttactgtgagcctggaactgccctaagcactttacgtttattaactcatttaatcctcacagtaactctatggggtaggaaggatcattatccccatctttaccgatgaggaaactgaggcccagtgcagttaagtgactcatccaaggtcacacaagcaataggttttaaaatcttggagccgtcttcccaatacccccttggcttgagcctcaagtgccatcttactttaagggtttttcttgatgatcccatctggacaaggcaggagttgccctaggtgagtcacagagccctaggattcctcacggaaatctccagggtgcatggactaggaccctggaggcagaaatagttaccgaggggaagttacaggcctgagtgtgagtccctgtttggttgctgatgagctttgaggtccttggccagacactcaaccactttgaacctcagtttcctcatctgtagatgagtgtaacagtctagaacactcctctcagggatcatatccacaagtgctcgtgctgtgcgaggatctcactggttgtttattgaaaggctaagcaagtaggttgaggtccctgggaagcaggggtggatcctgtgtcaccagggctgccccttaccctaaaccttggccccgacaacccacccacctgcccagcagtgctgatctgggacgatgcccgggagggcaaggactccaaggagaagctggtgctggagttcaccttcaccaagccagtgctttctgtgcgcatgcgccatgacaagtgagcctgaggaggaccggggtgggaggtaggaggtccccacagtaagtgagagggatagtcctccctgg

SEQ ID NO: 50279 - DNA, 1032 bp, Homo sapiens
cacacacatatatatatatgggggggggtctcactctgtctcccaggtttgagtgcagtggctcaatcacagctcactgcagcctcaacttcctgagctcaagtgatcctcccacctcagcctcccaagtagctgggactacaggcacgcatcatcacgcctggatgatttttgtattttttgtagagatggggttttgccatgttgcccagggtggtcttggactcctgggctcaagctatcttcccctctgggcctcctaaagtgctgggattacaggtgtgatccacagcacccagcctatattttggaagtagcactcagaggatttgcttgtgggggtgggagaaagaggagtgaaagatgaccctgaggataggtagattaactgatgtgggagaggccaagacaggagcagtttgaggggtaagagcataagtttggttgtggccatctggagtttgagatgcctgttagacatctaaatagccacattgcctggaactcaagggataagttacagagctggacgtatgtgtttgtcattatgtgtcacaggctggaggtgacacattagccagccaagtagatgatatttacagccataaggttgaatgtaattcccaagaaattgaatgtagacagaggcaagaggaccaagagctgagtcctaggatcctcctgcatttaggggtcagctagttgaggaggagccaaaacagggacaaagaaggagcagccaataaggtggaaggaaaacctggactgtgtggtgtcctggaagccaagggaagaaagtgtttccaggaagagagagtggtcagctcggtgcagtgctaccatcatcaagtctgatgacgactgagacctgaacaatgattttaacaatggggaagtcatcgatgaccttgacagctttggaagagggatgggagcggaagcctgcctcaagtaggctcaagagagattggaaggacaggaagtggagtgaacacaagtgctcataactttttgaggaattttcctgtaaag

SEQ ID NO: 50280 - DNA, 1033 bp, Homo sapiens
catcatgttcgctgtgtgaagtctatctctgcttcagtataagctccacaaagacagggatctttgttttgctcaatatagtttatcacaaatggctagaacagtacctgttaagggactatttttttggttggaggaaggagactgtaatctctttggtacctaacccagtgggggcaaggtcaggtatatcttctcagcagaggcagctgggatgaagctggctccaggaaagaagaaaagacataaagccaggacaaaggcataacagcccaacccctatctgagggcgccacccatgtcagaccccctctcctttctgtgtcttttgtctctacaggtcagtgaagcccaggaggacctggggggggcaagagctcaggagaaggcctgccccccttcccacccctataccctaggtctccacccctcaagccaggagaccctgtctttgctgtttatatatatatatattatatataaatatctatttatctgtctgagccctgccctcactccactcccctcatccactaggtgcccagtcttgagtgggccccctctcttaccccgtccctttccctgcatcccttggcccctctctgtttaccctccctgtcccctgaggttaaggggatctaaaaggaggacagggagggaacagacctcggctgtgtggggagggtgggcgtgacttcagactctctcctctctctccctccactcctcccaactctggccttggttcctccagcaatgcctgcctgaacaaaggccgttagggaaatccaactccagggttaaagaaaggcagagattgggggggcttggggtagagaggacagtttaggacccaaggtggtcttggagaggaggtgtggagtggaggggtcagcaggggggttgggttccagacagagtggatctggagtctgaaggagaggagtgcgctagagcattctggggtggggcttggaagggcgctgagggcagggttctagaaggggcgaggctttaagcgaggcagaatggt

SEQ ID NO: 50281 - DNA, 1053 bp, Homo sapiens
taatttccaaaatacataaggaatccatacaactcaataccaaaaaggaacaaataatccaaataaaaatgggcaaagtacctgatatggtttggctgtgtccccacccaaatctcatcttgagattgtaagtctattaaacttctttcttgtgtaaattgcccagtctcgggtatgtctttatcagcagcatgaaaatggactaatacagtaaattggtaccagtagagtggagcactgctgaaaaaatgccccaaatgtggaagcaactttggaattgggtaacaggcagaggttggaaccgtttgaagggctcagaagaagacaggaaaatgtgggaacggttggaactccctagagacttgtagaatggctttgaccaaaatgcttttaatgatatggacaatgaaatccaagctgaggtggtctcagatggagatgaggaacttgttgggaatgggagcaaaggtgactcttgttatgtcttagcaaagagccctacagattagtggaactttgaacttgagagagattaacttgagagagatgaacttgagagaggtggaagaaatttctaagcagcaaagcattcaagaggtgacttgggtgctgttgaaggcattcagttttataaaggaagcagtgcataaaagtttgaaaaatttgtacccagacaatgtaatagaaaagaaaatcccattttctagggagaaattcaagccctctgcagaaatttgcataagtaatgagctgaatattaattcccaagacaatggggaaaatgtctccaagacatgtcagaggtcttcatggcagcccctcccatcacaggcttggaggcctagaagaaaaaagtggtttagtgggctggggccagggtccccatgctgtgtgcagcctgggaacttggtgccctgcgtcccagctgctccagccgtggatgaaaggggccaacatagagcttgggccatggcttcagagggtgcaagcccaaagccttggccgcttccatgtggtgttaagcctgcgagttaacagaagtcaagaattagt

SEQ ID NO: 50282 - DNA, 1088 bp, Homo sapiens
agagggagagctggatttcaaagcttcatccatgctgagctgcaaggggaatggacagaactggaaactggggcagactggagttgccagcctaggctgggctgtgagctccatggagcagatgccgggccatcctgccccggctcctatttaactttttaaaacaaatgtaatttgtagttttgaaagtcaggatagtgactactcttgagggaatagtaactggtaaggggcatgaggaggtggttcaggagtgatggtaaagtactgtttcttgatatgggcaatgattatacaggtttgttcaatttatgagagtttatttaacttcattcttatgatttatacacttttaaacatagatgccgtttttcaatgaaaagttttaatgatgatgatgtaggtatattatttgaagtaaaattatatgtacttcctattatcaagctaaaataacagtttacaaagtatatggcatttctacacatttaaaaaagatatttatgattgtgtttatatatatgtgtgtcatacatagagaaaagtatgaagggtacgctacaaaatgttggcagtggtcatctctgatcagtggcactttaggttttttctcttcctaatatattttattatgttctgaatttattgccatgggcaggaaatgcttattttttatttctcttatttttaaatgagattgaatttgtaagctaacaatgttttatcatagtggtagaatatactgtgttttcaataaagactggctaaattaatgagtttatgcctcactcacacattcaaagaatatatcaaatgcccactatgtgtcatacactctggtttcagaaataaattagagtccttgctctcaagaagattactgtatacaaaaattcaacttcttttgctatgtttttatgcaaatttaacctatagttgtatagaaatctaatatgattgttttattgagatataattcacacaccaaaatattgactctgctaaagggtacaattcagtgcatttcagtattttcacaatgttgttcaaacatcaccattgtttaattccaaaacatttttatcacc

SEQ ID NO: 50283 - DNA, 1042 bp, Homo sapiens
gccatgtggtcactggactgaaaactctttcgtgggtgggaatcagcctgaattatttccatgagtctagagtctgtaacatggaatttaggatattttatgtcttaaatggtcactcctcttttacaaaacttctgatatcgctgctttcctgacttttttacatcatggtatacattggcttataacccctcagttgctgatccagactcattgattgcatctgcattagataattctgtggaagtgaagtgcttgatgcaaagtgattgatgtacataataagctcttggtacatttgtcagttggaggaattattaacataagcctgctaattgtgtgttggtttgtttttccagatgaacagcaaagatgttcagtattgtgctgaaagaaacattgatgtgaacccagtgatcagtggaattgtcaagtacaggtgagcacttctgtgttcccaagaagacagctcatctggtttcttcctgcatcttgggacactccttccctgtctataccactgactcttgctctggttgttgtactcttatacgtgaatagactcttaattcagcacctatagccttttgttgtgcttttttgatgtgtctgccttcattagactatgatgtctttgagagcaaagactatttttccttactctttgcatattctgcatctgagacactacttgaaatatggttggcatcactgaaggttctttgattcaattaatattttgtaatcaccgtgtggcaaaacattccccttccaatctggtgctagtagagtatatgctatctaggcaccatgtgtgtggcttttgtgtatcaggtgtttcagaaatatttcaagacagttgtaagatgtttgaggacaagaattattactcctatttctatgtcataccacacagtagctgcacagttttaagattatgccatcacctagggtaatgttttgtagaatcagtccttcgtgtaacaactctagtgtttttgtactgttgatgatttgcttaaattttattcaaaaactatca

SEQ ID NO: 50284 - DNA, 1044 bp, Homo sapiens
ttgtacttgcatgtgcgccctgactattccatcactgcctcatccctggaaggcattcatgtcagcttcagtttcctgtccagattggtgctgagcctgaaatggagacttgggctggacaaaaaaaggttcatacacaatcttagttaggaagtcacctgcctttctaagatagaccttcatggttactgggatttgtattagttggctgtgatggtaaacttgatgtgtcaacttggcttggccacagtacacaggtatttgttgaaacaccagactaggtgtctctgtgaaggtgttttttaagatgagactaacattaaaatcagtagactttgagtaatgcaaattatactccatgatgtggctgggcctcattcaatcacttgaaagtcttaaagaaaaaaaaaaagactgggatccccccatgaagaaaaaattctgcctcgagactgcccttggattcgagctacattacctcttccctgggtctccagcctgacattctgctctgcacaatttagacttgccagcccccacagcctctctctctctctctccctctacacacacacacacacacacacacacacacacacacacacacacacacacacacacagaggaaccctaaccaaaaggctgcttacatctgggacccttaaagggcatagctgagatcagtactttggtctcactctgttgcatggctcctaaggcagaggcctctggcattctcctcccaccctctgcagactgccagccatggggctcatcactgtgactcagcgtttggtcatccaaccatgtagagatcactacaattccataagtgttccctgccctctttctgtctgtgaggtcctctatcccatcctgaggactcagggatctactgggcatgtttccaaccttccaggagagaccacagagcctggtgagggaaatacacctgcaaagagaagttcagtttagtaacagcaatgggcatagccggtgtgttcaccaactaatgagagatcacactaccaacatctcccgctt

SEQ ID NO: 50285 - DNA, 1052 bp, Homo sapiens
aaagggaacaaaaagaaaaatttctccagccttttcttcagctttgctgctgctactgcagcccctcccagccttccagacagaatctcccctggcagctatgatgttaaccctataattgcaatgaaagccaaaaaaaggaattaaaaatagctttttttttgttttatggctgctgcatctggatgtatgataaaattgatgtgaaatgctatatacttataatgtaataaatgctagagggaccatccccttcagggaaggctggaggggaaatattttttcttttttattttgagacggtctcactctgttgcctaggctgcagtgcagtggtgcaatcatggctcactgtagcctcgaccttctgggttcaagcaatcctcccatctcagcctcacgagtacctgagatcacaggcatgtgccaggatgccaggctaattttcttatctttttgtagagatggagtttctctgtgttgtctaggctggtctttaattcctgggctcaatctgccttatgttagtcatttccagtgaacctgtaaagggccaaagccctcagctcctacacaacaaaggactaatagcctggctttgcttccctaacttttctcctggtgtacacaccttggtaaggcactttgaccattcaatgcagagctgtcaccagcaaagcattgaacttttccagcctgctcgtgaaataaatgatagagacaaaagggataagaagttatgcaaacctacataaatttatttttaaatctggaatttcatcctgatcagtttctgaacatgatgtgtattattggttgatttattaaaatttttttctctgaaaattcttttttccctcttgcatatgaccatttcagagaaaagatctagaggacggtagatgataagtaaagaaatgggaaggtcttttttttttaagagatacttggttttatttaaagtatatattgaattacattgagtgtctttatagtatctattgagattattattttttactttaactgattaatatatcgttacttacatt

SEQ ID NO: 50286 - DNA, 1019 bp, Homo sapiens
catgcccggctaagttttttattttttattttgtagatatggagtctcgctatgttgatcaggctgtttttgaactcctggcctcaagtgatcctcccacctcggtctcccaaagtgctgggattacagacatgagccaccacgcctggcctgggtgtgcatcttctgagctttttggacatttgtgtccctgggtgtgagagctctatgtaggtgtctgcaccccaggatgtgaagtctctgagctgtttgcaattctgggtcccaagttgtgatgtttcccagctggtgttggtgaggacaattttgcttaaggtataaagtatctgagctgtttggaggagggaggggtctctgcccagaatgtaggttctctgatttgtctggggactttatcttaagattatgtgatgtttctgagctacttgaacttctgtttctgttttgtattaggttgggaggtgtctgagtggtttggggggggtctctgtctagggtgtgagatatctgaatggttttaatttgtttcccaggagtgagaactttggtctgttgtgtgtgggggtctttgtcacagcatgtgtggtctctgttctgtttgggggtctgtgtcaagttgtggggtctctgtgcagggattttggagtctgtttcaggttgtgagattagtgagctctttttgatgtctttgagtatctgagctgtttgggagtctgtgtctcaggagtgaaatttcttacctttttggctgtgaggtctcggtccaggaactatgggttttggaggctggcagacatgatttcaaagcctggagcccccaagtcttgattgtgtgacattgggcaagtcacttgtctccttgaacctcagtatgtatcataatcagtaaaatggggccaatatccatcttggagggcatctgtgcatcttagcaatgtgtgtaaagggccccactccagccatccttcaacaagaatttcctgagcgtctgctgtatatttgagtactgttctaggttc

SEQ ID NO: 50287 - DNA, 1061 bp, Homo sapiens
gagtcccttgacttttgtattctgactccaaggtattgttcagacctcagctcctgggggccggcccctggagtcttccctccctggtagcctctaaccagcattcccagacacctgaggcagatagatggatgggctggtgggcaggggggtggctggggctgggccatcaccattccagagacaaggccagtgtatatgcaaactgggggactctcctcccttctctccccagttctggtcctggccaggccatgctacactaacccctgcccccactctcctcccctcttttccttccttcctacccccttctccctctcccttcccctgactgttccacccaggaggaggaaacttcacatagccgtgctcacagttttttattttaaaggaatttggctggggagctgaacagggctccctgtgatctgaagaaagcttttggtgcttgtcctcacaaccacctcagtcctccctccctgtcctcccctgtctcctttcctcctcctgggttcatgttgtaataaaagaagattgttggtgtgtaattaatttgttcaaaagaaaaaaaaaagcaaaacaagaaacttggttccaactgaagcctattttaattttattttattattttcctcttgttagaaataaaacccttagaaacattttttggaaacatgtttctgaagtgcatttctcttagacggggaagacagtgcttccatcaccagtcagtggagcagctgtagtgctggcaggagcactagggctgaagccagggagctctgggttctgaaatcaagttccaccagcttcttaaccttgggcaagacattctgatcctcccccgactctaaccccaagccactttccctcaagtccaaacagatgggctcgggccccctcacccaaactcctacactacaacctcccccagttgatgccctccagtttatcctcctcaagctcccaaagggatttttttgttaatggctttattgagatataatttacatactataaaattcacttgtttgaaatgtacaattcagtgatttggg

SEQ ID NO: 50288 - DNA, 1031 bp, Homo sapiens
gattatgataatgcttatctttttggatagttgattgtattaaagataatgtttgcttagtgactgacccatggcaggtactggtatagcagctatttatcattatttacatgacctagcaaaatagactggcatatgaaacctcactgctgattatctaggtgactgtatcaagttacttgatctttcatatctcactttcctactctaaagtgggaataaatacctaacttgcaagatgtaaggttagagtaaggtgatttatatgaaagccatctctctaacattgcctttgcaatgttgcagctgctattattggtaatgttaatacatgaagaaactgattgaaatttggaatgtttctcaggaattgccattttattacatgcagatggtttattaactccagctagggcaataatattaccaagctgaaggtggtcctgctttaattgatttcttgtaagcttgtgtcagttgtgtgtgtagctgagtggaagctgctacagagctctaaagtccactcgtgtagtttcagccatcatcttcaaatttcacacttgcccagttagggaattgactttgtgagagtctttcataagattacaaaggagtgctggttctgtgggatcccttgctgcctatctagggtaatactttcttattttaaagctcatttatagctttcctgtgagtgtgggctatagggagaactatagctacagtagtgttggaagtctggggcctctcagtcgtggtgtaagttgttgagtccctgggcttttccaggcatcattttctcactctgttcagtactgttattaaatgatggccgtgtggctgtgccaagctgtgggaaggagccaaagcaaggtggggagaatagaccttctcatcttgacattcagaattcttcacacttggcccttacctcagagaagcattctggacaccatagtcttggaatcctgtaagagattgtatgtgtatttaagtatgtttctgggaagaggacttatagtttacatcca

SEQ ID NO: 50289 - DNA, 1056 bp, Homo sapiens
gcagtaatacaggtaagaaagaaatgctgatgttgcctctaagtagagatagatttgagaagaaaatatgacggaggtgggagctgatgcatggtccaaataaatgtggagatatgtttatgaatgggaagatttgatattgttaggatgttaattctccccaaattaatttagactcctggcagaggaatcattgggttgaagggttcttgatatacattagcaaatttgttttccagagagtagaatgtatttattcccttaccggcactgtacctacttcactgtgtcttcaccaaaattgaatgtttatcttaaaaagctttgtgagacttctcagtaaagatgacagattaagcatacacatggctacttccattctgtactgaaactccacaaaaattacataaagggattttttaacgtgaaaaaaattacagagatggagaatacgagagaggagacaatgataaaattcttgaaactagaaaacagatagatgagaaaactgaaacataagccactactgaggacatcttgagaaccagcccgattcatacctcagaatcccccaaagatttgttatcagtggcaccaggcattctaggggtaaagatggatggggtgaaaataaggattggttcatgtctgtataagaagctgtgagggccgggtgcagtggctcacgcctgtaatcccagcactttgggaggccgaggcgggtggatcatgaggtcaggagattgagaccatcctggctaacacagtgaaaccccgtctctaacaaaaatacaaaaaattagccgggcatggtggcggatgcctgtagtcccagctactcgggaggctgaggcaggagaatggcatgaacccgtgaggcggagcttacaatgagccgagatcacaccactgcactccagcctgggcgacagagcgagacaccgtctcaaaaaaaaaagctgtgagataccctcccatgctgggcagctagaaatgtctagtcactctagtaaaagactgaagatttatttctgaagaggttaaaacagagtctct

SEQ ID NO: 50290 - DNA, 1050 bp, Homo sapiens
gctaaggggtggcttattatcacatctacattccagccagtggaagagggaagtggggaagtgcagggctagacaaatcttttaaaggcacacatcatttccattcaccttctgttagtaaaaacttggtcatatgaccacatctagctgcagggaaaactgggaaatgtaattcttattttggatggtcaagtaccacttaaaactggaggtcatgttgttatgacagaagacaagaatgaatatcgaggtacaactagcagcctctgccatactttgtatactcttacccttctcagagcagtggataggtctttttatttaacaggtcaaaagttgaacccagagttctggtctatcctctgtgtacttctttcttaccctttaaaacattttgctgggtatacaacatggcttacctgtgagagactttatattcctgggaatttctagcattgattagcatcagccagttttctggtgtggatcttaaaacagcctgatcactagtcctgtaagaacaggaattagtagatcctctatctctgctttaagtattatccggggctgctactcttccctacacccttccacgctctttggccttggacacattaccacttactctaatgtatgagatagtcaataaatactgaattaatgtctccttcagatattcctagatatctgtacagtagggctttggactaggtcagtggttctcacctgcatttctttttgccttctccttgttttggtatactatatgccccatgagtaatatttttttattataaaatttagtgatatttaaccaaggacttgggatatctagggaattggacagaaggaggtgtcctataacagttcaggcaatcttcctccactcagggagttatccttttctctctctacctcaccccatttaaggatgatgatcaagggcttgagttctgctgctttacaagtagacatggggtctgactttccttagacttctctcttcctgacccatagcacagcatcagtccttgtctataatgccatgga

SEQ ID NO: 50291 - DNA, 1053 bp, Homo sapiens
cagtgggagggggtggccagcctctttgagccatttcttcttcaggcccagacgagagtgaaactgaactacttggaccagattgccaaattctgggaaatccagggctcctccttaaagattcccaatgtagaacggcggatcttggacctctacagtctcagcaaagtaagaacaggtttttgtcaagcacccctcccaccaaaccccaatatccttgatactctgggggcccccttagtttggatattagatctttaggctgcaatggaaggggcacagcttggtagcacacaagctgtcatcagaacatcttggaatcttttgctgcaatttgaggttgggataaggggatagcccccagtgaagtgagggactagagttgccctcattgcccttttgccctttctacaggcctactccctcacatataaatacacgtggcacatccatgtcttttcctacttgttttttcagattgtggtggaggaaggtggttatgaagctatctgcaaggaccgtcggtgggctcgggtagcccagcgcctcaactatccaccaggcaaaaatattggctccttgctacgctcccactacgaacgcattgtttatccctatgaaatgtaccagtctggagccaaccttgtggtaaggatgtcacagtggggcagggtgcggctttacccttcagcacagatttccacacttgctcttaatgaaactggtttagtggactggagacctgggagttggactctgctctttcctagtgatgcttattctctttctacactgctcagggtcagaggtcctggagttatctgtacggctagcttatttgttatgtgacaaagttttaactgatagagaaatcagagaagggagagcttgggctagaaggtgtgggaagagatggcgtctgatttagttggggagatggttggtggaggaagtgactggaagggaggagtgatacaagcaaaggtactgagaattcccaaaatgtgtgctggtgtcagtgctaaagaccagtggaacaggggctgttggtgt

SEQ ID NO: 50292 - DNA, 1086 bp, Homo sapiens
cctcttggctacatcgcgaaaatcaggcccatcgcagagaaatcgggcatttgcaagatccgcccacccgcggtaagccccggggccggttttcgccggcggcgagacggaatgaagcagtaggatagccagcggcgaagtctggggcggagggcagctcgaggtggggagagggggtggctgggaccgttgtggttgcggcgcggatcggaaaaagggtgttgggccaggggtcctctcgtggtgtgaggcccacaggtgacctggagtcagagatccacccccaccccggcccttcagaatcactccgggtttaagacagggattcctagtgggccggagggagttcacagagaggcaccccgcacatctcttagcccgggccacctaggtcgaggctgtaaaaataagacgtttctccaatctgttgtcatcacttcctttaaggcaggcagcatagtatagtattaatagaaagatcgcagtcctgaagggagacagacttgagttcaaaactccactttgaagctgagcagctgtgtgaccttgggaaagtagaagtaatctctctgagcccgtgaaatggatcccagaaatggttatttagaggattgaattaaactaggtagcgtctgtatgtagtacgcactagataagtggtaattattgtgactgtgagggtgtttgatgtggtcattggtttattcctatgtaggttgactcatatttactcataccttgccaggccaattcatctatgataatatcctggcctgctggaccagtcaggaaatcagtctcacagggattgctctgtctcccttgaggtgggttcagggaattgtcctcttcttttcctcgttgaaggcaatgtcaaggccttttctgcacatcatcccgcagacttgacttcctatggagatgtttggaccggtcagcttggtggtggggtgtgagtccttctcagaagatttctactctcctctggtccaggatgtaggagatcccagaggatagggcactcttgggcccgcagaacagaatggagccatggaattctgtcccttttggaacatgattgccagg

SEQ ID NO: 50293 - DNA, 1024 bp, Homo sapiens
cctcttcaacaagtgcgtgctccccgttctagcctgcttaccccttcctaccctgccacatgcacttgggttcctgggacagaactccacacagtgatccccgttctgccatcctttcattttgtggaatggtatttctccccagacattcagggaagaggattggcaacagggtggcagagtagagagtcccttaacacacctgggctcgggtcccagtactgcccctggctggctgtctgatcttgggtgagatgaccccactaaatggattctgaaccttgtcctccccaccttccctttttagaggggaggtgatatggtgtagaaagagccctagtctgggaaacaggagacctggccccctcagtcggcctttggctagactcactgcatagccctgggcaaggtgcattcctcccctgggcttccatttttccacctaccactagcagaatgtgtatgtaagaggtgttgggggcagggtggtgtgctggacccttcagtgactgtgactaagctctttctaggtgcctggtcttctgccaggtgtttaggagtgaggtgggagtgtgacatttgattagaaaataattggaaaatattagatgtaattggaaaacattagatgtaattggaagccattacttgaatgccttacatctttatagcttattaaacactgccacctatatttaattcttacaataactcagcaaggcaggcagtagtgttcctattttgtagataaggaaccaaggcttggagaagcaaaaggaattgtccaaagtcatacaactgggaagtgatggatctgagactcctatggcatcagtcccttccaaattttaaccttgtggggtcctaaggttctggggttctgaatatgggatagctgtgacccagattttggcccagctccctggaaatctagggggcaccttgtctacagaaacactcagagaaagttggtgatacctgcctgagtgggatgtgggacgtggaacaaagtaacctcttcact

SEQ ID NO: 50294 - DNA, 1027 bp, Homo sapiens
gagggtggacctgtgtctgtctttagtatatccccattaccttgggctgggcagctctaccccgggtgtctttgttttgaggctcgatgatatgatacataaagaacgagctttggagacagacagacctggatttgaatctatgttccaccccaacccgcaggatggcctcagctaggtcattttaccttttatgaattttagtttttctgtaaaatgggataacaatgcctattatgcctatttctcaagtttttttttttgtttgtttgcttgcttgcttgttttgagacagggtctctttctatcagccaggctggagaacagtggtgcgatcacagctcactgcagcctcgacatcctgggttcaagtgatcctcctacctcagcctcccaagttgcttggaccacagacatgcactaccatgaccggctaattttttttgtagagacagagtctccctctgttgcctgggctggtcttgaactcttaggctcaagcaatcctcccacttcggccccctaaagtgcagggattataagcgtgagccaccatgcctggcatatttctcaaggttagccaaggtaatttcgatggcattccctgatactgtaggtgctccgtaaatagataatttcgatggcattccctgatactgtaggtgctccgtaaatagtcatttttcttctctttcatgaaatctcccatggacaatgacttaacgaatcaaagctttgcttcccctgaaaactggtatatttcttccttcctaatgtgaggctgtcatagctcattgtatcttcctttttgcctcagccaccagttaatttgaagcatagctctagcatctttgttgatttcttttttggacttattttcgagttcaatttctattctgtgttcttggagtaagcaccctcaaatcctttgtgactcaagcaggtataaataactaatgggtgtaaatagttgaatgaaagtaaggctgaagaggctggactggcgatggtgggatttgaagaggac

SEQ ID NO: 50295 - DNA, 1899 bp, Homo sapiens
cactgacaggagcacaggaaaaacatctagcttatgtgaagattcagagaaggcatcctgtagtctaggtggtgatacctgaactgagtcttgagggacgggtaggaattagccagttgaggaagtagaaggaatttccagatattggaaacagtatgcatgaagacatgaaggcaagaaacagcaaaacaaatactgaagcatgaagattcctggggtggggggaaagcagcaagaaaaggtagagaggaaccagattggaagagggtcgtaaatgcatggctacagaattcagatttgttttgtaggacagtgtggttcccaaactggctgtataccacaaacaggtacggcattctgggccccggcccctaaaacattcattaagtctggggtgaagatttggaatcttgaatgcttataaaggttaccacatgactagggtacagccagatttggaaaccatagcttgaaggcagtgagggagccatgaaatggtttttaatagggggactccagatcagatgtgaacttaacctgtttctggctggctagccaaccagcatggaaaacagattaggttagatgttcatgctgtatgtgcccgtgcctgtagcttccctgttaatcagcttcttacactactatatttgcttattttgtctctgaataagctttaggcaccacaagggtgggcctggggatattttgcttaccagtatagcccctgcaaaaaagcacagtgcctgacacaaaacaggcacccagtaaagtttttgaatgaatgaatgcatgagtgaatccatttgtgagagagcgaatggagatgacaagattagctaggagactggaaaaagaccaggaggcctgcactagggcaaaggccagtaggaatagattggaggtgttaaggtgtgaactgttaaggtaagatgataacttaatgactgattattggatgtggagggtgactgagaggatagaatgagtacccatgaatagccatgattcctaccctgtcccagtcatctctttccttatccatctctgaaacaatctgcttacatcctcctcagcaactggaattcctcaagttagttagacattctgtgtgctgtgtggtctctcactgcccccccactccccacccctccacaagccattgattcattcatccagttcaataaatcttggctaagcacctccagtgtgcagtaaggctcttccaagccaggactctgactccctctttcctacctcaagagatgtttttgagggctttcccaggtaagagtcacatctcttatacaataacttatagtgagatacccagaatgtcagacttgtaagggaagactgcccaaaccccttctgaggtcctcagaggggaattaacttcctaaggtccgactgctaggaagtgttggagccagaaatggaacctaggtttcctttctatgtcatctctggagtcttgatcttgatctatcccattgtagatcaggacaggcagaggtggtcagggagaaggtgggacttaggttgaaccttgaaggtcaatgtattggacaggtcaaacaagatggttgccaattacactgcccccttctggaaacccttagcaaacctgccatgcttgcagtcccttctaaggggtttccttagcataagttgccatgctctgtaccatgtgacctcacaatcctggccacagatagctagatgtggatagtgtctggttcaagggcaaccaatctctaggctggccagtggcctgttagctggactggcataaggacttcaccttacaggggtggcatgtatcaaatggcaaatgtatgaaacaaccagatctttcagggaggcagaatgtgagctattcagaagaagtgaacgtta

SEQ ID NO: 50296 - DNA, 1789 bp, Homo sapiens
tcattctccttttgagaagttagattgttaaagatagtctcattcagctaccaaccactccttgatccttcccttcttagtggctgttgtttgttgtacttccgtttagactttgttttaatgcttgtacgtacatatgtgaactcattggaaatattgtgtgtttaatgcaaatgatatattgaattgtttagcaatttgttttctttgcttaacgatgtttttgagatctgtgcatgttacttaatgtagctcaatccatcttctgtaattgctgtatagattgtcatcatatgattaccacattttacttacgcatttcttttgtgatggacattaagactgtttttaggttttgctattacaaaatactacacaggagcatcactatgcctgtgtgaaagtatatgtatgaaagtttacctagggttgattcctagaagtggaattgcaaagtcataggatatttatatattggtttttaataatacttccaaattgccctcctgtactatttactcagtatttttcttgaggttgatctgaggtctaacattgttatcctatatcattttcatcccaagtagtgatatctgtgaaatcacaggtttgatgtgtgctaattatgtattcttctaatacatattaaaagacataactatcaaaacaaaataaatttgtctgttttcaaccaaagaagtcacgtaccactggtggtactgtgtgccataatttggcaaatgctggcctttatggacgagcacaattcgggggtcagacctggttcaaattctagctgtagaaacttgtgcaagttacttcacctctgagcctaagtttccacatctgtaaaaggagataataaacacctaccttgcagtagtgaagcaaagagaaaattaaatatatatgaagcaatttggctggcatctagatcattcacagccctttaaaggtcacctttgctgttctccccactttacagataaggaaactgaggcccaaaaaggtttgaacccaggtcttccaagtcattcaagtgctttctccactgtacaggtggttatcaaccttggctgcgcatcagaatcgtttgtaaagctttttctttttcctttttaaaaagtaaagcaatatatacacaggtaaaaaaataaaatagtacagaagggcttataatgagaagcagcagttccctgcttgcacccccacatccaaaggatgtggagctctttaaaaataaattgctctggtcccacctctggaaatctgattcagccagcatggataataacccagataactaacccctacctcacaggataaaaaggattacatgagatgccttaggctaaggccctggcacacaggaacacatgtgctacaaaggagctttggggacttaagtcctgaggatccaggaggtgaggtgacttgtccaagattccactggtttagtggcagagcctagacttccactcggatctatttagtgcttgccccctgctctctcctgtcgtgccccaccacctcctggcatcacagggcaaccgttgtcaaggctatgctcacgggaggctgggcaccacagtgtttccaagagcaagctggatccgagtagattccctagggcttgttggaggaactagtttgactcccttatactgtggacgcagtagccttgctgtagggagttgaagagtactccacaacagtatcttaagtttaactgggcacttccctctggaaatcacagtgttgtgcaccaggaacacaaagatgagtcaaa

SEQ ID NO: 50297 - DNA, 1045 bp, Homo sapiens
acctctgcctcccaggttcaagcgattctcctgcctcagcctcccaagtagctgagattacaggtgcccgccatcatgcccagctaatttttagtagaggcggggttctaccatgttggtcaggctggtcttgaactcctgacctcaggtgatctgcctaccttggcctcccaaagtgctgagattacaggtgtgagccactgtgcccggccctaaatatctattgaattctggtttttgtttccactgtctaatgcaggccactttcatctcacatagccaactacaggagcctcctaaatagtttatgatgtgtttcaatcatcattatattcaggaggatttgatttttttaacttatggaaaatttcaagcatatggaagtaaagagaatgataataatgaacctcaggcactcagcttcaacagttaagcaatcttattttttataccccccattggagtattttaaagaaaactagacattactccatccgtaattacctcagcatgtatctctagaatatgagaacttttaagaaaaacaaccataatattatatctgaaaatatttaacaataactccacaatatcatctaatcagtaaatgtttagatttccatgaaagtcccataatatttttttatttttattttttttgcagtttatgtgtttagatcaatattccagtaaggtccatatgttaaaattggtctctgctagtctataacattttcttcttcgtttttattttatttttttccttcgtatttatctatggaaggaactgggtcgttggtactatagaattgtctgcattctagatttggctgattatgtccccttgatgttactgaacatgttttttctattccttgtatttcctataaactggtaggtaaatctagggtttgattggattcaagttctttttttggcaagaatatatcataggtgatgttgtgtacttgtgaacttccttctacatcacatcagtagacacctgatgtcagttctcactttctttgtaatgttaacattgacc

SEQ ID NO: 50298 - DNA, 1053 bp, Homo sapiens
gtgtattcatagaaaatgcacagtattgtttgtgtgggtttaaaaaaaaaaaaacaacaacaaatgttaccatactgcacatgacaaagttttgatgtagaaaaaaatgctcaaatataacattaagtcagaatacagagttttaattacagtctagtctcaactatgtaaaactgtctgtaaatcaaatgctgaaagaaaatgtgctagaatgttaattgattatctagctgatgagattgtgagtgattccccacttaatactttctctatacttttctacatatattagataacttgtaaaattggggtgtgtgggagaggacaaccaaattttaaaaagataggaggctgaggggtgatgggggtgtgaaagcaaagctcattgacgagtgactccaataaactgcctagtaggaagggtgggagcaggagaatatcccagggtaagatggggaaagtcttcacctattgtcctgttcccactgctgggaccaggaggaacaaagacacatgaagatcatagatgagaccatggctcagctacaagacctgaagaatcagcatctggccaagaagtcggaagtgaatgacaagaatcatgagatggaggagattcgtaagaaactcgggggcgccaacaagtgagtgggttcaggcctggggtgggaggacgtagatagagcaggcagcctgccagatttgggtctcacctagcccctggaccttttttagggaaatgacccatttacagaaggaggtgacagccattgagaccaagcttgaacagaagcgcagtgaccgtcacaacttgctacaggcctgtaagatgcaggacattaagttgccactgtcaaaaggcaccatggatgatattagtcaggaagaggtgagtattgtggctggtggtgggagtgggcgatgaacatcattaaccagggatggggagtgaaagtgaccaggaagggcagtgagagagagaaagatggtgggcagatggtgaagggacatgaaaagggatgcagcagaaatgaggcaaggtgcagtggtgaa

SEQ ID NO: 50299 - DNA, 1034 bp, Homo sapiens
tacattatgttgcagtggtggtatactagaaagagcccgggttttggtgttaaatctgggtttcagtctcacatgtgccatttactagctgtgtggccttgggcaaggtcttttacctcttggcctaagttttcctcatttgtaaaattaggataataatgcctacttgcagagctgttgattagaggattagagataatgtatgtaaagtacatagaagcctaataggaattaccatagctggtagaatcagatggactcttttatgcctccttgtaggaacttggagggcgctggggtcttcattgtttaaagggggataaataaggtttggccgaatcttccctgccttatgccatgtccacagggctaggctgaggaacttagttcttcagcttcaggggaccgttttatgtgcatatggatggatgaagcaagttgtgactgaaaatcagtaactctgggtccctgagccctgggtctagtttccctttcttcccatagttggattttgtacattggttatctctggctgatgagattatgagtgattctccccccacctttatacacagtttggagtttgagaatcagaagactcgcttgggcattcagttggattttgaaaagaaccaactgaaggaggaccaagataaagtacacatgtgggagcagacagtgaaaaaagatgaaaatgagatagaaaagctcaaaaaggtaaggaaggaaagaattaaaagacagactaataactgggaggaaaaatgggaagaaatacgacagacagaaggataatgtccacaacttagaaatttctcatctaaatcaataagaaaaataccaagacctaaacgggaaaaatggataaatgtcacaaacagttcaagaagactttcaaatagtccctaaacacatacaaataatttagtcttactaaagaaatgcaaattaaagcaacaattagatacaatgtattttgtaacacatcgtggaaaatgtaaaaacagaagacacaatgctcaataccagccatg

SEQ ID NO: 50300 - DNA, 1950 bp, Homo sapiens
actagggcagtagtgctaagccaggttctctcagttgtggagagctagcccttcctgactgtggggccaatgcagtcaaggtagctttttctccaaggagcctggtctgctttgtcctctcaacccattgcctgtaggaaaaatccaagctggagagtgagctagccaactttgggcctcgcattaatgatatcaagaggatcattcagagccgagagagggaaatgaaagacttgaaggagaagatgaaccaggttggtagggtgtgggccatgccagcgtgtgtgtcagggcaggactgggactggaagcaggacagactaaaagggccgatgccctccctggcttctcttctcaggtagaggatgaggtgtttgaagagttttgtcgggagattggtgtgcgcaacatccgggagtttgaggaagaaaaggtgaaacggcagaatgaaatcgccaagaagcggtaggtgggaggattggtagaagagattggcatgcccttgagcctctagcttgacatccttggaaaaccagatgctgtcataggcaagggtcagctcttagaactatgtgagtttatgtagctaggccttaaagaacagaaatcaggagggcagtatggcatagttatagtggttaagagtgccaactctaaacttgattttctggattcctggattacaaccccagctccacaactcgttatctttggcagtgacttgacttctgtaagctgcaatatctgcaaaatggtataatgatacctatctcatggcattgttgggaggattaggtgaaataattttttttttttaagattacctgttttaccttttttttttttttttttttttttgacacaggatctcactctgtttccgagactggagtgcagtgtcaatcttgaccttcccaggctcaggtggtcctcccacctcagcctcctgagtagctaggactacagatgtttgccaccacgcccggctaatttttctttttttgttttttgttgttgttgttattgtagagatggggttttgccacattgcccaggctcgtcttgatctcctgggctcaagtgatcctcctgcctcagcctcccaaagtgctaggattataggtgtgagccatattgccggcccttttttttttttttttttttttttttttgagacagagtcttgctctgtcgcccaggctggagtgcagtggcatgatctcggctcactgcattctccaccttccgggctcccgtgttcatgcaattctcctgccttagcctcctgagtagctgggactataagtgcacgccaccatgcccggctaatttttcgtattagtagagatggggtttcaccatgctggccagactgatctcgaactcctgacctcgtgatccacccgccttggcctcccaaagtgctgggattacaggatgagccaccacgcctggccccaacccccgcctggcttttttttttttttaacctttttaaaaggtatttagcagcttacatatcatctactaagagcaagaaatagtagcttttgttgttattatcataatgggcaacgtgaggtggagggaggcgggagatgaaattcttggttgaaacaatagtcagaagaaaataatcttctcatttttcctcactttagttgattcattcattcaacaaacctttgttgagtacctaccttgtgccaggttgtcttgtgctaggtattggaagggggacaagggagatggaggtaagacagatgaacacaacacagtctttgctgaaggaggtcatcccttgtaccctgggcttcagttagcagtttagccctttgcccatacagtaaatattcattgctgtcctacttcaagccagtctcaagggatatagaattgaatcagactgtatttctttcctcaggaaacatatagagtactgggggaaac

SEQ ID NO: 50301 - DNA, 1877 bp, Homo sapiens
ttattcatttctttacctcccttctcttacccaaacttttccacctttcaaagggacgttaggattggccactgtgctgatctggagtgcacacagcaagctagtctgcaattgcctcctcctcagtccatacagtctcattcagatagggtagggttgcatgggtacagaactagtgggctgtcttttttgtttgttttgagacagggtctcattatgttgcccaggctggtcttgaactcctgggcttaagctgtcctcccattgcaacctcccaagtagctaggattacaaacacacactaccatgcttggtattgggttatcttaaccactaggcaatacagttgcattcacttcctgatatagattctagtctgtccccctttccatactgggaattaggattcctgagccagcttccaaaagcttcatacttcagttttcccttcctactttactcagtacggccgcctcattgacctatgccagcccacacaaaagaagtatcagattgctgtaaccaaggttttgggcaagaacatggatgccattattgtggactcggagaagacaggccgggactgtattcagtatatcaaggagcagcgtggggagcctgagaccttcttgcctcttgactacctggaggtgaggcttgttggggattgggtcaggccagtgttcaagggcccctcctctagtactccctgtttgtgttctgccactgactgagcttctccccacaggtgaagcctacagatgagaaactccgggagctgaagggggccaagctagtgattgatgtgattcgctatgagccacctcatatcaaaaaggccctgcagtatgcttgtggcaatgcccttgtctgtgacaacgtggaagatgcccgccgcattgcctttggaggccaccagcgccacaaggtgtggattcccttgcccaggctggagctggacaggctcagtactggagattcatttgttcagcttctccccctcttctctcttccccctgctgtgtgtagacagtggcactggatggaaccctattccagaagtcaggagtgatctctggtggggccagtgacctgaaggccaaggcacggcgctgggatgagaaagcagtagacaagttgaaagagaagaaggagcgcttgacagaggagctgaaagtaagccacaggcagtgctgtttttagcagtgggagtcctaagcctaggtcagccaccaccttaccacctagcccttctttcttgttcccttcaggagcagatgaaggcaaaacggaaagaggcagagctgcgtcaggtgcagtctcaggcccatggactgcagatgcggctcaagtactcccagagtgacctagaacagaccaagacacgacatctagccctgaatctgcaggtggggcctggccttcagccctgttctccaaaggccatccacacattcctggcctaggtttctctgggggtggggaacttgtttcacttccccgtctcctcccagcctgccgcagggagtcaggtatagcatagagtcagacagccaggggttcagagcttggctctgccttgagtatgacattaggcaagtattttcacctctcagtgtcaaccttcacatctttatctgtgaaatgcgagttaagatgatacctactcggccgggcacggtggatcacctgtggatcacctgaggtcaggagttggagaccagcctggccaaacctgtctctactacaaatacaaaaaattagctgggcgtggtggcaggcgcctgtaatcccagctacttgggaggctgaggcaggagaattgcttgaacccgggaggtggaggttgcagtgagccgagatcatgccattgtact

SEQ ID NO: 50302 - DNA, 2130 bp, Homo sapiens
ggttggctggggtctgaagtggaagagtgtttcgacctttactagggtgctgtggaatctattgccatgaagaaccccaaagagaggacagctctatttgaagagattagtcgttctggggagctggcgcaggagtatgacaagcgaaagaaggaaatggtgaaggctgaagaggacacacagtttaattaccatcgcaagaaaaatattgcggctgaacgcaaggaagcaaagcaggagaaagaagaggtaggtggccaagctacctcttggctctgagggaccaggatggagccagtgccttatcgatgcacccctgccaccattcccctgtttgcacaggctgaccggtaccagcgcctgaaggatgaggtagtacgggctcaggtacagctgcagctctttaagctttaccataatgaagtggaaattgagaagctcaacaaggaactggcctcaaagaacaaggagatcgagaaggacaagaagcgtatggacaaggtggaggatgaactgaaggagaagaagaaggagctgggcaaaatgatgcgggagcagcagcagattgagaaggagatcaagtaagaggcagacctgggcctgcaacttgtgggaaaccaagaggccgtgctgtttattagggttcctctgagcccggagttcagtacctatactcatttctctgttattctcctaacttgcttttgtaagaaccaggcacatttcttgacttgcagtttagacaaatagaatatttaagcactcaggccctgggtagacaggtgctcagatgagggagaactcaaaaggggtggtggccttgccaagaaagaggaaccaatgtgaggccgagccaatggagtggctgagaaggccttcctagaagaggaaactgaagctagaagtttaaaggataggaatttgaggggccaactaagtaaatacaggatgttcttgggagttgttaatgagcttcctggccagggttgaggcagagttggtagctttgccttatggagtggctggaatgccaggctgaagtcatacctttcagggagtagtcagactgcccctttttttcaggatctgtggggcattacgcccatgttcttttaagtaattccctgaggttggctcaggggctcaagctctcctttgggtgaaaagcctgggaaccctcccttcttccatagttctcactggtttcccccacccctctggcaaaagggagaaggactcagaattgaaccagaagcggcctcagtacatcaaagccaaggagaacacctcccacaaaatcaagaagctggaagcagccaagaagtctctgcagaatgctcagaagcactacaagaagcgtaaaggtgacatggatgagctggagaaggagatgctgtcagtggagaaggctcggcaggagtttgaagaacggatggaagaagagagtcagagtcagggcagagatttgacgttggaggagaatcaggtaagctctggaaggggttggcagggaggagatccctgggctgacatctgctgacttggtcatccctgttctccttccctgtccctaacacaggtgaagaaataccaccggttgaaagaagaagccagcaagagagcagctaccctggcccaggagctggagaaattcaatcgagaccagaaagctgaccaggaccgtctggatctggaagaacggaagaaagtagagacagaggtgggctatagttataagattagggatgatggtccacagaaaaggatatatataggttgagcatcccaaatccaaaataatccaaaatctgaaacgtttccggtcctaagcattttggattagagttacccaacctgtaatgatagtctttttttttgtttttttgtttttttgagacagagtttcgctcttgcccaggctggagtgcagtgatgtgatctcagctcaccacaacctttgcctcccgggttcaagcaattctcctgcctcagcctcctgagtagctgggactacaggcgtgcgccaccatgtccaactaatttttgtatttttagtagagacagggtttcactacgttggccaggctggtctcgagctcctgaccttgtgatccacccacttcggcctcc

SEQ ID NO: 50303 - DNA, 1023 bp, Homo sapiens
cccagaggtttggttgtgctcagtctttatggggacagaggagtagtctctcttcccattagtctgagtactgagtgattaggggacatttttgttcatctcaatatctttattccttttcctctcctcttcatcctgactttccctctactgcctcgtccctcttcccttaggtaagtcaaatctcatggatgccatcagctttgtgctaggtgaaaaaaccagcaacctgcgggtaaagaccctgcgggacctgatccatggagctcctgtgggcaagccagctgccaaccgggcctttgtcagcatggtctactctgaggagggtgctgaggaccgtacctttgcccgtgtcattgtaggtgggtgaggctggccagaaagctctccttgggtcctgggaggtggctagactagttgattgggacaggaaggaggcctgacccttgccaactcatgcattgtcttgtaggaggttcttctgagtacaagatcaacaacaaagtggtccaactacatgagtacagtgaggaattagagaagttgggcattctcatcaaagctcgtaacttcctcgttttccaggtgggcgtttttaacagttattggctatctggtttttgccagaccatgtcccatccccactctgtctgctccatctcaggctttatcatctctcccttgaactaatgtagcaccttgttcactgagcttcccaacttcagtctggcccctgagccaggttcatcttatgaggacacacatttgttttgtttcccctcccttttttccttaaaacatttcagtgattccgtattgccttacaatggtggttcttaaactgtagtctccagaccagcagtatcagcattacctggtaacatgttagaaaatgcacattctcaggccctatcctagacttcctgacttggaagaaactgtggagtggggcacagcagtttgtgttttaccaagctctccagtttattatgatgtcggccgaaatttgagaactattgcctt

SEQ ID NO: 50304 - DNA, 1035 bp, Homo sapiens
ccccgcctccttgaacctcaagaactgctctgactccgcccagcaacaactcctccggggatctggtccgcaggagcaagtgtttgttgttgccatgcaacaagaaaggggggcggaggcaccacgccagtcgtcagctcgctcctcgtatacgcaacatcagtccccgcccctggtcccactcctgccggaaggcgaaaatcccgttaggcctggacgtattctcgcgacatttgccggtcgcccggcttgcactgcggcgtttcccgcgcgggctacctcagttctcgggcgtacggcgcggcctgtcctactgccgccggcgccgcggccgtcatggggttcctgaaactgattgagattgagaactttaagtcgtacaagggtcgacagattatcggaccatttcagaggttcaccgccatcattggacccaatggctctggtgagataaacctggccgcggccctgcgcacgtcccggcctggaccccttatccggtgccggagtagtacaacccagcccatgtaacctgaaacgtcgcggaccttacgggttccttgcccgtccagagggggttctgctcgaacccactctccccgcgcgggtgctctaactcgaaccccttccaggtgtcacttgccgcttcctgcgcggcccccgccccggcccagtggtacaggccgagctgccagttaccccgcctacttccccctcccgccaaaggagtcgcgtctggaaccagcttcccgccagctcagtcctccgccgcgcggctccccgccggaccggccggagccggcttcccagccttacttgaccccctccggagaatgtggggacgctggtagctctcccgtggccttcggtcccaaacggtgcacttctgtttcagcccagcgtcctctctcgcctcgcattggtacactccaactcctttctactcttctctggaggcggcacttttgaatttcagacccagcgctccagtctttagaatgcttgaggtgtcgatccccaccccccaccgctatg

SEQ ID NO: 50305 - DNA, 1026 bp, Homo sapiens
tcgggtggggaggcccaagccaagaagttaggaaacaactgcgttttcgccccagccgacgtaagtggggtcacctctcctctcccagggtgtgcatgaggtcaccaacaccggcctgggaacctgtgggggtccctcccataagggtctcctctatgggggcggtagacccatctccttgtctcttttggcctgagccttcaagcactgtgggaccacctgtgataaggattctctaaagctgggattcacaacaatgaggatggggattggacgtaacaatctcctggaggagttatgtatggtttgaaaatgcattttgtgccttgtaattttatatttacaaagtcaaaaaacttgttttcatgaaacaaactacagaaagtgaaacttgatgaaatcatcttagcaggtaaggatacaaaaaagctagtttatcttcctatcaataattctcacaagagggttattttttatttttatttttgagatggagtctcgctctgttgcccaggctggagtgcagtggcacaatctcagctccttgcaacctccatcttctgggttcaagcgattttcctgcctcaacctcccaagtagctgggattacaggcacctgccaccacgcccagctaatttttttttttgtatttttagaagagatggggtttcaccatgttggccgggctggtcttgaactcctgatctcacgtgatccgcccgcctcggcctcccaaagtgctgggattacaggtgtgagccactgcacccagcctcacaacagggttgcattagtgctctgatccacagcaattaagaatcttcaggagcatgtgaatttatcaagaaggtattgatttgaaaaatgttttgcaacactgctctatattacctaatattttcacctttgacctactctctcaatttttttttttgggacagagtctcactgttgcccaggctgcagtgcaatggcacgatctcagctcactgcaacctctgcctcccgggttcaagcgattcttc

SEQ ID NO: 50306 - DNA, 1478 bp, Homo sapiens
ttcctacagatccagtggttctggagagcattgcgttctttcgatcaagctgaccgtgccaagttcctccagtttgtcacgggtacttccaaggtacccctgcaaggctttgctgccctcgaaggcatgaatggcattcagaagtttcagatccatcgagatgacaggtccacagatcgcctgccttcagctcacacatggtaaaaggaagggtttgtttctccttttcagtgcttaggttgagcttgcatacttgatgttttcaggaccctacccaagattgggaacacaaatgtggctgagtcctggaccttgggtaactcacaatttggtgtttctatggaggtgatgtttgagatgagatgtgctagacacagtgggggctggggagacactgtcaggtaaacagcaccacaagagagcatggtgtattccagggccagcgtgactggagcaaggaggagttgcagggagcaaaagtctaaagagctcagcagaggtccgattaccagtgactctgaaaaccaccttcaagtttgcactttagcctatgggcgagtgaggccagggtgtttaaggaggagtgacagggtcagatttttggttttggtgcctgatggccagtttgggagccagataaagggggacatactgggctgagacaagattgggagtcatcaagaagcagggagttggtttcttcagggaggggaggggctggtgggcaccatgggaacacacagatttggttatctgtcatccctcaccacaaactgatctttcttctttccttagttttaatcagctggatctgcctgcctatgagagctttgagaagctccgccacatgctactgttggctatccaggagtgctctgaaggctttgggctggcctaataaggccctgcccaactccgtggggttttttttaccattgttggacctggggaggggggagttaaaaaaagaaccagaaagaaattgtcaaaaaccaataaatgaaatccaccaactcaccgtgtgtgtcccagctgccccatcttccccagcgcatacctgttcctcttctcattctctccccgccgcctgtttcctcaccttctctcccctttccatgccgtccatgatccccaccccatgtgttttaaaaaggcagtagcctttgcagggacctgtctgtcccaactgtttgaacagtgtgctcctcagattctgtgttcagaaggatttgctgcattgagacttgaaacctttggataggggaaaaaattatatatatatatatttttttgttctgtttgcatttcttaatttgtgcttggaatgtgttgatgtgcacagctaatgattcaatgcgagacaagattggcgtctgtgttgtggaggtttcaaataaagagcactcttcataactcacttttcacaatggagtttttttcaaacttaaaaaaaaaaacaaaaaactcttaagcacatg

SEQ ID NO: 50307 - DNA, 1155 bp, Homo sapiens
tccccatctcttgtggtgtgggctctccaactgtgtaatcacaagaagtcagggagtctccctagacagactgtatgccatgttcttccaccaccaaatacctttagagaatttggactctgggcttatccctctctaataccacttttctcccctccccacttcacctaagcaaggcctcatttatttctctgatacctttcctattggtgttttctggaatatctgttaaccttgactattttgggacatctcctctgtcagtggtgcttttgtttgctcccagatctccaccccatttctgggctgtcctggcactctctgtttacctcttcatctgacactgcactccccagacactgcttcacagtctctcactcacacaaatgactggatgtatcctgggttttctgcacagctcttttctgcttctgctttcttatgcaggtatatagtatttgaaggagaagaagggcaggatgctggtgggctcctgcgggagtggtatatgatcatctctcgagagatgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcaggtgaggatgaggcatagtcctgggactgtcttcagtcctgggggtctggtctttttgtgtcccatccttgtgctccttcttcccccccactcgcaaaccatgaccctgtataattgtgtttttctagatatacagatatggagagtgaagattaccacttctaccaaggtctggtttatctgctggaaaatgatgtctccacactaggctatgacctcaccttcagcactgaggtaggtcaggaaatcctaatcacagcacatcccagccaatctggaagatccattccaggttcaccttagaactagcactgcgtgaccttctcatagttctaaggaagcatcttgacttcttaaagctgtagcaggtgtttgtgagtgacatcacaaacaggaaaaccagaatttgcaggccatttcc

SEQ ID NO: 50308 - DNA, 1087 bp, Homo sapiens
acagcctactttccaaggccagctgtcagaattcaatgacaaaagtgtcctaaaacatcctgtgtaaactggaaggcaaccatccaaagctccactgttgttacattaccctgaaataatccacagattctcttgaaactagtgaggcagtgactagactagcactatctggatctgcagtagcacctgtggcttttgagcaccttaaatgtggctagcgcaactgaggaaccagattcattattttatttattctgtttaatgtaaatgccatccaatgcaggtcctagaccttgtttcagatgttgctcggtgagtaccactcagtggccagtggtcccctctacttgttctgtatattagttggtgcgtgtggtctagaaagatctaagcagaagggaaattttgaagactttctgactctcttctgtgtgccctccagcctccgatggaaccccacagggggagaaggaaaaggaagaaagaccacctgagttacccctgctcagcgagcagctgagtttggacgagctgtgggacatgcttggggagtgtctaaaggaactagaggaatcccatgaccagcatgcggtgctaggtgagttgtgtcctaaaggcccaggtcccaacccagtggtctgctctggggcccttcctgccagcttgtttttcttccttccaggttactcctctccctcagtgtctctgtaatgagaattcaaaagagaagtgttttttctctgacttcagtataaaaaagattgaccttctcttttaatagttggtgtctttcactttatagacaaggggaatctttataactggttagctatcccatttttctttggcttcaaggaagttcctctgtgacttgattctaccatatttccctgcaagttctcattgtttcttttttttttttttttttttttttaaatcagaaatgaggtctcactatgttgcccagactgatctcaaactgctgggctcaagcaattttcccacctcggcctcccaaagtgctgggatcataggtgtgagccaccacacctagcctagttttcactatttcttcttccttatttat

SEQ ID NO: 50309 - DNA, 1026 bp, Homo sapiens
ttgcctgaaaccaccacagaacctcagtaattttgagagatatatgggatttcaaccatggtctgtttagctccagaggagatactgtttctcttctacatgaaactcatttcatgcagattcagcagatccctgtggccataggtaaattggtagtcccaggtgacggttcgtggacacgcataataagctgaacagagcacgattccagctcactctaggttctctgcagctgagcaatgaagagtggcctaagcaggtgtcttagagagatttggcttttagccactttaccaggggagtctctgaacacttgctgactcctctgcctgctcaggtaccctgctggccgagctgcgggaatacaacctcgagcagcagcggcgagcccaatgtgaaaccctctctcctgatggcctgcctgaggagcagccacagaccaccaagctgaagggcaaaatgcagagcaggtgggtggtagccaccctttggctgggggcttgaatctgggatattctggaagatggctcttgctggtttcctggtcttttttatttctctgggtgattttcgtatctttcctatacacacttgacccatttttttctacttcctacttggaagatttccttctgagtttccttacccctctggttgacaccaggaagccttgcttgctttgggtgtttatactttgatgctgtcaatatacgcaagccacctctacactatccaggtttgacatggctgagaatgtggtaattgtggcatctcagaagcgacctttgggtggccgggagctccagctgccttctatgtccatgttgacatccaagacatctacccagaagttcttcttgagggtactacaggtcatcatccagctccgggacgacacgcgccgggctaacaagaaagccaagcagacaggcaggctaggtatggaactagagtgtccagttgaggggaagggttggtggcggtaaagccagattccttggaggtgcaggacttaacggcctgtct

SEQ ID NO: 50310 - DNA, 1045 bp, Homo sapiens
ttctttcaataataagcattgctgccatctatcaaaggcctgccttgtgccaggcactgtgcaaaatacatcatgtcgtttaatctccaacaactttgcaaggaagtgtagttatctccattttataagtgcgagactaaagctcaggaaaagtttgctcgtgagtctgtattgctacaaagccctcattcatttctctaggctgctttactgtctgttggataaaactcttatatgacatatcccccaatatttaccaaaattgtctgaaggagtctgggaaccagttgtcttttccctatcaggaaggctcatcctctgtgaagacgtcctagaccaagccttgtcctccttttcccggcaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgcctccaccacgcccacaccccctactgcacccacccctgtcacttctgctccagccctggttgctgccacggctatttccaccattgtcgtagctgcttcgaccacagtgactacccccacgactgctaccactactgtttcaagtaagtgtggatgtagactgggagctgtggggtatatactgtggcacccacttcacccccttttccatccagatagttct

SEQ ID NO: 50311 - DNA, 1052 bp, Homo sapiens
ggatcacttgagtccaggagttcaagaccagcctaggcaacatggcaaacccaatctctactaaaaatacaaaaagtagtcgggtgtggtggcgcgcactagtaatcccagctactcgggaggctgaggcacgagaatcacttgaatcctagggggtggaggttgcagtgagccggtatcacgccactgcactccagcctgggtgacagagcgagactccatctcaacaaaaagctggtgggggtggggggcttcattctctaagctgtacagcagccctgaaaggatgatgtacagtcattgtaaagtgcctggtacatagtagacacctaagagggcagctgttactatgaagagcccttggactggacacccacctttctcaagcctccttggagatacctagctcattcccctcccccattcttatgcctaatcccagagctctagccactgaagtgttacccaaaaaccatgttctgtttccaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtgagggtttcaaacc

SEQ ID NO: 50312 - DNA, 1035 bp, Homo sapiens
atccacagagtcagagctccagttcttgcattcttgggacagagatagcactgtgccttaaccttcatccttagtataccagaccagagatgttccttggagtatttttgttgtggggatgatcactggctgggtgggatacttatcaggccacatttgctgattggggtggctcccctcatcattggctggttgccccttaaccactattattgttctttccgagaaagatgggacgcctatgcctgacagctacccaacaaccccatcttcaactgatgcagctacatctgagtccaaggagacccttggcactctgcaatcctcacaacagcaaccaacactcccaaccccaccagctttgggagaggttcctcaggagctgcagtctccagctggagaagggggcagctctacacagctattgatgcctgtagagccagaggaattgggtcccacaaggccaagtggggaagcagaaacaactcagatggagttatccccagctcccactataagtgagtagaatttcaacatttggggaggatgaaacaagagggaagaaaggatgtctttgtagcttctctttgctcttttgcttgagagaaatagtaggagttcaacttctcaaataataagatctcgtcttgcgcattcactttcttaagtgaagttgaggtcctgaactggtgatagttgaatgtctaatgatattggtgatgataccaacagttcattgaggcaattactctgtttctgggctatcaccccaggcttattatttaaaaacaactctccagctgggtatgatgactcataatcccagcactttgggaggctgaggcagggggatcatttgagctcaggagtttgagaccagcctgggcaacatagaccccatctctattggggggaaaaaaaaactctccaaaatcgatggtgttatttacatgagtaaactgaaactcagaaatgaaataattagcccaagtcactctgtaagtggttgaactagaattaaaacccagatctgtc

SEQ ID NO: 50313 - DNA, 1034 bp, Homo sapiens
tcccccacccatatttcctcagaacattcttctgcctccctacacctgtctcctttcgcacttgagttggaaaatgattgtaccaaagcctgcacaatattttttaaagcagtgaagtagggtagatgccttggtacccttaatctagcaaaagatctttaaaagagtctgtcaccatgtaaaatggccttttgcctgctgcccttattagaggattctgctcatgccagggtgaggtagtaagttgtattgttgtggggtagggatattaggccccaattagaagataactatacaacttactactttccctggtgtgtggcatattcacacttagtcttagcagtgttgcctccatcagacaaagttgtagatgttccttggataatttggactggaagaaaagagacatggaaggggacagatggtgtttagggtgaggcagatgtcattataaagtgacttgtctttcattaattggagcatataattattttacctttgggcatgaactcattttgctattcttcaactgtgtaatgattgcattttattagtaatagaacaggaatgtgtgcaagggaatggaaagcatactttaagaattttgggccaggcgcagtggttcatgcctgtaatcccagcatttttgggaggccgaggcgggtggatcacctgaggtcaggagttcgagaccaacctggccaacacggcgaaaccccgcctctactcaaaatacaaaaattagccaggcttggtgacactcgcctgtggtcccagctactcaggaggctgaggcaggagaattgcttgaacccaggaagtggaggcttcagtgagctgagaacacgccactgcactccagcctgggcaacagagcaagactctgtctcaggaaaaaaaaaaaaaaaaaaaagattttgaagggctggacgcagtggctcacgcctgtaatcccagcactttgggaggccgaggtgggtggattgctagagcttaggagtttgagaccagcctgggcaacatggcaagac

SEQ ID NO: 50314 - DNA, 1050 bp, Homo sapiens
ctgtagggtgagaaagcgctgcctttcagttcttcaatgaagtccaggggctttctgcccctgagtctcagtagtgtaaaaagaatgatcattccctgagggtggccctttataaatctcagagggaaaatggcaaaggtaccctactgtcacctggctctgagggtgtatgtgttacttgtttttactttgttgatcaaggaaatcaaaggataaatggaagtagacacgtattcttaagttttacaaagcttttttatacccagtatcctctgtggtttcacaattagtgggattggcagggcagatgtgatcatcctgttttacagatgaggaaactgagactcagacaggtaaagtgactggccaagctcacctagctagctgacagcagacaatccaggtcttctccctcatccaaaaaaaagtggatatctgctaggtgtacatagctactttagacgcacccagtctggaaagggaagtcctctgttgttcagtgaaggctctgctctgtaaccttcagtgagcagaagtggagaggatgaatcacaagaggacgtgctgatggatgaagctccttccaacctcagccaagcttccaccttgcaggccaaccgagaaggtgagagtgccgaggccagaaaggcctcccttcttgccctgcacgtctgacagacactacactagggttttcctggaggcagctgcccacatgtgcagaataaggaagcatctgtctgcatgcgctgacatacaccatccactttatcctcagccagtttttcaaataacatgttactactgcttgcccaaagtttgtcacttcttacttggttcgctttcttctcacccacctgctatcatcgctccaggttccctcttgccaacaggatatagtcaatagcaaagtagggctgaaaaggcaagggggcaccagcagacttggccaagtcctagaccatggctcctcaagcaccaccctctagccagcctccacattcagccaccctgctcagtgtgttgatgcattgattggcactctcagga

SEQ ID NO: 50315 - DNA, 1025 bp, Homo sapiens
aatggcatgaacaacatcattcggcttttcctgaagaagggactggttaatgacctggccagagtacctcacagcttagacctgtccaggtaaaatcatgccccagccccaggcttttccttctcttcagcctcactacacgaatgatgtggaggtagctggtgtagtgggaaaactttgggtacaagtgggagacccaagtctttcttattgtggcttttagcacttgtctttcttaaagccttggttcttacttgctataaactcaagagttgaactataatagtgatttttttttcaagcttccccccactttaaaaattaccacttattagaagattatatgtatattataagaaatacagatgagtaaaaataagaagtagacactgtattcctaccacccagataccatgattaccttattggtttattattcagtgtttttctttgcatgcataaataatgtattctttactaacatgatatgatacatgctattgtgttgggggaaatttggggcattttcgtttttattttcagttactggtcacttccttgctatgaaaataagtttcatcctacctaatgcccaaatccataattaagcatttttctccaaaccagaatccaattaaggacttgtattacatctggctatgttttctgaatctctcttattctaaaacaattttttttcattatttcgatctttattttgtttttgttgttcatgattccagcttgttgaagcgaccgtgtttttgccttctaaacttggtgcagttgcttccttgcagtgtagtttaacttaatcctttacttcctgatattttctgtaaacttctagttagatctagaggctttagaggcttattgaagcagtttaaacattttgggctgaaatgtgtagcctaggtgatgtatagctcatattgtatcgtgggagacacatctcccatgataattgtcactttttgttcttactagaaagtcatctctgttgttattttggcactttacaa

SEQ ID NO: 50316 - DNA, 1045 bp, Homo sapiens
gagattgcgggaatcacttgaacccaggaggcagagattgcgggaatcacttgaacccaggaggcaaagattgcagtgagccaagatcgcaccatcgtacacctgcctgggtgataagagcaaaactctgtctcaaaaaaaacctgaaagagctaggccttttttcattaggttcactgagagagagagttaatgagatttgttctattgaaagtccctttttatgcattgtggagattgaagagggaagactggagtcagagagaacagttaggaatctgatagagtaatctagtaacgtacgatcttggtgaagttggaggaaaatgggtgagttgaagaaatatttttaaggtacaaatggacaagaattgggtttggaagatgaaaaaggaaattaagactcaaggatgtttcttgatttgtgggggtttttttaattgcttttatgggttggcatctaacaagaaaatagaatggggtggggaaggtttgaagagaaaatgaggagttttgagaagtatctgtgggacatctaagtaaaagtgtctaaaggacagttgaataaaccatataaataagaatataggtgttcatcttccagatgtactcacacatgtgcaaagacaccagatgtggtagcagtattggtaataaaaataaaggaaaagccttaaatgttcattagtagagctgtggaaaagaatgaagtgtcctgatgcagaattatcctcaggttagattttttaagtgagtggggcattttgagaaactgtatcacatgttcccgcatatgtaaaatgggtgcccaaatattttttcccgtaagggtgccttgttttgtggatcacattgtaattttatggttagtaagtggcaaaagggtctgagagtgagtaggggcactagtgttgccatctttgaaagcaaccgccatttttaaagctattcttactttaatccaagtttaatatacatagaaaaatacacaaatcttaaatagtctgtttttcctaggtaaccactagccaagttaaataaagca

SEQ ID NO: 50317 - DNA, 1033 bp, Homo sapiens
gtatgtgttttggttttcttctttctgaaccagcattcctaacgtgttaggaggaggagagttaccattacctaattaagtatagatttcagaaaatcgagtcttcctaaggtcattgattagaccttgggtctgtagcaatttgatactatccctcttagaaatgattttaagtgtttagtcaagggctagggagtggttagggatggtatttgctctgttggaaggtctacagttcattataaggccttgtgtatgccacttgccttctggggactttcaggttttttctctgtaaatgataaaggtgggataaattgccagagttccttcctgttgtagcattttacctgggagatgtccctcccctcccccacctttataattcatttttggtagaggtttttttaatgtctgtttgaattcctaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatggtatgtaccaagagtgttttacctaaagctaatgtgcctttgtggcttaaggtctggccaatttcattgtgagttattttcatcagcttgattaacagattaaagatacgtaggcctcccttatgctttttcatctgatcttaaaattggtatttggcatgcttctcttaataggacccaagtgcttggccaattacttaggagggaggcgtgggaggaaataaacatcaagttaaactgtctaaaactgttattttcccattttatagatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccaccc

SEQ ID NO: 50318 - DNA, 1304 bp, Homo sapiens
tttaattttccctgctggcacagaatatagaacagtgtctagaaatgattttgcgggaggtagtatagaatgctacaagtgacttgacagtgaaagttgtttgaagcatccctcccttctaccttccctgtcttgccttaaactttgtggctgccacatcctggatgaaagtatcaaccgcttgaggagaaggttgagggtaatcatatggtagagcaaaaacattctcagagtctctcttatctttcctccttcacctctcctgtgtattattcacacttccttccctgcttccaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgagctctcaaggggtcagaagaggggagtatgtgaagtggtttgcctgcctgtgtcaaaacctgatttctgaaaaatcagcatattttcattctacctgatatgggtatattctctatttggattctttcgatctggtaatcctgaaacagtgtgttaactacatcgcacacacaaaaatgtctttagaagggaaaaacaaagctctccttttctacttttctcttaaaatgtctaaaatgtgcctcacccttgagtcaggttcgtcccctggactaatactgaataaatgttttttcctatgtaacagccgcttgaacaactgagtccccatcctgatgaatacttgtgacctgatatttgtcctctttttcttttctctcattatgaaattatgctaattatagaagtgggataagaaaggaattaccttaaatccccacacccagatagccagttaacatttcgattgtatttaagttactggaatcttgttttatgtaatgtttcattctagaagcagggaaagaaattaaaaaagggaaaacttttttctgggctttgtaaaatagaactttaatgcacaagaacacaagtaaaggaaaactggataaaacattttttcacagaaagttttagtgtctattttttaacaataattctgagagagagagataaaatgaaagattgctgatggaagtataagttgatagaacctttttggggttgactgtat

SEQ ID NO: 50319 - DNA, 1063 bp, Homo sapiens
ttctgcaagctttggaagcatggtgctagcatctgctgggcttctagggaggcctcaggaagttcacagtcatggcggaaggttaagtgggagcttgcatgtcacatggcaggagccaggaggtggagggggtggtacacactaactcactatcatgaagacaacactaaacaatgagggatccacccccatgacccaaacacctccagcattggggattacaattcagcatgagatttgggcagagcaaatattccaaactgtatcactgcttaaggttgagtaaaatgcctcttctctgtgcctccttagacctcctcatgttggccaattattttgttgctggtactagttgtggaaggactgttccataggtctttaacttaatccttctgagctttgaattgaagcaaaatgattttcacacacttttcaaattacttacaggcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacaggtagggtactggcctcacactccagggtccagactttgcacccaatggagtgtgatgcttacggattttctaagctcacataccactgagtccctggtcacattaaccaggagacagtttagatttcctccttctcttagtatttattttttttctcctgaggaaaactggagtatagtcctgatgctctgcacaggtaatactcctttcaagcatgttgatgagtattctcagtagcctcctgctgcctcagtggaggcaaactgtcctcagttactttctggttaacctgtaaagagaatggatattgtgaaccagatttattctccaacaagagctttctgaaaccttagtcacctacaaaacttttgttttcacttgcaaa

SEQ ID NO: 50320 - DNA, 1051 bp, Homo sapiens
gtgtttattgcccacattttacttttttactcttaaaaaaattctttgtttgaaacaaactcttccagagttcagtgtttcatttgcattatgcgtttcatttgcattataagcacatttgggggaaattttccatgatgtttgcctgcaggagagaggtaggcaaggagcactaaatagcaaattaagagattaaacatgattgtaccactaattcataatgtggccctgagcaagtcacttaacttctctgttatctcgaaatatctgattcttggtgtgcttgaaaatggagattgggcagaaattgtagatattctttacttcctggatgttttagaatccgtatcatacatctggtttatctgaggttttgatactctatagaaaacactaatatcatgactagaaggctaccccatccttattccaggctggccatttagttccacctgtcaggctctaacttctttaaaaaatttttattacctagatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattggtaagaagcatctggccaaatgttttcatttctttctggaaatcaattttgcgatacttctgtatatatgtttttactatggtctcccttcaactaaaaaataatgaataaatttgtgttatgttgtataagtgaattttgtgactaatatatagtgtgccatgttatttctcattgaaaagtcaaagtattttttctttgttcatcggttgggtatgtagttctacatcattagagtttattggagggaaaagtgtatctccaagaaagcttttctagttgggttttattagtacctctcccttctttgttataggtgcattttaaacacattttatgtttatggttatgtttaaccatgtattttcctcccctttcaag

SEQ ID NO: 50321 - DNA, 1024 bp, Homo sapiens
agctactctggaggctgaggcaggagaatcacttgaactcgggaggcggaggttgtagtgagccaagatcatgccactgcaagactctgtctccaaaaaaaaaaaaagtattttagattgagaattgttttccttaaaaatttttttccatttaatgtaacctgtatataatgatttcttttatatattatatggacaagcagacatggcttagattaagtttgtaaagcatattaccctttctagtctccgtttgttgatccctgtggctgccccccacccccgccttattagctctgccagtttccttttagaattgttgttgaaattggtatataagttcctggtgcttggtgaattgggacagggagtcaggttcgtcagtcacttatacagccgtgtgacgctcaacaaattatttaagtttgcagcacttctattcccttgtttataaaatgtaattaatgaccatattctgggaattatgtatataacatgtatacaaagtgtttgggcaaatacacaacacatagaaaacgctctaaatatgttagctgtctcctcctccccattccatgattactaataagtaatcttatttcctgtgcctttcagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcagtaagtgtttacagaacagatcatctagccatataatcgtgggcatgttatcacctctctaagtcttaatgaacactttcatctataaaaagcaagagagttgtattagatcattttaaagttctaaccggttctaagaatgtattagtttttccttttttgacccttgtgtgtcatttgtgctttggtatttaatt

SEQ ID NO: 50322 - DNA, 1057 bp, Homo sapiens
aaggcggctttaggcagaacttaaatggtacatttggaggttagcatcccatgactattcatgctccttcaccattctggtgttccattttcttatattaacatgtctttcatagcattttatacttttccaacaatttgcacattgattatcaaaacagccatgttggagggcagataatatccaaaatgggaactgagtgaggtaaaaaaaaagttgaacctttttactttgtaatttttcttttttactttagacttttagtattggtaaaattaaaagtattagtaatttttccaatttcaaagcttaattaagtattcttcctaacattcagagacctcacttcgaatgtcttctaattttattatagtgtatttggatctcttaaaattttgttttatgtgcttgatcattgtggtttaatggcgaactcagcataattcttttgtctttcttcattgccaggagtccagtgtattccacaacgagcagcacttctgaaatccatgttgaatttcctcaagaaggccatccaagaccctgctttctcagatggcatacgacatggtatttgattccagataactttttttggaggatattttactctctcaaagattggttcttttcatactattctggcacctgttgttttacaaggcagtctttggtaaaggccatgccattttcaatagcttttagttgttttgtgtcacttttcctagatgtaagtgttgcttagctattttcataatgatttaccctttttttccccttttccagctttcgactctgtgcttaattccgtcttattacccctttctgactcttaagtgtttgtgttctttctttttttaacccatgttagaaagcctattgcatggacaaataataaaataggaggagacaactgggggccattagattagaattaacacaggctttgaggaccacagtgtgataatacataacatatcactcaattatccccactcctcacacctttccagactattcgtattctccataatgttcacttttcttttagtgatgg

SEQ ID NO: 50323 - DNA, 1051 bp, Homo sapiens
ttggttcactttttgttcctaactatatctttttttttaatgtagatttcagaaagcccttctgaaatcatggaatctcttaccaaaatgtacagcattcctaaggataagcaggtatgatgtggctttaaaacatccacaggatgtggttgttatctaaatagattaatgatatgtactggggtgggagattgcatagcagaaagaatgtcagctttggagtcagaccatgggcaaattgttagcttctctgagccttagtttccttgtcttttatgaggttaacacttaataacttcctaggccttatgagagtttgaggaaaacataaactacctcaccgtgagcaggtaataagtggtggtagctttctgaacacttcggatatcaaaggagaaaacgtttagttgtgttgttttttgagttagccctcataaagaatattcacctttttcattgatgtttttaaaatgtatgtcttatctctctacagatgctgttatttacacacatacgactggcccatggcttttctaatcacaggaagcgattgcaggcagttcaggccagactgcatgcaatatctatattaggtaagagaagaatactttaattaccaggccgtattagacagtttgggcctgatttcctttgaacttcattcatctttgttgctatgagtcctattatagttacctaggtagcaacttaaatacttccacccctcccagtgttcactgtatttattcattatccttgagctccttaatgttggacgagaaagagggtatgatgatgttgattgacatgtcacctgggtttattcttggtattcgtctctttttttttttttttaatagatatgcttgtagctatcgttcactgtccccctactctttctcttgccattgtgtcttcctcctctctcatcctttcagggatatcattttgaattaagtcacaaaatattcagtagtcaatactgtgcatttaacttcttttactgtggcacagtaaaatggaaaacacgtggttttgtaatcagtcctgt

SEQ ID NO: 50324 - DNA, 1049 bp, Homo sapiens
tcattgaagaaatcacctttaggcagaccatcttgccttgattcttaagttcttatttctgttcgttttttcctcttgtttgactttcacattggatgtcttctcaacattatgttccaagcagccacacactcttaaatatatatatgtatgtgtatatacatagagagaaagagagataaggtctcactctgttgcctaggctggagtgcagtggcgcaaagtcaccataagcactgtcttaacactatctttttcctttttcaagagctggggtggaaaggagaatggctttggacttgcagaatgttgcagagacttgcatatgatggtaagtaactctttgggatatgggtgtcttttgacagagctgtggcctctctgtgaaccttactttacaatgaattgtggtatatgaagtgacgccttcacatcgagacctttgaggaacctaagatcagttcagacatagctgaaccacgtctataggaagcagtctagcagtgcttgggctcttgatgtgctggtggtagataaaaaaatctgagaaatagagtgtgtgttcatacccagttcttgagtaggtagctgtatttgttgaattaattttaatgtgattttttttaaatcccagaaagtatgttcgcttgcattctcacactggaactattgtatcagaactctggacagtgtggtgtgatttaggaatggctgcttggagagcagttctaccattaggtttattgagaacttataatgttttatgtgctttccttgtttatctctctgcctttcacccatgtttaagttatgagctcaggccatcctcctttctgctttgatatgttgctgtggagctacaaaacacaatttgattttcaataattattttgcatctggaagcaactatattttccacgtgggatttgtcttgtcagtttgtcgtgtttagcacaaatggctgcagtgaaatttagtgtatttatcttagcaagcctttttttcctaaagagaatggctcttttctggtctcagaaaaccacagatta

SEQ ID NO: 50325 - DNA, 1039 bp, Homo sapiens
ggatgttacagtaacactaccagataggtgaatactgtgaggctcagaagttacttatgtattttttttttgttttttgtttttttgagacggagtctcgctctgtcccccaggctggagtgcagtggcgcgatcttggctcactgccagctccacctcctgggttcatgccattctcctgtctcagcctcccaagtagctgggactacaggcgcccgtcaccatgcccggctaatttttttgtatttttagtggagatggggtttcaccattatttttggacaaaggccctgggctctttgcttctgctaaaatgtgaagaataatatctgttcttcctgtcttaggcatttggggattctttgagcatggtcatgttcgtttttttaaataaaaacaagcttacttagtacttgagaaagcaagataaatagataataaattaataataataagggcaaagaactagtgttattctgaatagtactgactaaaaagtaccctagaatcttaacatttaatatgttgattttgttggcagcgaaacaaacttgtcttcctgataaaaataggtgcttggtgttttatgtatgcaacaaaatttatcataattgtgtatctactcattttggtatattttcttagtctttatctgatgaatatttcttcacaagaaacatttctttatatttcatataatgttactagttcataaatataacaacagcacagactttcgtgagtcacgtttgagttggcagggttttttaaggatctcagcttaccaaaactttctaattaaaggtgcttgttttttatcaagttgcaaaagttggcaagaaggattttgtggtgacactaataaaagtattctgaaacaattagttggaataacagaagaaacaaaaggaaaataattgtgtagatacacagcctttcaagcttattctgccttgcagattcagacttttggtttgacttacctgtctgttctctgtagcatcaagcctttataccctcatccttactttatggtttt

SEQ ID NO: 50326 - DNA, 1079 bp, Homo sapiens
tgccttttagatgaatattttgcaaaatattcgacttagtttttgtgaaataattccctttctcatttaaatcagtcaaattgattaagtggaagtctgttaatagcatcaactgagacacagaaataaatgagaaaacactgataatgaatcagggtgagttgctgtatcagataatatcataaagctatagtggttttattataaagccaagtttttatcataaggctttttatgattaagccaagtcttgcagttggcacaggaatagacaatacatctgcaaaatgaaagagtataccttatgttgcttagaacagtgggacagtaggctgttttgaggggaaaatgtgtttagaacttttcttcacacttgacataaatcctaggaacgtatttagaggtaaatacaggtgacttttaagatctttgataagagtttgctaagaaagttaacagacctagaagtcattaaaaatacagctttgatcatgttaatttggttatttgtataggaccacaatagcatctgacagaattcacatcaccctacttttaggctgatacaaacacactaatatttcatactttaattaaatgttctgacaatttaagtagaagttaaaatgcaaactgtttttggtataagtggctcacatatataaagtatcgggtatgtttctttgttttgttttttaggtaattcagatccagttgttgttcttcctttggatgattttaccacagaaaggactgcttaaatgattgcttttttgtccctttgcatttttgacactttttacctttgagaggcttgctactttttgctctgaattgatctaaagagattgtagattggaggttaatttctagtcctggagaatttggaatcttgacaggtgcagtacattgcagcctttggtaatagattgatgtgtttggtgctttgcaataaaagatttttacaggtttttgaggtttagagataattaggtatttagtaatggtacctccaatactaatatccctcattaaaatttaaaaatttcatgtttctctaaaatgtaaaatttctctaa

SEQ ID NO: 50327 - DNA, 1727 bp, Homo sapiens
ctctgattcaatataacctaccaggcattctggttaactttcagaccatggtatagattccttaattgtttttttttttttttttagatgtttaacttattattgtttttgttgtcagcacctttccaaatagtttgtctgcatctacctttatccaaatccaaggtgggtttttgttttgttttttgtttttttttgtttttttttgttttttaagcccaggtggattgttgggggaataaaagcattttctcatgaggtttccattttaatcccaagagattgtctggcacatctcgttttcttaagtagtaaatcctagcaaaaggaaaattgctgtgtgagcttaagggttccttttctgattctccttatttgcaactccctcattccaaaacatcttttgtgaatacttttcttttctcagcctgcagactgcagagccttaatagacaaactcaaagtttgtaatgatgagcaacttctcttggaactgcagcagatcaaaacatggaacattggaaaggtatgtgaagtcaagctcccaaaagacaggactcaccatactaatacatcattttgtatgctctgatatggaataagaaaccacaatgggatagcctcattcagcaattaataagcatctagcatgtgccatgtgcctaacacagctttaaaccagtggcaaggaaaattttgctggctgaggatggagaattgatttcacaggtgatgcttaagaatctcaatcacagaattcctgtggtttgacaatataagtttgagataatttctggatttttagtttagaagaatttttattagataactctaaaaatgaatttttctgataaaatggattctggcaaggatagttctcttgtcttcgtagatcttagaatgtaaccggagttctccatctaaagacctagctctaggggttttatggtgtctattggtgttagcacatatatctagatgggtatgacaatgaactacagcacttttagctcagagtatgatctttctcatatgggcaagggtgggacgtgaacttgtctaggtgtcatgctcagcaatctcttgtaacaaagctcagttagaaagcacccatgcggcgcttctaccttattcttacatcctctttttcctcccctctccagtgcgagttatatcactgggtggacctgttggaccgcttcgatggaatactggcagatgctggacagacagtggagaatatgtcatggatgctcgtatgtgataggccagaaagagagcaactgaaaatgcttctcttggctgtgttgaacttcacagccttgctcattgagtacagcttttcccggcatctgtacagttccatagaggtaggggaggttaaagcctgtgtaccctgttcttgactagaattgtgtacatccagaaataaggaaattgctatttctattgcttctttccttttcattgtggagctctgggtttttcattgtcaaagataatagtagaatgtttcttggatatagatactatccttcatagggttgatgggaagattctgtactatcacctttgctttgccttttcaagattcaagaaatgaatgagaaatgttatatatgtattaaagtatttaaggaaatttgcatgaattgatttttgccctaggttgttagagcagccccacattacttttaaattcctagaaatagtttgattttctcatc

SEQ ID NO: 50328 - DNA, 1049 bp, Homo sapiens
tctcttactgaatgccatatatattgaacgtactcattttcatatctgttggaaatatcttcatttgcttttgattttgtttttgatgtgttttggcatctagaagttttgacaactgtgtacttgaatgtcttttactgaaggacaaaaagaaaacttgcttaagaaactataatttaaaaatttaaagtggaaccaatgtaagaatctactgctacgagaatagaagacctagaaaagtgatcctagtgtatataagaactagatatatggtaatagagggattataaattggaaagaagggacagtattaggaaaccatgctagaatgattatcttgtagagcatgtgggactattatattgcgataaattttagataaaccaaaagtcaaatgtttttaaaagaaataagctataggagaagtagaacatgtaggtgaatgtttactttgtcttaagtgggcatggtctttccaagcattaaaacaaaggaaaaaaaccataatggaaatgttaaatactgtatccaaaattaaaaagacatgacaatagccatcctaataggtgtgaagtaatatctcattgtggttttgatttgcattcccttgatttccttgatagggagcacctttttatatattttaaaactatttgtatgtaaatagacatctggataaatgtctattcaagacccttgcccgtttttaaattgtgttatttgggatttttttgctattgagttgcaggagttccttatatattttggaaattaatccctggaagacattaggcaaagtgaaataagtcagccgcagagggacaaatagtgcatgaatcctcttatatgaggcatctaaaatagtcaaaggtgtaaaggtaggcagtagaatgatagttaccaggaaatggtgggagagagaagggggagttgctgctcagtgggtataaaattataccaggcaagttcgttccagagatctgctgtagaacaacatagtgcctatagttaacagtcaggtattgagtatagtctgccctccgtgtgtg

SEQ ID NO: 50329 - DNA, 1881 bp, Homo sapiens
accctaaatatcaaccatagaaaacattttttcttcttaaggaatggtctctgcagaaatgttttagaacgtattctgaatttttcacaaactcttccttgaatgcctgctgattgaatggatacaggtcgtacaggcaaatacacgctatttccatagtactgagtatattggactaaatctaggcaaaaagctgcctaaaatttatactgtaattggtcagctttatattatggcagccttctcgggggaggaacattgatttctagtgactgccactgagttaaatacattgttaatagcagaatcttttgtgtgtaaagagcctgcaacccacttctacctctgtgcatgtgtcttagttgctaacaggagaaacttatttcttcttgtgctttggaggacttgtctgccatcaaagatctagggattatacagtggatctgatcaggctgttgtctgcttttgagccttccaaattacatggcttaataaaatgattgttttctgtgctcagaatatttctgttgtgatccttatacttcattttctagttgaaaaaagtgttgttttgcctttgctcttatgatacaactaatacatttttattggtaggaacagtaaaaggtgcataggtaaaacagtcatacttaatccttttggttaacaatgaattaatattctgatgcctagcacctctaagctgttttctttagacataagttttataccgtatgttctgtgttgtaatctttttatttcatcatgaacatctttgtgtattacatagtttgcaatatttttaacagttgtgtgacattccattttaaaccagtcgtattttggacatttgatcttttttttagccttgtgatggaacagtaggtctttttcagtcttttactattatacatggtcatgcagtatggattcttgtggttaaatatttgtgtacatctttacgactttctttggattaattcctagaaatggaagttatcaggaaactgcagggctatggtgaatttttccatcctgagatgtgttgcaaacattgtacactcttattttcaattaagagtttgagatgcttgtaaaagagaaaaaattttcattttgacctgatttggtttcagtcttgtgcaacatagggatgtgggccagtttgatctggagagattctttacctctctctacctgatagctgtgcctctgagttggcatagcatcataactccagtgtttttactttaagcattttgcattgctcttcattctgtattgtctgtgtccaagcttgtagagctcaagattgtagctttaagttctcacttcttttgggattttcttttttcagatcgtaaagctgaaaattgaaatcatgaaagtagacaggactaaactgaagaagacacctactgaggctgtaagtatccaaaagtttactttgcttattttttcttcattaaaaaataaaaaaatatttgtgaacagttcatccatgctcttcaaatctcatcacccatatatacaaaaggcagtaaaacaacaacttgtctagaaacagtaagattttcttttgaacttccctggatcaaaaaaatggatagccaagagaccagtggaaagtgaacaccgatcagttagttcttcgtagctgtgtgtgcctgaagtcagctctcaggctgctgtgcaattccttcctatgcagaaaggatgtgtggtataatggaaagagcagatatgggttcagatttttaatgtacttctgggatcttgcaattttgttttttagaaaatgaaagtggtaacatctttcttactagtttttttgttaaggccagtgttttagcttgtctttattactgattcttaatcaca

SEQ ID NO: 50330 - DNA, 1057 bp, Homo sapiens
aattccctaggtagcatgtctcaaactgtattctttggaatacttcaattggactttgagtagatgccacttgagaaaatggttctgtgcgctaataagcctcctttacctaagatgtcttagagccattaataatgtcaattagctatgtgactgccctagtggaagagaaattctgtctataacatttcccaaattacaggattcttgtctccctttatagagcaagacattctaacacactttggggaactccagtctcagtattgtctggcttgtaatggacactcagtatactaacgttcccccctcccactgttgaaaccagttttagaaatatgagaacacaacaacttctaaatttttaaagttgatgtctcatggacagtgatgtcttggttttttaaactacaaatgtttcttgcagtagaattatagacaccaaggtaggactgcacttgttatgggaacatttgtgtgtgtgcattcatattggctctgttattttattgggtgcatcaaatgcttacacttgggacttagagtctagcgccactcatgcaaataacctgagatgatttagaattatgccaccagcatagtttctaggcatccagagtcttgtgttggcagcagaagtaccccaagctaagctgtttccgtggggggtctggctgtagttccaggctccctagcttccttggttcctcttagttttctgcacgtggagctctagccttctgtcagttctgtgagctatcagatactctccagtaaattacttggctgcattaattatccagtctttctgtagttacagacacttgactagtatagtacactaggtcaaaacagcattagagcaagttgcttatttgtttgaagattcatcagtgactcatctgcattaaaaaagtaaaatggttgtgatttgcttatttcagtgcataagttactctgtgctcttgttttggaggattgtttttttaaaatagactttatttttagagtagttttacattcccagcaaaatcgagcagaaggtacagaaatttcc

SEQ ID NO: 50331 - DNA, 1115 bp, Homo sapiens
attcctaatagtcatcagtatcaccactgttaacacatttgggcagcaccatgcatggcaggtcagcaaacaggtaaatcttatttttttaaacattacacataatatctaaagtatagtatgtggcatgtaataagtgctgctgaataaatggaagtcattgttcagtttttagcttaatatatctttttttttcttttaacataacatttactgaatgttgctaagtataaggagtaagggacataaaatgaatgagacttggtctctgcccttgagaaactcacagtcgagttaaggactgtgaaatcatgtttaaagttccttagccttttcctttgtgtcatcatttcttcccctgcactgtctatgcatgatatagcctgtccattgtttctcacagctttcctaattctgtgtgcctccccagcctttgagactgctgatatgtgagaaagccaacaattgtcttctattaatacagggtaatatcaagaaaaacctttgggccaatattggatttcagagtggcatgtgcagttgacattacaataccagtttatggtctttagatgggcctgtacacctgggctccagcctctttcctgtgcctttaaactgccttacttccatctttcctcccctataccctacccttaatgtacttggtacataaaaatagaggctcccatacccaggtagtgatcaagtacaatgtaaagaaacagctgtacttcatataaactaggattcgagtgggcctagggtatatcactaaatttccattcttatctataaaacagtaatcggaaagcctatttcataggttgctgtgagcattaaagcgagatgatgtatttttaaatgcttgtaaagtacgaagataaggtcattataatttatataaaatacttagtagctatgttacttggggcaaattacctcatcactgagccagtttcctcatcctttaaatgaagatggtgatattcatttaacaaatatttattgaggacgtagtcattgcagctacatcctgggaatacaaagataagtgactggagaatgtaggacagtgtggtctaggggaaggagacttgcaaatcacacaaaag

SEQ ID NO: 50332 - DNA, 1030 bp, Homo sapiens
gttcccaggtgatacttctctatttcctgcaaattggcagctggatccagagacttgataaatttcaggttcgttccctttggcaaatatattgcgggggggtggggtgggggggtgttcattcacaacattgattatgttacgatgacttgaattttttggatccattaatttgttggggggctacaaaatggtgacgttctgatgctatcattttgttttcatctgttagctggaataattttgtttcccctcatcttttatttggttactcagcaatatagtttatataggaagagcaggataaatactcaattttttaaaacattgctttcaagatgatgaattggtcccctgtcatcttcaaaaggttacacatataagtgtatatataactatgcatccatagatgtaaacatttgatgggtttcaatacattgcagttctgatccttagcgaagttcaaattgcccttcttgtggctagtggaactctcttaaagttggctcctgattcttactgacatgctctctagtagtctttgatagcttccttgctatctggtatgtcaagatgtttccaggcgcattcttgtgcatttctgccccagacctggaattagctaatgggattaagataaaaggtgaagtcaaaagaaattctgtttttgccaagggtagcttggaactttctatcaagttccacttttctctttccacttaacctccctagcctgcctcttcattcttctctacctttttattagagttaaggtggaaaggtttgagaagccttgataatcataggaagatcatggagcccaggcagttccggatttggggcctggccacttactaggtctgtcagtttgggcaagttaacctatatcagttatgatgtggggaaataccttattcatatggttattggaattaaagagaaaatgtaaggtgttagtacatggtaggtgatcagtagatggtaatttatttaatgtactattttacttaactccttcaacagctcagag

SEQ ID NO: 50333 - DNA, 1033 bp, Homo sapiens
atgttagtgtctcagctgttctgacccataacttctaagctattaagacctaataatgagttcctggctgtcatacagttcttgaaatggcaatactaaaacagtttttgagagcttctacttacatgttgattttcagctattatacacaaccttagttttcctactgtgatttttcatttcatttcatctgaaatttatgtttccttagcataaagtcctttaaggacttttaggctgctttatgatgatctcactatctataaggttgatattcataagtacttgggcttttggtgttttgctgtattattcgttgtttcctcaacgactggttactagatgtttatatatgttaatgtcaggaataactcaacttttaagtcgtttgatgtttcataggtggtgttgttaaaacttgatgtacttgttgaccagcttggtcttctggatatagaaatcctttcaggtagtgaagaagtggctctatgagtaaaacaactgtaggttttgtttgggctgttaacctgagcattttcaacttttaagttctctttaaaagtttttagtcatttggctttaaaaattacagttggtggcatagaatgatcccataatgtgattttacagaaagttggaatgttttaatttattatgaatgtaccattacgtggagattgggattgtagatctgattcagtctggattgctgattgaactagatgaatgttaaaattcttcaactctgagattctgatggtataatcttaggtattgaaagacagcagtttttcctttcagtagtcattaagtaaatggtgactaaaagtagggagatgaattattctggaatgacctttcactataaccatttagatttaaaagattgatgagtctgaggatactgtcatgaatttatgtaccacctttagcacaatccaggttttaggtccttgtgattagatatcagagataattgccccagaagtgcgtgggtatattacatttggtggctgttaatgttttggaatga

SEQ ID NO: 50334 - DNA, 1083 bp, Homo sapiens
caaagttcaacctgagttgccaggatgtttatcgtttgtctcccaatatggccaaaaagcatgtatgaaggtgaagaataatttttatatgtacagttgttgttttttttcacagaaacaatgaaacaaatacgtccttagtgtttatattgagggtataaacttgtctaaaaaataaactgtcttctataatttcatttgggttgagaactcagttttcaggaatgttgtctaagcgttagaagtattagagttgttggttctgaattcctcagttacttctcaaagcaggtcctaaaaaatgcaaatagatatgtaaggactattgctttagaaataataactagttatgtttgaacataatagaatggttaaccctcctcacacaccctaataaatgtgttgtgtatctcactcctctcccccaactttttttttgtaggtcctccagcagcctgacctgagtgggttagtgatccagagaaaccagcaggccaacttggtcaggaaggttcgggaagctgttggagcagtgtggggaatttcccaccaggatgagtatgattggctgtgattttaggttagtttttgtaaatcttgtgggaagtatttgtattttacttcctggaatggagatagtaggggtggatgtattcccattctgtaatggagctactttggtttcttccattctctggatctgatgtggtactggttgcttctttttttaaagtggagctcattactgaattaaagggaattgtttaaatgaatgatgtctgtacatgattttttaaatcaccctaggcatcgttcaaaaaataaaattgcaagtcattatgtctaaccagttcttattaaagttacgaaaaatttcaaacatgcaaacattgaatagtataataatccccccacttacccatcaccagctttaatagtatcaacttgcacattctatttcatctatacttctgtttgtttggttttttttaatttttttaaattgagatggggtttcatcgtgttgcctagactggtcacaaactcctgggctcaagccatcctcccttcttggcctcccaa

SEQ ID NO: 50335 - DNA, 1046 bp, Homo sapiens
cttacagcgccaacacaggcatgtggtcttataatttgcagaaatgcgtgagaacttgtcaaattctttatggatatctcattctttagcttttttttaaccatttgggttaatctattgtttgtcacaactgttatccatcaccttaaacagctatgacattaagcacatgcctttaaaattcttttttaaacacccatcagggagggagaggcttttagtactaggctttgaaagaaagctctagctcctttctgctcactacattgctgggaacttggactgctgtttttcaaggtgttcactaagctggggtaaggtagatgtgtctagggcaagttaaaatgcacaaagctcattgttcttactgagattcagctgtttttcttgaatcaagtgctttccaggttgctgcaagccttttgttaatttccagagttctgaaaaaatttatcctgacaatttttgctagtttttttgttgtttttattggggagtgaattcttggaggtcctttgccatgtttactgatgtcgcccatcataacatctcatccttaatacttaaatatgcattgaatgatattttcttccataaccacggtgccattatatgacacctaagcaaagtaacatttatttcttttttttttttttttttttttttgagacggagtcttgctctgtcacccaggctggagtgcagtggtgcgatctccgctcactgcaagctccgccttccgggttcacaccattctcctgcctcagcctcctgagtagctgggactacaggcgcctgtcaccacgcccggctaattttttgtatttttagtagagacggggtttcactgtgttagccaggatggtcttgatctcctgacctcctgatccacccaccttggcctcccaaagtgctgggattacaggcatgagccacagcgcccggccaacatttatttcttaatatcatctagtaccatgtacttattcaaatttcccccagttgcaccaaaaatatcttttgtaattggcttacttaaaccagaa

SEQ ID NO: 50336 - DNA, 1039 bp, Homo sapiens
ttttttcttttctttttttttttttttttttttttttgagacagagtcttgctctgtcacccaggctggagtgcagtggcatgatcttggctcactgcaagctccgcctcctgggttcacgtcattctcctgcctcagcctccccagtagctgggactacaggcacctgccaccacacccagctaattttttgtattttttagtagagatggggtttcaccatgttagccaggattgtctcgatctcctgaccttgtgatccgcctaccttggcctcccaaagtgctgggattacaggcgtgagccaccacacctgtccgttttttgctgattttctaattgctctatccattattgaaaatgtggtattgaagtctccagctattattattgaatttatctattttctcccatcagtttggtcagttttcacttcatctattttgagcctctgttgtaaggtacacatatgtttgtaattgttataccttgttgatggattgacctttttatcattataaaatgctcttctttgtctttagtaatgatttttgtctcaaagtctgatgttagtatagccattgtagttttcatttgagtaccacttttattgttatctcttttttcatccatttattttcgacctgtgtcttcaaatctaaactgtgtgtcttgtatagatagcatatagtagggtcatttttaattcattctgccaacatctgcctatcagttggagggttctaatagctgccaaagttcgactcaatatccattttgctatttgttttctatgtgtcttattttttgttcctcaattcctccattagttactgccttcttttatgtttaatagctattttctaggaccccccccgcttttttttttttttgagacagagtgtcactctgtcacccaggctgaaatgcagcaacgcgatcttggctcactgcaatctctgcctcctgggttcaagcaattcttttcctgcctcagcctcctgagtagctgggattacaggtgcctgccatcacgcct

SEQ ID NO: 50337 - DNA, 1051 bp, Homo sapiens
gatccacctcggcctcccaaaatgttgggattacaggtgtgagccaccacatccggcttctaccatgaatttttgatccttggtaattcataagcaaacaacagtatctcattgatttaatttacatttttttgattaagcatagcctctatgttttattagcatcagagtttcttccattgtaaattttgtttacatcctttgcccacttatccatgtggttcttcaaggttttcgagttgcccattttatatagtaagggaatagtcatcctttgtttcatacacacacacacacacacacacacacacacacgcacatattttatacttataatgtgcttgtacttcttcctcattctacaggaaaatttgaatatttcagtatcaagtgttgatcatttgtttgcatattcagagagtagataattaacacccttgtattttttaagcataatttttaaatatctaatgtgttgatctacaaagaattgcttaatatatggtactgagcagaagatataaattggtattccccccaaaaagatgactgttggtgctagaatcacattcccactaagctgaaaatgctttctttgccatgtgtactgactcatacgtatcatgggttgtttgaggcacatccattttgtaccatcaaagttctgtctgctcttgtgctggtatttcacttattcactacctatttatgacttagaaaaaccacagacttttttattttgaggcagagtctcactctgttgcccaggctggagtgtagtagcatgatctctgctcactacaacctccgcctcccaggttcaagcgattctgctgcctcagcctcccaagaagctgggattaaaagcacccgccaccaccatgcctggctaatttttgtatttttagtagagatgggattttaccatgttggctaggctggtctcaaactcctgacctcaagtgattagcccgcctcagcctcccaaagtgctgagaattacaggtgtgagctaccacgcccagccaaaaaactgcaaacttttaaaaag

SEQ ID NO: 50338 - DNA, 1061 bp, Homo sapiens
aagtgagctgggaagttgtgcttctagcctcaatgcttgcagcatgtttcactgcctacaccatagcttacagtgtccacctcctacctctcattttcctccagtcccatctgtcaaaatcattcaggatagttaaaggcttaccttttctccagcgcctctcacttaaaccacaaaactttgggctggttggaagaggacttagagatagattatatgtggtccatgggctttcaaatgttttaaagcaatggaatcctttttttaaaatgacatcttaggtggaagcccaatattcaaagcataactgctttgaataagatgaaggtgggaggcccagggctccacttgttcttctcattcgccttctaccttcccccgattctcggggctcctcccaagaagctcaaaggagccacagaacatcttcaaaaatcacctttccagtctagtcctttaattttacagctaagcaaacagtctcaaatggtcagataactttcctgagctagttacagagctagctagcagcagaattaggactagaacctctccttctctcaaatcctgtagtccttagaatttgaaccacacagattagtacttgattattttctgtctcatgtcagctacttaatggagtattttctctccagttttgacagtagtgctttgctcgtcttcttacttgtcaatggctgggtaaagaaatgccacccaataaattcttgatgactcattatgtaaaagctagggtgtgcatatgtggagcatctataagccacttccatggcagtaccaccagtaccaggaacagacctctgctgttagtgttgagagaacccttgagtaagctctaaccccctcatgtactaacactcttgtaggacatcttccaacagaacgttgggaagacgagcaatatctttgggctgcagaggatcttcccagccggctccattcccctaaccaggccagcccattccacttcagtgtccatgtccaggctgtcactgccctccaaaaatggttcaaagaagaaaggcctgaagcccaaggaa

SEQ ID NO: 50339 - DNA, 1059 bp, Homo sapiens
gctgttgtttttaagatgcaaggttaaacaacctgagagtgtttaaaaactgtatttgtttgtttatacttcacttcatcctgaaagactattcaaggtagcttacagagatgtggagaagccaaaaaaaaaagagagaaaactagaacaaaagtgaaataagattgggaaatagaatgcatgtggtgggtgctcagcacatttcccggttggtggaaatggactatagagttttcagtgaatttcctgaaggtcagaacaaagagaggagtgcagtattgtaagatttgtggctttacgtaggataaaagcaacagatgtttcagagaaacatttctttacctggaactgagccctgtgaggttgctctagtggtttctcataaagaagacactatgagatggggatagtgcaataacttctataatccacatgccaagtgagtagtctggagtggggctggggagtatgagcatttagtggaggaaatgaacacctttgactggagaagcctgtggagcttggacttgggacttctggagatgagtagaatgaggatactgaccagacttacagaacagaaataagtgtcctatgtgcctttggggattctgtggagggaacttgttctctgacttatctgaccctcactgaactgtggggtattttattcaggcctcaatcttctcttcctaatcagctgacatctgctctccaccccttccttggtagactttctaaccttgtggagacaccgaagattgttcgaaagctgtcatgggtcgaaaacttgtggccagaggaatgtgtctttgagagacccaatgtacagaagtactgcctcatgagtgtgcgagatagctatacagactttcacattgactttggtggcacctctgtctggtaccatgtactcaaggtaggaatgcgcatggcttctggaggcagccaggccttgggcctccctgtacgtgtcacatggcagcacagaaacattttgaatcagtttgatttacattttgaataaaaaaaatttgatttggccgggcgcggtggctc

SEQ ID NO: 50340 - DNA, 1056 bp, Homo sapiens
acttagtagttttgtaattgccaacaatttacttaaccactcagacccagatttctcatctgttagattaggataatattaacgatgatgatgatgatagctaatacttaacatgtgccaggaactttaagtacttaactattttagctcatttaatcctcttaaccaccctgtgaagtgggtactattagtacttccatttcacagatgcagaaactgagatgcagaaaggtgaagtataaattgcttaagttcacatagctagtgagtggcagaggtgagattcaaacccaggcagtttggctcctaagcctgtactttaaacctctgcttctgtgtttaatgtctgtgaatgttgtacggaaggccctgatttgttgtggagattaaatgtgataatatgtgaagttcatagctcagtttttttctcagtgccttttatgctaacttcaaattcattcactcactatcctgttaccttgctttactgactttatagcacttacgaaactgttttgacactgcctctctgtctcccgctctaaaatgtccagtccatgagggcagtgtctgctcaatcaatatttgttgaatttatgcactcatttacttaacaaatactgcttaccgtgtgcttggctttgcagtataccatggggataactcatcttaatcacaagacctggtgctataataattatcctcttgactaaggaagctactcagagcaaatcagcatttaccacccttggtcccaggtggtaactatcgagacagtgcagccagaagcccgatttttcatttgtctgcctccctgatatgaggagttgtctagcacgttgatgtttgttgaataataagtaaggcaagactgagagatgggaaaggtgaggacttttggtaaataagatacactatctggcaaatgtagtggggacagacagcaggtaagtgagcaattccaaggcctcgtggtgaaggctgaaatagggatagtgttgtgggggtgccacagcagcagggaaaaggaagagcaggaatgttccaggtagaagg

SEQ ID NO: 50341 - DNA, 1022 bp, Homo sapiens
ggggctgagctccgcgggcgtggagtccttgcagcccaaagcatgaggaggtccctgtaggattctggactgaagacgttcttgtcaggtttggggcgtgaggaggttcctgtcagttggggaagcgttaagattcctgtaagttttgggggctgcgaggctattactgtcagttttaggatatactgtgaggtacctgaacatttggggagactagggagctctcatcagtttgagggggggctgcaaggaaacgctgccagtttccgagcgatgcaaaagaatccttgcttagtttcgggagtgtgaggaaattctagtcagtttgaggggttttgaatagatccttttgagtttcagggatgcagccagaaccctgtcatctttaaagtacagaacgagctggtcagtttagagatttatatttatttcagttttgggggtgatgagactcctgactggtcggggaaggaatgatattgagagtgatggaaaggattatttaaactctccgaacacgaccccagaactgtgatttgagttgggcgcctagtcttgtctgtcttgttcgtgaaggctttgagtaacctgaagagactttcagggatcccttatctctctctggttggccctatttcaggtggtgagaggagggtcttgtcttgagatacccccagcctcatttttgacgctgtggtttgcgtcataatagagggagccctgtgaaacaggggtcagctaggggagggttcagtgagagatgaaagaagcttcccgaaaaggcttcaggtattttcttgaaacccggaaagaagttatcactgacaacggggccgaagaaggtggggggtggggagtggagagtgtgggggcggtgggaagcctggaaggttgagctccgttctttacgtgtgaaagaaattctaagggccgggtggactttctctggttgccccctacagccgcaccagctgtgttgcatcccggcggcggtaactctattggagaactgagggttggtg

SEQ ID NO: 50342 - DNA, 1043 bp, Homo sapiens
ctaattttttgtatttttagtagagacggggtttcaccgtgtcagccaggatggtctctatctcctgacctcgtgatccacctgcctcggcctcccaaagtgctgggattacaagcgtgagcaaaatatttacactccatgactcagtaaccttcttttgagtgtccatctagagaaacatgcctgggcacaaagaggtccctacggcgatgttcactgcagccctgtaatagtgaaaaattaagaccactttaaatatccatcaagggagaggagaaatagattaagactgcctccttccccagtgatggaattccctgcagtagttaaaaagaagaaagttggctgggcgcagtggctcacgcctgtaatcccagcactttggaaggctgaggtcggtggatcaccaggtaaagagatcgagaccatcctggccaacatggtgaaatcccgtctctactaaaaatacaaaaattagctgggcatggtggctcgagcctgcagtcccacctactcaggaagctgaggcaggagaatcgcttgaactcgggacgtggaggttgcagtgagccgagatcacgccactgcactccagcctggcgacagagtgagactccatctcaaaacaaaaaataaagttgattttttttttgtttttttggtagaaagatctccaagacttattgtcaactgaagaaagcagttggccgcctaatttgattgaacagtatgatcctgttcatgtgaaaatgataaatacccacaccaacctccatatttctgtgttactatcctgccactacccacccggacccccactcccagtggagaggattttggtttgagcagtgaggctgtttgagtggcttcaatcccagttcacctcacaattaccaccaagtaggcatgggagtcagctacataattggtgaagcccagcacaacgtgaaaatggaatggagagcctcacgttcaaaaagcagaggagaaagccgggtgcagtggctcacgcctataatcccagcactttgggaggctgaggt

SEQ ID NO: 50343 - DNA, 1034 bp, Homo sapiens
cacactaaccaagattatagaaatagctgtgtggatatggctaaggggtgggggaagaagggggtgagagataaagaactgatttatgataagaaatagttatcacaatgtattacacatttactcttctaatcactcttacaaacacgtgagctcattgaaaccacataaataccctgtgaagtatttattattctccattttattattattatttttttgagacagggtctcgctctgtcacccaagctagagtgcagtgcactgcagcctcaacctcccaggctcaagcaaatttcccacctcagcctcctgagtaagctgggactacatgtgtgagccaccacacccagctaatttttaaatattttttgtagagatggggttttgccatgttgcccaggctggtatcaaactcttggcctcaagctgggtctcccaaagtgccgggattataggaatgagccaccacacctggcctgttccccattttaaacaggaggaaattgagactcagaagaatgaagtatcttgccccaaattatctatgaagtcagtatcagaattgacattacagcctgagctaactgattgcaaagccccgtgctatgctaattccaatatagtataacaactctagttgttagagacaaacatcagactcaagtgtggctgactctagtgtacatgcctttaaccattactactagagctttctttctctaagggcaagctacaagagaggccttggtatcagaagtttgcttgggggcatggaatcagaccaatgatattagctagctttttttttaatgagtcacctaggctggagtgcagtgttgcaatcatagtttactgcagcctcaaacccctgggctcaagtgatcctcctacctcagccttctgagtagctgggactagaggtgcatgccaccatgcccagctaatttttatattttttgtagagacagggtttcgccatgttggccaaactggtctcaaactcctgagctcgggtgatccgcctgcctcgg

SEQ ID NO: 50344 - DNA, 1044 bp, Homo sapiens
gggagaggcatgcatcaaggctttatcatttctagcaaaaattcattcaaatatcaacagttttccagagatggaacatgaaattggacaaggtttctcctctttgtttatgggtaaagttgaggaatctctcttgagaagcaaatcgtttaagaagcagtggattcactctcagctataacaagatatttggattaaccatgtgccatcccgatacatgaagaataaagatacataagaactagtgttcattcacttgacagaataattctaaagtccatcaggaaaggcaaatgaacaagattagcttagaaaatgtaacaaaaataataataagatatatcttggtcctgcagcaagactgttattggaaaaaaaaaaaaaagaggtgttttggacctattacgtaccgaagtgtattataaactcataccaaaataatgtagtattatcacaaaaattgacagctcattgttttagagcagataataatgaataagatccttgacacgttagaacttaaaatacgctaaagaaagcatcacaaatcaatgaggaagagatgcattttttaaataattatttagagaattggatttgtatttggggagaaaacatccatttagagccatgcctcacataaattccagatggattaattataaagatgaatgtaaaaaagataaaaggcagaataaaagctaagcaatgatttgctgaccttgagataggaaagggattttttttgttgttcatttcttttaggaaaggaattttttaaatgagagtacacaagccttaagcccagagtattgtcagagacagtaactatcttggtgacaggaaaggcaaatacctcagttgcctgagatataggcaaactgaaaactacaaaacactgttaaaaaaatcataaaagatataagtaaacagaaagataccccatgtttatagataagataaaatccttcttgttgatttctaactagaaaaaaagaatataaaatattgttaagatggcaatactccccaaattgatctaca

SEQ ID NO: 50345 - DNA, 1034 bp, Homo sapiens
ttacataagcataatgccattattactcctgacaaaattaatgctaatttcttggtatcatcttaatatccagtccattttcagattttcctgattgtcttaaaatggccttttgtgattagttcaaatcagaatccaaatgtcaactcattataatattacatttaatagcaaaaaagccaaaatgtctcatgaaaggaagcctgattaattgtgacagtgtcatatacagtagttatctctgcaggaagatggatgatatgtttttattgctttatacttttccatcttttccaagtgttctgtactgagaatgaaggggcaaaactatttttaaagaaaatattttaactgtctctctgtggatttaccaaatgtgaattccatatctcccctcaacttcactctttttcttagtgatccatctttgatgtcagtgtcccttgcttatcttgcctttctaggttcgagctcatcagctggttcttcctccctgtgacgtggtgatcaaggctgtttctgagtatgtcagttccatcaaagatccctcaaacctggatgtagttgggaaggatgttttcaaacagtctcaggtaagttagcattccccttcctaagagtcctccgttttcttaccttcttcagcaacaccagcaggtccctgatcttttctgtgacacctaagttttcctagctgcttgtcttctccatgcttacaaatgagagctccaaaatttcctttaaaaaacattacacagcctggattgaaagtgccctttacctttttttctactgatgattaaagtaatataagcccattctagtccgggcacggtggctcacacctgtactcccagcactttgggaggccaaggtgggtggatcacttgaggtcagaagttcaagaccagcctggccaacatgatgaaatcccatctctactagaaatacaaaaaattagctgggtttggtgaagcagaagaattgattgaacccaggaggcggaggttgcagtgagccgagattgcgccgct

SEQ ID NO: 50346 - DNA, 1064 bp, Homo sapiens
agcagtattatccctgttttccaaatgaggaaactgaggcacgggcttagaaacttgcccaaagtcacccagagataagtggcagggctgagatttgtgcctatgtggtcttcctccaaagctcatactctaaacaacagtgctgctctaaaatgaatctttctaaagtgccactgtgattagatcatttccccactcagctaaactcttccttggctcctgggtaaagacgtgttcaggtcattcacttacttttttatttgagtgcttgctgtaggctaagtactagctgcttgctgaggactgagaggtaaataaggggatcccgtcctcaaggaggacaaggtttagtgaaagagataataaattgcagatactgtgggctaattgcaagtgatgaaaaatgtggcccctatagggggcatggttaattttgagtaagggagtgaaagttggggaaggcttcaccgatggtgctaagccatgaagagggctgtagatagttcagatagcggacaagggtgtggagacccgaatagccagttatgagctctgaatagattttgattggaggttggcaggagagttgaacacttgagtatgggtttgtggtttccaaagttttttttgtttatataccccatcagtcaaaatctttagagaagcagcccttagtatatttttgtcatacttcactacacagtctcatttttaaaatcccagcagttaataaaaaagatggattgaatagatggatatgtgataaatcaggtatagtaaaaatagtagaatctcagtcacgggtattcagatgttcactgtaaaattatctcaactttgccatgtgtttgaagtttttcataataaaatgttggggaaaaattcccagcagtcctctttagtccttagaagcactcttggggaatgtataaatcttattccctgtgctagattataaacaaactctgatctttttgtattctccataatgtcctgtgtactttgggtgcagggtacattgtttttttccatagtgaataggtcaatgatcctaagagaatgga

SEQ ID NO: 50347 - DNA, 1067 bp, Homo sapiens
tagctgggattacaggcacgtgccaccacgcccggctaattgttgtattagtagagacggggttttaccatgttggccaggctggtctcgaactcttgacctcgtgatccacctgccttggcctccaaagtgctgggattacaggcatgagccactgtgcctggcctgacttattttatgagttatataatgtaggaactttaattttccttttctgccccttcaaatcacaaaagtaaccactaataatttgatgcttattcttcttgacttttcttaagcttatacagatctatttacatacatataacattatattcataaaaatactgtgctgtatacatactgttctgcaacttaattttttcattttacagtagatcatggacatctttctaaatctttattgctgtatctttttgtcatttttgttattatataagtaataatatatacttgtacatagtatatatgtactacgtacaagtaaaatccaccccatccccaaacctgtagacacagctgttaacaaatctttccagacatgattttaattaatatacaaatatttataaagacatactttttatatatgatatattgtatctttatatagatatagatacatgttaatatttatatacatatacttatttacatatatgctattctgcatttttttcatttatgggtatctatccatgtcagtacacatagttccatcttactcaactttttgaaacaactgcataatattccactgatacatataatttaaagatttaaaaattttttaaattattttaaataataaatatcacataatgtgattcgaatcttaagaaatgaactgttatttctgtcatttaaactttgttgcttgaaggagactctcccaagtgtcaaggtcaaatgaattcatttatttgtttcaagtgtctgttgctatatctggatcatacttagctgccactgtttctggtgtcatggaattcttcttttttcccctaaaatacttctatgagtaatattttcaaatatattgcatgagtatcctatttggtatt

SEQ ID NO: 50348 - DNA, 1074 bp, Homo sapiens
ccctcctgactctccccactacccttcccagcctctggtaaccatccttctactttctatctctatgagttcaattgttataatttttagctcccacacataagtgagaacatgccaagttcatctttctgtgcctggcttattgttcacttcatataatgacctccagttccatctatgacaatatctcattcttgtttattgctgcatagtgctctgttgtgtatatttgatttgactcttactttaacatatatctgcatcctgacttctcaacaccttcaccattgtcgtgctggtctaattcagctctttttttttttcgctgtcttgtccaggctggagtgcagtggcacgatctcggctcgctgcagcctctgcctcccaggtagctgggagtacaggcacccgccaccacatctggctactttttgtatttttggtagagaccaggtttcaccatgttggccaggcaggtctcgaactcctcacctcaagtgatctgcctgccttggccttccaaagtgttgggattactggcgtgagccactgtgcccagcctcatctcttgaataattgtagtagtctcctaattgttcttgcttttgcttttgttcttttgtagcctttttcttattgtaggaagcagtgatagttttaaaatgcaggtcacaacatgtctcagagacccacaacctctcgttgctcatctctttgatagtaaaagccacaataatgtactaatggcctgcaaagtcctacaggatctggactcccctgcacaactctctgacctcatgtagattttctttgacttccgttttcctcttttttttcagacggagtctcgctctgtcacccaggctggagtgcagttgcgcaatctcggctcactgcaacctctgcctcccaggttcaagcgattctcctgcctcagcctcccaagtagctggaattacaggcacatgccaccacgcccggctaatttttgtactttcactagagacggggttttaccatattggctaggctagtcttgaactcctcacctcaaatgattcgcctgcctcagcc

SEQ ID NO: 50349 - DNA, 1047 bp, Homo sapiens
gggagacggaggttgccgtgagccaagatcgcgccattgcactccagcctgggcaacaagagcaaaactctatctcaaaaaaaaaaaaaatacagaggagttgaataatataatccacaatccacaaactttatttgatggatgtatagaactttatatccttcaagcaagaaatatacattgttatatgtggcccccaaaaacccttaagttaaagcagagagattttgtacttgcattactcaataagattagaaataaataatgaaataaataaccaaaagattcttaactaattagagagcagaaatcacattcctaggtaaattttgaatcaaagagaaactgaaaactgaaaatgaaaatgaaaatgaaaattataaactagaaagcaatgaaaaagagaagacattacaacaaaacctgtgggtcattgcaaaagttgtacctgttagaaaatttatagcctaaaatatcttcattattaatgaacaataactaaaggaatttagtactcatgttaagaaattaggaaaataacagcaaaagaaaggaagagggaattcagaaaaactgaaattaatttaaaatttatatacataaaaataggataaatagattttattattttgggctttctgaaaaacgattaatgtacctgatgaagaaaatagggcagaaatacacaaggaaaggaatgagaaggccgggcgcaatagctcactcctgtagtcccagcactttgggaggaggccgaggcaagtggatcacttcaggtcaagagttcaagaccagcctggtcaacatggtgaaaccccatctctactaaaaatacaaaaattagccgggcgtggtggtgggcacctgtaatcccagctactcaagaggctgaggcaggagaatcacttgaccccgggaagcagaggttgcagtaagctgagatcgcaccactgcactccagcctgggcaatggagcgagactccgtctagaaaaaaaaggaatgagaaataaaacatagcatgctatgaaagagaataaaagaaatt

SEQ ID NO: 50350 - DNA, 1033 bp, Homo sapiens
gaggcgggggtggggggagacaggtatttaaaccagcctgcattttagccccagttctgacatgttcctgttgataacactggagccacggaaggttcctgagtaggggagttcctgagtaggggactgaagacagagcatatgcaaaaccagttagaagctggggcgggggaaaggtctagccccaaggtggccccagctctgtccctcctcccgccaggatgtgaaagcccagcgcagcctgcccctcattggcttcgaggtgggaccgcccgaggcaggggagcggcctgacagaaggcatgtcttcaagatcacccagagccacctcagctggtacttcagccctgagacagaggaactacagcgacgctggatggctgtgcttggccgggcgggccgaggggacacgttctgcccggggcccacactgtctgaggacagggagatggaggaggcaccggtggctgctttaggagccactgctgaaccccccgaatccccccagacccgagacaagacctagagggtttgggacaaactgggagcccccaccccacactctagttgcccatgtctgattgggggctctagccccttccctcccagctcagtcaatacttgaactcccatcacgggcactttcaatcccgaatgctgggtcttgggttttttaattcatcttttcacaaaacgtgggcttttaaaaaatatattcctacagtgatgtcaatttttattaatccctgtccccagggagggtgggagccgttgccagtcctacctgaattaggtcgtttttctccctcatccctcaataccctaccacagatcctgcctccacccagttccccacaaagcaccagaggtaggagacctggattcaagtgccagctctgccactgaccctggggccccgacccagccctgcctcctcagccagtgtcttcacacgtacaactccacgtggggtggcaactagacctctcctgcctctcccatggcttacagcttctacccggccccaaggcta

SEQ ID NO: 50351 - DNA, 1032 bp, Homo sapiens
caccaaacgcaggcaccactgcaaggcctgcgggcatgtgagtgttgggaggcaggggcagagctagggaggggacagaatggcagcccaaaggcccactgcagagtgggtaccctccaagtggggggaggccacaagtctgctgtgggagttggtatgctgaagggaagacccgctggaatcaggctactcttgcccacttgccaccccaggtggtttgtgggaagtgctccgagttccgggcccgcctcgtctatgacaacaaccgctccaaccgtgtgtgcactgattgctatgtggccttgcacggggtgcctgggagcagtccagcctgcagccagcatacaccccagcgccggaggtccatcctggaggtaagagccagcccctgactaactctcccacagtgggcaaatgggttccaactctacccagtgagactgaggaggcccgagtatttgggaaacagtagtgatcaagggacccaggcttggagtgaataaaatgacggcaagagtgaatgaaagacagtcatctttaagtacttagacatttaatccccacagtaactaatctgcccatgctattgttctctttattttacaaacgaggaaactgaggcccagaggggtcatttgcccaaattacacagcaaatgagtggcagcactggatttttttaaaattaaaaaattggctgggcacagtggctcatgcctgtaatcccagcactttgggaggctgaggcgggtgaatcaccggaggtcgggagttcaggaccagcctgaccaatgtggagaaaccccatctctactaaaaacacaaaattagccaggcatggtggcgcacgcctgcaatcccagctacttgggagggctgaggcaggcaaatcgcttgaacctgggaagcagaggttgcggtgagccaagatcgcgccattgtactccagcctgggcaacaacagcaaaactccgtctcaaaaaaaaaaaaaaaatttaaaaattgtcttttgttattacaaagtaggataagt

SEQ ID NO: 50352 - DNA, 1035 bp, Homo sapiens
tgctatgcctcagtttcctcatctataaaatggggggaaataataacggcctaccttgtagggttgttttaaggattaaataacttaatacataaaagagcttagaacagtaccaggtataggccaggcatggtggctcacacctgtaatcccagcactctgggaggccgaggcaggcggatcaccaggtcaggagagcgagaccatcctggctaacacggtaaaatcccgtctctactaaaaatacaaaaaattagccgggcatggtggcgggcgcctgtagtcccagctactcgggaggctgaagcaggagaatggtgtgaacctgggaggtggagcttgcagtgagccgagatcgtaccactgcactccagcctgggcaacagagcaagactctctcaaaaaaaaaaaaaacaaacaaacaaaacagtaccagatatatacagtaagtgctcaatggatgtaagcttttgttatttttacagtgctatgatagagcagagaatgggaggctgtgggaatccagacaaatggaccaagcctagcttggagattacagaaggattcagggagaaggtgatgcctaagctgagtcctgaggtagaagggcaaggtttacaggcagcctctcaggccttcttccaatccagcctttagagtccacaccatttgccagaacggtctctctaaacaagtcagaccatgtctctccctgcttaaaatcatgtccacattccccatacctacagattctccacacctacagagtcaagtgtgtccccctcaccagactgtgaccacagaaagccagcatgaagcctggttcctatatctccccacgagtctgtgaaccctgagggctgggaccaggtctggtttgctttgctcctgcaccagactgaccaatgaggagtacaaccaggcctggtctctttgtctcacctaccagatggtgaccctctcagggctcaaatgggtgtgactcatttctgtgtccccagcatcacccagcacacagttgataatcagtatatg

SEQ ID NO: 50353 - DNA, 1069 bp, Homo sapiens
gtactgggttttatttatataatttttattgttgtattgttattttttgtctttttttccaaacatttcgatcaatcagcctccatgcagaggccgaggatgcaaaacccatgaatgtggagggccacctgtatgccacatgtctgtgattgtgagttcgtgtttctgagtgtgtggtatcatgtgactttatgctgttttgccactgtatgtgattgtgtctgacatggtataattgactctgtgcctatagtctttgtgtgtaaccatgtttgcaggtgtgacatggtgtgtatgacactccatggccctgcaattgtgagacatagtgtaaatgacaatgtatatcttttgtgactcagtgaaaccatgtttgaagaatgtctaactgggtatatgattgtctgtggttgggcggttgtatgaagctgtgtgtgagatggcagaattgccattgtgtgactctgtgtctttgtgactgcatgaccatgtttgcaggtgtgtgtgatactgcgaggctgtgtgatcgtgtgtgaggttgtggccgcaggtctttgtgactgtgtgtaactaggctttcaggagggcgattacctgcagttgggtgaaatggtgtaaataacaccaagtgtttctatgactgagtgggcccatttgtgactagtcatttatgagactgtgtgtgatataagctaacagaccctttgtggctgtgagtgggaggccatgtggttgtggcacagcataacttacaccatgtgatggtggtacctccgggagctcttgactactgctcactctcttgtcctcacacctgtttgcctccatctctccctatgcaaggggtttttgtggctcccttctgctacaggatgaatgtcagcctagcatccaaggcctttcccactcctctctggccccacctgacttctctatcatttgaggcactcccacagccccctgcccagccaggaccacatgagccccacattcctttccttggggcatgccatccctggggtgggggtccctcactgcctcccagaccaaatcctctctcctaagcatg

SEQ ID NO: 50354 - DNA, 1022 bp, Homo sapiens
agcctgggcgctgctccaggccaccgggtcttgccctgcggtcccagtccacagcaccaccgggccctgcgcttctcttaccacctggagggctcgcagcctcggcctggtgagtgagcgactgagagagcatgggagcccgggccacgggcctggtactgggagcgggttcttgttctcgagccctctaagccccacctcggaacaggctcgcttacctcggccctttgggttccctcaaacccctcctcctccccacgtcccttggccttatgtccagtcctttcaacctctgtccccatctcctctctctgtcccttgtgcccctcaacctctccaacccccttctcctctgtctgctgaggctaatgggagagggagcactcgcgagaaaaagagggaggattgcaaggcagcaatccttggatatttggttggggaaaccagggtttcgtttggagaacagaagaaaaaaaggagccttacatttgccaagcgcctacattgtaccaggcactggactgggtgctttacatggattttcatttcagcttcaggaaccctcatgaagtagataccattagtcccattttgtagggaaggaaactgaagctcagagaagttaagcaacttgcccaaggtcacacagctagtatggagccacgattcaaaccagatctgtttgtgtccaaagtctgtggtctttctgcttccccaaactgaggctggagaccatgaaagtaatgccaagccttctgcttatgtgattttctcctgtactattcagcagccctggagtatgagcggaaaaaaaaaaaaaaaaaaaaaaaaagaaagacggtggattgatccaaggttgagattttgccaggtgtgtgtggcgggagaacaagggaaggaaggagtagaaggtgctgagagagaaaggtggaagaggtgggccttgggagtcaggctagaggagaaggctggaggggctgataggtagggagacagcagaaaagccaacagaggcagaagcc

SEQ ID NO: 50355 - DNA, 1033 bp, Homo sapiens
actcactacctctctacatcgttggagggcttctaacctctcatcctagagacacatgaaattcctctggacctgaaaccagccctgaccactttcacctttccccctgcatttgcaattttgctctgtttctctaagacctaactcttgtcacttcgatgaaaccttctctgactttcgcagatgagttagaaacccagagcaccttacctatacagctaagctagcacttatcacaatactgtagttgtttatgtgactgtgtctccacaggagggtgaactccctgagagcaggggccatgtatcttcaagctttcaacaacacccagcacaagactggtatgaggcaggcttcaacaactgtttgttaaatgggtgagtttacaggcctgcaccacaaaaaatgggaaatgggctgtttagtagatggcattgggaaatttggctctccatgaaaagaaatataaaactggatctctatttattccacctaagagggtagactgtgaatgtgaaaggtaaaactatgaagttaatatatgcaggagaatatctttgtgacttgtgactggggaaggactttttaaacaaaatcccaaatgcacaagatataagggaaaaaatacaatgaaatcttgtggaaactagttattacgactttggaaaacaattaggaagtatccagaatagctgaagatgaccctgggacccagcagttctagtattggagatgattgattaataggtagatagatagatagagatcacctctaaactttaactcctagagaaattcttatacacttgctcaatgagcatgtggaagaatgttcattgcagaactgtttgtaatagagaaaaaaatgtgaacagcccaaaattccaccaacaggagaatgaataagtaaattatggtatagccatatgacagaatactatgcagaatactataatgaaaaagaatgaatcatgttgcatgcattgacccagctaaatttcaaaaacacaatactgagataaaatacaaattg

SEQ ID NO: 50356 - DNA, 1025 bp, Homo sapiens
tcatttgttcaacaaatttattcagtgcctactttgttccaggcactttaactaggcatttgggatatatcatgaacaaagcattcagtgatgcctgttctcatggagcttacattcaagcaaggggaggctaacaattaaaaaaataataataataagtaaattatgtgggatgtcaaaattgataactgttataaaaaagaaaattagaacaagataagagggaagggaagtggtaggtcaccatggtaaatagggagattggggtggacttcatggagaaggtaatatttgagcaaataaatgaaggaagtgagttagccaagcatatatctagagaaagagcatactaggcaaaaggaactactagaggaaagggcctaagagataagtgtgtttttggcatgttcaaagactaacagggaggcttatttagctagagctacataggtgaaggagaaagacataagagaagtcagagaggaaataagggtctaaataatataaggcattgtaaagacttggtatttactctgcatgaaatggggagcctgtcacaagttgggttttcccaggaaacagacccagaaacaaagttaatcttgtagaaaatttattaagcagcgcccttggggtcaatacctggggaagaaatgggaaagcagcaggagcacaaagaaaatgaagctctaaaaagactcagttacagtgtcaaccacacccacaggaagctgtggaactagaatggcccttcagagttggggtaatatttacaggcctttcaacccctacactaatccgtctttggatatgggctgccccaggaaggggtgttgcattggacaaagttgctttcagcagctgaggcaatctctaatgggggtgagagctgaagcagcataataagtccatcactgaagcataacctgggtgttgcatcccatgtccacaaacccactgtggattttcagcagagaattgacctcacttatgtttctaaaaaaatctctctgctgttttaagga

SEQ ID NO: 50357 - DNA, 1023 bp, Homo sapiens
actggacagttaagagagcagggttattatcctgaatgcaatcattcattcattcattcagctactttttgatggatttgcccaatagtgattaatgagatagatactgtccattctgtcagggagcttacattttcatagaggggagaaaagcaacaaagatatagacaaataacctaaataacgtgtataatttcagagagtgataagttgtatgaagaacaaaaaagcagagcaatggatagagatgaacggaaataagggaactacttcagcaaaaggttttcagaggaaggcctgagtggatattagcaaataactaaagaagccagcccatgcaatgatttgaggaaggagtgttctagagagaaaaaaaaaaaaagttgaaaggctggaatacctgatgtcatttatccatagctattaattcagtaatgtgtttaacattgaaacctagggcctgtgattcttctctactgttctgcacagctaacactatacctctgctgttttctggtatgtttttggagtttttaaatatgtttttgtttgtttgtttgtttgtttgttttttgagacagagttttgctcttgttgcccaggctggaatgcaatggcccaatctcggctcaccgcaacctccacctcctgggttcaagcaattctcctgcctcagcctcccaagtagctgggattaaaggcatgcaacaccatgcctggttaattttgtatttttagtaaagacatggtttcaccatgttggtcaggctggtcttgaactcctgacctcaggtgatccgcctgcctcagcctcccaaagtgctgggattacaggcatgtcccaccatgcccggccttaaatatgtttttctattgttatcctagaaagcaagtaaagtggctaagaggtcactgattaaatggaaatggggcagatttcttcctctaccccaaatctatgaaacaggtgcataacataaagttgaagctcacatgtaatgtaatgaatgtgtatacctattt

SEQ ID NO: 50358 - DNA, 1049 bp, Homo sapiens
aggcaacggcgaggtgtccgatttgtgcacttgaggcccgcaatccgggacggtggggaatctgcgcctcctggccgggtagtgttggaagcagggcgaggggaatggggaaacgcttcgtatttcaccgaaccgcagatcttagccagactgagctggggaggaaggttactgcaggcactcagccagggtgccttgatttccagctttgctatctagctttcgggaaaaacaggtgtgggtttactgggtgcgctgattaggagaaaaagctctccgtgttatgcattgattttgttaatttcctttctcggtccacctggcaactgtgctcctcttcgcaggcatgaagaccccgtttggaaaggcagctgcagggcagcggtccaggacgggcgctggccacggcagtgtgtctgttaccatgataaagaggaaggctgcacacaagaagcataggagccgacccacctcccagcctcgggggaacatcgtgggctgcagaattcagcacggatggaaagatggagatgaacctctaacacagtggaaaggaaccgttctggatcaggtacctgtaaatccctctctgtatcttatcaaatatgatggatttgactgtgtttatggattggaacttcacagagatgaaagagtgtcatcacttgaagtccttcctaatagagttgcatcatctagaatcagtgatacacacttggcagaaataatggttggcaaagcagtggaacatatttttgagacagaggaaggttccaaaaatgaatggagggggatggtcttagctcaggcacctgtcatgaacacatggttttacattacctatgagaaagatcctgtattatatatgtaccagctcttagatgattataaagatggtgacctccgcatccttcaagattccaatgattctcctctggcagagagggagccaggagaagtcatagacagcctggtaggcaaacaggtggaatacgccaaagacgatggctccaagagaactggcatggtcattcatcaggtagaagcaa

SEQ ID NO: 50359 - DNA, 1053 bp, Homo sapiens
ttttgtgccttatttttggccagatggaattttggcagaaatgacaggtgtcatgtataggcctatctcataaaatgactagagctatactgcccaatatagtagtcactagatacatatggctattgatcacttaaaagatggttgttataaattgagatgtgctttaagtgtaaaacacaagattttgaagatcttgtatttaaaaataactttaaatacatcattaataatctgatattgattgaatgtttaaattatagtagtttgggcatattgagttaaatacaatatattattaaaattaatattacctgtttctttttgcctttttaaaatgtgacaattgatacattttaaattatatatatattactcatcttaatgtttctattggacatcgctgctctagaaaacttcctctctgtctctctttctctctctcactcttgctgtcttcaatttttggccagctggatagacaggatctggcagaggactatgaagtcacagaaaatggtcaatctttgactacatggaagacagatactgtctttcctgaattaccaattatagaaaagctgcctaatgaccaggaacacctacatttaactgttttatgtgtgagaaataatttttttgtatgtcaagccactaagatgtgtatggtgtttgtaacagaagtaattatacactgactaatacaaatagtatggggaagagttgagcaagataaagatgatcagaatgttaaggtccctaagatagcccaatttgtgaagataaggagcagagacctgaagatagtgaaaaaataaattttaatatagaagtaatacaggtccaaaggctctgaggtgagagacatttcgcttgctcaaggaacagcaatgatgtcagtgtaaaagaagcacagtcagctgttaggatgaaccaaacacttagaattgctgatatttgaccattttgacctatgaatacagaaattttatatggttcaatgttatgagtgagagtagtagaagatggaattttaaaagataagagggtaaa

SEQ ID NO: 50360 - DNA, 1039 bp, Homo sapiens
gggacacgaatgagttgtaatttgttctctttacataatcccatatttctcagagattttgttcatttatttttattctttattctctattcctgtctgcctgtcttatttcagaaacccagtctacaagctctgagattccttccttcacttgtctactctgctattaatacttgcgattgcatcatgaaattcttgtagtgtgtttttcagctctatcaggttggttatgttttttttttttctatactggctattttgtctgtcagctcctgcattgttgtatcatgattttttaacttccttggattgggcttcttcattcctatctaaaatctgaattctgtttttatcatttcagccatctcagcccagttcagaacttgcttgagaggctatgtggtcctttggaggaaagaaggcactctgtctttttgagttttcaggatacttgcactgactctttcttatctttgtgggcttacctaacttcagactgctgacacttgaatgttttttttttcttctatttgatgtccttgagtgtttgactgtggtataagttgaattcagccaactgactttgtttctgaaagattttaggagcccagtgctcagttcccaatttctgggctgcatgctctaactctgtagcacttatattgggccccaactttgctctctgccatctcgaggttaggaatccactgtgctgaggggcctatgtgctcctggactgctcctcactaaattccagtgagtggtgtcagccaaagcattttgtagtgttgtgacagtggaatccatcctcgttcgctcatgccagcagcagtcctggaggcagctgctccagagcactagtgggtgccagggtgcttgcctccctgtgggcgttcatcaccttggcagaggcaatgcatctgggggtgctggcgcctctgctggtcactgtgtgcacagtcatgctgaaggtggccgttgactcggtggcggagcactggcagttataggcctaagtgcattatctgtaccccacaag

SEQ ID NO: 50361 - DNA, 1030 bp, Homo sapiens
gggaaaaaataccgcagaggacattaaggctaacatggtcacaaacatggaatcgggtttttgtctggccttgatgctccagtagtttctcagcttcctgcatggttttcttgagttgtccccaggttatgggggttgatgtcgtcatgacgctggtcaacctctccgtctttgtactcaggctcagctggctcatggctcataccagagggaccgggcccatggttggccaccctgggttcctccagtctcccattccacggctgcatccaccttgaggacacccacacggtttgtcaatctcctgtaaaaacacaagcataccctcgtccccacatcagtaaatccaccagacctttccattgtccctcttctgcggatttccataacactttcagataaatttttgtctttgcctctaacacttgtcaatgcctttctgctggagtcttaccatctgtaccaggaatcaaaaaatttaaagtaaataagtctaaatgtagttttgattgaggtggtagttgtcctcttataccccctttttgtcttttcaacatgtgttgtaatgtttgattgtaatgccttgtcctctaggattataaggaattcctgttttatgggttattgtccaaagctgtaagaaattttgaaaagcatgactagtataagtgggtccattgtcagttcttaattgtttacgtatctccatatgagcaaatgatgacagacaatgttgccatacatgaccagctgtctcatctgtttggcatgtatcatgcagcatatgagaataagtgcctatagtcacacgaacataaacaaattatgcagttttgggtctagtggacttttaattgtagcagtttctatgtgactggttacatttacaacataagctgaatcactgacaatgttgataggatctgaaactgtaagctataaaacctgaatgattgcaattagctctgagcattgagctgaaaccccagaggtcattattgcttctggacttttttggaataacaaatac

SEQ ID NO: 50362 - DNA, 1887 bp, Homo sapiens
tgtctcataggaatttggggatatcccacaatgtgccactcagagcaagatttgaccctagttctgactcctatagattgaggatatgaaagtgagatagatgaagtcaaaatgaacattcaagcctacatagcttcagaattccactgtatattctgaaatgatatggcaaaaatgtcagagactagagcaaagaatgctggctagaagattacaggagtaagtcagacagaaatttttagttaataattttagaaatgcatattaaggtgcattgtgagggagagttaacattgtagctgattaattttgtaaggaaactgactatgtagtaatcaaaggcctccaggattatgagttatctgcaaaaatcagagagttaatgtacgggaacggacaagattttaagagtcagtttaaaacaaaacacaagaataagggctagataagtaagtataggtgtacagtgatcatactttttctccattttagtctgtatctaaataggctcaaaaaagtgaatgaagtgtgaaatgtctacattgtctattgtttggacaaaatattttctttaaagatagaaaaaagtttgctatctgtaaattggctatttcactgaactaattaattctaagtatggatttctttttttttttttaaacagtgtcctgctctgtcatccaggttgaagtgcagtgggcgatcatggctcacggcagcctcgacctcccaagatcaagcaatcctcccacctcagcctcttgagtagctgggagtacaggcacaagctaccatgcccagctaatttttgatattttataaagatgaggtttcgccatgttgccctggctggtctcgaactcgagctcaaggcaatccacctgcctcagcctcccaaagtgttggtattacaggtgtgagcaactatgcttagccctggttttacttttaactgtatgacctatattcaggacttttgaaaatgtaaagaatccatgttttctctccttcacaaattttccacatgcatccttcattctcttgttgactgttcataccataaaagatttaggttcatttttaaagacatctagataactgcaaaaggaagtgacattagcgcttctcataaatcagggtttctggtatgattactttgattagtacttgtttatttaatcattcatttatttatgaaataataacccaggatcctctgacaaaatgtgcaagatgtttttctgggtgccatgctgggaaaccaagatgaataacacatggtcttttatatgttcttttatggccttcaaatcaatagcagagacaaaaagttgcctttaaagcaatagcagaggcaaaagatgggtataaaaccctgtataacaacgtaaaaagaatgtgataaatgttatttaaagggtcacaggggtacatatatactgttaattcaggtgacagagagagagctcatttcatagaagttgatattaatcttcattatgttacacaagcaagagggtttctaagttgatgatttcatagtaccaacatagcaaattatatatatatatatataattttattgagatataattacatagagcaaaagacacagtatcttgaatatataacacactgacttttcagtttttcttctgtcatttatttacggcatcattccattgtaattagaaaaaacactttgtattattttaatctttcaaaatttgttgagaattgtttagtagcctaacgtgtactatcctagagaatgttctatgtgcacttgaaaagattatgtattctcctgttgttgggtgaggtgttataagtctgtcaagtctagtttgtttgtagtgttgttcaaatcctctattttctattgac

SEQ ID NO: 50363 - DNA, 1130 bp, Homo sapiens
cgcattcaacacggctggaaggaaggcaacgagccagtggagcagtggaagggtactgtgctcgagcaggtttccgtgaagcccactctttacatcattaaatatgatggcaaagatagtgtgtatggactagaactgcaccgcgataagagagttttagcgctagagatccttcctgagagagtgccaactcctcgtatcgattcacgactggcagattccctgattggcaaggcagtggagcatgtgtttgaaggtgaacatggtaccaaggatgaatggaagggtatggtcctggcgcgagctcctgtgatggatacttggttttacatcacctacgagaaagatcctgttctctatatgtacacgctgcttgatgactacaaagatggtgacttacgcattattccagattccaactactatttccctacagcagaacaggagcctggagaggtggtcgacagtctcgtgggcaagcaggtggagcatgccaaagatgacgggtccaagagaactggcatttttatacatcaagtggtggcgaagccatctgtttacttcattaagtttgatgatgatattcacatttatgtctatggtttggtgaaaactccttaaattctttgtgctctttagagaagttgtggatctgttagatgtgaattattttgtgttctcgtagttgtgaacgcagagaagagtttaggtgtcagaaattcaggaaagtggataaattttattgtgccaacaaatcttaccttgactagtttcacaattttgcctcaagtgtactttgctacttttgatattgccttgttctgtaacttaacagttaaattgggtgctaatagaaaattaaaaagtgtttgcaaccattggaacaatgcaaaaatagattaagaaaaattaatggtgtaaacccacaccccgtccttaccccttcctttccttaccttgtttcttcccagaaaacaagtgttgaggatgcgaagtacatccttccacctattttccccatcttcatgcagaaagtatgttctagtagtttctgtaaaaatggcaagccacatgcttttctcacttgacatgtagatgatatctcttcttatcagtagcttcagtctttc

SEQ ID NO: 50364 - DNA, 1085 bp, Homo sapiens
caaggatgacgcctagtaaaaaatatgactaagaggaacctgtctaaagtttagtctttgcctcaattctgccaatactttaaggagacaaaaggtcatcctaatttttgaagctaaaaggggagaaaattcactacatgttaaatatgccttactataattttgtttcttatattttcttgctttctgagttcaaatatacatgcatgagcataaacagagacctagagaaatgaagcaatgaagcactttagttatggaaggcaagtacctcctctctctctctctctgtcacacacacacacacacacacacacacacgcacgcacacctgtatctcgagatctgaactagtctaatgattggcagcatgacaagagctgattgttaaatattccgaaatttggatgttaaactgtctgtatcttgaaattggctaaggtggaagtatttacacaatggaaactggcaaacactgcaaattaagtttttttcccccctaaagagcaggtttaccagcacaccactggatgtaagcaacaatgtatttaagaggtctctctggttgtataaaaataactttctagggctggtctttcatttttctttattttctttctttaatttttgggcttctttgccactttttaaagaggaccagaaggtaagtatagcttaaagatgtgttgtcctcccagcgatcctgctcttggtcttcctctctcctcttttaaagtattcaatcagcattagtagttcttgagaacttttcaagctttctattgttttctataattagcatgatcttaaacagggatctgcttaacacatttttgagtttcaaaaaactcactagcaagagctatcagccacacaaaaccattcataagtttcaggaacctattttctcaattcagaaagacattaaagcaaactataaagataaggatacatttttataaaatagtatgctatcactagtaagttttcatttcccgttgattttctagattacaaatcatgcctacatttccttagttttattccatgccccttaattcatttcttccttattttacaataaa

SEQ ID NO: 50365 - DNA, 1033 bp, Homo sapiens
aagactatatgattttaggaattaatttggtaatgttatttggaaataaaaaatattgcatatacataacatacatacatacccaaacatacacagacagatgcaaatagacactatagcttttattctgaaatttgtcatgagtctgataaatacagtaatataaaactcaacagtttatttaaaatagctggttctcatcttctctctgcttcatatttttatctgaattgtattgctggtgataaaaaaatgttaccttctcaatatttctttttaacaatattcatggaggagacttttaagattttcttttgttccaatatgtacttggttttaagttccccaaataccttgagagccctaatgggggaggaggggcctaaagttcaagtgactgtagggaatttaggagctggaatgggaagggaaaagtctggcagggatggatggatgtgtggaggaggtagactgttgtgaaggaagacatttcaaagaatccaaggaaactgaagggaagatggaaggtggtaaaagaaggagggaggagcagaagttatcggaagggagaggtcatagatgagcaagtttggatagatttaagttttctgaagaagccaatggagttccaattttctcagtaaaatcatgccaacaaggtagaaagtgggcagttagcaccatagtggtagaacatatagttaccaagggttcaacaaagggaggttcagttgacagaaaatttcctatgggaaaagcaggatcaaatagaacaaagaggcctcacaagcagccaagaaaaaaaaaaattccgagccacgggtaagtgaatatccactcaaaagttccaggaggaacttccagcttaggaagtacctttcaagatatctaattgagcttcggagaatgtactcagaatcctaggaattaaaatctgtccttaacatgcttcagtggactgtcatccagagcactggctcaagagttggactcaccaatggatctctgatcaataactaaggagtgaagacaa

SEQ ID NO: 50366 - DNA, 1347 bp, Homo sapiens
ccctgctattcaagaatagtatgctcatcaaagtaagccttcataaattcagaagaaataaattacttccaagacaagcaaaaattaagggaattcattaccactacactggccctacatgaaatgcttaatgaaatcccacacctggcagcaaaaggatatctatcatcctgaaaacacactgaagtatacaacacactggtagagcacatgcaaataaagaggaaggactcaaatgttaccacttaccaaaaaccaccaaaccaaaatcataaacaacaggagaggaattaagagaaaaagaatattcaaaacaaccagaaaacaattaacaaaatgacaagaataagttctgctatatcaataataaccttgaatttacattgatttaattttaatttaaagatatatattggctgaatatatatacatatacatatatatacatacatatatatacacatacatatatatacacacacacacacacacatatatatatatgtgtatatatatgtgtatatatatatatatgtattacccaacttctttatggtacctatggtacccataggaaactcacttcacctgtaaaaacacatatggactgaaagtataggaattgaaaaataaattccacacaaatggaaaccaaaaggaagcagtagtagctatcttcatgttaaataaagcagactttaagtcaaaatagtaaaaagagacaaagaaggtttttatacaattttgccagagtatataacaattatatatatatgcacctaacactagagcagcaagatacataaagcaaatattaccatatctaagtggagatagagactcaaatagtagtcagagacttcaccaccccactctcagcattagacatattagatagaaaattaacaaaatgctttgcattcaaagtacactttaggccaaatagacctaactgacatttagagaatattttattcaacagcggcacctgctgctgtttattttgacacgtggaacattctccaagatagagcatacattaggccaaaaaacacgtctcaacaaatttttaaattcagtcataaaaggtatctttacagatgacaatgaattaaaactagaaatcaattacaacaagaactttggaaattaaacactatactcctgaatgactattgggtcaatgaacaaactgacagaaatcaaaaagatgcttgaaacaaataacaatgcaaatacaacattccaaacctaagggatacagaaaaaccagtgctaagaggaaagcttatagcaagaaatgcctacttcataaaagttgaataatttcaaataaacaatttaatc

SEQ ID NO: 50367 - DNA, 1024 bp, Homo sapiens
tctctggaaattatttcttcttctttgaagcttaatctagctggatataaaattgttgattgcagctttttgttaagcgtttgataatactatcccattctgttctgactgttaagttttctgctagtatgttttcacttagtctgatagggtttccttgtgggtcagtagatacttttctcttgataattttacaattctttttttcacattttttagacagtctgatgagagtatgctatagtgaattcctttttataatgtattttccaagagattgttggtccccccgtatgtgtatgtctacatttctttgcataatctggaagctttcatcaattatttctttaaataggttttatatcatttttaaaatttttattcctttttgggaatacaaataatttgaaagtttggtagctcttagtcccatgagtcttgaaggcctttctcattcttttttattctttttaaaagtttttgtcttcatgggctatttcaacacacctgtcttcaagttctgagattctttattttgcttgttctggtatattgttgaaaatttgacatgattttttaaagatatttatattcttgataagttgattgtttatattctgaattgattttgtatttctttgtattggtttcagattttttcttgcatttcattgagctttttaaaaatcaatattctgacttatttggcattttgaggattttttgttagaatctattgctagagaattattgcgatcctttgaaagtgtcataataccttgctttttcatgattcttgtatctttacattgatcactgcatatctggagtattagtctttttttatttctgaatgtactttcatgggggaggctattcttgatgtgactctggtgtatgttgtgtaaggctgtttggctgtgttcagtggcaaagattgtatgatttccttgcttctaaatacccttaatatgatctttctcaaaagccagtaatctttctcaaatgccaagtatactaaatg

SEQ ID NO: 50368 - DNA, 1031 bp, Homo sapiens
agtgtacataacatataatgaacacttaaaacaacaataaaaagagaaaaacaaaaataatttggtcagttaaaacataaccaaattatgtgaatagatacttctccaaagaagacgtatatatgacaaatgaacacacaaaaatatgttcaacatcattaatcatatagggaaatgcaaaccagtaaggtattctttatatccactgggatggctataaatattttaataaggaaataaatggtattggtgatttgcaaaatttgaatcctcatatattgaaggagggaatgtaaaatagtgcagctgctatggaaaatactttcacagtttataaaataattcactgtagaatgccaatgtgacctatcaattctaatcctaactctataaccataagaattgaaaccatatgttcaaacaaaatcttgtacacaaaaaaaaagtccatcaatggttaaacaaaatgtggtctagcaaaacaataatatattgggccataaaaataaattaattactgatatgtgctccaaaatggatgaatgttgaaaagatgctccctggaagaaaaaggatgtcaagtgtaggcaatttcatggagatataaagtagataaatgtttgccaatgacttagagatgaagatgatggagagtatatgttaatgaacatgggagtatggaaatgttctctaattagatagtggtaatagttgcacagcattgtgaaaatactgaaaactgctgaagtacacattttaaaatactaaaatttatgttatatatcaataataaaaaatagaaaaataaaaataatataatgttattatatttcacagtgtacatgcataccagtaggctgtatgactgtattcattttattttatttgtataaatttatggggtacaagtgtaataatgttacatggatatattgtatagtggtgaagtcagggcttttagtatatccatcaccagaataatgtacattgtatccattaattaatatttcatctgccaaatccccatcctt

SEQ ID NO: 50369 - DNA, 1497 bp, Homo sapiens
tggttaacattttgttagcattttattgaggatttttgcatctatgttcatcgagaatgttggcttaaagtttttattttttgttgtgtctctgtgaaattttgatatcaggatgatgctggattcatagaaagagctaaggaggagttcctcctcctcctcaattttttggaatagtttcagtaaaactgataacagttctttgtatgtctgctagaactctgctgtgaatccatctgttccagaccttttttggttggcacctgtttttttgttgttgttctcattgttttgtttgtttgtttgattgtttttctcattcaattttgaaacccattattggtctcttcaggttttcactttcttcctggttcattcttgggaggttctttgttttgaggaattgttatccatttcctcaagatattttaatttgtgtgcatttaagtgttcataatagtctctaaggatcttttatatttctttgggattagagtgtcatctttgtcattcctgattgtgcttattcggatcttttatttatttattttttgttaatctagctatcagtctatcaatcttacttactctttcaaagaaccaaatattgtttttattgattttttgtatagctttttacaccttgatttcattccgttgttgtcagattatagttatttcttctttctgttagctttggggtaaatttcttttttttttccttttaagttcctctaggtgtgatcctagattgttcatttgagacctttctaacttcttgatgtttgtatttagcactgtaaactttcctcttcacactgctttagctacattccaacaattttggtgtattgtgtctccattttcattcatttcaaataatttttaatttttaccttaatttagaatttttttaatttctatgtacttttgtagttttgcgggatcttgatattgatttctattttttttcactgtagtctgaaagcgtttggtatgaattcatttttttttaatttattgagatgtgctctgtggccaagcatgtggctgattatagaatatgttctgtgtgcagttgagaaaaatgtgtaatttgcatttagtggttggagtatttgttaatgtctcttaggttcaataggtcacatattgagtacaattccagtatttctttgtaagttttcttcctcaatgatctatctaacactgccagtgggctatttaagtcttccactcctatagtgtggttgcttgagccttttcatatgtcgagaagaacatatgaacccctgacctcaggtgatccaccttcctcggcctcccaaactgctaggattacagacatgagccaccacacccggcccattaaggacattcttgattcaagggaggagatcaaaatatcaacattaagaggagttcggaagttgctgatttcaaccctcatagatgattttgaggagttcaagacttcagtgggagaagtaactgaag

SEQ ID NO: 50370 - DNA, 1046 bp, Homo sapiens
ataatatattcttcctttattcatcaatagatacttagattgattacatgtcttggctattatgaataatgctgcaatgaacatgggagtacagacatccttttgaaatactgatttcatttcctttggatatacccagaagtgagacttctggatcatgaagtagttttatttttaatttattgaggaacctccatactgatttccataatggctgtactaatttacatctccaccaacagtgtgcaggggttcttttttctccacatccttgtcaacaattcttttacctttttgataaaaggcactctaaaaaatgcgaggtcatatgtcattgtggttttaatttgcacttctctgcggactagtgatttagaacattttttccatatgcaagttggccatttatatttcttcatttgagaaatgtctcttcaggtccttgtcccattttttatttactgttatttttattttattttttaaatttttttatgtttgtgtgtacttagtaggtgaatatatttctgcagaacatgagatattttgatacaagcaaacacttcctaataatcacatcagggtaaatgggatatgaatcatttaagcatttatattttctttgtgttacaaacaatccagttataatcttttagttcttttaaaatgtataagaaattattgaagactgtagttaccatgttgtgacatccaatactagatcttactcattttatctagctttatttttgtaaccattaactttccactgcactattctttttggcctgtggtaaccattgttttagtctctagctccatgagttcaattgttttaatttttagctcctacaagtaagtgagaacataagaattttgtctttctctgcctggcttatttcacttaacataatgatgtccagttccatctaagttattgcaaaggacagaatctcaatctttttatggctgaatagtgctccattgtgtatatttaccacattttctttatatattcatctgttgatggacatgtagattgcttt

SEQ ID NO: 50371 - DNA, 1060 bp, Homo sapiens
aatacataaaatcaattagtgtaaaaaagctgcttatgtttctttcagataaatattatgtatatcaactgaggatacttaaatatgaatccagtgaaattgggaatgacaatgccttggagcaattcattgttcaagaatctttggactgaattcaaaattagggatttctgcttgaattgttatttgcaattttatacatatacacatatttggagagaggcagtttccaagacaatgtcttcttccctgatctcttgctctctcccatttctatagtagttagctgcagacaggcttgtcagtgattgcaactgatagagtaagaagttatctgggcttcatttttaacatcagcacagttattaggcaatctaagtggaattttggccacaagagagggagcacaagtcaaagtattttaaatcagagatttccaatatactttattggatatgagagttgaagaagaggaaggaatcaaattcaggcctaaagacatggaattactgtgtcttaaacaaaagtgggaaaaatagaaaggaaattctgcctctgctactgatacaaagaggcatggatgtttgcattgaggtgtattgaggcaatagtgaatgtttttattggaatggatctttggcacactttgatagtgtatctatgccattatactgacagttcaccttgagctcacacacatcactctcttcccatcatacttcattccacagcggccagatcatggcttcctctgccatttggaatgctccgaccttaagcagttgtctcagcaatgctttttatttgtttttccttgaggccatgccaaagcaaagctcattgagatatagccaaaactgccagatgttgctggatgttattttatgctctctggggaaagcattgttttccagtgaaactcctcaattatttcctccaaaaactttctgaaaattttactgaaataagtaaaaaatgtaacaaaccttcagagatatgagattctatgagacgttgtttctgtgtctcagatacatctgcctggtgtcaatcccaaaag

SEQ ID NO: 50372 - DNA, 1095 bp, Homo sapiens
aacattgtcaaattcactgttgttctcaactgtcagagagtctaagttctactaaattctgctgtgtatgtcttcatctatacttagcacaaccagctaaaacaggatatactattcttttttcatcttacatttctttgatttccatagaggaaaaataatttttatatgttctctgataactaccttctctcagcaaaataatttttcttaagttctttcctgctgctctagcagcccctattgcttagtgctgttctctgatattcaggtattctgctgtgccaactgtttttaggaagcatcccgttgtatgctgtaatttgcagaaaatgttcccttggaacttacaatggtcatgttaaaagaataaactgagattccagttggtaaattagctttgtggattgggtatacatgaatacatttggagtttgatcataatagcctgaactaaaacacaaaaaggttttttttttttttttttttttttacagtgcaaaactgaggacaaaagtagagaagcagtagctgtgtagttaagccaacccagttaaatttcacttatcttgggtgattgtatgccatacatactatatgtccaatactgctaaacactgaaggtgttctggaagtacagatcttctgcctcagggaatttatattctagttaggaagtttaagcacttagagacagcaataacttgaatgctaatgcatgttataaataagtactgaggaatgtagaaaagagaaaaactccacctgaactttaaaaataatactatcgaaatgctcattttatgcttagaaaaattgaggcccaaaactgttaagagacatggccaggatcacacagtgttttagcttctcaaaaggaactggaatccagatctcctggctcattccaggttctttacactagagacgtctcctaatttaagcctcagttatttctttgacaatgatttcaagtcagtccttaactcagatgcttatttcccgaaggacgaagtaatattttgacataaaattcctagaaacccatttaatacaatgaaatatcaaaattgataataaaaagaaatgaaaatt

SEQ ID NO: 50373 - DNA, 1062 bp, Homo sapiens
gacacaaggaggggaacaacacacactggggcctgtaaggagggtggtggctcaggagagggagaccattaggacaaatagctaatgcatgcagggcttaaagcctagatgacaggttgataagtgcagcaaaccaccatgacacacataacctatgtaacaaacctgcacattctgcacatgtatcctacaacttaaaggaaaaaacaaattatcatgtttgtatccttgctttgtgctgcagcctttcacagcttttagtgagcccactttagcaacccctctcccaactttctaaattatggtttctattctgctacatgctaacagattaaatcattaaacttgctagaattatttgtgaattaagactaagttccatgtaaagatatagagcacatttgctaccataggtctgctcttgtccatggcaaacaatgacaatttatcatagtttctattctcatagagtccacttaagatctcaaaatttcttcttaacactgctctgtgtttcaggcagcagttacctaattagtagaactcgttaagcatgattaactccagtttttatgactagtctaagagctctcttttgagtacattctgtgggtcttaacgctggagctatttggtttcacagaggttttctttgtcatttaatttccgtttctcagctatggtcacagagttgtgagtgtcagagagtgcaggtgttcctgccccaagcactacatgttcatgcactttaattgcttaaattattaagcagattaaacttttaaattatagcctggcctaccaacaaaactccaggcaacgaaaggcttttatgagcattcttgtgatttggtctaggaaaaactggtctgagcgtcacagattattaaaactacgaagtcccataaaattactatctaattttactctactaattttgcggatgtgaaaaaatgtaaccagagaagctaagtgactttctctttttttttttattttaacggtagttatggttttttttttttaatatactttaagttttagggtacatgtgcacaacgt

SEQ ID NO: 50374 - DNA, 1084 bp, Homo sapiens
tatgtgtctttgtatggtcttggtatcagggtaatactagcttcatacaatgagtttgcaagtactccctcctcctctatctttcataatagtttgagtaggattggtattagttcttctttaaaagtttgattgaattcagcagtgaagccgtcaggtcctgggcttttgtttactggaagaatttttattatggctttgatctcgttaactgttactggtttgttcaggtattagatttcttggttcaatcttggtaggttgtatgagtctaggaatttttttatttattctagattttccaatagttgctcatagtagccactaatgatcctttgagttcctgcagtatcagatgcaatgtctcctttgtcatttttgattttatttatatgaatatttctctttttattagtctagataaagttttgttatttttttttaacttttcaagaaaccagggtttcttttttttcattgattttctttctttctttctttctttttttttgagacagagtttcactcttgttgcccaggctggagtggaatggtgcgatctcggcttactgcaacctctgcctcccgggttcaagcaattcttctgtctcagcctcctgagttgctaggattacaagcatgcaccaccacacccagctaatttcatatttttagtagagacggggtttctccatgttggtcagcctggtctcaaactcctgacctcaggtgatctgcccacctcggcctcccaaagtgctgggattacaggtgtgagccaccgcacccagccacactgatttttttttatttcaattttatttatttattttttgctctagtctttattagttcttttattctactaattttgggtttgtttcctcttgcttttctagttttttaagatgcattgttagattgtttacttgaaatttttcctcttttttgatataggcacttaataactataaaattcactctgagtactgtttttgctgctgtatcccagaggttttgatatgttgtgtttccattgtcatttgtttgaagaaatttttcaatttccttttaatttcttcat

SEQ ID NO: 50375 - DNA, 1033 bp, Homo sapiens
ccccaccccccagggctcctgaaaatcaaatggatgagtaaaagtgtcagtcatctctctactaatcaatacattagagcagtatgcgggagcagcagggagaataatctgttcccagggactgcagtttctgggaaatttctatttctaatttccatgatgctgaggtttggttgagctgtcactttgccaccttgcacactcatttaatccacttgaaaacaagggaaaggtaacatatcctggatagcttctttttaatctttttttttttctggagatttgtagcaggaacctaacattgtagctcatatttgggagcttgattgtgtgtggttgtaatttcctctttgtgggatccctctcctcccagcctggttgtgtaatacccaaggacctgttccactttgctatttgatgactgaatccaaagaagttggaggaaacaagaaaacccaacatgatgaaggcagcaaaagcatctacttaaaagctaaagtggcttgatgaggcatactcctgggacaagaagatcaaatgtagggctagatggatttgttactcctctgccttcctgtcagtaggcagcattgaaaataaactagttaaaaagtatggcattccccttgtcctttccctggatctgctcagattacagccccacatcaattggcctataattagaatggggtgaaatcaggcagaatggggtgaattagaattagaatggggtgaggcctcttcgctcgggctctgaccccaaggaaggaaggtagataagctggcaagaaagctttgggtagtttttggtggccactgttcattccacacctattgatttagttgtcaaacagtatttattgagtatttaaatatcaagtactctgtgtcagaccttattctaggttctgcaaagacatcagtgaacatgacaaagtttccactctcattgatttatattccagtagggaaaagaggcaacaaacaaacatatatcatcaggtagatgggcctctgaagaaaaataaagtag

SEQ ID NO: 50376 - DNA, 1050 bp, Homo sapiens
tagatactggttattaattccttgtcagaaggatagattgcaaatattttcttcaattctgtaggttgtctttttcactgttgattgtttcctttgctatacagagctctttagcttgatgtaattccatttgtctattttttctttgtttcttgcactttggaaatcttacctaaaaagtctttgctcaaaccaatgtcctaaagcattttctcaatgttttcttctagtgttttcagagattggggtattacatttaagtctttaataatttttatttttatatggtgagatataggggtctaattttattcttctgcatatcattatccagttttcccagcataatttcttgaagagtctgtcctttcttcagtgtaagttcttgatgactttatcaaaaataagttggctataaatgcatgaatttatttattggttctctagtctgttctattggcctatgtgtcagtttttacaccagtatcaggctgttttggttattatggctctgtagtacatattgaagtcaggtaatgtgaaacttccagcttttttctttttgttcaggattcctttggctatttggggtctttgtggttccacacaaattttaggatttgttttcctatttctgtgaagaatatcactggtattttgataaggattacacaaatatacagattgctttgtgaagtacggacctaataacaatattaattcttccattccatgaactatgggaaatcttttcatttctttctgtttcctctttaatttctgtcattggcattttatagtttttattgtagagatctttcattctttggttacatttattccttggtattttatttttgtagctattgttaatggggttgttttcttgattcccttttgagattattcactgttggcatatagaaatactactgagttgtgcatgttgattttgtatttggccacttttttgaattcatttatgaaactcatttttagcagctaaaaactgtttgttctaaagatttttttaaatgtaaaattatttta

SEQ ID NO: 50377 - DNA, 1056 bp, Homo sapiens
aatccagcaacataaaatataattaatgatgacaggattaaatccacacatatcaatattaaccttcaatgtaaatgggctaaacgccctaactaaaaggcacagaggggcaagctggataaggaagcaagacccaatagtatgctgtcttcaagagacccatctcacatgcaatgacaaacattggctcaaaataaaggaatggagaaaaatctaccaagcaaatggaaaacagaaaaatcaggggttgcaattctaatttcagataagacagactttaaatcaacaaagatcaaaaaagacaaagaaagaaggatattacataatggtaaaggtcttcttgaaccagaagacctaactatcctaaatatatatgcatgcaaaacaagaacactcagatttataaagcaagttttagagaccttcaaaaagacatagaatcccacacaataatagtgggagacttcaacaatccactgacaatcttagatcatcaaggcagaaaattaacaaatatattcaggacctgatttcaacactggaccaaatggatctgacagacatctataggactctctaccctaaaacaacagaatatacattcttctcatctgcacatggcacatactctaaaattgaccacacagtcagacataaaacaatcctcagcaaatgcaaaataacaaaaactataccaaccattctcacagaccacagtgcaataaaaatagaattcaagactaagaaaattgctcaaaatcacataattacatggaaattaaacagcctgcttctgaatgacttttgggtaaataatgaatttaaggaagaaatcaagatgttctttgaaactaatgaaaacaaagatacaatgtaccagaatctctggaacacagctaaggcactgttaagaggaaaatttgtagcactaaatagccacatgaaaaggttagaaagatctcaaattaacctaacatcacaacaaaaagaaccagagaagaaagagaaaaactgaccccaaagtgagcagaagacaagaaataaacaaaatcagag

SEQ ID NO: 50378 - DNA, 1027 bp, Homo sapiens
cttagccactaggtttactgtgaggaagcaaagagagaatgtgtagagaatcacatagaaaatataatgtgctcagaaaatgctagagaccataatattgaaaccgaacaactccacctgacctcagttttcttcttaaaagcctttgctctgaaaattagggttcagacaactctttcttgctcctctcattgtgactcaggggaagtcacgtaactgtgcctgagtttgtcatccctaaagttgaggtgataattacagtacttgccttaacattgggatgataacacagcaactgccttaaaggattgctgtaatgagaagatggattactatctgtaaagaattcagaagaatccctgtcacagacactgtactcaataaaaatttgttatttattttacagaaatcagaggataagtgtctgtctgtgttgtggggatggaatttttcactaataatattttatttgattgccatagccattctaggagagagaaagaatactgggggtggggggggcaacattaatactataaatgttctgtacattgagtctctcccagcctcaaactatggatcaaatttcatattattttaagagactgaagctatactcaaataaaaaaaaaattgtcttcaacctccatcttattttaagggtcatactagtgttaaatatgtaacttgatatcaattacatgccttaaaaaattagtaaaaaaaaaaaatcagtgaatagattggaaattaagatccctcgacctcaatctgatatctgatatctgtatcttactgtgtgactttgggctcctttcttccctttttggtacccttgtttcctgtctgagcaatggaggaggagagagcctttcagttctaagattctgtgatcccatctcaatctccccttgacttctttttgtccctgagtaaacctttcatcttagtttgtttagtattgctacaaagaaatatctgaagctgggtaatttataaagaaaaaagatttgtttggctcatgatt

SEQ ID NO: 50379 - DNA, 1031 bp, Homo sapiens
aaacccttgcataggacttcctaggagctcagttgattgtgacattttcccagaagagaggctttggggaactccttcacccctcttgctgctttgggggaatctcctcccctaccaccattccccctcccctgccctgctccagctcacacgtggatggtactttggggaacagtgactttcagggtgatggcttgctggcctgatccctgactttccaatcctatagtcactccaaagaagaaaatccacatggtatgtatatgtgtgagggttgggtctattgagaggtgggactttaattattgttattattattggtgcttatttttcctgctgtatatgggggtgggggtgggggggaataaaacaggaatgtatatttaggtcatgttaaataaaatggctggaggaaggagggaagaaattaggaactgcagtacatcatcaccccaggtgtaagagttatttctctcccagtgcagaaaggggagtgtggcccctggctgtacctgagcttcctcttctccatccctgagacatcacagaatcacccgggttctgacctctccacttctagctctcactgacatctggatatcttgatgcactgcctgtttgtaacaacatatacttctttgctgaatgctaataaacttctgggttcaagagggaacccctcagtcactaatgtgcattcttgtggtttgttccacagtagtgtgcctgtaacccatggttgttgggattgcccttggagagaaattgagaaaccaaggaggtggtgggtggaggtggagtagggagaaccagcaggggaaacagaagccagggctgaaattgaaagtagaggaaattgcagtttttcatccaagccatgccttatatcccagtcagatgccatattggcaaactctctatcacaccttctatgccttaagacctgccccttaagtccctgtgcactgccaggggctggctagcacttctaaaattagcctcaatttctgcaagtatgtggcctccctacc

SEQ ID NO: 50380 - DNA, 1116 bp, Homo sapiens
gaatctgggcctcaactagctcgtccctcacacctacacctgcccatgggcccttgctataacctccagccacaggcctcccagagcatgagggccaggcctcgagatgtgctgctgcctgttgatgagcccagttgctcttccagttctggaggcttcagccccagccctctaccacaggccaagcctgtgggcatcacccatggcattcctcagctgcccagggtccggcctgagcacccccagcctcagcccactcactatgggccttccagccttgacctgtcaaaggagagggctgagcaaggtgcctctcttgccaccagctactcctccactgccatgaatggaaacctagccaagtagttattatcaattctggagtagggacacggggcctgagcatgtgaatggggatcaggggttgggcagaagggtgggggggtgggggttgttgtttaacttgaaaaccctttgggccaaggaaaactcctgtgagttttcaccttggttttcccacttgcctcttctgccatctatggccacgttcaactcaagtgcatctgcccagggaggctgctgctgctactgcactccagtttttgctttcgaggtttcttcttgtgacccacgctgggtttgggatgctgtaattttgtgcctattccagttgccaagttagtgattatatatatatatatatatatatatatatatatatatatatatacacacacacacacacacacacacacacacatacatacacacacacacacaaacacacatgcacacacatatatagcatgcatccttgacacaggctaaacctttagtgccccctgcccctttcccccaatgaatgatgaaccactgattagcagccaagtctgcattgcctcccgcttggggaagtggggcttatttgctattagcaatgtgaaattatggtacagatcctccccacccctattccttttggcctggcatagctgccatcattatatcagatgactataagctattcatcccagctagctgtccttagagaggatcaagtagcgtgtgtctcacagcctatcgctgtggactttggcatcatgaccagatgggggc

SEQ ID NO: 50381 - DNA, 1050 bp, Homo sapiens
ctagaatatatcaagaactcttaacacgtaatagtaaaagcaagcctagttaaaaataggcaaaagacataaacatttcactgaagaaaatataacagatggaaaataagcacatgaaaaggtgtgcagagattgaggccatctcactctcagcatgcattacattccgccaccgttgctgccattccgctcccgtagttgtctccacctgatctgctctcatgctggggttgaggaagggagttgtacagggagaggagaaggcctcagctgaggcagttgaggaggaggaaggaagcagtggcacagccggcatagcagcacaggcagcctggttcctgggagtgtcggtgtggcatggtggttggggcagatcctgtggggcctgggtaggggaaggagtcatcagctcgttcatagtggacaatgaaaaactagacagccaatggctcaagaattttgagaacaaagtccacaacttggggattatgagaagacagcaaaatgaagttgtagttgaattaaggaagaataaaagagatgaacatctcttaaagagaaggaacgtactgaatgaagatacctgtgaagactgatacaaatgatgattatggagtgtaaaatacctctctagtagctattattcaaaatgcttcaagtgataactaagaaattcaattaaatgcagttcgggctgctaggaagctttgtccagtgatcgaagtctaccaatttataaaaataaaatctggaatactacctgttctagtctattgtcttgaaagagatgacaatgctttacagttagaagctgcatgggctttgacaaacactgcatctagaacctctgaacaagctcaaacagtagttcagtccaatgctgtgccacatttcctgaggctcctccattcacttcatcagaatgtttgtgagcaagcagtgtgggcattgagaactatcataagtgatggtcctcccgatgtagagattatgtcataagtcttggagttgtgaaacctttattttacttcaaaacattttttttttctg

SEQ ID NO: 50382 - DNA, 1027 bp, Homo sapiens
ataaataatggctgataatattccagtatggcaaaaggcttatacgtatagattcgagaagctgagtgaacatcaaacaggataaaccccaaataaagttacatgaaaatacatcatagcaaaatttgtgaaaactaaaatattcttttttttttttttttttgagacacagtctcgctctgtcatccagtctggagtgcagtggcatgatctcggctcactgcaacctctgtctcccaagttcaagtgatcctcccacctcagcctcccgagtagctgggactacaggcacacatcaccacgcctggctaactttttgtctttttagtagagacgggattttgctatgttggccaggctggtctcgaactcctcacctcaagtgatccaccttccttgacctcccaaagtgctatgattacagccgtgagccactgcacctggcctaacaaactattgaaagcagcaggagagaaattacaccttacttataggggaaaaacagtttaaatgacagtggatttctcatcagaaatcatggaagccagaaggaagttgcacatttttaagtgccaaaaaaaatatatcaatgcgaaatcttataaatggtgaaaatagtctttttttgagactgggccttgctctgtcacccaggctggtgtgcattggtgcaatcatggctcactgcagccttgacctcccaggctcaaatgatcctcctgcctcagcctcctgagtagctgggacaacaggcatgcaccaatcatgcccacctaatttttgtattttctgcagagttggggttttgccacattctccaggctggtcttgaactcctgagcttaagtgatttgcccaccttgggctcccaaagtactggtattacaggtgtgagccactgcatctggcccaaaaatattctttaggaatgaaggagaaatgatgatattctcagatgaaataaaacgtgtttgtcaccagcagacctaccttaaaaggaagacttaaggaagttctctaaagagaa

SEQ ID NO: 50383 - DNA, 1052 bp, Homo sapiens
aatcttagttttcccatcggtaaaatggttacaggagcaggcaaagttcaggtttatcttcacgtaacctagaaaaggaggagaatagaagtctagatagatggggatataagcaaataagtaattaaccaatacaaatcagtatcttccctctgcaagacagttgatgagctataacaagaacccttgatgtttttatgcccttcagcctggtaaccctgttcaaaggcaatatagagtagtggatggtatggatggtatgtaggctttggtgttagagagccctggttcaaatcccaacatccaatttactagctctgtggtactgggcaagttaccaccctgaacctcactcaattcccttctctacaaatgggataacacccaccttttaacccatttctaaggttacaaaaaaaaaaaaaatacaataacatgaaaagatgttttcttagtatagaaagagaaacttctcccaccatcctacccacctaacagttctttctgtagttctgtgccattgaaggctacctcttgaggcaagaggcacaggcaatgtcaagaaaagagagactgaagacaagcaggctgatggcagaagccagagtccagtgtgtggagttggatcacccataggatagactggggcagaggggaagatcagctactgagggagaagaaaggagactacaaatctgagtaaggggataatggctaggcagatcctgagaagcatggtagggagccagtgggaagacaacaacatgccttagagggtacccctttcaaaactttgtagccctttcccagaggcaggcttcaaattatgttattaaaggcccttgaaactgtgtttcttccaaatctttttcttatttagtcacatccatgtatgttttgaaattgtaatcttagtgtgtacactttttcagcgagtatcttatcttcaacattttctatgtcacaagtcttcagtggctgtcaaatatcctaattttgctgaaagcccagaaagtacacctctgtgtattaactttttgcttccttgaatt

SEQ ID NO: 50384 - DNA, 1022 bp, Homo sapiens
ttgaatgagctttgggtcaacaatgaaatcaagatagaaatttaaaaattatttgaaatgaatgataatagttacacagcttacaaaaacctgtgggatacagcaaaagtggtgctaagacaaaagttcatggtgttaaatgcatcaatcaaaaagtctgaaagagcacaaatggacaacccaatgtcacacctcaaggaacaagggaaacaagaacaaactaaactcaaacccagcagaagaaaagaaataacaagatcagagcaaaactcaatgaaactggaacaaacaaaaacaatgcaaaagataaatgaaacaaaaagctgattctctgaaaagataagcaaaattgatagactgttagtgagattaaccaagaaaagatccaaatgaactcaatcagaaatgagactggagatattacaactgataccatggaaatacaaaagataattgaagtgtactatgaacaccttttcacacacaaactagaatgtgtagaggatgtggacaagttcctggaaatatacaagcctcctagattaaatcaggaagaaacagaaaccctgaacagaccaataacaaaaagcaagattgaaactgtaattttaaaattgccaacaaaataagttcagaaccaggtggattcacagctgaattctatcagacattcaaataagaattggtaccaatcctactgaaaccattccaaaagacagtaaaagaagaaatcctcattaaatcattctatgaagccagtgtcaccccaatacccaaaccaagaaagaacacaaccaaaaacgctacagaccaataccctgatgaacatagattcaaaaatcctcagcaaaatactagctacccaaatccaacagcatattaaaaagataatacaccatgatcaagtcagttttatcatagggatgcaggtatagtttaacatacacaagtcaataaatgtgatacatcacataaacagaatcaaaataaaaaatcatatgattagctcaatagatgcagaa

SEQ ID NO: 50385 - DNA, 1724 bp, Homo sapiens
tgtgtgaccaataagagatttataattctttttacgagtttgtctcttaaatcatgtagaaaataaaaagaagtgttagaaaccaaaaatatgatattactggctgttagatttgcctgtttggttacctttaccagaaatctttatttcttcatatggttttgagttactgcctagttttcttttatttcaacctgaaggacttcctatatgttttctcataggggtggtccagtgttaatgaattccctcaccttttgttcatctgggtgtgtcttgatagtgccatcatccttaaagtatagttttgtcaaatataaaattcttgattaacaattttttcttttagcaatttaaatgttttcccactgccttttggcctccatggtttctgatgagaatcagctgttaattttattgaggatcccatatacagaatgagttgcttttctcttgttgctttcaagattatctctttgtctttggctttcaacaatttgattacagtatgtgtcagtttgtatcactttgaatttatcatatttggaatttgttgagcttatgggatgtatagaatcatgcctttcatcaaattttggaagtattcagtcattatttcttgaaatattgtttctaccatttctctctctctcttttttcgttctaggattcccaaatttgtatgttggtccacttaatggtgtaccacaggtcccttaggctctattcacctttctctattatcttctgtttgtggttcttaggactgggtacttccagttgtcctatcttcaggtttgctgattctgacttctgcctgctcaaattttctactgaacccctgtagtgaattttttttatttcagttattgtacttttcagcttaaaaatctgtttggttcctttttaaagttaatattcctatatgaatattttaattttgttcatacattgtttactgatttcctttagttcattgctcatggtttcctttagttcttttagcatatttatgacagttgtgttaaagtctttgttgcttcctcagagatagtttctgtttattttctttttgaataagctttcttttcctgtttattttttgtgacttgtgcttttttgttgaaaactggacatttggatattataatgtggtaactctggaaatctgattatttctctttctcagagttgggtgggttttttttttaacactgtaatagcctgtttcattacttttcctatttttgcagatactgtatttcttgtctgtggttactgaagtttctgtttcttagcttgtgttcacctatggttttgacatatttccttgaattccaagagctaaaacaaacaaacaaaaaattcacctatttctgtctttacaaattttctatgctgggccgctccttcatcacttagcctgatcttagcctttgaacactgagcctagggatcagcccacagtggaaatctgtgctcttatcaggttttttctgagtatgcatcttgtcttgggcataagtgtggctctctaaattatttcatatacagatactttgaatgccctgatttcccaagcaaactcccccagatttttctcccagacctgttgcatatttcattgctaatcttttgcctcaagcatcttcgtgttgtttatttgccttgctttacgatatttttaagcaatgctcacaagttttctgccctgagaggattcc

SEQ ID NO: 50386 - DNA, 1087 bp, Homo sapiens
aaaaaaggaaggtgattggggagaaaagtttcaaagatgttgttttagcttatgacatgtgttaaaaagagttgttggctgggcacagtagttcaagcctataatcccagcgctttgggaggccaaggcaggaggatcgcttgagcccaggatttgagaccagcctgggcaacatatggtggaaccttgtctctacaaaaaaatactaaaattagtcaggcatggtggcataggcctgtagtcccagctactctggaggctgaggtgggagaatggcttgagccctggaggcagaggttgcagtgagccaagagggcaccactgtactccagcctgggtgacagagccagaccctgtctcaacaacaagacatagaattgttaccttttattgttactgattgaaaaaatccacaaatgaatgtattaaagactggcatactttggaaaatcacattagtcagatgaaattatagaactggatgtaatttgttttaagaagctgagagctttgtcaccagatagccacgtgtggaagatacagagcttgcctataacttgtttaagaatatgatcaagcaaatgattgcaaacttgcatctgaatctaaaaaaagcagagaaacatatgcaggcaaaatctgctaaaagtgacctcgaagaggaatttccaccaagaaaaaaagatcaaagtcttctactttcttctctctcccactaatctttttattaggaaatacaacttattcagcttgcgtttgcatagggaaattttccaagattagtcttcaggttctactaaaaacttgacttcatcttttccagaatctgccaaatgacatcttatacagaggcagaaatatctggccatttctagtgagccaaaacctttggaaatattcaagaaagcccattaaccacatagaacagagttacccagcagtaatcaagtcaagaacaaaatagtaagttctcaattatctgcaggtggccaagccacttgttattgtgtttggtaaatgcatgttttgatagagacttagggatgcctacttagacagctgcccttcccgccacttatagcaattt

SEQ ID NO: 50387 - DNA, 1044 bp, Homo sapiens
aatactgtgtggtaggcgtctcagtgatacgacagagagggatgggggatgtccggcatccccattctaaagtggagcatctgtatatggggggatgtgagttgtgaatgtggaaagtctagaacattaactctttccctttctcctttgccattgctccttatgtgtgtacacatgtgtggggaggtagggacaggaagattgctggttgtatgccagtgaatgaggggtgtgggaggcagggagtgaacaggacagtcactgagtgaaggacttgtgtatgtgtgcttctgtatacatatttgggtggctgtgaggggtgggatgtgtggtgagacagccgttccctagaaaaggggtgtaccttgtgcatcttggggcaagaactgcagggggcaggggaacatactatctcagggagtccaccctgagttgggcatgggggtgtgtgtgtatctctgcattaagaaaatatgtggtattcaaacaggcaggggagtgtgtgtgtagatttgtaggaaatctaggtcattcagctactctgaggtactggtgggtttggggtttgagggggaggtgctttgggaattctgggacatccagaccctccatgatgtgtccctgtgtgtgtgtctacagacagggaaataggggtgaagatgaaaagttgaagcagtgatacagcctggtcagaagttgttgtttgtgtccgtgtggaacatgcctggggaagtaggaaaagagcaaagagggacaaaaatgtctgtagttgtatacttgtatatgtaagcacatagagggggagaaggaccataaagaatgtgtggtgaagcactctggtggagaggggctcatgagaagtgataccgagagcagtgaagctggagatcctgagagagcccacctgtgctaagtggggtgggtggatggacagggtgagcaggcctgtgcaccagtcggagaaccagctcatcagcccagtcttgccacttccctttgctccacagaagacgtgcgatgggacacatttcccctaggccgaat

SEQ ID NO: 50388 - DNA, 1049 bp, Homo sapiens
ccctccccctctcccatttcaccctagcttcctcgagcacatggaggcatccggcagggccccctcgacctgaggtccagccctcgtgaactgatctgcggctgcactcaaccttctcgccagtctcaggatgaggtggccttgccccacctcaaagcctgctcctccacctgtgctctggagccacctctgccagcatcgctggggcctcaccccagcctctaccttgctctgctggctcttgctcttcaacctaggaacgtgcctgagcttttctcatcttaaacaaaacaacaataacagcaacacaagcaaaatctcctttgaccctgcatccctctgttgggttatcatcagcttatcattcccacccttcccatcaaaacatctcaaaagagtagtctacactcaacactctccatttcctcactaccctcttactcctcaacctgctgcaatttgacattcacccccagagttgctttgacctcctaattaccaaatcagtgggcccttgtcagtctctgtgtctgctgcattgatgctgtttaccaccccctcctcaaaaaatgcctgtgcttattactagttcctataaagtgctgaaacccaaatctgtctagccctggcccctcccccaagattcagcctcctgtactcgactacatgtcagacatctccccttggatggcccacaggcaccttactgtgaccaaaagagaattggtcgtctcagtccccatctcaactctaaagtgatcttcctcctctgttccctatctcacttggtggcggcaccatctaccctgtcctgttgactctcgaatacttcccaaatctgaggttttgtgttgccgtgtctacttcccttagtgtctccttccctctatcagactaagcttttcaagggcaaggactctacatcagctgtccgtgccctagcacaccacacaagtctaggcaccaaacaggcctcagtaaatgtcgttgaattgaaccgtgctctgctctctcattcccagcagtgctgtccttggtgggagctgacc

SEQ ID NO: 50389 - DNA, 1665 bp, Homo sapiens
gaagaatggtcaagataaacagactgcaagaactgagtctaaaagcccttgaccccatgatcccaggcatttatttccttctgtggatgtggaactttttcctgtctgtgtgttgaagtgtattcagacactactgctctcgttatgggccatagatcagcattagtgcttggtaagcacttgttcaaaacccactgatcccagcctctaaccagcccctgcctgaggaggctgaagcctaagatccaattgtcaactcccttcctccccactcctacccacccaccacccctcctccctatgctgcttcagccacttgagccagaggcattagctgctttggaggtgggtggaggagtaggagagggtcttctgccagcatcactttgctaaactagtgtcctcttgttccagggaggctgtgctggatgcttttctggatgatggcttccttgtccccacatttgaacagttggcagctttgcagatagaatatgaaggtagggttctgggggctcactgcacccttagggttctgattcctgggtggaaacagctggggtgggctggggggccctgggttggggtgtgaaggctgtttcctgccattccatggcctctgaaagtccctcagccttcctggctgagcagaacaggtagccccactgacagttgtggggctgcccttaagtgctctggaatggggtggggtgggatggggtggggtcggggagtcttaatgacattattgtgccatgttcgttgtgatttagctgctagctagagagctagaacagcagaattggaggggccttgtgaggtcatctagtccaacatcctcatgttacagatggtcagactgaggtccagagaggggaaggtactgacccaaagtcacacagtgagttattgacaaagctgaagctagaaccagatctctgttttgtttatactttattttgagtcagttgttggttgccagatactaactggtttctctctccccactgttctgctctcctctttcctttgttctgcggtggcaactctgttgttggtggggggcttggctcatgcgcgcgcacacattctcttgctctcactctcacttcctttctcttgctgtctcttgctctctctttcgtgctctcctgctctctctctcctattgcccccccaaatgggtgtcccttacaaaccagaaaacgtggacttgaatgacgtcctggtgccaaagccgttctctcagttctggcagcccctgctcaggggcctgcactcccagaacttcacgcaggccctattggagaggatgctctctgaactgccagccttggggatcagcgggatccggcctacctacatcctcagatggaccgttgaactgatcgtggccaacaccaagactggtgagggagactagccctagccctagggcctaaggcagcccaggcaggagcctctgccactgtcctcagctctctgctaagaagcaccaggcaaacacctcccgtgttaaaggtttaggtttgcccaagagggccccacggcagcagtggacaaatctcccttttccttttcttctcagagccaactaaactgggctggggcaaagtgccctgaattctttgagcagttgggaggtataggtggggagtctggggg

SEQ ID NO: 50390 - DNA, 1050 bp, Homo sapiens
agataggattggatttgttgatttctgggttcttttccaattctttatatctatactagtaggtataaattctagagcatgtcatgaattgaggaaggcttggctatatctgagatacgactgtaataaaagtggttgaggtctaaggccactgctatcagtataataacttcacaaatggggataactgaaagccctatgtccagagtagttggcaaacctggactttctccctcagataatactgatgtcaagaggtctagcccagtccatatcagacagccatgcaaaattccagatggaaaatcatatttaaagtcacagtaacattgtgatctctattaagcacaacttcagctactagacaagaatgtgggacagaaaagccagctcactgaggacaaagatgggggaggtgggaatgtggctgatcaggaccaggcaaagagttagaactccagccaagagtaccaaggttcagtgcagcttcattgccattaagggaactgagagttaggcagggacactgaaacaggaactcagatcagagaatgaagttgatttataagggggaagataaagtttactagataaaagagtgctcaggactccttttcagcccactggatactgtgtgcaaagctgcagtatttgtgtgggaagatcctgctaatgtaaatttgccttgggtcagtttggctctggggcctagcagatgatcttgaaaagcccaagaggtatgtttggttgtgccctggcttaattggagatgaatatagcatttcatgggctgcaggatacacggggaacactgttgttcctttatgatttttctcaaagtctacttcttgctagctcctgggacactgtgactcaaggtagaccttcctgtctctgactttggaggccagtgtcccagataagagttgttgcttaggccctgggtgcatggacatgaaacatgagcaatgaagcatttggactccagggtccagaagatgaaaatgagaaaatatcagagagctgcctcagaagaagagagatgggtaa

SEQ ID NO: 50391 - DNA, 1046 bp, Homo sapiens
agaagaaaagctttcagtctttgaccattgagcatgactttagctgtgggtttttaacatgtgacctttactatattgaagtagtgtccttctattcctagtttgttgagtattttttttttaattatgaaaagggcttgaattttatcaaatgtgttttctgcacctattgaaatgataatatgggcatcttttcttcattccgttattgtggtatattatattgttttcttttcatatgttgagacatccttgacttcaaaaaataagcccattttggtcatggtgtataattctattaatgtccttttggatgcattttgtcagtattttgttgaggatttttgaatccatactcataagggatattagttcgtaggggtttttttcttatagtgtcattgtatagatgtattatccaggtaaggctggctgcatagaatgagttaaaaagtcttccttccttgatgtagttcagatgtttttcccctccaaatctcatgttgagatgtgatccccaatgttggatgtggggcctgatgcgaggtgtttttgcaaagggagtggatccttcatggatggcttggtgccctacttgtggtagtgagtgatttctcattctcttagtttatatgagagctgtttaaagagcctggcaactgctccattccttcttactcctctcaccgtgtgtcatgtctgctcctccttcctcttccactgtgattgtaagcttcttggggtcctcaccagaaacaaatactggcactatgcttcttgcacagtctgaagaactgtgagcaaaaataaaccttctttctttatcaactacccagcctcagatattcctctatagaaaccccaagcagactaatacactcctcttcaatttttttgcaaggttttgagcaggattggtgttaattctttttaaaatggttaacagaattcattagtgaagccatctggttttgggcatttcttttttggcaggttttcatgatttggtcttggtgtgtttgtgtttccagatattttctcatttc

SEQ ID NO: 50392 - DNA, 1160 bp, Homo sapiens
tgttagaagcactcaggccacatctttaattctttactgcttaaaaatttcttctgccagataccctaaatcatctgtctcacgttcaaaactccacagatccctagaccaggggcacaatccttccagtctccttgctaaggcacagcaagagtgacctttgttccagttcccaaatagttacgcatctccatctgaggctaccttagcctggacttcactgtccatatcaccatcaacattttggtcacagccattcggcaagtttctacgaagttctaaacattctctcatctttctgtcttcttctcagccctccaaactgtgtcaaccttttcactacccagttccaaagctgcttccacaatttcaggcatctttatggtcatgccccccttcccagtaccattttttggtattagtttgttctcatattgctatcaagaactacctgatactcagtaatttataaagaaaagaggtttaattggctcacagttccacaggctgtacaggaagcctggctagggaggcctcagaaaacttcaatcatggtgggaggtgctatactcttttaaacaagcagatctcaagagaacttactcactatcacaagaacagcaaggaggaaaatcacccctatgatacaattacctctcaccacgtccctcctccaacattggggattataatttgatatgagatttgggtggggacagaaatccaaaccatatcagatatcatcagcttcttgagaaacccttactataatggattgtaaaaataaacactttaaggacagaattctcaattttaagtgttgcagaacgaaacagcatgtttgagttgatgcagggcctacagctcaccattgaacaattactgatgaacatatataatatgaatgcacaggtggttattcctgagagaatacccaggctagtagactggatttacaccacagtaaggtctgttaccctgagaaggggactgcctgactcttcttaaaaaatatcaagtggagctccccaggtgaagcagttgatatgcttcatatgcaagccatgtgggactgactttatgatgactgggacattctcctacagaatatgcctgtgaccatccaagatggctgaatagggacagctccagtctacagc

SEQ ID NO: 50393 - DNA, 1030 bp, Homo sapiens
gtattctctcccattctgtaggttgtctgtttactgtgttgattatttcttttgttatgcagaagctttttagtttaagtcccattcatctatttttgtttttgttgcatttatttttggggtctttttcataaattttttgcctaggccaacgtctacaaaagttttacctaggttttcttttagatagggtttcaggtcttagatttaagtatttaatccatcttgagttaatttttgtatatggtgaaagacgtggatcaagtttcattcttctgcatgtggctatccaatttttccagcaccatttattggatagtgtgtccttttccctgtttatgtttttgtctgctttgttgaagatcagttggttgtaggcatttagcttcatttctgggttctctattctgtttcattggtctatgtgtctacttttatactagtaccatgctattttggttactgtagctgtgtagcataatttgaagtcaggtattgtgatgcttccatatttatttgtttgttttgcttaggattactttcactgtgtgcgctcttttctattccatacaaattttagaattttttttctaattctgtgaaaaatgatatttgtattttgataaaaattgcattgaatcttagattgctttgggcagtatggtcattttcacaatattaactctttgaatcgatgagcatggaatgtttttccatttgtttttgtaatctataatttatttcatctgtgttttgttgttctccttatatagatctttcatgtccttggttaagtatattcctaggtattttgttttattgttagctattgtaaatggtattgagttcatgatttattttcagcatggttgttatttgtatatagtagtgctactgatttttgtatttgaattttgtaactgagactttacttaattcatatgtgaaacctaggagtcttttggaggaatcttaagggttttcaaggtataagattttatctttggcaaggagagatagtttgattttc

SEQ ID NO: 50394 - DNA, 1024 bp, Homo sapiens
ctttgactaattagcttactatatttacaaaaagccaacaattatactttgaaatcaagactggtttcatttatttcccccaagaagagcctgactcagcaacatactcagaccattctgaagcaatggggataaagagtgtcagctatggccttaggggtgcctatgggctctgggccatttcacatttgtatgtgtagggcctttgccagcaaaggcaggggctggcattggtgtcccatctggttcagagtctcctgtcctttctgttggccattggttctcacgtgtataccaaagcaacttatgggacttggttggcttctgtttgcagggtggcttccaggaccaggttttttgaaacagcttcccggaaaacaggaaggtaagatatggaggtgacaaaagaaaaaccaaatcgccttttaataactgcatccttagcatacaattgtgctcactctaacatctttctctttttgtttctctacagctctgtctctgtctgtcactttctcttccccaattctgtctctccatccctatctgtctgtcacctgttcacctgtgtgtctatttgtttctctcatattctttttctcacttggtgtctctgtccttttttttttttttttgagatggtgtctcactctgttgcccaggctggagtgcagtggcacgatcttggctcactgcaacctccaactcccaggttcaagtgatcctcccacctcagcctccctagtagctgggactacaggtgcacgccatcatgcccagctaatttttgtattttcagtagagacagggttttgccatgttggccaggctggtctcgaactcctgacctcaggtgatccatccacctcagcctcccaaagtgctgggattacaggcgtgagccactgcacccagccagtgtctctgtcattctcaatctctttctgtctgtctgtgtttctttgcctgtgtccccatagttgtctttatctgtctgtttctctgttcatgtcactctatatgt

SEQ ID NO: 50395 - DNA, 1049 bp, Homo sapiens
ttaataatctactgtttggtttttattctctacttttcttggagcctaacgccaaattgttttataaggataaataatggctaaggaagcaggaaggctttaaggtgagcatggaggagtgtcatagaaaaaaagaggtaattctaggtgactgggggaatctacaagaggaatcaacctcctcctactctgtgccttcaggttgggtatagaggaatataaggaaaggtggaaaaaagttgctaaggttgaatactgatgaccatcaggtcccaagaactctgcaaatgttaagattctttggttatggtcatttgacagagattagagagagagggaacaggtggggcttgagaaggagatcaagtttgtagtaaaagccaggtttcggaccaaagttgaaaagaaattaaaaagaagtacagcttggtggaaagcctataggctcaagtgacttagtggttaaaagctcaggctcctgaatcttccagatgtgagtttgaatcctggctctgcctcttcctagctgtgggactttgggcaggttacaacctctctgaaccttagttttctcatttgtataatgaggatagtatttgcgcccataggattgctataacaacaaagtgagtcctctacatgcctagcacatcaagagtactcagtaaatgatagcagttgttttgctttcataggagactattactagctacttgatcttagttagttcagctttacttctttgagccagttttctcaactgtaagtggggacaataccaccattgaaggcaaggattttgcatggattaaattagattaggtatacaaagaatctggtaaaataatagaggcttaagaagtggtagtattactaggtaacaacctcttaggaaatggcagacatggaagatggggtgtctactcttctgtattcgaggccctttgagaagcctcaagcctaaaatgtagatggcataaaagagttcagagttatattttcaacccacaacctgtccctaccatgccaaacacctaggaagaggcgaa

SEQ ID NO: 50396 - DNA, 1044 bp, Homo sapiens
tcagcaaggcatttatctttcaattccctctcccaagtttgctctccctttaggttttcaagaatcaaaggatgcagatggctttctgtggagaatgatgtgagcacatgggcccactgaatgtggatccataccaacttgatcatggcagatttttccacaaatcccttgtttagaaaagtagcagaaaaggctggctggcacaaaaatatctcccactgaaatatctgtgggcatacacacatatgcagaacttattttaaggagaggctgttcaaacagactcttaacagatggcatatagagggctcatttcctgcaacctcacattactaatgttgttgctcctttactaaacactccagttcactagtcttacaaatctcatccatgcctttgcctaaactgtcaaagaagatcagggcttgaaggaatgtctactccaaccctgatcactttactgatataaattttgagatctggagaatggaaagggcatgcccaaaatttcctaagaggtagaggtagagccaggactagacttcaagagtcaacagtcttctttctggtctctcacatagctatcacagcacatactccaagacaacacagacaaatcttggtgtattcatggatctctttcagatggacatttgcctttccacagagaagtattcatcaaccagtctttgagggtgggagattggtgttaggaacatttaaattttataatgcccattagacaggtacatagccatgaggaaaacactttcctggtctcttgctttatcataaaaatgccccaggtgttacataagtaaatatctaagatggattagctaaaactgtagctatggtgaactgtgtgaaattcagtgtaattttcagggattgttcaagtattttctttctttcttccttccttccttccttccttccttccttccttccttccttccttccttccttccttcctttctttctctctctctctttctttctttcttttttttttgacagagtctcgctctgttgcccaggttg

SEQ ID NO: 50397 - DNA, 1048 bp, Homo sapiens
ggtttgtgtttgactgcgtttagcgctatactgggtaaacaccatggagttttttgttgttgttgtttgtttgtttgttttttgtttttttgagacagtctcactctgtcccaggctagagtgcagtgatgcaatcttggctcactgcaacctccgcctcccgggttcaagccattctcctgcctcagcctcccaagtagctgggattacaggcgtgcgccaccacggccagctaatttttgtatttttagtagagatgggatttcaccatgttggtcaggctggtctcaaactcctgacctcacgatctgcccgcctcggcctcccaaagtgcagggattacaggcataagccaccacacccagccacaccatggagttttttggtgagttcatgtttcttttatttagtttattagaagatgctggtgataaagttatttttacatgttttccctaggtcttggcctttcttcatagtctgttcatttctaacagcctgactgtggagctcacacaggatttcctcccatacaaacaacagctccaactcagtttacagaatgtgagtttgcatgtggatttttctcaccggtctttccattccgattgaatttcagccctagcgaccttgattcttggaattctaggttactgcatcctagccaatttgttagaatatactggtgtggatcacaaatatttagtatatcagactgttcttgctcttccactttcacatctttcctgtttttgaggctgactgctgttcaaacccacccttccacacaccaacaccttcatctatgcaatatttattaagtattgctaatttgctgcatctctctcagatcaggacatagctataggcttatttgagcccaggccttaagctacttccctgctcagtcaaaacactctcactgtagactttattaccacaaacactcattttatcttctctttcttttctcagtacttattagtagagtcacataaattacttttaaaggttttctctaccttctttgtcatgctggttcttacag

SEQ ID NO: 50398 - DNA, 1042 bp, Homo sapiens
tttctttctttctttctttctttccttctttcttccttccttccttcctttctctctctctttcttttttttcttcctttctttttctttctccttccttccttccttcctttcttcctttcttaatttcttttccttccttcctgccttccttccttctttctctctctctctttctctctctctcatccaggctgtagtgcagtagtggcatcttggcttactgaagcctctgcctcccgatttcaagcaatattcctgcctcagcctcctgagtagctggaattacaggcacctgccaccatgcccagctaatttttgtatttttagtagagacaagtttctccacgttggccaggctggtctcaaacttctggtctcaagcagtccacctgcctgagcctcccagagtactaggattacaggtgtgagccaccacacctgcccctagggcattttctaaaaccattcagtggcagttgtttagtactacagtttccacagacaacaaaaagaataaagtagcaaataagaagctgaacaataaaccaaacaggacaaaatggagaatgaattatccttggagagctttgaagagctgtgagatattcctggaaatctaggagtcatgcacatgagaggggctttgtacatacccagcgtttgtatctgtctagaagatacaaacaaggagattagacttgagacatctaatctcccacttctggctgaccttcagctctttgcaaggaggagtgaaggctaaggcacagttgtaaactgtctggctgaatgttgaaggcacaccccacaatacacagagagcccttcagcaaaggcttggagatatttgttcaaaccatttaaagaaatctctgtccaatcacttgttgaccagtaagcttactgaccagagactttagtggtttcatatgacaaagaatgcagactatagaatgagtccatgaagccaatgtaacaacaagcaaccacaagaacaacaagctctggggaaagagaggagttctgatttccaaagttg

SEQ ID NO: 50399 - DNA, 1027 bp, Homo sapiens
atctctcagtagccgtactcacattccttatgctgcagcctagtatttctcaaagtgtttcgtagcctagtgttcccatgccctgtagggacattagatgatccaaggtggtgtatggataaaaagttattttaatgcatagagaataaaagcaaattcatggtagcgatataaaatttcctgttaaaatacattaatttaggctacagagatgacttaatttgaaggaaaagtatgttaagtaataatagcataggtggtacacagctgtggaaagagccagaagatgggacacaaatggctaaagtatgggaaacgggcccgaccacctttgtctacttcccattccctcaactcaccatgtaattcacatttctgtgcctttgatgatactgttcccttatttttattactctctttccaactttctgcttatcaaaattctctcaggctttatggtttagctcaaatgacacttccttgtgatatctttgctcatctcccggtcagaattgaggactccctcttctgcacactcccaagacattactcgtgcttctttctggttctggttcattttgtttgatggtgtaattagtacctcatatgtctgtctctctccctatcagacagtaagtttggcctttagcacagtgccaaacacagagagatagcttatgataaatgttcattacattgaattatagtaaaggaagaagttcaatttcacaattctccaagttgcaggtgaaagttaataggaagagaaaccgtattccaaacaaggaaaggctatctgaagttataaggtgtgcatgtgtgtgtaaggatataggcaacgagttatttccagtgtaaggtgaaaacctataattcttatgggtgaaaacattatgtttcatgtttcggggcaatgacctaaatctgaatgttggcaatgcttgcctaatctagtcagttggctcaatgccttcagaaatttaaaaaaaaaaaacaaaaaaacaaaacaaaaaaaaaacaaaagtag

SEQ ID NO: 50400 - DNA, 1046 bp, Homo sapiens
acatcttagttaaaagtatttttattttcaaatacataaataatggttgtgaatgattcatgtacacttgtaaagaaaatgtaattccctgacttgctcactaagtccttaccatttgaaagcctagtctacgttatttattgtattattcagctctgtacttttcagccttatcacaaatcaatccctatcaaaaggctatggaagaatgaaggaaggagtaactcattcggtctggtgaaggcttcactgggaaggtgagatttgatgtaggcttaagagatgagcacgatctcagctcactgcaacctctgcctcccaggttcaagtgattatcctgcctcagcctactgagtagctgggactacaggcatgtgccaccacacccggataatttttgtaattttaatagagatggggtttcaccattttggctaggctggtctcgaactcctgaccttaggtgatccactcgcctcggcctcccagaatgctgggattataggcatgagccaccgcacccccacagaattatttttttctgtgcaatattcattaacatctaaggaacattattggtacccagagtggaggtattgtaggaacagtaaaggatttaagcaggggaatgaaaagtcagatataagttttagcaagattgccctggaaatagcatgatgggtgggttgattaaagaggacttttctagagggagtggatatagtcttggaatgttgagggccttgactagattgtgactgtagaaggggagaaggggacaggttggattaatatgaaggtggcaaaattgatacaacttggtgataagttatgaagttgggagaaggaagatgactcaactggtattgggtatgttgaggttgaggtgcttgttggagattagtaaattggatatatcgcactgtttgcttatgaggaaaatatgggttagaaatagatgtctcagacctgaaacagtagaatgtgagagaacaggatgggacccaatatttaaaggttaagcaaaggaaaaaaaaagctagtag

SEQ ID NO: 50401 - DNA, 1028 bp, Homo sapiens
acctggtcactcaccatgagatggcttcggatggatcaggaccaagggtagctccacaccaacatcgctgcaaggatcccaaggtggagttacatctcctctctctacaagcccaatccctgaacctccctcccttagttttccagtctttggatgccctcagaccctccagaatcaatcattattttgctctccttatccccttgtcctcctcttcttgcccaagttcccccaccccacagtctctcacctggctgtcaggtctcctaggatgctgtgggtagaatgacacccaaaattagcagcgggaaatagagaaggggcaacctagtttcacaaggggatgagggatcataagacctaatgagccagccacagaatgggtttctggaagggaaagtgacttgctcactgagctcacaggtttgggaacctggtctgggagaaagggtggggaatggtttgattgggtcaatctaactgggagaaaaacagaggcgaaaagcccttgactcttcagcccctgcccagacagacccagaaccctcacttacccaccacaggacaccatcaggttgactctgactttgtaggacaccaggatccccagcagctctttgtccattcccggtctaatactggaggttgtagtattcgttttagggtgtttggggcatgaagagtaattcattctgtccccagtttcttctcatgcattcctatcaccacaccctattatgtttagtcttatcccagaatatctcccaggctctaacctttcctacccgttgagaccacatttctcttcctgacattcacttttaccatgtcactctctgctcaagagcctaccttttgaatataacaactactctgcctgactttcaagacccctaacaaccttgccctatctagcctctctaaccttttctcccctaactcctgggatacaacctaagcagacccatcttctctccgtgatcagaacatgccatgtggattcccaccttctagcctttgcccatgct

SEQ ID NO: 50402 - DNA, 1066 bp, Homo sapiens
caaaaagaccccaaacccctggtcttttgccacagatagttttcatttttgttttttactgaagatgggatgttgctgtgttgcccaggctggtctcgaattcctggcctcaagcagtcctcccaccttggcctcccaaagtgctgggattacaggagtgagccactgcacctggtcaccacagatagtttgagaagcactgattgaggtagattccagtttggggttgtcatttgccattaactcttttttatggacaatgtttctctaaggtaggtactgaagagtagaattacagggttactggattgaagagtatgtacattttacattttattactgcaaaattgctcttcgaaaaggccaaatgcttctaacaatggtacatgagtcctttttttgtgtcagaaatgatattcaaaaaaagaaaactaaaacagtatatgagagtacctgtttccttacactcctgccaacacttgatatcaatctcttaaacttttgttagtctgtcaggcaaaaaatatctcctctttattcacagttttatgattattagtgaatttaagtattttttcatgtttattaactttaaattttgatgtagtcagatatattattcctttcctttatggcttttacttttttgttgtttttttgtagagacaagtctcactttgtcacccaggttgtagtgtagtggtgcaatcatagctcactgcagccttgaactcctgggctcaagaaatcctcccacctcagcctccccagtagctgggaccatgggcacataccactacacctggctaattaaaaaaaaattttttttgtagagatggggtctcactatgatgcgcagggtggtctctaactcctgacttcaagcgatccgcccacctcggcccccaaagtgctgggattataggcatgaaccactacacctggcccagcttttgcttttttagtcttaagatggctgttcttgctccaaggttttaaacatattcatttatattttcttctcatgtgtttcttcccccctttttcttacagctttattgaggta

SEQ ID NO: 50403 - DNA, 1050 bp, Homo sapiens
aagagcaagtacctgctgtggtactgcaaggtaaggagggtcagcatgcgagcgaggcgggaaagagggcagtggggagcacgggctgtggtactgagctcggggtgtggacagatctccagggagggcagccagccttccatctctaagctggcccgatctccaaggggaggagcatggcttatcccgggggaaagaaagggcccaacgcattttagggaggcaggtctgaccatccttttgacatcctcaggctgcccggtgccatgcgtgtaagcgccaggggaagctgctggagaccatccactggcgtgggcagatccgtcatttctgcaaccagcagtgtcttctgcgtttctatagccagcagaaccaacccaacctggatacccagagtgggcccgagagcctcctgaacagtgagtcccaggcagggggtacactctgttagagggagcctggactctcctaatcctaagcctagcccctttctccttcctcttgcgttcagctcacccctggccagatagggtgctagtactgtgaactgtattctcttttagcttccgaaccctgcaggtaccgggggagtcttatttaaagcttcttggagttagcatctactgattgtctatgaaatatatattgttagggagtgggtgcctttcctggtaggatggagcatataggggttatggttacgtttctgagataaggaaatctcagcataaactctacatttagtgagactgaagactgctatttctagaatgttacccctgcccctccacaactccagggataacagactcttcaggctatctaagtggaaggtctcaaatgtgggttttgggggaaaatgtaatgtttcattctccaggaacaaataatcttttaggctgctattgctggggcatagaggagactagatctgggatggcaagggggtcaaatcctagaagttcccatctgtatttggtgtacctgttaatgaagctctcctggaacaggggtaaggaaaatggagagctagtcccttggatgagagca

SEQ ID NO: 50404 - DNA, 1049 bp, Homo sapiens
gtacaccggctctgcagcgattcttgcttctccaaattccgggccaacaagggactgaaaaccaactgttgtgaccagtgtggggcttacatctacaccaagaccgggagtcctggccctgagctcctcttccacgagggccaacaaaagcggttctgcaacacaacctgcttgggggcgtacaagaaggtggggccgagggagtagtgcattagagggctgtggaagggggtgtggttcttgggttataaataaaggtggctgatgggtcaagggctgggagaaataaaacaaataaagggggtttcaattgtatccgttatgttttatttttgaagctggctggtggatacacaggtctttgttacatcatcatctatactttttttgtatgcctgaaatatttcatgtttaaaacatttaaaaaataaaagtgaagggacaaatccagcctcagcctctccttccccatcctcacagaaaaacacacgtgtgtacccatgtgtctggtgcaagaccctgtgtaagaactttgagatgctatcacatgtggatcgtaatggcaagaccagcttgttctgttccctgtgctgtaccacttcttacaaagtgaagcaggcagggctcactggtaggtgcaaagccctcttctctgagtcccctgctggccttctctctacctcccatactcccctcttccagagtaatccttgctgcccgacctcagtcccaaccacatctccccatggattttctgttcgtctcttacactgccttacaccttctgtgtgctctctctctccctctctctttctcttttcctctctctctttctctctatgccccaggccctccccgaccctgcagcttctgccgccgcagcctctctgacccctgttactacaacaaggttgaccgcacagtctaccagttctgcagccccagctgctggaccaagttccaggtactccagaccctggaccagggatagaagggtttggcaacataaagagggttggagaattggggtaggcaggcctgggcagagc

SEQ ID NO: 50405 - DNA, 1060 bp, Homo sapiens
aaatgcaggtggctgctgggattgtagcatccaggctcctggctggctctgctgaacctagtgcaaagcctcttctggataggactcacgcagagctgggctgagtcataatgattagccttaggtactactaaactttgactcacttgaataaatggtaggtgcctgctatgcacaataaacttctaagacattaattctgaagggcatacggtgagtttcataggacagccccagaaacccaagcagtgggtgcttttggtaaccagcatctgtgtcttgcaactgcctagctgatgccaagcactctcacaaacaggcttcagttctgttaagtgaggtgacaaatgtagcatgtgccaagccactatgagttggtgtgtggtgggttttgattctgcttgttttctcttccagggcaacaaaccatggatttctcttccccgaggaaagggtatccgcctcaccattgctgaagagagagacaaaagactggcggccaaacagagcagtgggtgaaatgggtccctgggtgacatgtcagatctttgtacgtaattaaaaatattgtggcaggattaatagcattttggttttgtgggttgtttttttttttaattcagtttcctgctattttactgtataacatgaacagtgattaagttctcaggcaggcttaggcagtctgttattggctgggcttagttagtggtgggaagtagaagataccagacttgggaaaggaacagcaactaaccaaggagtagaaagagccaagaaatcccggagtatttatctcccccgccttgacttggccaagaacttctctacacagtggacccctctgccctgttaagttcccttggctttctaaaaatctgccctcattttcttctccagtctgtattgcactagcccatccacaagcctggctcatctgtttttcccactcctgtgcccatcttgccaaacgcaggatgaaaatctccagttgccattaaaggtggtcataaatgggctgttgatgttgcaaagcattgcagttccttggacttagtgc

SEQ ID NO: 50406 - DNA, 1030 bp, Homo sapiens
aattgaccggtgtgtttgtaagtatcttatataaatatttccgtggccactgtttttaagtgtctcccaggactcatttggggaccaggctaggggaggaatatctattcttggcttcctctgcccttgaaggagctatactatctagctgtcctccacttccaatcgatttaatatttttgtgcctcatttattccacataccacatagtacatttacatggactcaggattcatgttcttaatgatcctggtcctctgacagggaagatgctataaaactttaaggtatgaaatagttttggatgctttttacacctcctgtgtaaaagtccaagttgggtgtaatatggacggtcttggtgttcagttagtggatctggtggactaggaggtaggtttgagtgctttagtgaatcccaacagtgattatcatttttaacgttacaggctcctcgtccatccaccggtccccacaagttgagagagtgtctccccctcatcattttcctgaggaacagacttaagtatgccctgacaggagatgaagtaaagaagatttgcatgcagcggttcattaaaatcgatggcaaggtccgaactgatataacctaccctgctggattcatgggtaagaagttttaaatactctggagacgcatattgatggcagccctatggtatccaaatactgtcttgatcatttttctaacctttgtaatctgtcaagtctcagaaacaaagcctgaccttccctctgttttttacttaaataaaaaacatgcaaataatcatgaaacgcttttcaaaactaaatttcgattcacttttaaattttacatgcagtcatggggttttgaaatattgaagatctggccgtgatctttaatcttcagaatccttgttggattagaactgggaggcacatgggggttctttttgtttcgtagagagctatggttgttgctcggcatgaggtagtggggatcactgtatgtagtaaccggttactgcttgatttcagatgtcat

SEQ ID NO: 50407 - DNA, 1080 bp, Homo sapiens
gagactgtgtctcaaaaaataaaaataaaaaatatatataaagaactttccaaactcaacagaaaaaaaaaaaaacaattaggaagtaggcaaaagacaagacatgaaaaggatatacagtcagcaaatgagcacatgaaaagatgttcaacatcattagccattgggaaaatgcaaattgagatcacaatgtgatatcactatacatctatcagaatggccaaaataaaaaccaacaccagatgccagcaagaatgctgagaaaccagatgactcaaacattgctggagggaaagtaaaatggtaccaccagtctggaaaacagtttggcaatttcttataaagctaaacatgctactaccatacctcccagcaattattctgttgagcatttgtcccagaaaaatgaaaactatgttcacacaaaaacctgtatgtgaatgttcatagtggcttgattctatagccaaaaactggaaatgactcaggtgtccttcagcagataagtagttaaacagattgtgctacatccatactgtggagtactactcagcaaaaagaagcaacaaacttgatacacaccacaacttggatggatcttaagagcagtatgctgagtgaaaaaagcctatctatctcaaaagtttatatactgtatggttccatttctataacattctcaaaatgaccaaattttagagaaggataacagatgaatggttgttgggacttagggatggtgaaggaggagggatgggaatgactgtaaaggaggtagaggagggaaatctttgtggtgataaaatagtttcgcatcttgattgtggttgaggttacatgaatctacacttgcgattaaatggcctagaattatacacttatacacacacaaatgagtgcttgtaaaactagtgacatattaataagatctgtgaattgtaccaatgtcaatttcctgacttggatattgaacagtaattatgtaagatgttaacatgtggggaaacctggggaagggtgtgtagaacctctctgcactattttttttttgcagcttcctgttattctataattatttta

SEQ ID NO: 50408 - DNA, 1068 bp, Homo sapiens
aacaacacaagcgaaggtgtggaaacaggaaagcatggatggggcccatttacgctaaggagttggacttcattcataggtggtaggtcgggaactgctaaagtcttttttttttttttttttttgaaatggtgtctcgctctgtcacccaggctggagtgcaatggcaccatctcggctcactacaacctccacctcccaggttcaagcgattctcctgcctcagcctccccagtagctggggttacaggcgcccaccaccacacctggctaatttttttgtatttttagtagagacgaggtttcaccatgttggtcaggctggtctcaaactcctgacctcaggtgatgcatccacctcagcctcccagagcgctgggattacaggcatgagccaccacgcccagcctgctgaagtctttttgagcagagaaggaatgtgatcacagctagcaattgtgcagggaatagctctagaagcaggaggaccagataagaggttgtcgcagtgacctgagtaacaagagatgtgactaaagcagagacagtggaacagaaagaaggggatagattggagagacatcttgaggttaggcttcacaactcataagatgtggagaaggcgtgaactaagaaattaaggatcaaagattatccagagatttttttgaggttagggggttgaaataccaaaagcatgatccaaaaaaagaaaaaaaattgataaggaattggagctcatcaaaatcaacttttgctttacaaaagaccctgttaagggaatgaaaagataagttacatactgagataagatatttgcaaatcatatatcccacaacagatttgtatctaaaatatataaagggctgggtgcagtggctcacacctgtaatcccagcactttgggaggctgaggcgggtggattatttgaggtcaggagtttgagaccagcttggccaacatggtgagatcccctctctactaaaaatacaaaaattagtcgagcatggtggcacatgcctgtaatcccagctactagggaggctgaggtaggagaatcgcttgaa

SEQ ID NO: 50409 - DNA, 1051 bp, Homo sapiens
ggtgtggtggctcctgcctgtaatcccagaactttgagaggcttaggagggaggattgcttgaggccaggagttcaaaaccagcttgggcagcatagcaagaccccatctctacaaaaaatttaaaaatattttaaaaaaataaaaatggacaaaagatattaataggcacctcaccaaagaagatatacagacagcaagtaagtgcagatgctcctctgcctattgcagtggggttatgtcccaataaatccattgtaagttgaaaatataagtggaaagtatgttttcaacttacagtatcttcaacttatgatgggattatctagatgtcaccccatctcaagttgaggagtgtactgaatgcattattacttttgtaccatcataaagttgaaacatcttaagtcagagactatatgtgaaaagatgcccaatatcatggtcactaaggaattgcaaattaaaatgagataccattacatatctattagaatggctaaaatccaaggcagtgacaacaccaaatgctgttaaggatgtagaactacaggaactctcattcattgctggtaggaatgcaatatggtacagtcacttgggaagacattttggtattttcttacaaaaataaacatattcttaccacatgatctagcaatcacactccttagtaattacccaaatgaattaaaaactcatgtccacacgaaaacctgcacatgaatgtttgggggtcttttttgttgtttgtttgggttgttgttgttgttgttgttgttgttaatttttttttttttttttagagacagtgtttcactctgtcacccaggccagagtgcagtggcacaatcatagctcactgcagccttgacctcctgggttcaagcaatcctcttgctccagcctcttgagtagcttggactacaggggtgtgccatcacactcagctaatttttttattttgtagagacagtttctcactattttgcccaggctagtcttgaactcctggcctcaagtgatcctcccgcctcagcctcccaaaacac

SEQ ID NO: 50410 - DNA, 1001 bp, Homo sapiens
actaatagacaaaattataaatatatgtcacctaacaacagagcaccaaaacatatgcaacaaaaactaaagaagtgaaaaagagaaataagaaatttaacaataatagttggagatgtcaatactccattttcaataataaatagaacagctagggagaagatcaacaaggaaatagatttggacaacgtgataaaccaactagagcagaatatacattcttttcaagtgcacgtggaacattttctaggacagaacataagttaaatcacaaaagaagtctcagtaaatttaaaaggattgaaatcatacaaagtactttggaattaaattagatggaaaggaatgaaattagaaatcaataaaagaaggagatttgggtaattcataaatatgtggaaattaaacagcacactcctaatacaaataggttgaagaagaaatcacgttgcttcatggccttttggctaagttcaagtgtagtatctgtccttatcagtttaatatctgatacatcctctatctgaggacaatacattaaagggatttttggagcagggagatggaataaggactagtttcctccactccatgcatcaacctggtattgcagtacctccagaaatggtgcacccctcccaataagaaaaaaaaattaaaagaaaagaaatcacaaataaagttataaaatactccaagatgaatgaaaacaaaaacaaaacatgccaaaacttatggagtgcaatgaatgcagtactcagagggaaatttgtaactgcaaaggtctgcttaaaaataagaaagattacaaattaataacttaatctttcatcttaagaaaatagagaagagcaaactaaacccaaagcaagcagaggaaaagaaataataaaaattaggtggggcatggtggctcacacctgtaatcccagcactttgggaggccaaggcgggtggatcacctgaagtcaggagttcaagaccagcctggccaacatggt

SEQ ID NO: 50411 - DNA, 1050 bp, Homo sapiens
ggtagttctgttctaagttctttgagaaatcatcataatgctttccataatggttgagctaatttacattcccaccaacagtgtataagcattcccttttctccacaaccttgccagcatctgttattttttgactttttaataacagttattctgactggtataaaatggtatctcactgtggttttgatttgcatttctctaatgattagtgatgtggagcattttttcctatgtttgttagccattagtatgtcttcttttgaaaagtgtctgttcatgtctctgcccactttttaatgggtttgggtgttttttgcttatttgtttaagttccttatagatgcatagtttgcaaatatttcctcccattctgtaagttgtctgtttatttggttgatagtttctattgctgtgcagaaactctttggtttaattaggttccaccttgtcaattttttgttttcattgcaattgcttttggcatctttgtcatgaaatctttgtgtaggcctatgactagaagactactttctaggttctcttctaggatttttatagtgtgaatcttacatttaaatatttaatgcattttgagttaatttttgtatatggtgacagataggggtccaattttattcttctgcaagtagttttcccagcaccacttattgaataagatatgctttccccattgtttatttttgtcaactttgtaaaaaattagttggttgtagttgtgcagctgtatttcaggggtttgtattctgtttcattggtctatatgtctgtttttataccagtaccatgctgttttggttactatatccttgtagtatagtttgaagttggataatgtgatgccttcagcattgttcttttggcttaggattgctttggctattcgggctcctttttggatttacatgaattttagaacagtgtttttataattttgtgaaaaatgacattggcaatttgatagaaatagcattgaaacagtaaattgctttgggcagtatggccattttaaaaatattgagtcttcct

SEQ ID NO: 50412 - DNA, 1048 bp, Homo sapiens
aaaagatgcagaaaaatatttgacaaaaatcagcaccctttcataataaataagcaatcaaaatattaggaataaagggaagttactcaacatgaaaaagggcatttatgaaaaacctacagctaatgtcatactcaatggtgaatgactgaaaacttttcctctaagatcaagacatgaatattaacttttaccactgctattctatgttgtactggaaggtctatccagagcaactagacaagaaaaatgaataaaaggcatccaaattagaaaggaagaagtaaaaccatcctgtaggttgtcttttcgttttcttgatatgtcttttatagcacaaacattttaaactttgaagtcatatttaccattggttcacactgtaaccagcagcattgcaggttacaatgtcattacacaaaatcagatgtgcttttatctaccaataatgaacaatccaaaagaaaaattttaagtaattgcatttatagtaacatctaatagaataaactcaaccaaggaggtgaaagactagtacactgaaagctacaaaacattgctgaaagaaattaagacctaaataaatggaaagacatctcatgttcattgattggaagacaatattattaaggtgtcaatactacccaaagcagcctccatattcaatgcaatccctatcaaaatcccaacagcccttttgacacgaatggaaaaaccaattctcaaattcatatggacttgcaagaaacccaataaccaaaacattcttgaaaaaggacaaaagttaggagatccaatttcaaaacgtaatacaaagctatagtaatcagaatagcatggtgttggcataaggatagacatataaaccaatggaatagagtcgtaaatcctaaaataaatctctacctctataaccaattgttttttgacaagggtatcaagtccattcaatggggaaggaatcatctcttcaacaaatggtgcttggacaacaggatatccacatgcaaaagaattaagttgcacccctacttcacaccatatacaa

SEQ ID NO: 50413 - DNA, 1023 bp, Homo sapiens
aacttctgtcatgggggtttgttatacagattatttcatcatccacattatattaagcccctgctctggctcagcaacagtattgaagacagcagcctgtgtttgcagtgtgggaccctggaccatggttccagggggaacacagcagaccttattcaaaaattattgtgtaggtctgctctaacctgtcagagggctatctaaatgacagatgtaaagaacttatctctgttgcacctaactcagaactcacccaagccagaaaattaccaggcattgctcaaaaaccctaagatggatgaacaacccagatgcctgaggcaaagggttacagttgaggcttacaagagacaacctaaggcctgagaagaaaagccatagggagagcttctttgggaaattagggcaaacaaaagtatccatgtatacgggaaaatatagaaaaatatgtgaataaattgccagggaaacttgcatgttcaggaaagacttgagaggaccttaaagactgggagaggtgttttacttgtctggattttttttttagctcctggcattcaaggatagcaattcactagaggcttcaggcacaagacagaatcagtgcacttggaagataggataattgaaatgaaccaatctgagggacaggaaaaaaaagaacgaagaataattagcagagcctaagggacctgtgggacaccatcaagtggtccaacatacacattatgggagtaacagaaaaaagagaagaggttatgaaagggatagaaagaatttttaaataaataatgaccaaaaacttcccaaatttgatgaaaagcattgaacataaggatccaagaggcttaatgaactccaagtagaataataactccaagtagaatagacccacatcaagagacattataatcaaactgttgacaaagacaaagagagaatcttgaaagcagcaagagagaaacaactcatcacatacaagggattctcaataaggttcataactgatttcttatctgagac

SEQ ID NO: 50414 - DNA, 1049 bp, Homo sapiens
ggataacggtaatggttgtgcagtgttatgaaaatacttaataccactgaactgtacactttaaaatggtttttaaaaatttcaacaaggagttggaagatatagatgaagaaatctctaagaaaacagaatttgaaaatagggaaatgagaaataggaaagataaaagacaagaaaattatagtcaacagatgaggtccaatagccaataagaattcctgaaaaagaaaagagaagaaaaatatggctaggaaattatcaaagaaataattaaagaaaatctgtccaaatcctgaggatacaactttccagactgacagggcccactggttgcccaacattatgaaggaaaaaagatccaaagacattatcatcataaaactttacaacaaaggagaaaaaaagctatcctaaaaggtaaacagttgtaaggagaaaaattgaagatcacataaaaagcttcaagaatcagaatggcattggacttctccacaacaatattgaatacttcaagacattggaggagttcctttaacattgtaaaggaaaaattatttcaaccttgagttctatacccagccaagctaccaagcaattggaaagatcaaatacagatattttcagacatgccaaggtcaggaaacttggagtagatgtccaccagaatgaagataataagccaggaaagagaaagacatgggacacaggaaacagatgctccaatgcaggagagaacagcagagatttctcaggatgacagtgaaaggaaactccaagacaccagctctgtagaagggccagaagtcaaacagttcagattggagggctccagagggaagactctcaggtgaatatggaattcacagattgcctggtgtggttgatagtactaagaggactaataattctgtcaaagaatgtagtatgagttagtgataagtacatagaaagctaagcaacatttctaaggtgaggcaactattaattcaaaaaaattgtccaaggaagtaaaagtagtcataatacagtacatagctgagctgtgaaca

SEQ ID NO: 50415 - DNA, 1042 bp, Homo sapiens
tttctggtgagggctcgcttccttctctgtatgtcttcacatggcctttccacttaatgtgtgcagagagagagaagaaaatctctctctcttcctcttcttataaggccacccatcctattaaattaggaccccacccccattacctcatttagtctaaattacctcctaaaggctctatctccaagtatagtcacagtgggggttagggcttcaacatatgaattccgggataacacagttcagtctagtagatgggatgcataaaacttgtgactgcatacacagccatactcactgtttataatactgctaggaggtttggacccttcaaaaacaggaattatgataaatgccattttgcacaacttttatgaaaaaagaaaaaatacagtttgtatatactcatatatgctacactattgactctgttttttaaaggagaaaattttattttgactaggcattgttaaaaaccaaatcctccacttaaaattttaatatgctcattggaagaattttacacaaactttgaactctgtacatttcaaattttgtttctcctctactatccaatgtatctaaccccagatgctataggacacatttatatcatgatgctacctctggctctgtcctttttgtgtaaggatgctggatgagtaaacaccttaggttataggaccattcctgaagccattcctacaccattagcagtaagttaactatacacaataagtgattgcaagccacataaatgtatctctctaaacccaaactaaatgtatcctcacctcaacttcctcttcgccattccagttacactcaaaacaagggagaagtctgatggaaaagtcagactggaaagagagagctgtcttaaatgaatgtggttaaataccttactttgaaaattaggggaaaaatataaccttgtaaaaaaccagtggtggtacccctccctggaccttgagagggatctgtccagtgaggggctttgaagatttatgattagcttcatggtgaatcagcttctaaggaa

SEQ ID NO: 50416 - DNA, 1055 bp, Homo sapiens
caatcatcacacatgagacactcacaagtataaagggcctaagaaccaacatttcttgaagtatatccttttcttgcttgattaaagtctcctacaaaactgctcaactgggttgagcaagatgaattcgtctcaacaattaaattactagctgaatatgtaaattgttgttacctaaaaggccaaaaataaagtttatatagcccctctgctttattgattggatgtttgacttatcaagtcattcagtcattcagtgactatttattgaatactaacaatgtgccagacactgccaagtgctggggctacaatggtgaacagtgtagatgtggtccccatgccatggaacttataatccagtaagaaaggtgcactaaaaaacacgcaaaacataagtcaaaagaattttaacctgtaataagtgccataaaggaagcatatggggagtggagatagaaactatcaaagggatttaaatcaggtctctaagaaaggcctttctgaaggtgtgacatttaaggccagaacttcaggggtaagaaagactcagccaggtgaaaaaaaaaaaaataactaaagggcaagtgttccaggcagagtaggcaaccatgtacaaagatgctgaggtaagaaagagctcagtgtattctgggtgctgaaaggaggccactgtgactaaggctaatgagtgaaggataagaggtaagagatggaatgggccgggaccagaccctcaggggcccctgtagaccacggtgaagagagtgggatcttattcttagagtcagaagccactgaaggcttttaacaggagaggtaccaggatgtgatgtgtgttttaaaactactctgagccaggcatagtggctcatgcctgtaatcccaacactttgggaggtcaaggcaagaggatttcttgagcccaggagtttgagattagcctgggtaacatagtgagaccctgtctccacaaaaaaaaaataaaaaattaattgggtgaggtggtacatgcctgtagtcctagctaatcaagaggatggggaaggagaatc

SEQ ID NO: 50417 - DNA, 1030 bp, Homo sapiens
ttttctctgccttcatttttgaagaatatttttgtaggatttaaattctacatttacagtttttcttttcttctggcttctgttgtttctgatggatattagtcttattattattgtttccctgtatataatgtatcttttcccctctggctacctttataaatttatatttggtattcaaacctttactgtgggctaggcacggtggcccatgcctgtaatcccaacactttgggaagctaaggcaggcagatcacttgaagccaggagtttgagaccagcctggccaacatggtgaaaccccatctctactaaaagtacaaaaagaagcccggtgtggtggcacatgcctgtaatcccagctactcgggtggctgagtcatgagaatcacttgaacctgggaggcagagtatgcagtaagctgagatcacaccactgcactccagcctgggcaacaatgcaagactctgtctcaaaaggaaaaaaaaaaaaacagagagaaagaacatcgactgtaatatgcctcagtgtacatttgtttgtatttatcctatgtgggattccctaacttcttggatttgtgggttgctaatttttatatacaggttgggtatcacttttttaaaacacttgggaccagaaatgttttggatttcagattttttttcagattttgtaatatttgcaatctggaaattcaaaatctaaaatgctccagtgaacatttcctttgaacatcatatcaggactcaaaaagtttcatattttagaacatttcagattttggattttcagattagggatactcaacctgtgatttggaaaaagtatcagccagtatttctttattttttttttaacttattctccctttcctgttcttctgggactctaattacaaatatgtttgattgatgctgtcctacaagacactgaagtgagcttactatttttttcagtttttttctctccaggctacagtttgtttgatttctattgatcagtcttcaagtttactgattccttagt

SEQ ID NO: 50418 - DNA, 1725 bp, Homo sapiens
catatggtatcctcctttattgttagtacagtaaattgcactgattttttaatgttaaactgactttgcattcctggaataaaccctgcttggtcatgttatattatcctttttatgtattgctggattcattttgctgaaacttggtcaaggtttttttgtgtctatgttgataagggatgttggcctgttgttttcttttcttgtagtgtctttgtctggttttgatatcagggcaatgctgatctttggtttctctggggtttacatctgggcatctgtttgtttttgtttttgtttcgttttttgttttttgtgagacagaatcttgctgtgtcgcccaggctggagtgcagtggtgcaatcttggctcactgcaacctccgcctctcgggttcacgcgattttcctgcctcagcctccccagtagctgagactataggcgcgcaccaccacacccggctaatttttgtatttttagtagagatgaggtttcaccatgttggtcaaactggtcttgaactcctgacctcaagtaattcgcctgccttggcctcccaaagtgctgggattacaggtgtgagccaccatgcccagcctatagtatgcatttttaacttattagagtcaacttttaaatagtattacattacttcacatataatatagtacctttacagcagcgttcttccatttttttcctttctctttctttgtgctattgtagtcatatattttacttttgcatatgttataaacctcttgatacattgttattgttttgctttgaacaatttttttagtttttaaaatatttactaattcattttaagtagaataaatccagcatatattagcacaaataacatgttttgatgaaaaataactgtattttcaaagataaaaagaaatttcttaagaaaaatgtcattgttatacccttttgcccatttctttaacatctggcttaatagaagacagctgacttctcatacctgcttctacattcagtgtgttttgagatgttgtttttttaaaaatatataaagaaaatccagcttcacatagatatgtaattggaaaagggaaaatgtattttaatacactttcagataattatggatattcttcgatactacactaaaacttcacaaatgaaagtttcttaaaggttaatccagtgtggaatctgaaaccgtatcagtgaactttttatgtactattacattaaaactcattggtcatcttattctttgagtggatatttgacccatcttatacatattggttatttggaaaatattagttcactaagttatgcaaatattccaaatgctaacacattttatgcagtatcaaaaaatcagtcattgatctcaccaccgatctcactggaaaaaaagcttaagtattgagaagctgttatgctcccagtggcagaatgaagtttcctaaaattctaattttcactcaaaaaatgtgaatattatcattggcaagaaatgctgtcagttgtttgccctgaagtgacaaacttatttcatttttgagaaaatatttgccaaatgtccaagtatttaatcatgccttatccatcattctttcaagcaaaaatgatgttctatgaaaaatgtggctagttaagctcaaaacttgacatgcttttcctcaagacaaccaccatagcacagtttataccagaagcaccttacgtatacctccaat

SEQ ID NO: 50419 - DNA, 1047 bp, Homo sapiens
gataggacaactggatgtatcaatatacaaaagaataaagttgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcatagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaataaataaaataaaataaaaaataaagttggacccttacctcgcaccatatataaaaattaatttaaaatagatcaaagacttaaatgtaagagctaaaactataaaactcttagatgaaaacatagatgtaaattttcatgatgttgaaataggaagtggtctcttggatatgacaccaaaaacataagcaaaaaaagaagaaatagataaattgaatttcgtcaaaatttaaaactttgtgctgcaaaggacactatcaagagagtgcaaagataacccacagaatgggagtagatatttgcaaatcatgtgtctgataagagacatatttagaatattttaagaactcttacaactccatattaaaaagacaacccggtttgaaaatgggcaaagggttgaaatagatattatttcaaagaagatacacaaatatccaataagcacatgaaaagatattcaactttattactaatcagaaaaatgcaaatcaaaaccacagtgagatgctacttcacacccactaagatggttataattaatttaaaatgaaacaaaacaaaaaatagcaagtgttggtgaagatgtggagaaattggaaccttcatacattgctgatggggatgtaaaatggtgtggcccactgtggaaaacagtctagctcttcctcaaatggttaaacatagagttgccacatgacccagcaatt

SEQ ID NO: 50420 - DNA, 1031 bp, Homo sapiens
tgacaataacaagaagaatgacattaaagctgtttctttttccaggtgatttttatggactgttaacagatcacttatgcttactatactagtagacaccccatgcaactcctaacatcctgaataattgcagtgataaattgatgttatgtcaacctaaaaagcatgaagccaagcaaaggagttaatctcttattttttcatttgatccagtaaggtgaaaactgaggtttttcagtttccttatgatttgcctgcttctccaagattgtttacaatacttacttctttatataatttttcttaatttctttccctagaaatttccctatcaggaaatcctttaagttttctgggttctcatgttcctaataactgatcatagtgctcttctcttttataggaacaggtgacgtgtctgatgttggcctagggaagggacggtactacagtgtaaatgtgcccattcaggatggcatacaagatgaaaaatattaccagatctgtgaaaggtatggcagtaacactagccagtaataagtggattgcagttctgtaggatgaaatggcccccatctcacaatgtaaacaagaacaatgtaaaaaagaaaacatctatatacctataaagcttttgtatactggtcattatgcttatttgatcagtagctatccgctgtatggcagagccaagcagttggaccagagccatgctccaggttggatcttactcaatatgattaagcccatcccaagagcagagctttttttgctatcctgaagaatcccttatttgctactttcttagctaaataaacctacatgtgtcttatttcattaacctggcagggttcatttcagttgtcagggttcattatggagacctgtgctttcttctactggtgtaaatattagagaattgactattattattcatcatgcattcttaccttctatccactgtgttaaaattggagtcagatacctgttctttctacaccatggctaaggattaagttacagacaatcgt

SEQ ID NO: 50421 - DNA, 1244 bp, Homo sapiens
aatgtatgtttatcatcaccagtaagcagagatatagaaattgaagcaagatatattgtttcccctaccaagtttgaaaaagattctttatttcaaaatatccaggtggtagaaggattacagtgaaattaatacaaccccttttgaaaaccttggaagtgttaagaatgggaaaaaatgttcataccagttgggccagtaacaatattcttggcaatctattctaaggaaataaaccaattctacctgcaagaaatttatatcttaggagtaagacagcaaataattgcatttgaaagctaaaaaaggatgattttcaaagaatattctacaaaagaagagtaacgaaggactaatactattagatattaagcatccaaaactacagtaatgaaaacactggtacaaaaattagacagataggttatagtacaccccccaccccaacaaagagaccaattatatagaatttaatctattacaaaggatgcattgcaagtgaatgggagttgaaaggtctgttgagtaaatgaatggtattgtgacagcttgtaccattataccctcatctactgtaataaactaaaatgagtgacagctagattgaaaagttaaatatttaaaaaagcaaattttaaacactagagtgaatggatatttatcaagcttctaaaggggaagaattttctaagcttagaaagtaattttttaaaatcacaaaggaaaagatcaaacccgactgtacaaaattttaaaaccaaaataacttttaaaaggttttttggctattttcaaaatctaaacacagactgaaaaagcctatgtatcataaatatgacaaagtgtaataggcttgtattatctaacccactcctacaatataatgtataagaagaaatctgcacaaagaacacgaatagacaatttacaaaggagtttaaggacaactggaaaacattggaaaatgttcatcactactaatcaaagaaatgtaaattaaaaccattaggtaagcctcttttttttgagacagaatctcggctctgtcatccaggctggagtgcaatggtgtgatctcggctcactgcatcctctgcctcccgggttcaagcgattctcctgcctcagcctcttgagtagctgggattacaggcgcgtgccaccatgcccggctaatttttttatttttagtagagacggggtttcaccgtgttggtcaggctggtctcgaactcctgacctca

SEQ ID NO: 50422 - DNA, 1021 bp, Homo sapiens
taatttctgaaacacttttcaacacttttaaaatcagaatctatgtctattctgccctactgtatgagttcttcctcccgattgccctctttcttatattgctacctctagtcttttctttacccagagtttacatttaagagttttcagcaacccttttccatcttcctccctctcaccaatatccaagtaataaaaaagtcctgttgaacctaccctgtacattatttctcctttgttcccattgcccccaccctagtttaaaatcattatcacttcttatttggaccattgtggcactctaactgcccctagccttttaatgactaatctttcctacacactgctgctatagaaatcttttttccttactatttctgtctaaatatgttttcccatttcccacagaatgtagtctattctctttagcctggtattcaatgttcttcatgatctggcccttttagctaaactcgactagaaattttcccttttgtgttactgtttatgctgttcattctagtcagcatgccctctcctggctcccatcttcaccaagcaaaatcttgcccacctcctaagaccctctcaaatgccatcaaagatgaattctagttaccatttattaaatgccagttatttagtacttaatgcttatttattaagtaggctaagcatcctacattcattgactctgcattgcctttggtttcttgtgtacttgccccatcttctgtataagaatgcaaattctggctgggcgcggtggctcacacttgtaatcccagcactttgggaggccgaggcgggcggatcacgaggtcaggagatagagaccacggtgaaaccccgtctctactaaaaataaaaaaattagctgggcgtggtggcgggcgcctgtagtcccagctacttggacaggctgaggcaggagaatggcatgaacccgggaggcggagcttgcagcgagaggagatcgcgccacggcactccagcctgggcgacagagcaagactcctct

SEQ ID NO: 50423 - DNA, 1047 bp, Homo sapiens
tttgaattaagtcgccttagaaagaaatcatgatcaaatgcaggataaaagaatacaagctgaaattagtagtactagaaggagtcagaccaaagctctactacggtgatttgtgttaacatttgtctattaataggtatgactcaatagatgaatgattatatttaacttttagaaattgatcataatggggaaaattctaaacaattaataatttttaaataatttacatgatttggggacctagtgaaaaatgcctgcatacaaactcatattcacccttttgtccataaacctatttcttcctggataaacagtctagggcccaactaattggtgttggggaggaggttctgaattatgctaatcaggactttacttagtaagattggtaatttttcctttcccctatgttcttctacccttaaaaaccaaacagaaaacccttggcgcagatgataccatgttggcaaaggatcccgcatctggcatctgtactcttctgtatgacagtgcacccagtggcaggtttggcaccatgacctacctctccaaggcagccgccacctacgtgcaggagttcctgccccacagcatctgtgccatgcaatgagggctttggttcctggcttctgggagccttttgacagctggtccctgcctcggttgattgtgcatggaactaaaatgttattgcctaatcactccaaccctgcccctttctgtcccatccttcccaagaagagagaactttttcgataaactaactactgtagaagaagtgaacacttacctggaggctcaccttgcagaaccagtgacaatcttatgagtataatgaacactcagccaggcctgtcatgattggctttatttctttcatcattcataaaagtttgcatgtgtttttattctctagatctgttaccaatatagttttctaactcctgtttggggagcaagtgttaataataacttattcctaaagcttggtttttcttttttgtgattttattgtgtatatgagtggtgggtactttgggacat

SEQ ID NO: 50424 - DNA, 1052 bp, Homo sapiens
tacaaatacaactaatttttttattatagtaagacatttaacatgagatctatcctttaaaaaatttttaagtgtacaatatagtatcattaactataggcttgatgttgtacagtagatctctagaacgttttcatcttacataactgaaactttatacccattgaatagcaagttcccattttcccctctacccagcccctgacaactaccgttctactctctgcttctatgagtttggctgtttcagatacattacataactggaatcatacagaatttgttcttctgtgactggcttatttctcatagcatagtatcctgcaggttcatcgacactgtcatattttgcaaaatttccttcgtttttaaagtctgaataatattccattttatgtattaccagattttcttttgccattcagttgttaatatatatttaggttgttttcatatcttgactattgtgaataatgctgcatttgaacatgggcatgcaaatatctcttcaagattctgacttcaattcttttggataaatatccagaagtgggattgctgaatcatatggtagttctatttttaatttttgaggaacctccataatgtgttccatagcggctgcagcattttacattcccagcaacagtgtacaagggtcctaatgtcttcacattctcaccaatacctgttatctttgggtgtttttttaaccacggtcatcctaacaggtgtgaggtgatagctcattgtggtttgatccgcatttccatgatgattagtgatgttgagcatctttacatgtgtgtggtggctatttgtatatcatctttggtgaaatgtctactcaagtaaaatttaattgatttttgttattgatcttatatcatgaaacttcactgaactcatttattagttgtagttgcttgttagtgaattccttagaatttctatatacaagatcatgtcatctgcaaatagtttttacctcttcttttccaatctggatgccttttatttcttttcttacttaatctccctggttcaggccc

SEQ ID NO: 50425 - DNA, 1031 bp, Homo sapiens
tgaaaaattatgaactctcctacataagcacagtataattgccaaagtcaaggaattgtttaacattaaaccaatactattaactatctacagatactattaagatttgtcatatagcccaatagtgtctttatagaaaagaacatctaaaatcatgaattttattgagttctcaggtgtcttgagtctccatttatctggaacagttcctgagtcttcatttttcatgttgttaacatttgtgaggaatacaaaccagttattttgcagaatatccctcaatttcagtttatgtgttgttttgtcatgattaaattcagattatacattactaaggtaatgccaagttcttttccatgtgtcatatcatagtgttgattagtcccattgctgatactgtaaactttgatcgcttggttggatcatttggttaaggtagattcttccatgtacctacactgtaaagttattatgtcatcttttgtaattaaaaaagtatcctgtagagatgtactttgagactacgtaaatatacggttactcttcaaacttttgctcactgatatttttcatccattaatgactcttcctatagcacattttatttcatgttttttaatttaatatattgaatagatatattcctatggttcaaaaatttttaagtacaaaagaatatacagtgagagggtaaaatgtctttctcccatctctgttcccccagataccctgttccccttctcatgggcagtcagtgttgtgtgtgtgtgtgtgtgtgtgtgtgtgtgtatcctcccatggacatttatggatatgtaggtaaacacagacatatatggggataattttacccctatttatccaaaaggtagcatagtatacacacagctctaccttgctttctttcactaaaactatatatcttgatgataactacatatatattccaattatctattgcttcataacaaatcactctgaaactcagtagcttaaaataacaaaaatttaaaaatttttaaattatcttt

SEQ ID NO: 50426 - DNA, 1058 bp, Homo sapiens
ttttcccactagattatcctgattcttctctttctgttattcccttgccccactctgagggtttaccaagattccattcttgagcagtttgctcatttcatttagtgctatttcacaaagctcatctgtaacttgtacttcatatgtcacctctaggaaaatgattcccaaaccctcatctctagttgcccttctaaacatttctacttgtatgtcctattattacaaaaaacttaacaaatataaaaccaaactgaactttattgcaaaccaatcttatttcttcatacaccctcttgtgatatcattgctatcccaattccgctagttagaagtcgcatcatagagtacttgctaagggaagggagtatgtacatgctctgcttcctgaacaccttctctaaaacaatcagtaatgaaaacccgtattataatacctctgagctaaagatatacatctaacctctgagtgatgacagactttattgtgtttttactaggatcccaatcgtctgtactatgaaccagctgagctgaagctatttgaaaacattgagtgtgaatggccattgttctggacatactttattcttgatggggtcttcagtggcaatgcagaacaggtaataagctggggaaagagttttcagcagaatgtttttgttatatcttcttacagctaatagtataccaaccctgtgtccagttggaagtcttcctaataggggagagacagttgttccctacaggctactagttgagggcactaagagtaaaaagacctggattatttttttcttctttttaaaaaaattttggtttcggccgcgtgtggtggctcacgcctgtaatcccagcactttgggaggccgaggcgggcggatcacgaggtcaggagatcaagaccatcctggctaacagtgaaaccccgtctctactaaaaatacaaaaaattagctgggcgtggtggcaggcgcctgtagtcccagctactcgggaggctgaggcaggagaatggcgtgaacctgggaggcggagcctgcagtgagccaagatcg

SEQ ID NO: 50427 - DNA, 1028 bp, Homo sapiens
aatggtggttgacaggaatactgggattctctgtactgtttttgcaactcttctgtaaatctaaaattatctcaaaatgtaaaaaatatgtgtttttttaaaaagcttatggagtcttatgacttatgagctgtatgtgtcttatgaacaggaccacatagattagtaattatgctgtcagacttaccctaggtggatagccatggagaggatactgttaggaacactgctttagtgaagagcctgtcactttgccttcacttgaaatcacattgctgaaatctgtttctgctgctggattgattttttggttttaagcattattatattattataggttttttggttttaagcattatgcctttatcggtgataggttggtggtacatatagatgttgcaaggatgtatttctgattaattacatggccgtaccagtgtacaagctgctgaccttttttctttgtattcccagggtcgttatggttgctgtcgctttctacgagatggatataaaactcctaaagaggtaggtttcttttctccaaaatgaatccaaggtagaatggccacttctacctgcagcctcattcagagaaaatatttacctcactgatggtacttatagagatcactaagtaggataatgataactgatgtttgctatatttgttgaacttggcttagctgccaagttctcagtttgtaggcctttctggattaagtaaaatagaggaaggtgtagtccttccacctcttgcattggttagtttcgggaaagaactacagatacatggtaaaatcagtggatgaaagcttatacagaaatagtatttgcattgtctcaaagtatctctcccaaaatatttaacaattacaaagggaaaaatctttccatcagtagatctttctggccccacattccacctcttgtagttggttagttctaaacagtacttgattttgaaaagtttacgttccctttattcaactagtcaaaagttcaccttggaaatatcaatgagaaaa

SEQ ID NO: 50428 - DNA, 1033 bp, Homo sapiens
tactcaaattctgcagtcagctctgtggaacccatctataagaaaagtcagccttccatatacatgggtttctcacccctgaatcctgtatttttgatccgtgtttggttggaaaaaagccacatataagtggacctgcacagttcaaacttatgttgttcaggggtcccctgtatataaagaatgagtatagttatgtttgaataaaacttaattcataaaaatagcaatgggctagatttgtccctgatctagatgagtggttccaaactctgactgtactttgagaagctttttttttttttttttttttttgaagactaagtcttgctctattgcccaggttggagtgcggcggtgcgatctcggctcactgcgatctccatctcccaggttcaagcgattctcctgcctcagcctcacagtagctgggatcacaggcgtgcaccaccacacccggctaatttttttgtatttttagtagagatggggtttcaccatgttgaccaggttggtctggaactcctgatctcaaatgattcacccacctcagcctcccaaagtgctgggattacaggtgtgagccaccatacccggccaggaatcttttaagaaatacccttagtacaccacagcttagaacaatttaaatatgaatctctggaagtggagctcagtagcatcaatatttttaaaaaactacccgggtgattttaatgtatagccagtgtgaagaatgactagttatggcaaaatatgaacatagattaaatccaataaattcatagattaaattcccacctactgcaactttctattactgtgtggattttcccaaaacattgattgttaattatttctacccttccttccaattcttaccttggtttctttctgagaaataatgtcagagaattgaagagaattctggaagaaaagaggacaagggtttaggcaactactgcatcctagattgagagtagaattatgcacatgtatgtttttacaaatgtctttctctaaggtatataga

SEQ ID NO: 50429 - DNA, 1024 bp, Homo sapiens
agatttattctgagccaagtaaatatgagtgaccaatagctcatgacacagctccaagagacctgagaacatgtacccaaagtagtcaggctacagcttggttttatacattttagggaaacataagacatcaatcaatgcatgtaagatgtacattggttgggtctgaaaatgtgggacaactctaagtgggggcttccaggtcataggaagactcagaggttttctgattaaagtcttgaaatcaatagaagggagtatctgcattaacataaggggcttctgagactaaggctcttatgcagatgaagcctccaggtaggaggcttcagagagaatagattgtaaatgtttcttatcagacttaaaaaggtaccagactcttagttaattctctcctggataagcgaaaagatctggaaagggaagggcattctctacagaatgtaggtttccccacaagagacagctttgcagggccatttaaaaatatgttgaataaatatattttggggcctgctatctgttgtgttcatatcttattgctacaaagagtctactttgtcaatcttaaggtctctgttttaatgttaatgttggtcatttgtgtctaaattccaaagggaggaggatataatgaggcatgcctgaccacccacttccatcatggcctgaattagtctttcaggttaactttagaatgcccttggctgagaggaggggtccattcagttggttggggggcttagaatttcatttttggtttacagaccttatatattcttatttattttacttagttatatttgactattcttatttccttgaaagagtcaagaattgccaagatgaaacacctttggggtatctggacaggttttacctctgtcaacccttgcaagaaaattagaattgacttaccttggggatggagaataggtgacacttgtgaatgaagaaaatattgtagtgaaggccttgtgattgggaaaatcagagggcttggtgagggtacaaatgttgg

SEQ ID NO: 50430 - DNA, 1048 bp, Homo sapiens
aagactggtatcaagcaagaggtcccatatcctagaggttcaaaacagatgttcactggtagggagaaaagtgggcagatttacctgataggctgattaaacagatacaaatgccatttagatgcttctataactcttgcctatattctgattccttctcaccttagtgtttatagcttttgccccatcaactgttttctctgtacatttcctaataaaatctctgaaacaccccaatctcatttttatagagctaaactttatataagtagagctgtctagtgcctgtgtggtgtgatttcatacaagaaggccttctttcccaagcctatattttccctccttggtagctgatgtctgaaattctgttatctggagacgaatctttgattctacattaagtgataaagcagggacaagtttatttttgtacctaacaaaagtacctttctcatagtggaaaatgcctgtcaaattttttggaattatatttaaacttcaggaccctctaggaaagaaaacaagacttccatttcacacttaaggcaagatcagctaataccataatatgggtggatgccacagtttttttccaactcgtggaaaatttcattaattaatcatagcattgattcctgttaagcctagtaagggacaaaaatgctcgttgcccaccaaaatacattctcccattcttgcttgatgtgtggctgcccagctagggtacatttttcagcttcttttgcagttctgtgcagccaaatgattgttatgatcaataaaatgtgagtagaagtgatgtatgccatttccatgcctgggtcctaagacatagggtatgctctcctttccatactttctcccaccagctgcaactcagatgtaatggctacccagtttcagtatacagatgggagtgattccctatgagatgaaagtacaatgacttggaaggaaatcaagtccctgaatgactaagaaacagaattccctctctgatttgaactttttacattgatactgtcatgtaagaaataattaacactct

SEQ ID NO: 50431 - DNA, 12082 bp, Homo sapiens
gatttgcttaactgtttttgtggcgtgtattttttttttttcgcagtttcgctcttgttgcccaggctggagtgcaatggcgcaatctcagctcactgcaacctctgtctcctgggttcaagttattctcctgcctcagcctctcgagtagctgagattacaggcatgcgcgaccacgccaggctaattttgtatttttagtagagacggggtttctccatgttggtcaggctggtctcaaactcctgacctcaggtgattcacccgcctcgacctcccaaactgctgggattacaggcgtgagccaccacgcctggccagctgttgttataactggagttctatgtgcttgtgaccattcttggtttctccgaatatcctagaactttggtggcgccctattatacaggttgttgaagaaatgttaccatgtggattgagtaggaaacaattctctttatcttggcaatattatggcatggcactacttaaagtacaaattaaaagagggggatgctacagaactagctgacaggcactttgatagaggtggatttctcagttcttaaaatagctctttataaaggaagccagaggcattgtggaggagaattcttacataactcatagggttagaccacatccgaccttttctgtgtggcttcatggctctcttggttgagaaagcattagtttctccttccattagtttcaacctcttgatttcttgacccccctactatattttgtgctgagaacacaagggtattaacaacccacattgtagaggatcgctcagtaataaagactggagaataaaatgcagcatgggaatattggcaattactcagttctaaatttctcttggaaatgagggaaagcatacagaatagagctggaatgaataggataattttttttttttttgctaagttggtagccagaatataacagctccgcacaactgtaaatgtccactcttcaatccacatgaagaaaagggtaaaaatatggttgaactcaaccactagttgcccattagaacagactttcccagtgtactgcatttcaatactttttcttttatctcttttcagatcttcctcagaagaataggcttgttgttttacagtgttagtgatccattccctttgacgatccctaggtggagatggggcatgaggatcctccaggggaaaagctcactaccactgggcaacaaccctaggtcaggaggttctgtcaagatactttcctggtcccagataggaagataaagtctcaaaaacaaccaccacacgtcaaggtgcgtaagctgtccctaaaagcataataagtagtcttaattttgattttgttttccagtatacattgcacttagtgtttcactgaggtcgtattcatcattattctgcatatgatttggtaaaaacagcttcctaactaacctgggaagcaactgggtgtgagattaactggttaaagtgatgatgtaaagagggtagcgggttgcatgtgttcgggtgtttggagtgggactatagcacgtggcagaggcttacagctaagttgttcttttaggagaacatggacaactgtcacatcagtgacattgatcacatgggcaaatcattctgttccatgtggtccccaaagtctctcttaaagccttacagaagaactttgccaatcatttacatacttcaggatggcttgggatgccatggtgtataatacaacaagtgagaggtgtgtctttttatgctatggttgctgattgatggaagccgcataaatacaaatggaaacctgactaaaaatggcacaaagttatctgtcatcaggcaggagctaaagaaccaggaccctacattctctaggtcagtgttgggagaggctgattagcgagtgagaattggcagataaaggtgaccattcggtgcaataaatcctgaacgtataggctttgcccagcattcttcgtaaatagtgggtagctataaatttcatgaaatattttcatgggtaagaactcttgaaatgttataattgactagaaatctctgtagatttagaaatagagagttactaacaaattgttagaaagtctaggaactagaaagctaagttgagagttatctaggaagatctatctattgtactcataatctttagataaattctcctagggccagtagtctatgtgaattttctttttcttcttcttcttcttctttttttttgtattttagctgcaatgttaaacaacctatgtgaattttcttattgtgagaatatttgccttccagagtgactcacctttatctcaaagagcaatattgtgagttttgaaaatgctgctctaaggctgtgttttgttagtcctgagccaggagacttaaagcaaacttgaggggtcttaaaacatcgaagtgagccttaaacattgggaagaccttatgtttttccctctcatatctattatttttgtgatctcagttattaatcatttaaagggactctttcctagctgattggcacttaaaacaggatggaagtctttttttttttttttttttttgagatggagttttgctcttgttgcccaggctggagtgcaatggtgcaatctcagctcactgcaacctctgcctcccgggttcaagcgattctcctgcctcagcctcccaagtagctgggattacagtcatgcaccaccacgcccggctaattttgtatttttaatagagacggtgtttctccatgttggtcaggctggtctcaaactcctgacctcaggtgatccgcccacctcaacctcccaaagtgctgggattatgggcgtgagccaccgcgcccggcagttctggtctttaactaaggtataaggctatgactggtagtggtgtctctagtgactcatcaagtgatatttggcaagacattttcccatttatgccagtttcctattctgttgaatgaggaaattttctctctaaagacctaaaagttttgactttataggtttcaaagttctgtggaaacattttctattgcttattaatttgaatcttatgtaactctagcacagtactcaatatttatggcatttacatggtttatctcatgtttttttatagctcttcattgttcctatctgccaaatcattatacttcctacaagcagtgcagagagctgagtcttcagcaggtccaagaaatttgaacacactgaaggaagtcagccttcccacctgaagatcaacatgcctggcactctagcacttgaggatagctgaatgaagtaagttgttgatgttgcagtcctgtgaggatcacttcagaactgttataacagctgttttttgggagctggtgttggatggggtgtgttggtctaatgtgaagtggggctaaatgtgagatggaaagatgaccagtcttccatattactgactgggttcactgaagcaactcaaagacattatggtcttcttaccagttgtatcacagaagaatttagcctttgcttgtgtgttctatgtcttcactgtataggccctctgtcattcttagagccttaaacgttgagaagcttaaaacaccatttctgctttctgctgaaagggtaaccctttctcatctccgtttgtgagagactctgtcgtcagttaagattagtgtaaaaagaaaactaaactctgaagtagccattataaaagtgtgagaatgaagtcagttttctaaagagttggggaaaggtgatgctaaaggaggggattgagcaagtcctatcaaagagccttttatgaaaatacttagtcatctgtgacatcccatttggctcttccagaaatcctagtaaatagttgtaacaggatgttaagaggcatacattgtgtgttttaaatcctctgctactcattaggtatatgacctttgacaacttaaagtctctagacttctctgtttgtgagggttaaatgaaatcatgtatgtaaagtgctcacctattgcagtgcctggcacatgtcaagtaaaaggtaacccaagaagactcataagttcatttcccacaatataagtgaccactagcactatcaggtagcaggcagagttggcatgctttggttctatgtaagaaatccctaaggtaaaagtttataaatagaagagcatctgtgttggtattggtggttgttattattgtagtactataagtagtattcgtagtaacaatagtttattataattactaatgacactttttgattttttttatctttctgtgatgcttttcatgcctcttgtgcccctcactgtatcttgcctcttctactacttacttcctctgaatgtctgcctttgcttatctcttgcactcaagtgtgtatttctttgtctctttctttcttgtctttgctctttgttctctatctaaagtgtgtcttacccatttccatgtttctcttgctaatttctttcgtgtgtgcctttgcctcattttctctttttgttcacaagagtggtctgtgtcttgtcttagacatatctctcatttttcattttgttgctatttctctttgctctcctagatgtggctcttctttcacgctttatttcatgtctcctttttgggtcacatgctgtgtgctttttgtccttttcttgttctgtctacctctcctttctctgcctacctctcttttctctttgtgaactgtgattatttgttaccccttccccttctcgttcgttttaaatttcaccttttttctgagtctggcctcctttctgctgtttctactttttatctcacatttctcatttctgcatttcctttctgcctctcttgggctattctctctctcctcccctgcgtgcctcagcatctcttgctgtttgtgattttctatttcagtattaatctctgttggcttgtatttgttctctgcttcttccctttctactcacctttgagtatttcagcctcttcatgaatctatctccctctctttgatttcatgtaatctctccttaaatatttctttgcatatgtgggcaagtgtacgtgtgtgtgtgtcatgtgtggcagaggggcttcctaacccctgcctgataggtgcagaacgtcggctatcagagcaagcattgtggagcggttccttatgccaggctgccatgtgagatgatccaagaccaaaacaaggccctagactgcagtaaaacccagaactcaagtagggcagaaggtggaaggctcatatggatagaaggcccaaagtataagacagatggtttgagacttgagacccgaggactaagatggaaagcccatgttccaagatagatagaagcctcaggcctgaaaccaacaaaagcctcaagagccaagaaaacagagggtggcctgaattggaccgaaggcctgagttggatggaagtctcaaggcttgagttagaagtcttaagacctgggacaggacacatggaaggcctaagaactgagacttgtgacacaaggccaacgacctaagattagcccagggttgtagctggaagacctacaacccaaggatggaaggcccctgtcacaaagcctacctagatggatagaggacccaagcgaaaaaggtatctcaagactaacggccggaatctggaggcccatgacccagaacccaggaaggatagaagcttgaagacctggggaaatcccaagatgagaaccctaaaccctacctcttttctattgtttacacttcttactcttagatatttccagttctcctgtttatctttaagcctgattcttttgagatgtactttttgatgttgccggttacctttagattgacagtattatgcctgggccagtcttgagccagctttaaatcacagcttttacctatttgttaggctatagtgttttgtaaacttctgtttctattcacatcttctccacttgagagagacaccaaaatccagtcagtatctaatctggcttttgttaacttccctcaggagcagacattcatataggtgatactgtatttcagtcctttcttttgaccccagaagccctagactgagaagataaaatggtcaggttgttggggaaaaaaaagtgccaggctctctagagaaaaatgtgaagagatgctccaggccaatgagaagaattagacaagaaatacacagatgtgccagacttctgagaagcacctgccagcaacagcttccttctttgagcttaggtgagcaggattctggggtttgggatttctagtgatggttatggaaagggtgactgtgcctgggacaaagcgaggtcccaaggggacagcctgaactccctgctcatagtagtggccaaataatttggtggactgtgccaacgctactcctgggtttaatacccatctctaggcttaaagatgagagaacctgggactgttgagcatgtttaatactttccttgatttttttcttcctgtttatgtgggaagttgatttaaatgactgataatgtgtatgaaagcactgtaaaacataagagaaaaaccaattagtgtattggcaatcatgcagttaacatttgaaagtgcagtgtaaattgtgaagcattatgtaaatcaggggtccacagtttttctgtaaggggtcaaatcataaatactttagactgtgggccatatggtttctgttacatatttgttttttaaacaacgtttttataaggtcaaaatcattcttagtttttgagccaattggatttggcctgctgttcatagcttaccaccccctgatgtattatttgttattcagagaaaatttctgaatactactagtttccttttctgtgcctgtccctgtgctaggcactaaaaatgcaatgattattgatatctaggtgacctgaaaaaaaatagtgaatgtgctttgtaaactgtaaagcacttgtattctactgtgataagcgttgtggatacaaagaaaggagcaagcataaaaaagtgctctttcaaaaggatatagtactatgcagacacaaggaattgtttgataaatgaataaattatatgtatatttgaggccaatttgtgtttgctgctctggtaattttgagtaaaaatgcagtattccaggtatcagaaacgaaaacacatggaaactgcttttaaactttaaaatatactgaaaacataagggactaagcttgttgtggtcacctataatgtgccagataccatgctgggtgctagagctaccaaagggggaaaagtattctcatagaacaaaaaatttcagaaaggtgcatattaaagtgctttgtaaactaaagcatgatacaaatgtcaatgggctacatatttatgaatgaatgaatggatgaatgaatattaagtgcctcttacataccagctattttgggtactgtaaaatacaagattaattctcctatgtaataagaggaaagtttatcctctatactattcagatgtaaggaatgatatattgcttaattttaaacaatcaagactttactggtgaggttaagttaaattattactgatacatttttccaggtaaccaggaaagagctagtatgaggaaatgaagtaatagatgtgagatccagaccgaaagtcacttaattcagcttgcgaatgtgctttctaaattataaagcacttgtaaatgaaaaatttgatgctttctgtatgaataaaactttctgtaagctaggtattgtctctacaaaattctcattgtatagttaaaccacagtgagaagggttctataagtagttatacaaaccaagggtttaaatacctgttaaatagatcaattttgattgcctactatgtgaactcactgttaaaggcactgaaaatttatcatatttcatttagccacagccaaaaataaggcaatacctatgttagcattttgtgaactctaaggcaccatataaatgtaactgttgattttctcacttggtgctgggtactaggtttataaaattgtatgatagttattatattgtgcaaataaagtaggaaaatttgaataacaatgattatcttttgaatacgcatacgcaagggattggttgtctgaagaatgccactatagtagttatctattgtgtgccaatctcattgctaggcattggggatgcaaagataaaccatctttattgtgtcttgggtagcagaagaaaatatgtgtaaaatcaatttataatttgtaaactgccacccatatataagctatatctgctgaatgatcattgattactcttatccttagagataacaactgggggcacaaacatttattatcattattgaacctacaacagagatctatgtgtagatttacaaagcctacagttctatacagataggaatgaactattggcttactgaatggtgattactttctgtggggctcggaactacatgccctaggatataaaaatgatgttatcattatagagtgctcacagaaggaaatgaagtaatataggtgtgagatccagaccaaaagtcatttaacaagtttattcagtgatgaaaacatgggacaaatggactaatataaggcagtgtactaagctgagtagagagataaagtcctgtccagaagatacatgcttcctggcctgattgaggagatggaaaatttttgcaaaaaacaaggtgttgtggtcttccatccagtttcttaagtgctgatgataaaagtgaattagacccaccttgacctggcctacagaagtaaaggagtaaaaataaatgcctcaggcgtgctttttgattcatttgataaacaaagcatcttttatgtggaatataccattctgggtcctgaggataagagagatgagggcattagatcactgacagctgaagatagaagaacatctttggtttgattgtttaaataatatttcaatgcctattctctgcaaggtactatgtttcgtaaattaaataggtctggcccagaagacccactcaattgcctttgagattaaaaaaaaaaaaaaaaagaaagaaaaatgcaagtttctttcaaaataaagagacatttttcctagtttcaggaatcccccaaatcacttcctcattggcttagtttaaagccaggagactgataaaagggctcagggtttgttctttaattcattaactaaacattctgcttttattacagttaaatggttcaagatgtaacaactagttttaaaggtatttgctcattggtctggcttagagacaggaagacatatgagcaataaaaaaaagattcttttgcatttaccaatttagtaaaaatttattaaaactgaataaagtgctgttcttaagtgcttgaaagacgtaaaccaaagtgcactttatctcatttatcttatggtggaaacacaggaacaaattctctaagagactgtgtttctttagttgagaagaaacttcattgagtagctgtgatatgttcgatactaaggaaaaactaaacagatcacctttgacatgcgttgtagagtgggaataagagagggctttttattttttcgttcatacgagtattgatgaagatgatactaaatgctaaatgaaatatatctgctccaaaaggcatttattctgacttggagatgcaacaaaaacacaaaaatggaatgaagtgatactcttcatcaaacagaagtgactgttatctcaaccattttgttaaatcctaaacagaaaacaaaaaaaatcatgacgaaaagacacttgcttattaattggcttggaaagtagaatataggagaaaggttactgtttattttttttcatgtattcattcattctacaaatatattcgggtgccaataggtacttggtataaggtttttggccccagagacatgggaaaaaaatgcatgccttcccagagaatgcctaatactttccttttggcttgttttcttgttaggggcatggcttagtccctaaataacattgtgtggtttaattcctactccgtatctcttctaccactctggccactacgataagcaggtagctgggttttgtagtgagcttgctccttaagttacaggaactctccttataatagacacttcattttcctagtccatccctcatgaaaaatgactgaccactgctgggcagcaggagggatgatgaccaactaattcccaaaccccagtctcattggtaccagccttggggaaccacctacacttgagccacaattggttttgaagtgcatttacaaggtttgtctattttcagttctttactttttacatgctgacacatacatacactgcctaaatagatctctttcagaaacaatcctcagataacgcatagcaaaatggagatggagacatgatttctcatgcaacagcttctctaattataccttagaaatgttctcctttttatcatcaaatctgctcaagaagggctttttatagtagaataatatcagtggatgaaaacagcttaacattttaccatgcttaagttttaagaataaaataaaaattggaaataattggccaaaattgaaaggaaaaatttttttaaaatttctctaaatgtaggcctggctgggctttgaccttttccgtttttaaatcactcacagagggtgggacaggaggaagagtgaaggaaaaggtcaaacctgttttaagggcaacctgcctttgttctgaattggtcttaagaacattaccagctccaggtttaaattgttcagtttcatgcagttccaatagctgatcattgttgagatgaggacaaaatcctttgtcctcactagtttgctttacatttttgaaaagtattatttttgtccaagtgcttatcaactaaaccttgtgttaggtaagaatggaatttattaagtgaatcagtgtgacccttcttgtcataagattatcttaaagctgaagccaaaatatgcttcaaaagaagaggactttattgttcattgtagttcatacattcaaagcatctgaactgtagtttctatagcaagccaattacatccataagtggagaaggaaatagataaatgtcaaagtatgattggtggagggagcaaggttgaagataatctggggttgaaattttctagttttcattctgtacatttttagttagacatcagatttgaaatattaatgtttacctttcaatgtgtggtatcagctggactcagtaacacccctttcttcagctggggatggggaatggattattggaaaatggaaagaagaaagtaactaaaagccttcctttcacagtttctggcatcactaccactactgattaaacaagaataagagaacattttatcatcatctgctttattcacataaatgaagttgtgatgaataaatctgcttttatgcagacacaaggaattaagtggcttcgtcattgtccttctacctcaaagataatttattccaaaagctaagataaatggaagactcttgaacttgtgaactgatgtgaaatgcagaatctcttttgagtctttgctgtttggaagattgaaaaatattgttcagcatgggtgaccaccagaaagtaatcttaagccatctagatgtcacaattgaaacaaactggggagttggttgctattgtaaaataaaatatactgttttgaaaactttgtattttgatgtgacaatttctaactcactgtccctaaccacactaattaccgtaagttcttcatttcttttttctttttctttttaaattaataaattaatttattttttggagatggagtctcgctttgttgcccaggctggagtgcagtggtgccatcttggctcactgtaacctctgcctcctgggttcaagcgattctcctgcctcagcctcaccagtagctgggattacagtcatgagccaccatgcctggctaatggttgtatttttagtagagacggggttttgccatgttggccaggctggtcacgaactcctgacttaaagtgaaacacctgcctcggcctcccaaagttct

SEQ ID NO: 50432 - DNA, 20531 bp, Homo sapiens
agatggtactaacctcaatgtattactcctttctagcttctttggttcaaaagtttggtggaggagttacaaattctggtttgaatgatatatttggatactttatcaacacatcaaagctctacctatcccttcccccattctcaaaaccaagctgaattaacatctttacatttattatgcagtttatggaggattttagcattaattattgcttgatttactcaatgtccccatgttatagatgagaactggaaaacccattgaagttgtgactcctggtctagaaatgaagtctacttccagttaatgttctttctggtatgtctttgctttcttgaaatttcccttttttgtccttactgggtaaattttgaaccaaccaaatcacaaagatgtccggctttcaatcttctaggccacgcctcttatgctctctccgccctcagcccccccttcagttcttaaagcgctgcaattcgctgctgcagccatatttcttactctctcggggctggaagcttcctgactgaagatctctctgcacttggggttctttctagaacattttctagtcccccaacaccctttatggcgtatttctttaaaaaaatcacctaaattccataaaatatttttttaaattctatactttctcctagtgtcttcttgacacgtcctccatatttttttaaagaaagtatttggaatattttgaggcaatttttaatatttaaggaatttttctttggaatcatttttggttgacatctctgttttttgtggatcagttttttactcttccactctcttttctatattttgcccatcggggctgcggatacctggttttattattttttctttgcccaacggggccgtggatacctgccttttaattcttttttattcgcccatcggggccgcggatacctgctttttatttttttttccttagcccatcggggtatcggatacctgctgattcccttcccctctgaacccccaacactctggcccatcggggtgacggatatctgctttttaaaaattttctttttttggcccatcggggcttcggatacctgctttttttttttttatttttccttgcccatcggggcctcggatacctgctttaatttttgtttttctggcccatcggggccgcggatacctgctttgatttttttttttcatcgcccatcggtgctttttatggatgaaaaaatgttggttttgtgggttgttgcactctctggaatatctacacttttttttgctgctgatcatttggtggtgtgtgagtgtacctaccgctttggcagagaatgactctgcagttaagctaagggcgtgttcagattgtggaggaaaagtggccgccattttagacttgccgcataactcggcttagggctagtcgtttgtgctaagttaaactagggaggcaagatggatgatagcaggtcaggcagaggaagtcatgtgcattgcatgagctaaacctatctgaatgaattgatttggggcttgttaggagctttgcgtgattgttgtatcgggaggcagtaagaatcatcttttatcagtacaagggactagttaaaaatggaaggttaggaaagactaaggtgcagggcttaaaatggcgattttgacattgcggcattgctcagcatggcgggctgtgctttgttaggttgtccaaaatggcggatccagttctgtcgcagtgttcaagtggcgggaaggccacatcatgatgggcgaggctttgttaagtggttagcatggtggtggacatgtgcggtcacacaggaaaagatggcggctgaaggtcttgccgcagtgtaaaacatggcgggcctctttgtctttgctgtgtgcttttcgtgttgggttttgccgcagggacaatatggcaggcgttgtcatatgtatatcatggcttttgtcacgtggacatcatggcgggcttgccgcattgttaaagatggcgggttttgccgcctagtgccacgcagagcgggagaaaaggtgggatggacagtgctggattgctgcataacccaaccaattagaaatgggggtggaattgatcacagccaattagagcagaagatggaattagactgatgacacactgtccagctactcagcgaagacctgggtgaattagcatggcacttcgcagctgtctttagccagtcaggagaaagaagtggaggggccacgtgtatgtctcccagtgggcggtacaccaggtgttttcaaggtcttttcaaggacatttagcctttccacctctgtcccctcttatttgtcccctcctgtccagtgctgcctcttgcagtgctggatatctggctgtgtggtctgaacctccctccattcctctgtattggtgcctcacctaaggctaagtatacctccccccccaccccccaacccccccaactccccacccccaccccccaccccccacctccccacccccctacccccctacccccctacccccctctggtctgccctgcactgcactgttgccatgggcagtgctccaggcctgcttggtgtggacatggtggtgagccgtggcaaggaccagaatggatcacagatgatcgttggccaacaggtggcagaagaggaattcctgccttcctcaagaggaacacctaccccttggctaatgctggggtcggattttgatttatatttatcttttggatgtcagtcatacagtctgattttgtggtttgctagtgtttgaatttaagtcttaagtgactattatagaaatgtattaagaggctttatttgtagaattcactttaattacatttaatgagtttttgttttgagttccttaaaattccttaaagtttttagcttctcattacaaattccttaacctttttttggcagtagatagtcaaagtcaaatcatttctaatgttttaaaaatgtgctggtcattttctttgaaattgacttaactattttcctttgaagagtctgtagcacagaaacagtaaaaaatttaacttcatgacctaatgtaaaaaagagtgtttgaaggtttacacaggtccaggccttgctttgttcccatccttgatgctgcactaattgactaatcacctacttatcagacaggaaacttgaattgctgtggtctggtgtcctctattcagacttattatattggagtatttcaatttttcgttgtatcctgcctgcctagcatccagttcctccccagccctgctcccagcaaacccctagtctagccccagccctactcccaccccgccccagccctgccccagccccagtcccctaaccccccagccctagccccagtcccagtcctagttcctcagtcccgcccagcttctctcgaaagtcactctaattttcattgattcagtgctcaaaataagttgtccattgcttatcctattatactgggatattccgtttacccttggcattgctgatcttcagtactgactccttgaccattttcagttaatgcatacaatcccatttgtctgtgatctcaggacaaagaatttccttactcggtacgttgaagttagggaatgtcaattgagagctttctatcagagcattattgcccacaatttgagttacttatcattttctcgatcccctgcccttaaaggagaaaccatttctctgtcattgcttctgtagtcacagtcccaattttgagtagtgatcttttcttgtgtactgtgttggccacctaaaactctttgcattgagtaaaattctaattgccaataatcctacccattggattagacagcactctgaaccccatttgcattcagcagggggtcgcagacaacccgtcttttgttggacagttaaaatgctcagtcccaattgtcatagctttgcctattaaacaaaggcaccctactgcgctttttgctgtgcttctggagaatcctgctgttcttggacaattaaagaacaaagtagtaattgctaattgtctcacccattaatcatgaagactaccagtcgcccttgcatttgccttgaggcagcgctgactacctgagatttaagagtttcttaaattattgagtaaaatcccaattatccatagttctgttagttacactatggcctttgcaaacatctttgcataacagcagtgggactgactcattcttagagccccttcccttggaatattaatggatacaatagtaattattcatggttctgcgtaacagagaagacccacttatgtgtatgcctttatcattgctcctagatagtgtgaactacctaccaccttgcattaatatgtaaaacactaattgcccatagtcccactcattagtctaggatgtcctctttgccattgctgctgagttctgactacccaagtttccttctcttaaacagttgatatgcataattgcatatattcatggttctgtgcaataaaaatggattctcaccccatcccaccttctgtgggatgttgctaacgagtgcagattattcaataacagctcttgaacagttaatttgcacagttgcaattgtccagagtcctgtccattagaaagggactctgtatcctatttgcacgctacaatgtgggctgatcacccaaggactcttcttgtgcattgatgttcataattgtatttgtccacgatcttgtgcactaacccttccactccctttgtattccagcaggggacccttactactcaagacctctgtactaggacagtttatgtgcacaatcctaattgattagaactgagtcttttatatcaaggtccctgcatcatctttgctttacatcaagagggtgctggttacctaatgcccctcctccagaaattattgatgtgcaaaatgcaatttccctatctgctgttagtctggggtctcatcccctcatattccttttgtcttacagcagggggtacttgggactgttaatgcgcataattgcaattatggtcttttccattaaattaagatcccaactgctcacaccctcttagcattacagtagagggtgctaatcacaaggacatttcttttgtactgttaatgtgctacttgcatttgtccctcttcctgtgcactaaagaccccactcacttccctagtgttcagcagtggatgacctctagtcaagacctttgcactaggatagttaatgtgaaccatggcaactgatcacaacaatgtctttcagatcagatccattttatcctccttgttttacagcaagggatattaattacctatgttacctttccctgggactatgaatgtgcaaaattccaatgttcatggtctctccctttaaacctatattctaccccttttacattatagaaagggatgctggaaacccagagtccttctcttgggactcttaatgtgtatttctaattatccatgactcttaatgtgcatattttcaattgcctaattgatttcaattgtctaagacatttcaaatgtctaattgattagaactgagtcttttatatcaagctaatatctagcttttatatcaagctaatatcttgacttctcagcatcatagaagggggtactgatttcctaaagtctttcttgaatttctattatgcaaaattgccctgaggccgggtgtggtggctcacacctgtaatcccagcactttgggaggctgaggtgggaagatcccttactgccaggagtttgagaccagcctggccaacattaaaaaaaaaaaaaagtaagacaattgccctggaatcccatccccctcacacctccttggcaaagcagcaggagtgctaactagctagtgcttcttctcttatactgcttaaatgcgcataattagcagtagttgatgtgcccctatgttagagtagaatcccgcttccttgctccatttgcattactgcaggagcttctaactagcctgaattcactctcttggactgttaatgtgcatacttatatttgctgctgtacttttttaccatgtaaggaccccacccactgtatttacatcccagctggaagtacctactacttaagacccttagactagtaaagttagcgtgcataatcttaggtgttatatacacattttcagttgcatacagttgtgccttttatcaggactcctgtacttatcaaagcagagagtgctaatcaatattaagcccttctcttcgaactgtagatggcatgtaattgcagttgtcaatggtccttcaattagacttgggtttctgacctatcacaccctctttgctttattgcatggggtactattcacttaaggcccctttctcaaactgttaatgtgcctaatgacaattacatcagtatccttccttttgaaggacagcatggttggtgacacctaaggccccatttcttggcctcccaatatgtgtgattgtatttgtcgaggttgctatgcactagagaaggaaagtgctcccctcatccccacttttcccttccagcaggaagtgcccaccccataagacccttttatttggagagtctaggtgcacaattgtaagtgaccacaagcatgcatcttggacatttatgtgcgtaatcgcacactgctcattccatgtgaataaggtcctactctccgaccccttttgcaatacagaagggttgctgataacgcagtccccttttcttggcatgttgtgtgtgattataatcgtctgggatcctatgcactagaaaaggagggtcctctccacatacctcagtctcacctttcccttccagcagggagtgcccactccataagactctcacatttggacagtcaaggtgcgtaattgttaagtgaacacaaccatgcaccttagacatggatttgcataactacacacagctcaacctatctgaataaaatcctactctcagaccccttttgcagtacagcaggggtgctgatcaccaaggccctttttcctggcctggtatgcgtgtgattatgtttgtcccggttcctgtgtattagacatggaagcctcccctgccacactccacccccaatcttcctttcccttccggcagggagtgccctctccataagacgcttacgtttggacaatcaaggtgcacagttgtaagtgaccacaggcatacaccttggacattaatgtgcataaccactttgcccattccatctgaataaggtcctactctcagaccccttttgcagtacagcaggggtgctgatcaccaaggccccttttcttggcctgttatgtgcgtgattatatttgtctgggttcctgtgtattagacaaggaagccttccccccgcccccacccccactcccagtcttcctttcccttccagcagggagtgccccctccataagatcattacatttggacaatcaaggtgcacaattataagtgaccacagccatgcaccttggacattattggacattaatgtgcgtaactgcacatggcccatcccatctgaataaggtcctactctcagatgccctttgcagtacagcaggggtactgaatcaccaaggccctttttcttggcctgttatgtgtgtgattatatttatcccagtttctgtgtaatagacatgaaagcctcccctgccacaccccacctccaatcttcctttcccttccaccagggagtgtccactccatatacccttacatttggacaatcaaggtgcacaattgtaagtgagcataggcactcaccttggacatgaatgtgcataactgcacatggcccatcccatctgaataaggtcctactctcagaccctttttgcagtacagcaggggtgctgatcaccaaggccccttttcctggcctgttatgtgtgtgattatatttgttccagttcctgtgtaatagacatggaagcctcccctgccacactccacccccaatcttcctttcccttctggcaggaagtacccgctccataagacccttacatttggacagtcaaggtgcacaattgtatgtgaccacaaccatgcaccttggacataaatgtgtgtaactgcacatggcccatcccatctgaataaggtcctactctcagaccccttttgcagtacagtaggtgtgctgataaccaaggcccctcttcctggcctgttaacgtatgtgattatatttgtctgggttccagtgtataagacatggaagcctcccctgccccaccccaccctcaatcttcctttcccttctggcagggagtgccagctccataagaaccttacatttggacagtcaaggtgcacaattctaagtgaccgcagccatgcaccttggtcaataatgtgtgtaactgcacacggcctatctcatctgaataaggccttactctcagaccccttttgcagtacagcaggggtgctgataaccaaggcccattttcctggcctgttatgtgtgtgattatatttgtccaggtttctgtgtactagacaaggaagcctcctctgccccatcccatctacgcataatctttcttttcctcccagcagggagtgctcactccataagacccttacatttggacaatcaaggtgcacaattgtaagtgaccacaaccatgcatcttggaaatttatgtgcataactgcacatggcttatcctatttgaataaagtcctactctcagaccccctttgcagtatagctggggtgctgatcactgaggcctctttgcttggcttgtctatattcttgtgtactagataagggcaccttctcatggactccctttgcttttcaacaaggagtacccactactttttaagattcttatatttgtccaaagtacatggttttaattgaccacaacaatgtcccttggacattaatgtatgtaatcaccacatggttcatcctaattaaacaaagttctaccttctcaccctccatttgcagtataccagggttgctgaccccctaagtccccttttcttggcttgttgacatgcataattgcatttatgttggttcttgtgccctagacaaggatgccccacctcttttcaatagtgggtgcccactccttatgatctttacatttgaacagttaatgtgaataattgcagttgtccacaaccctatcacttctaggaccattatacctcttttgcattactgtggggtatactgtttccctccaaggccccttctggtggactatcaacatataattgaaattttcttttgtctttgtcagtagattaaggtcataccccatcacctttcctttgtagtacaacagggtgtcctgatcaaccaaagtcctgttgttttggactgttaatatgtgcaattacatttgctcctgatctgtgcactagataaggatcctacctactttcttagtgtttttagcaggtagtgcccactactcaagactgtcacttggaatgttcatgtgcacaaactcaattctctaagcatgttcctgtaccacctttgctttagagcagggggatgatattcactaagtgccccttcttttggacttaatatgcattaatgcaattgtccacctcttcttttagactaagagttgatctccacatattccccttgcatcaggggcatgttaattatgaatgaacccttttcttttaatattaatgtcataattgtatttgtggacctgtgtaggagaaaaagaccctatgttcctcccattaccctttggattgctgctgagaagtgttaactactcataatctcagctcttggacaattaatagcattaataacaattatcaagggcactgatcattagataagactcctgcttcctcgttgcttacatcgggggtactgacccactaaggccccttgtactgttaatgtgaatatttgcaattatatatgtctccttctggtagagtgggatattatgccctagtatcccctttgcattactgcaggggctgctgactactcaaaacttctcctgggactgttaataggcacaatggcagttatcaatggttttctccctccctgaccttgttaagcaagcgccccaccccacccttagtttcccatggcataataaagtataagcattggagtattccatgcacttgtctatcaaacagtggtccatactcccaacccttttgcattgcgccagtgtgtaaaatcacaggtagccatggtgtcatgctttatatacgaagtcttccctctctctgccccttgtgtgcccttggcccctttttacagactattgctcacaatctcaggtgtccatatttgcagctattaggtaagattgtgctgtctccctcttcccttccctctgccctgccccttttgcctctttgctgggtaatgttgaccagacaaggccctttctcttggacttaaacaattctcagttgcactttccttggtcccacccattatacatgaacccctctacttcctttcgcattgcttctgagtatgctgactacccaaagccccttctgtgttattaataaacacagtactgattgtcccatttttcagcccatcagtccaagatctccctaccactttggtgtgttggtgcagtgttgactatgaaaagcaggcctgaactaggtggataagccttcactcattttctttcatttattaatgatcctagtttcaattattgtcagattctggggacaagaaccattcttgcccacctgtgttactgctttactgtgcaaaatactgaaggcaagtcagacccagggagctggattgccatcctttattttgtgtttccagtgtacactataaaattgtctccccaggaaggaaggttggcactttctctgcattcttctttccagagcagattgcctggttaagaatctcttgttgtcccctttgtatattgttattgtaaagtgccaaatgccaggatacagccagaaaaattgcttattattattaaaaaaatttttttaagaaagacatctggattgtagggtggactcgataacctggtcattatttttttgaagccaaaatatccatttatactatgtacctggtgaccagtgtctctcattttaactgagggtggtgggtctgtggatagaacactgactcttgctattttaatatcaaagatattctagagtggaactcttaagaccagtatctttgtgtgggctttaccagcattcacttttagaaaaactacctaaattttataatcctttaatttcttcatctggagcacctgcccctacttatttcaagaagattgcagtaaaacgattaaatgagggaacatatgcagaggtgcttttaaaaagcatatgccaccttttttattaattattatataaaatgaagcatttaattatagtaataatttgaagtagtttgaagtaccacactgaggtgaggacttaaaaatgataagacgagttccctattttataagaaaaataagccaaaattaaatattcttttggatataaatttcaacagtgagatagctgcctagtggaaatgaataatatcccagccactagtgtacagggtgttttgtggcacaggattatgtaatatggaactgctcaagcaaataactagtcatcacaacagcagttctttgtaataactgaaaaagaatattgtttctcggagaaggatgtcaaaagatcggcccagctcagggagcagtttgccctactagctcctcggacagctgtaaagaagagtctctggctctttagaatactgtaagtactacttcgtagctattaagtaatctttttcctattctattttctttctcttagatgccacctatagaaaagtcagagggtccagtaagtttctttccttcttcccacctcatctgcaatatatatatatagagagagaaatagatacatacatacatgcataaatacacatatgtgagttaaccagcagaactgtagaattaatattgtggacccagctctatgctaggttacactgataacctgggtaggaatgatatcatcctatataatttcattcctgagatgattttatcgttgaggagctaatgtgagcacatttgaaataactttagaaaataataagtgctgttttgtgtgaatcataagtagtagttttaggaagggaacccacaaggatttgaagttgatagaataaacttaaggaagtgggtttgctttttctctttaagccaagataggattaatattgcagccatctggatagtccagttggtttattttaatttcatttgttttttacctcttttggagccatggaaagagatgaaagggatagagcatagccattgtgtttggctatttgcgaaggttggcaaattagtgattgctaaatctcataagcttgagtattttaaagttcagagattgagggcataaatctaatacttcggctccttccacaattttactacatttctgcccaagaacagatgaccatggataatgcatatcgtagatactttttaagtttggaacctttttgccaagagggtagtggagaagtgaagtcaaaaccttgaccttccttgcctactttatgctgtagtttatataccttctttcctcccacctttcgtaaagctaaaagaagcttagcctccttaatgttttccagctgacaaaatattgtttaacataacattcgaaactttttttctggtgcacattcatgcatcacagcaggagcaacaagaaccatataagtgaactggcttcacttatagcccgttttaattcatatccatatttcctcagggcttgtttccatgcctcccagccccactccatatgcttaacaacattgtctggctgactgagggttatatacatcatggtcttgaaccttcttggaaacatggtctgtgccattgtttctcaaacccaagtaatgcttcatgatgaaacaccttctaaaggaacaaaattttctgagatcctaaaaaaatgtgttttgaggaacactgacttaacaaagatatttgaaatgtaaatatgttttccaatttcacgttgtctttgtcaaagatgtgttttatataacttatgtagaacttggggatccattagaatatattcacaaatccccagggttatcaccccaatttgagaaaccctggtctatgcttatgaaatcttctattggtaattaaattgtcattcattgtcaacatacaattataattattattggaatttgttttaaatgaatgaatttggaggtgattctgtaccttaagtcaagaggaaggatggcttgattttaggtggattgattatactagatagcatccaaaggtgaatcttgaagctgtatttaaattcattgcttgaaataatttccacccttaagaaaaatctctagcaattgtaaaaagggatgctctggaaatgtgggcatcttcaaaatagagataattcttgtgttagttcaacaaatattattgtaccaggtgctggaataaatagcaaaaccaaagacaggatttatatcaaggaatttgctttcttatggaggatgcagaaggaaatcattatggttttgggcagaaatgcttagactttagtcctggctctgagtttggttcagatcaccatcaatctgaccatctcgagactgctagtgaaataagataggggcttatatcaaatacctaaatccctgaaaatgacattttgtgatttggaaaattttcaaaagtctaatgaaggaaacttttttggcatttctttaaatgattattgtcatttcttttctgacttttccctttataaaaccttaacatgtaggattggaggaagttttctgaccattttctcatatcctctttcagctttatctttctgtaacttccatttctctagccacctccctaaattacagaagactgtgagacccagggctgctgtgattaggcattcataatttcttttcagggtgtttgtgccctgattatcaaatgtacagcttgaagggagttcatgtcttaaagtaatgaattaagagttgacctttgttgactgctaaaatattcttatatgtgaaagcatcctggaaaaatacgttaccagcttaaagagaaagaaactaatgattatatctgaactgagctaatgcctcttctcttcccccaaaccttatcagtttggatggcaaagagtaatgatgtgtcagttaaacagagctaatgccttcctctgccttgtcttaaagactggattgggagaaaattgatattctcactaccatattttgggctgtaggcaagtagcattttacacaggtttccttcaaaaatccaactcaagttggagctcatgtatttaagacatagctggcctgctgaatttaacaagttaaacttcagtggccatgtacagttatatatcactatatatatgtgtattaggctgtcgagttggtcatgtttttgttggtgacttaggctttacttgatagctcttccttgacctttccaaattgagtactgatacatggagcttgggcttcttctgcatcttatacaaatgagtttggtaaagaagcctctcctttactgttttgatgtttatattagaaataacttttgattattttttttcatgttaggatgagaaactgaaacaaaatgtaaatttgaccggtgctagacttcttaaattatgggtagacttaaagtattattttccttaaccaattagaatgctagtcttctagtgttcccggaaacatgagaggttatgcagtagacccaagcaataccctcttattacataatcaagtgcgtataagaatttaaaaatagggatatgactggaacatcactgtactttaccaggtcccattataaaattatctatgttactttacccatagctttgaaaactagtggcatagtatattttatagtatgctgttagtgtgattggcattgaacagtgatgggatataatcactctacaatctatatgttattaaagttttccagccttatagatctcccttgactgaaaattagctactaacttacgacttattttttacagcagattgactaggtctttccaggaaatctgttgatgtacaaaaacaaagtttaattgctaatgtttttttaaaaaataactttttgatattacggatacctggttatttgggccttgtatattttaacatcaaaattacctattataaatccatataaacagaaaagaaagagagtaagtctttagatcagatctgcaaacaatgatggtacgtactgtagaaaaatctggaacatagacttaccagttcttaggttccattttgcttgctttttaaaaactgtgtcttataagtcttcagcaactggttgggagatttttagaaaaaataaccttttaatgttagaacagtgtagagatttacagaatgattctgaagatagagtttctgtgtacttcacacccagtttttcccagtgttaacattttacattagtttggtacatttgtcacaacaaaccaatattgatacattattattaactagagtccatattttattcagatttccttagtttttccttaatgttctttttgtgttccaggatcccattgaagataccacgctgcatgtgtccttagtagtcatgtctccttaggctcctcttggtaatgacagtttctcagactctttgtttttgatgaacttcacagttttgaggactaatggtccagtattctatagaatgtctctctattggaatttgtctgatgttcttctcatgactagattgggtttatgagtgtttaggaggaagaccacaaaggtagagtgccattcttatcacttatcaagagtacatactatcaacatgacttatcactgtttatgttatccttaatcacctgtctgaggtactatttgtcaggtttctccagcgtaaaattagtctttatttctccatttccctactatactgttcacataggaagtcactatgtgcagccagcacttaaggaatgggaaattaccttccacctcattgagggcagagtatttacataaattatttggaattcttttgcacaggatgtcttttctccacaatgtattgtgtttattcagtcatttatatcagtatgatctcagggatattttatactctgggttataatacagtattactttattctgttgttcaaattgttccagctttggccattgggaggtctttcatttggctttgatataaccccatgaatgtgggttttttgtttgagcactttcttatttttggaactacaacatgcttcagactcatttgcatatctcctgcctggacctaaaatgatgtatttctgcaaggagccttgatactttttattggagagtaatattagaaatcaagaagtgaatgctaggtgcgctcattactactggagtgtcattccttcaagaccttttcagttgacaagagcaaggagatatatatttgcattctaacgtgtgtatatgcacatagctataaatatatataaccatctgtatctatattaaactaaatgtgtttatacctacgtctccaactctaatcattgccacatggatcattatagtctcacctccttgcttatctgttacctcccatttctacagtgagaaacctggcttggttgggaaatttttctgttaatattacggtagtgagtgtttgacatttgcttctatggttaagtttagggagagtttagctgtagggtattcttgaaactagaaatgacccttctgccctaaatgtttctgccagttttgaaacgtaaaataggttgcagaaacaaactttatcttaagaaccagaatttacttcaatccacattttgacattgattttcagattaaattattctgatatcgccaggtaagctgttccttgggtatgcatttcttctttccgtttttttctaagagctaaaggaccctgagaacactggaggtgggaaaggaagggaaaggcatgttcacacgtgggataggaaaggttcatttactgacctccagctagccttccaaagtgcctatttaagacccaaggagtagatgtcttccttggcaattgtaacccaaatataatttttaacctttcaattttagtcaagaaagttggtgtgctgttacaaaaagtgccctgattaacagcattgtcatgtgcattgcatattaatcagcaatttaaaataacatgaaattatgttgagtataattttaatattttatattagatattagtttgagacagtgtttctcaagtctgtataataagtttgatagtagggaggttttctctcaagaaaagaattattcagtgtgcacctacataatcactgcttagattctacaattaatattttgctatatttgattaaacgttttctgtaaaagaaaaatattattatgtactatttaggtttatgggaataattgttaagttaaagtgtatgaacaaacctggaatgaaatctgtttgcctacatctataatacaactataaaacatagcagatgtacaaattagtagttaatagataactaaaatgcaaatatggcactactattatagtattatagtttcttttgagtggcgtgtctgtaatatcacatgctgtgttgatgcacttcaccaaactgctgttttcaaactgctttaaatcctgccattatagcacatagcaatgctatttcactttcatttggcacaaaacacatttatatattgtttgcttctcttcttttctgtaatccccaggcaacaaaactagaacatttgccactaatctggcaacgtggtcctatattatgaagtagtcatatagctgatctaaactatccttacagtgaaatgagagtattgtgaaagttttgtagaaagctccccatatgtcctgagaatctatgcacagaccccacagttaaaagacctttgaattgtgggaagacatgggtttaagtatcacttggttaccttctatttgtgtaacattgaggtagtttcatcttctgggttcccagtttccttagagaatgaaaatgttgaattatgtgatttttttttttttttgagacggagttttgctctttcgcccaggctggagtgaagtagcacgatctcgactcactgcaacctccttcccccatgatcaagcaattctcctgcctcagcctcccaagtagctgggattacaggcacccgccccccaccccccgcccccagctaatgtttgtatttttagtacagatggagttttgccgtgttggccaggctggtctcgaacttctgacctcaggtgatccactcgccttggcctcccaaagtgctaggattacaggcatgagccactgcgcctggcctatgtgattattaatatcacgtctagctgtgacaattctgtctgatgctggagtatttgaaccagatggctggctgtgccactcagttattctctccataagactttgatattttgttggtctgcaagatgacggattctcaaaattcttgtcagtgaatattgaaccctagtgaaatgtatggttctgtatcagttccaaaatgtaaccactttctctagccttagattcccagttccaaaatgtaaccattttctctagccttagattcccgttaagggaaagggaatgctctttgagtatgtcatcaccatagtaacaggcaaaactagagggctttgatgctaaagcaagatactccataaatatgcttaagaagacttggggagactggaatagttgttcccttttagatgccagtgtataaatgaatttgagctaggatccgtttatttaaaatttctttaggtgtatttgcttgcatatggagtgcacatttactctcattaatggagttttaggaagcagtagagtaaatgcataaacatgtatgaaccgccatgtttaactggaagcctgcatttggaagtcaagtatctaatcttagattaaattaggatggggaaggatgttggcaagagattttgaagcttgttctgcttatattgagaacatcatagaacagtttggcctttttaaagctagagaatagtgttgaataagtgatgttccatatattcctgtttgacattgacataaaggtttcctcatgatacagtaatccctgatcagggatctggaagcctgtattcatttaaggtactcaggtttaacatactgggtgcttttcacaccatactatacagtaccatgcaaagtgctttcaagactgcaaatttggcttagatcccctttagtgagctcctatgctatagtaaaggtagatagccaattattaaaaacagtcaagacaattgcacctctaagcagtagtagcagttgccacaccaccttgaatcttgaagtattttcagcaacaggatgaccattagccacaaatttagtgtcagcccttaaggtcggtattggtttgacccatattttcatgtagttctttttcttcacttgtctaatcttcccgtgtactgccagggcttgtcattagaggactttagggagaccaagcaggctagaaagtagagacaggagatacctatgtctaatgcttcagtttatacttcctaggtttttttcattggggtttttgtaactcttttggtatcctaccggtgctttggtagcctactgaaccctgtctttcttcttaaggacattctgagcatgtgagacctgaggactgcaaacagctataagaggctccaaattaatcatatctttccctttgagaatctggccaagctccagctaatctacttggatgggttgccagctatctggagaaaaaggtagtttggggaatttattgttgtagtgcttctgtctttggattgaacttcccacaactctcctttttaaagcagaacacagctgggcatggtggctcctgcttgtaattccagggctttgggaggttgaggtggggggatcacttgaggccaggagttgaagacccatgtctctacaataaaataaaattagttgggcatggtggtacgtgcctgtagtcctacctactctggaggctgaggcagcaggattgcttgagcccaggagttcaaggctgcagtgagccatcattagccactgcactccagcctaggtggcagagcgggacccagtctcttaaaaagaaagaaaagcagaacgtgagccagttttcatcaattcctatactttttcttttgcatgtacacatacattttaactttacataatgagttcggcctgtttcatttatccctcagagctgggctccagtgaggtctgtaagggcaagcatacttgatccccaatgaagaatgagagatgcaaagcactaaattatttcttttctcaccacacagcaa

SEQ ID NO: 50433 - DNA, 1041 bp, Homo sapiens
tatactctctcttccttctgatttttaataacattttcttctctagctaattgcaagaatatagtagataataaattaccatagaaagtatgtgttaattgactatgttattggtaaggcttccagtcaacagtaggctattagttaagttttggtggaattaaaaattttatgcagatttgactgtatgaggggttggtgaccctaacccccccattcctcaagggtctactatatatgatcccacttgtatacaatattcagaacaggcaaatccataaacagaaagcaaattagtagccatgggatagagggcaaagggaatgagtacagggtttcttttagaagtgattaaaatctgttggaactagacagcagtgatggatgcacaacactgtgaatgtatgaaatgccactaaattgtatactttaaaatggctaaaacactaatgtgtattgtgccacaattaagtaaaaaaatactataaagtgaaaagaaaagtagctaactgaaaaaaatatctgcaggccgggtgcagtggctcatgcctgtaatcccaccactttcggaggccaaggcgggcggatcaaaaggtcaagagatcgagaccatcctggccaacatggtaaaaccccatctctactaaaaatacaaaaattagctgggcatggtgccacacgcctgtagtcccagctacgcgggaggctgaggcaggagaatcgcttgaacctgggaggcggaggttgcagtgagccaagatcgtgccactgcactccagcctggcgacagagcaagactccatctcaaaaaaaaaaaaagtctgcaatattataacaaaaaaaggcgaatttccttaatttatgaagagtgtctacaataagaaaaagtccaaacaccaattttttttttacaggaccaagaatattaacaaatagttcacccaaaaaaaatacctttcaaatggataaaaaaaaaaagttcaaatatctttaacactgacattctccgtttccccttcaattttctcacaactggcattc

SEQ ID NO: 50434 - DNA, 1709 bp, Homo sapiens
atttcatgcaattccaaactcccagcatatttgtggatatcagcaaactgattgtgaattttatatggagagccaaaagactcaaaatatccatcacaatattgaaggggaaataataaagtcactgcgccaggcacagtggctcacgcctgtaatcccagcactttgggaggccaagacgggcagatcacttgaggtcaggagttcgaggccagcccggccaacatggtaaaagcccgtctctactaaaaatacaaaaattagttgggtgtggtggtgtgtgcctgtaatcccagctacttgggaggctgaggcaggagaatcgcctgaatccaggaggcagaagttgcggtgagccaggattgtgccactgcacttcagcctgggcaacagagcgagactcagtctcaaaaaaaaaaaaaaaaaaagaatagtcactgcttgacttcaagacttaataaaaagctatggtaatccagacagtgtgaaattggtgaaggaatggataaatggatcaatggaacagaataaagagcccagatagagacataaatatagtcaactaatcgttgagaaagaagcaaaggcaatacaatggagcaacaaatagtgttggaatagctgaatatccaaatgccaaaaaatgaatctaatacaaactttacacccttcacaaatattaattcaaaatggatgccagacctaaatgtaaaatgcaaaactgtaaatagaactccaacatttgagaaaatctagacatcactgggtatggcaattactttctagatacaataccaaaagcataatccataaaagaaatcattgacaagctaaatgttattaaaattaaaaaaaaattactccacaaaagacaccattaaaatatgaaacgataagtcaaaaaaaatctgcaaaacacataactgataaaggactgttacctaaaacatacagacagcacttaaaactcaataaatagcccaatttttaaaatggacaaaagatgtcaacagaaatctcgccagagaacatatacagatggtaaataagaacatgaaaacatgctcaactttgtatgtcattagggagttgcaaattaaacagtcccattgcacacctattagaatggtgaaaatccaaaacactggtaacaccaaatgctgttgagattgtggagcaacaggaactctcattcatggctggtgggaatgcatcaacagtacagcaattttggaagacagtttcgtggtttctcacaaaactaaatatactcttaccatatgaaccggcagtcatactccttggttttttgttttgtgttttttttctttttgagatggagtctcaccctgtcacccaggctggagtgcagtggcgtgatctcggctcactgcaacctccacctcccgggttcaagcaattctcctgcctcagcctcccgagtagctgggattataggtgcctgccaccacgcctggctaattgtttgtatttttagtagagccagggtttcaccatgttggccaggctggtctcaaactcctgacctcaggtgattcacctgcctcagcctcccaaagtgctgggattacaggcgtgagccaccatgcccagccatgcatgatttttaacatcctaaatggatcatttacaaaatactgtttcactgagcaatgcagatgtttcaaatgttgacatatttcattaag

SEQ ID NO: 50435 - DNA, 2210 bp, Homo sapiens
aacaaggcaagaaccccaggatacagaaagttctctgtccttgccataaggcagggggtttaattgtgctgactaacacaagctacctatggacggctaaactaaaagagcaccctgtaacaaatgcccactggggcttcagctgtaaacattcactcctagagggccgggtgcagtggctcctgcctgtaatcccagcactttgggaggctggggcaggtggatcacgaggtcaggagttcaaggccagcctgaccaacatggtgaaatcctgtctctactaaaaatacaaaaattagccaggcatggtggcacacgcctgtaatcccagctatttgggaggctgagcaggagaatcgcctgaacctgggaggcgggggttgcaatgatccgagatcgcaccactacactccagcctgggcaacagagtgagtctccatctcaaaaaacaaaaacaaaattcaaccctagacactgccgtggggtcagagccccgcagcctgcctgactgcatgctccacctagagttttgagccagcaggcactgaagaagcaatccacaccctcatcgcgtgccctgcgaggggaacaagggaacttttcctgtctcacttccagcaggggaagaacatacaaccattttgaaatacataacagcattctgttcatatcaaggcctccactcaagacaaactacttaattagagcctaactgacctggagaaagggaaatacccattacctgcccctctagcctttctcttggggtaaaggaactacccaactcagccccctctagccatcatatcccatataagtggaggatagagaagactgagaagcagttgcaaagttcgcagcccaggagcacaggctaagaattaatcgtaggtatacagaacatttccacttaccatacatcttaccaccacatcactaaaggcctgtgtaccgaagttccttttactcaatacatcatgtctggctttcaaaaaaaaaaaaaaaattacaaggcattttaaaaagtaaaaaacattgcttgaagagaaatagcaagcatcagtaccagacagatatgtcatgggtgttgaaattatcacactggaaatttaaaataactccgatttgattaacatactaagggctctaaggaaaaaagtagacaatatgcaaaaatacatgtgtaatgtaagcagagatgcagaaagaatcaaaaacaaatgctaaagatctaaaacactacaacagcaatgaagaatgactttgatagactctgtacactggacacagctgaggaaaagaatctctgaacttgaggatatgtcaataaaaactctcaaaactaaaaatcaaagagaaatgactaaaaaaaaaaaaagaacaacaacaacaaccggccaggcgcggtggctcacgcctgtaatcccaccactttgggaggttgtggcaggtggatcacgaggtcaggagttcaagaccagcctggccaagatggtaaaacctcgtctctactaaaaatacacaaattagctgggtgtggtggcaggcgcctgtaatcccagctactcaggaggctgaggcagagaatcgcttgaacctgggaggcagaggttgcagtgaactgagatcgtgccactgtactccagcctgggcaacagagtgagaccccatctcaaaaaaaaaaaaaaaaagaacagaatattgaagaaccgtgcaaccataaaaggtgtaacatgcatgtaactggaataacagaggagaaaaaatggaaaagtagtatttgaagcaataatgatggagaattttccccaaattaatgtcagacaccaaactacaaattcaggaagctaagagaacaccaaacaatataaatgccaaaacaaacaaacaaaactacacctaggcatatcctactcagcctgcagaaaatcaaagatacaggaaaaaatcttcaaagaaaccgcccagtggagaaaaaaacaccttaccatagaggagtaaagataattatatctgacatctcagaaaacatgcaagcaagaagactgaaatacttaagagtttttagagagagaggaaaaaaaaaaacctagaattctgtacctgcaaaatcatccttcaaaactaaaggagaaatactctttctcagacaaaaacaaattgaaggaatttgttgtaagtagatctagcttgtcagaaacgtttttcaa

SEQ ID NO: 50436 - DNA, 1083 bp, Homo sapiens
cagcacccagactgttttgttttttttttttttttggagacagagtcttgctcagttgcccaggctggagtgcagtggtgcaatcttggctcactgcaacttccacctcctgtgttcaagtgattttcttgcgtcgtggcgcatgcctgtaatcccagctactcgggacactgaagcaggagaatcgcttgaacccaggaggcagaggttgcagtgagccgagattgcaccactgcactccagcctgggcgacggagcaagattctgtctcaaaaaaaaaaaaaaaacaaaaaaaattagctgggtgtggtgatgggcacctgtaatcccagctacttgggaggctgaggcagaagagtcacttgaacccgggaggcagaggttgcagtgagccgagatcatgccactgcactccagcctgggcaacagagcaagactcggtctcaaaaaataaatatataaataaaataagcaagtatgagagctaatctcaaataagagtcagatatcactgtacattcatgtttactttaatggacacatagctacatacatgtgtatgtaaaaataattaaatagatccaaacattactatgcatacatatattttctagctttctgtttaggaggtacagaatcagtgctacctcagtaactaaaagggcactcagtgctcagaccatggtttctaaatgtatttttcaataaaaagtacccgggctccttattaaaatggctaaaagtaaggctggtgcagggagaatacaagataagcctatactaccttgtaccagaaagtaagcaatagctccaaaaaaaagatgtgggattatgtataattaacaaattaataattattcacgaatccagaatgatagaaacagatgaccaaataaataagggagagaaaaaaaatcttccttagagaaaatttcccaaaaataaatacatatatacaggtagatacccctccagatatggaggttaattctgcttcccttaaatgtggactaaatttagtaactcacttccaaagcatagaggatggaaacagaaaaacagtaactttacagtggagaaacc

SEQ ID NO: 50437 - DNA, 1091 bp, Homo sapiens
accaaagaaataggttgaaaatatttattaatatgaaacaaaatagacatcagaacaggaaagattatcaaaggataaagagaaacctcatgaaaagacagttatttccccaagaacacataataatcttataggtatacgcacctaatcaaaggttttcaaaatgaataagacaataaatgaggtatgaaaaaacaagtaggcatatctaaaattagtttgagatttgaacactgctaagaaattaataaaacaagtaaaaaatcacaaatgatatggaaggcctgaacattactatcaaacaacttcatataatgatagaacactttaagcaacaacagaatacatattcttctcaattatatgtagcattcacaaagacagatcatgttttggcttattaaataaacctcaattaattatttaaacatagaaaaaaatacaaggtgcatcctgagatcatacaaattagaaatgaaaaaaaaaaatctggaaaattccctcaaacaattggatatgaaacaagaaactttcaaataacacataggtaacaaacaaagtctcatgagaaattaaaacatggattgaactaaagaacaatataaatacaatatatcaaaacatataggatgcagacaaagcagtgttaacagggaagtttatagcattcaatatatacattaaaaaataatatctaaagtcagtaaccaaagtttgtctcaaaggaaccagagaaagaagagcaaagtaaatataaagcaagatgaagaaagggaataataaacattgagagcaggaatccaaaacaaaaaacgaaaaaacagaaacatacaaaagaaagaaatcaataaaaccaaaagctgaggctgggcacggtggctcatgcctgtaatcccagcactttgggaggccaaggcaggtggatcacctgaggtcaggagttcgagaccagcctggccaacatggcgaaaccccatctctactaaaaatacaaaaattagccgggtgtggtggcgggcgcctgtaatcccagctactccggaggctgaggcagaagaatcgcttgaacccaggaggtggaggttgcagtg

SEQ ID NO: 50438 - DNA, 1032 bp, Homo sapiens
gatgggcaccagtaatcccagctactcgggaggctgaagcaggagaattgcttgaacccgggaggtgggatttgcagtgagtcaagatcgtgccactgtactccagcctgggtaacagagcaagaatccatctcagaagaaaaaaaaaaaaaaaaaagatgcgttattatagctaagatggtaattctcccaaaactaatctatatagattcattacattccctatcaaaataacagcaggcttttttcagaaattaacaagtttattctaaaattcacataaaaatgcaaaagaccctgaacagacaaaagtacagatttggacaacttctattgccagatttaaaaattatgcaaaagatttaaatacacatttcaccaaagaagaatggctaataagaacatgaaatatttcctactccattagtcattaaggaaatgcaataaaaccacaatgagataattttactttcacaaaaatggttttaataaaagacagtaataaatgtagacaaatatgtagaaaatcactaaccctcatatattgctgataggaatgtaatgtagtacagtcactttggaaaagagtttgccagattcttaaaaagtcaaattaccatattatccaaaaaatcctacataagagaaatgaaagcacgtccgcttaaatatttccacatgaatgtcaacagacgcataattgataattgccaaaacacagaaactacttaaattcccatcaagtgtttaatggagaaagaaaatgagacatattgacacaattgaatattatttacaaataaactaaatgaaaggctgatacatataataatatagacaaacctcaaaataattaacccatgtaaaagaactgagacataaaatactatatgttatatgattctaattgtatggaaggtccagaaagggcaaatcaacatagatgaaagtagattagtatttgcctgggggtgaggatgggaacaaaggttaactgtaaagtggtatgaaaaatgttactggggtggtaaa

SEQ ID NO: 50439 - DNA, 1057 bp, Homo sapiens
tcaggctggtctcaaactcctgacctcaggtgatccgcccgcctcggcctcccaaagtgatgggattacaggcgtgaaccaccacgccccaccaaaaaaagttcttcatttacagaaaagatcatgaagcagtggaagggaatataaagcagaccaaaattccccagaggcccgtctcctatctcgcctaagaagcaaaaaccttagagcaatttgcagggacaccctggagtggaagcaacaggggctgggtaaggaggtaaggaacacataaagctttagccataggggaggaatgggaataaatactaggcattgactggaaaagaaagacttatgacagccacacccacaagacccagattcacagtgcctacttaagactgagtttaaattagaacattagagaacatgcctctttttcgccccaaccacagactaaacatcaaataaaattaaagtaatgcacaggggaaagctgaaaaccacaggccttctctagagaagagtgaaaaggtgaaaacccacgccaaacaaggacacaaaaacaaggtatcattatagggtttgaagtttctgatacacagagagtaaccatggtaacaacaaaacttcaatcccagaccaactcctgactaatttcacaaaaacctccacgctaatagcctagatgaaggaaaggtgtgcttatcgcaaagaaaatacatatatatacctcagtatctactactttatatgtttgactctcaacattataatgtatacaaaaacaaagaaaaaaataccatctgaaaagaatgcaatcttgaaaaccagacttaaatatgagatgccaaaactaacagaaaatgaaaagtaactgtaataccttgtgtccttcttactcccatttgttagttctaggtttctggagatgctctaaaaacgtctatgtagacaatcttataatctacaaataaagatttattttttcccttccagtctatatttccttttcttgtattaggagtggtgagagaggacatctttgcattgttcccgatctgagcagtatgtc

SEQ ID NO: 50440 - DNA, 1035 bp, Homo sapiens
tgctcttctagttcaatacttacatggattcaatgaatagcaccagcccactgtcacatttcttctattccagtgttatttttgtttacttcttggttaactataattgactgttaaataccttgatcaagaagggtttatagatgttaatcccaatagttattttatatttgataacatctgccagtctccttaatatttgcaggacaacttgtctggttataaaaaaaattgtgatgtgctccagtcgtcatggtgaacttaagtgctatagaaaacctcacccaaagcaacagaaagtagaaatgctgaataaaacaaaacaaaacaataaaaatacataagaaataccaaaaggatgagaagaaattcctcaggtaccagaaacagggcagaactcaaagccactgttgtaaagtctgagtaacaaatgtggcctcaaagcatgaagaggtgcttaaagcaggagctccctgatgaggccaaagcactacctatccaaaaaagaaagtgaaaattcacagttcccacaagcaatatataaaagtaacctttccccatcactgccaacagtagttgtatccagttaattttatcccaataaagtagatgagaaaggatcttgtactaacactacaaatttgcatttacttcagtatcatttttatgtcttttattgattggataagcactgccattgaattaactattcatttattttacccattaatctacgatttttcttactaattccttgaaatggcataaatagcaagcctttatctttttttggaacagggttttactctgtcacccaggctggaaatggcgtgatctcagctcacagcaacctccacctcctgggctcaagggatcctcctgcctcagcctcctgagtagctgggactacagacgcacactaccatgcccagctaatttttgtatttttggtcgagattgggtttcgccatgttacccaccaggctagtctcaaactcctaagctcaagtgattgttgtctcagcctcctgtgag

SEQ ID NO: 50441 - DNA, 1074 bp, Homo sapiens
aactgcgtcaactaatgtgcaaaataaccagctagcatcataatgagaggatcaaattcacacacaataataaccttaaatataaacaggctaaataccccaattaaaagacacagactggcaaattggataaacagtcaagacccatcggtgtgctgtattcaggagacccatctcatgcaaagatgcacataggctcaaaataaagggatggaggaatatttaccaagcaaatggaaagcaaaaaaaaaaaaaaaaggcaggggttgcaatcccagtccctgataaaaaagactttaagccaacaaagatcaaaaaagacaaaaaagggcattacataatggtaaagggatcaatgcagcaggaagaggtaactcctaaatatatatgcactcaatacaggagcacccagattcataaagcaaattcctagagacctacaaagagacttagattcccacacaatagtgagagactttcacaccccactgtcaatattagacagatcaacgagacagaaaattaacaagaatattcaggacttgaactcagctctggaccaagcagaactgatagacatctacagaaccctcaaccaaaaatcaacagaatatacatttttctcagcaccacatggcacttattctaaaattgaccacataactggaagtaaaacactcctcagcaaatacaaaagaatgcaaatcataacagtctctcagaccacagtgcaatcaaattagaactcaggattaagaaactcactcaaaaccacaaaactacatggaaactgaacaaactgctcctgaatgactactgggtgagtaatgaaattaaggcagaaaaataaagatattcttagaaaccaatgagaacaaagacacaacgtaccagaatctctgggacacagctaaagcagtgttaagagggaaatttatagcactaaatgccaacaagagaaagcaggaaagatctaaaattgacaccctaaaattacaatttaaaaaactagagaagcaagagcaaacaaattcaacagctaccagaagacaagaaataactaaaatcagagca

SEQ ID NO: 50442 - DNA, 1188 bp, Homo sapiens
cttggtgagtttgatcactatgtgtcggggatggttgtcttgtatagtatattgcagaggccacctgaatttcttgaatttgaatgttgacctctctagcaaggttgggaaacttttcatggatgatatcctcaaatatgttttcccatttgcttgctctctctccctctcttttagagatgccaaagagtcataggtttggtctctatacataattccatatttcttggagattttgttcattttttaagtttttttttcttatttttgcctgactcagttaatttgaagaaccggtctttgagctctgagagtcctcagcttgatctattctgcagttaattctccccattgtgtcatgaaatttttgtagtaagtttttcagctctatcaatcaggtcagtacggttcatttcataaaatgtctattttgtctttcatgtattgaattattttactgtattccttagattccttagaatgggtttcaactttctccaaattttgatggtctttattgccatccagattctgaattttatgtctgtcatttcagccatttaagcctagttacgtactattgctgggaaactagtgcagtcatttggtggtaaggagacactctggcttttagagtttcaaaggttcttgggctggttcttcctcatctgtgagggcttacgcttctataaatgtgggataacttgggtatagtcagttgatgacatttttatatgttttcagagagtcaaggctttgttcagggtctttatttgtgactgaatttttcaccttgattttgcagggcggatatattaggaaagaatttttggtgttgaagtttgggctgcgaccttgtagatggtgcttaagtgtgatgggtagtaggtaggctcttgctcagccacacagctcccctgtattccttcacagttgcagccatgcttcttctaagtgctctgagagtgttggctcctatcccacttcattgctggcttcagatctcaccttggcaccatcaggctgcacaccacagccacggggcatgctcaggctttctgtttcctttccatttgggggcagcagtggtggggccttgacaatgacaatggcagaaaaatgttcacttgtttcttgaggtgccaacccagagaaatgcagactcactgctgactggatcaatcagcc

SEQ ID NO: 50443 - DNA, 1051 bp, Homo sapiens
agggaggaggaagggacctggtgtctccaggtccctttccctgggacaacctcccacaacaggacaatgagcctccaccattcttttcttttaagtaaaatctttagaatggcttgtatttctaggtgactaaaaacattctcttttctctctctttttggatgtttgcctaacaagctcctggtggttccaagtggctcctgttgtgaccagtggcctccatttgtggttttcattggtcctgttgtaggtagctgccttgctctccaaggcatcccgatcaacatcatctggatttggatcagcctccactagtgcaacagtggcaggatcacttggcaaggccccaagccctatttctttaatagtttgctaacctcctcagagatcatgggagagttggcaaagaaatgttctggccttttaatttgaatcattaagttctttgtcatcacacacaatggggttaaaccaatagggtaacacatagggtaaggggatcaagagtgacagaaggaagagaagacagaaacatatcgattgtagatcacagtgccactgctgccagtgagatgctgtcatctccccagtgaagtaggcacccctcttgtcatactggaaagtctagccccagatactgcctcaccaattcagtgggtagtcagagtatatcttcctcttgccatctgctaaggcttacactggcccagtatcttcctgacagccccttagcacaggttactccctttaacctctcagtaataagccattcgaatctgggcaaggccttcagaatacagtcaacttaactgtgactagtagttcccattcaggagagtgatagcgatcatggttgcctctcttgctgtactaaggcaggtgattgttggttcttggagagaactccaactttctaggacgcactcaatttagggaggggagttttggcggtacttaataaagacaataagcagtaggatgcagcagcacagacacacatcagcaagccatggagccttctcaaatggtgttagccaggtgagagggccag

SEQ ID NO: 50444 - DNA, 1795 bp, Homo sapiens
aaatcccagtgcttggtatatacccaaaagaaagaaaatcagtatatcaaagagatatctgtgtgcctatgtttgttgcagcagtgtttacaagagctaagatttggaagcaacgtaagtgttcatcaacagatgaatgggtaaagaacgtgtggtacatatacacaatggagtactattcagccataaaaaagaatgagatccagtcatttgcaacaacatggatggaactgtagatcattacattaagtgaaataagccaggcacagaaaaacaaacatttcatgttctcatttacttgtgggatctaaaaatcaaaacaattgaactcatggagataaagagtagaggaatggttatcagaggctgggaagggtagtgggggcatgtgggggcagtggggatgttctatgggtacaagtaataatcagaaagaatgaataagaactactatttgatagcacaacagggtgactatagtcaataataacttaattgtacattttaaaacaacttaaagagtgtgattggattgtttgtaactcaaaggataaatgcttgaggggatggatatttcattcttcattatgtgcttatttcacattgtatgcctgtatcacatctcatgtacccaataaatacatacctctactatgtgcccacaatttttttccaaactattgcatttattataaacaagggtgcagactctagactctcagaaacacaacagatacgaagctgagacagctctggtgaaacaataactgagagacagggaataccgaggtattcatgtctgccatccaggaccccacaccccacctttggtccagatggccccttggcccaggtgtccctgctgccagaacacactggactggggtacaggagttgcatattccatgaggctggtgtcaggggaagcagggactcacagttgccaggttttccctcttctcctggccaatttccctccacaacccaggggtttcagtctcacatcaactatcacattttaaaacagaaaacaggcaaaatgtttggttaaaataaaatgaaaacactgcagggaagagacctgagtgtgctggtggacagagcgccctgttcacctgtgggaagggcagggccagcaagggcaggagagctccctgtgggtagctaggctgtgtgtgtggccctccaggtggtcctagggaggatgtagggacaggaacagtccaggtagacagctatcaggtaagcagggctctgcctgaggtgttctggcatcaggaggctgcctgatccccagtcggcatgacacaggctccaggaagcaatgggacatctgcccaaaggatcaaagcccaacttggtcagatcccaagcttcacctgcatcatgtctctggctctgcaaagggtacccccaactctggggacaaaccatgcccctgagcagcagctggctacgttgccaaaaccaggacacatctgtatcatactcacagaaagctgcaccatcctggtgtgacaggccacacttggtcaccctagggtaagctggaaaagaactccagatgtgccatggagagccccccacctctcaggggccacctcacagggtgctccccaccccattctttgagtttggcttgagattttaggaagcataatttcaggtgaggaagagaagaaagtctggtcccagcccactctggcaaggaacgttccccacctcgtcagcatcaaaggaagccacatatacaggcaggacacacacagcacgcacggggcgtaaggaaccgtgc

SEQ ID NO: 50445 - DNA, 1035 bp, Homo sapiens
aaggaaatttatagcactaaatgcccacatcagaaattgggaaagtgggaaagatctaaaagtgggaaagtgggaaagatctaaaatcagaaagtgggaaagatctaaaatcgacaccgtaacatcacaattaaaagaactagagaagcaagagcaaacaaattcaaaagctatcagaagacaagaaataactaagatcagagcagaaatgaaagacatagagatatgaaaagcctttcaaaaaatcaatgaatccaggagctggttttatgaaaagattaacaaaatagataggctgcttgccagaataataaagaagaaaagagagaataatcaaagagatacaataaaaaatgataaaagggatatcaccactgatcatacagatatataaactaccatcagaggatactataaacacctctatgcaagtaaactagaaaatctagaagaaatggataaatttctggacacgtaatcccttccaagaccaaaccaggaagatgtcaaatctctgaatagaccattaacaagttctgaaatttaggcagtaattattagcctaccaacaaaaaagagcccatgaccagactgattcacagccaaattctaccagaggtacaaagaggagatggtaccattccctctgaaactattccaaacaatagaaaagaaggactcctccttaactcattttatgaggccagcatcatccttataccaaaacctgacagagacacaacaaaaaaagaaaatttcaggccaatatccctgatgaacagcaatgcaaaaatcctcaaaatactggcaaacctaatgcagcagcacatcaaaaagcttatccaccatgatcaagtcagcttcatccctgggatgcaaggatggttcaacatatgcaaatcaataaatgtaatccatcacataaaaagaagcaatgacaaaaaccacatgattatctcaatagatgcagaaaaggccttcgataaattcaacacccctttatgctaaaaactctcaataaactaggtattcatg

SEQ ID NO: 50446 - DNA, 1058 bp, Homo sapiens
aaagatagcaaaaaacagacctgactggagtcaccaactccattccctcccccaccctgtggcagtgcagcatggtacagagagcatctctgggcactgtgggagggagaacacagttgtgaggcattgaattcagtaccagagtagagtagaaaggaaataaaactgaaaatcagtaacaagagagattttggaaactacacaaatgcatggaaattgaataatatgctcccaaattaccagcaggtcaatgaagaaattaagaaggaaattgaaaaacttcttgaaacaaatgataatgaatacccaatatacaaaaacccatgggatacagcaaaagcagtactaagaaggaggtttgtatttataagtgcctatatcaaaaaagaggaaaaacttcaaacatcttataaatcctgtcaaaaattaaaagcaaagttataaaccaaaattacaatattaattacaaaattacaaattacaatattacaataatatttggttatgtatctatatggacatctttacctgagaccttttactgtcagatagctttgtgttactgtcaagtatctttttattttaacttgaaggactttctttgcatttctcatagagcaagtctaatgataatgaattacctcagcttttatttatctgggaatgtcttaatttctacctcatttttatttttaaagtatagtgttgatggttgtagaattctcattagacagattttttcttttaatactttaagaatgtcatcccactgtcttctggactgtaaggtttctgctgagtaatctgctgatattggagaatcccttgaatgtgatgagtcacttttctcttggtgctttcaggattttctcattgtcttttgcttttaacagcttgactataaagtgtctaggtgtatttctggtttatcctacttggagttcattgagcttcttgaatttgtacattcatatctttcctcagatttggtaaactttcagccatatttcttcaaataatctttcctttttctgtatctcttcttcttctggaactca

SEQ ID NO: 50447 - DNA, 1050 bp, Homo sapiens
agagttcagagctgatactggcctgagagctctagcagtgggtggctggagtcccggaccagtgagtcttatcctccgaggtgcagcagaggcaaggcctgcaggctctcgctgttcagccctatgtatttggcacatttcctgagtgcacacgagggagcctgacttcctccattgctggagatgcagccaccaataccaggatgcctggggatccaaggcttctgggactccacgtgtacctgaacagtggtgctgcccagactccatgtagctctgcatatcagtgtaaaggccccagtggcatgggctcatgagggctcatgaaggttgcaaaggtctgtgggaaaagtatggatctccagggactttcactcactcaccatttccctgtgctggaaaaacctcccctggcttgatgctactcccaggtgggcagtcatcttgtctcgctcctctccattctctgtgggttgagttgtttctttgtcttcctggatgtttcagttgaagatctagtatttactcaccactttttcttctctccatgaaagtggtgcacattagttgcttctagttagccatcttggccctgcccccaataatactacttttacaaaaatatgtttcagagctgatcctgctaagttaattatcctggttatcttgtgactcattttgtatcaattatctgttgctgcataacaaagtaccacaaatttagcagcgtaaaacaacacacatacattcattatctcccagctgttgtgactcagcaatgtggggctggcttaggtggatcctctgactagttctcataggctgcaattaaggtgttgcccagggctgagtactcatctggagacttgattaggtcccaaatatgtgagaacatatgatatttgtctttttgtgcctggcttatttaccttaagataaagtcctttagttccatccatgtttcagcaaatgacatgattttattcttttttatggccaattagtatttcattgtgtgtgtgtgtgtgtgtgtgtgtgtgtgtgtgtatt

SEQ ID NO: 50448 - DNA, 1124 bp, Homo sapiens
atagccacatggcaaataaaggaaatgatttttggggagaggaatccaagcaggctgcagagcaagcacttgctagagagatttgcctgactaaaaggaatccaggtgctgatagccaagacaatagaaaaaaggcctcaatggcatttcggagatctttaatgcagcccttcccatcaagggcccagaggcctaggaggactgaatggtttcattggccaggcccagggcaccagtgccctgcaccacccagtggtatgattttgtttttgtttttgttttttgaatatgctttgcattgttttatgtttgattgtcccgtcaattttagagtatgtgccctgtggcaatgagacggatgtatattctgttgttttgggtagaaacttctgtagatgtctattaggtccatttggtcaaatattgagttcaggtcctgaatatctttattaattttctgctttgatgatctgtctaatactgtcagtggggtgttgaagtcttctagtattattgtgtagtcatctaagtctctttgtaggtctctaagaacttgccttatgaatctgggtgctcctgtgttgggggcatatatatttaggatagttagatttcttgttcaattgaatcctttatcagtatacaatgctcttctttttcttttttgatctttattggtgtaaagtctgttttgtctgaaattaggatagcaactcctactttttttctatttgccattttcttggtagatttttctccatccctttattttgtgcctatttgtgtcattgcatgtgagatgggtctcttggtcacagcatgccattggatcatgcttctttattctttatttattcagcttgccactctgtgccttttaattggggcatttagcccattttcattcaatgttagtattaatgtgtgcagatttgttcctttcactatgttgttagctggttattatgcagacttgtttgtgtggtgctttctaatgtcattggtctgtgtacttaagtgtgtttttgttgtggcatggcttctaatggtttttcctttccatatttcacactccttttaggacctcttgaaaggcagatctgttggtaatgaatttccttagc

SEQ ID NO: 50449 - DNA, 1079 bp, Homo sapiens
tcaattgtgtttattttttcaaaaagcctacttttagtttcattacttttttgttttagtatcaatttaatttatttctgctctgatctttatcatgtcttctactaattttgagtttagtttattcttgcttttctagttctttaggtgcattgttaggttttttctttgaaatctcttcactcttttgatgtaggcatttattgctctaaacttcccttttagtactactgcttttgctgtattccatagattttgctatgttgtgtttccattttcatttgtttcaagagaatgctaactttgacatttctttgtttatttacccactggatgaactgtctgttactgagattgggctgttaatgtctcctattattattttgttgtatttctccctttaaatttattgtttgttttatataattgggtgctccagtgttagctgtatatatatttacaattcatatgtcctcttgttgaattgatttatttatcatttaaccttcgtttctatttatagtttttgacttgaagtctcttttatctaagtacagctactcatgttcctttttggtttccatatgcatggaatatctgtttccatcgcttcattttcagtctttatgtgtctttttaggtgaagtgagtttcctataagcagcatatcattgagtcttgtttctctagctgtttgtccactctgtcttttattggagaatttagtccatttacattcaaagttatttttgatatgtaaagtcctactaataccagcttgttccttgttttccggttgtattgtaactctctctttcttactgtttccctttcaggaaaagttattttacctgatggtatgttttaattttttcctttttattttttagcgtatctatagcaagtttctgctttgtggttaccatagtacttaaaaaatgtcttatggatgtagcaagttattttaaacagatgagaacttaattttaattacagacaaaagaatagaaagaagcaaacaaaggaaaactaaaaacaactctgtactctaacttcatccttatcacattttggctttt

SEQ ID NO: 50450 - DNA, 1249 bp, Homo sapiens
attattgattttttttttgccattgagttgtaggagttacttatgttataagcatattaaccccttattagatataaggtttgaaaatatcctcttctattctgtcagtagtcttttcatttttttgaatgtttcccttgctgtgcagaatcttttagagtttgatgtattctcatttatttgtgttcttgttgcttgtgcttttggtgtcatatccaaaaaattattgccaaaattaatgccatgaaggttccccccatgtttgattccagtagtttcatagttttaagtcttatgtttaagcctttaatacattccaagttaatttttgtgaggagtgtaaaatagggatcccgttttattttatttttgcatgtgtatatccagctgtccttaaaccatttattgaagagactgtccttttctaattgtgtattcctggaaacttaaacttaactcagatattagttgatatggttagtctatttctgggctttcagttctgttgcattggtgtaggtatctgtttttatgcctgtgctacattgtttggatttctatagctttgcaaaatagtttaaaatcagtaagtgcaatgcctccacctttgctgttctttctcaatatgcattagctatttgggatctttataattccatatacattttaggattgttttttctatttctgtaaaaaatgtcactcagattttgatagagattgcatttaatctgcaggttgctttgggtagtatggacattttaacaatattaatttttctgatccacgatcatgggatatgtttccatttatttgtgacttcttccatttctttcattaatgaatgttttatgcttttcattatgcaaattgtttgccttcttgattaaatttattcctagccttttaatgttgattttgatgctattttaagtgggattgttttatttatttttctgatagtttgttgttagtgtataggcaattctaatttttgaatgttgattttgtatcctgtatctgtattaaatttgttgttaattctgaaagtttttggtggagtcttatagtgtttttatatataagacctgacatcttcaaacagagcaattttactttcctttcctatttggctatattttttctaattgatacataatagttgtagtatttgagaggtacatgtgatattttgatacatgcaaaagtgtgtaatgattaaatcagggtgattggtatatccatggcc

SEQ ID NO: 50451 - DNA, 1026 bp, Homo sapiens
ttgagtttagtgcttttctgagtttctcgtccctttaggtgttacattaggttgttaatttgagatctttctatcttcttgatgtagacagtaagcactatacttttgccacatccttggggttttggtgtgttgtgtctctattatcatttgtttcaaagatattttttgatttctgccttaattttgttatttatcctacagtcattcaggagcaagttatttagttttcatgtatctgtatggttttgacagttcccgtcagtattgatttatatttttattccactgtgatctgagaagatgcttgctatgattttgatatttttaaatttgctgagacttgccttttgactgcatatgtggtcaatcttagagtatgttacatgtggaaatgagaagaatgtatattctctggttgttgggtggaatattctgtaaatgtatattaggcccaactggtcaagtgtcaaatttaagtccagaatttgttagttttctgtcttgatgatctctgtaatgctttcagtggggtatggaagtcccccatagttactgtgtggctgtctaagtcttttcctaatattagtagtgattgttttataaatctgggtgctccaatgttgggcgcgtatatatttaggatagttatgttgggaacaggccccccaaaatctggccataaactggccccaaaactggccataaacaaaatctctgcagcactgtgacatgttcatgatggccgtgatgcccacgctggaaggttgtgggtttaccggaatgagggtgagaaacacctggcccacccagggtggaaaaccgcttaaaggtgttcttaaaccacaaacaatagcatgagcgatctgtgctttaaggacatgctcctgctgcaggtaactagccagacccatccctttattttggctcatcccattgtttcccataagaaatacttttagttaatctataatctatagaaacaatgcttatcactggcttactgttaataaatacatgggtaaa

SEQ ID NO: 50452 - DNA, 1031 bp, Homo sapiens
gagagattatttgtcttcatctcttcctatttggatgccttttctttctttctgcttccctttcttcttgatttttcatcagggatattgttctatcattttctttttgtgtatgtctttgtcagattttcgtatcagaatgatattggtttcacagaatgagttaggaaggaatccctgctcaaatttttaaaacagtttcagtaggattagtaccagctcttctttgtatgtggtagaattcagctgtgaaagcatctggtccagagattttttttttttttttttttgatggtaggttttttattactgattcaattttgtaagtaactgttagtctgttcaggaattctatttcttcctgcttcaatcttgggaggttttgtctttctaggaattttggcatttcccttagattttctagtttgcgtgtatagaaatattcacagtagtctctgaggcttttctgtatttctgcaggattagttgtaatgtcacctttgtcatttctgattatacttacttgcatcttttctcttattttatttcacttttgagacggagtctcactctgttgcccagcctggagtgcagtggcgcgatctcggctcactgcaacctccacctcctgggttcaagtgattctcctgcctcagcctccggagtagctaggattacaggcccatgctaccatgcccagctaatttttgtatttttagtagagacagggttttaccatgttggccagggtggtctcgaactcctgacctcaagtgatccgccagcctcgacctcccaaagtgttgggattacaggcgtgagccaccatgccagaacttctctctcttttttgaaaatctaactagggtgggccaggcacagtggctcacgccttaatcccagcactttgggaggcagaggctggtggatcacccgaggtcaggagttcgagaccagcctggccaacatggcgaaacccgtctctactaaaaaatacaaaaattagctgggtgtggtggcaggcgcttgta

SEQ ID NO: 50453 - DNA, 1049 bp, Homo sapiens
tccagataataactttctaatgctttaagagaactagattgtttttaactgcatggaaattagaagagatcttaaaaaaattcacaaacgtaactagtgtatgtacaaataaccctaattttagggatatgcacacaaaaatgacattctgatattaaaaataacagttttactgtccctcctgagtggttacacacctggaaggatgccatgtgctttcactggaagtaccacacttgcatttctgtgttgtgaggtcagtagcagaaacccttagttagagctggcaatttagctcccttttctcctgcttggaagaggcatcaagttactaccctgtagagatacttcatttttctatttggttttttaaaaatcacctgttctgattgatctttaagaacgaacgacataaacagccattaaattttttttcaaattcataaaactattcatacttttttgaaacaggagttaatgccagtaatccatcagaagtatctactgtttagaaggaaatggggcagcaccaaatgggtctaattcgactggttgggactgttgggactgctgtagagtgatgctttgcaccacaagttctgtaaagggcatggcaccaaaatcatccattgtcaatacatctgcactatggaatgacccatgtagtgaattttgccttggctgcttaggcaggacagtattgtgatcagcacggatgtcattcaggccctgatgtagagggtgccatgacaggtctggaggatggaagggcttggcaccaaaggggtccaacagactctcctcgagttgtaagacgttccccctatcgttcccatcagtcactgcggcaccaatgttctccttggagtctgagatggttacaaattcattgctggtttgagagactcggcgacccacttttttgtgcctgcgagccctctctggagtgcggtaggtaggcttcaaagtcttctttttgctagttggcgtgccatgatgccgcttcccattacttttggacatatcctgctttgtgcgcctttggcgag

SEQ ID NO: 50454 - DNA, 1042 bp, Homo sapiens
tctgacaggccccagtgtgtaatgttccctccctgtgtccatgtgttctcattgagagttataactacatcctaaagaagcacaggggacacccaaatattattagggaaaaaaacccatatatatatatatggtctttgctatatatatacatagatatttatatttgcttagtggtatatatatataacctttcttacattcttaaaccagaatttgaacatcccataatagagccaaacttattattgagtgctgtatgccaggtactgtgttaagcactttcacataccttgagagctttattctcataattctcataatgcaatgacctgagcatcagctgtgtggagtgacctacactttgaccatgattctgggggatgatgaatgaaaatgcaaagtataaatatatactttttaggaaaatgcctctatttcaacacaaaggaatctctccacttctatccctttgaacccccaatggaatcctgtgtcttttctctgagctacaatcttgaaagaagaaagttactgtgctgtgttataacataagaatgtaaatattttaagctgtcagagttgtttcctcagaatttatccaacattataagccaaagggtctacatcagtgtctgaaccatttaaaattattcagtgtattgagaagcgagtaaaacgctaggtatttcatgtttacatctgaaggagaccacactagttcatcccctaccccttttctaaatgatgaaactcatgagatctagcaaagaccaaggactaaaataagaagcatattgtgcacacctcaaaagattttcatttaaaaagttattctgtttgatacaaacctactgtagttcatgaatttactatgtgtaatcatcaagtcttcacttttaaaagaaagtattccttgaatctattttgtaaagtttttaaacatctacttgagcatttgcattagcagtattaatcaacctgagaaatgaaaaaaaaaagttgcaaatatatttgcctttggcatgaggacaagtaattg

SEQ ID NO: 50455 - DNA, 1028 bp, Homo sapiens
tagacccaagcttgaggccacccctgacagtccagcagaatcaggatccaggcctgccccaggaatctcagtaaccataacggtatgaatctagaaatcaataacaagaaaaattggagaattcacaaatatgtagaaattaaacaacatgctcctgaacaaagagtcaagaagaaatgaaaaggaattgaaaaatatcttgggacaacagaaagcggaaacaacatgccaaatgtatgggatgcagcaaaagcagttctaagaggggactttatagcaataaatgcctacatcaaaaaagaaaaaagacttaaaaatccaaactaacattatacctcaaggaactctaaaagaccagcctaaactgaaagctggcagaaagggaataaaggtcagaacaggaataaaaatgaatagagactagaaaaacaacagaaaggataaacagaactaagagttagtattttgaaaagataagcaaaattgacaaacttttagcttgactaagaaaaagagagaagactgaaatgaataaaatcataaatgaaagagaagaccttacaactgatactacagaaatataaagtcataagaaactatgagcaattatattcccccaaaaattgataacctagaaaaatggatacattcctaaaaacatacagcctaccgagactgaatcatgaagaaacagaaaatctgtatagaccaataacaagtatattaaatgattaatccaaaactcccaacatagaaaagcccaggacctgatgacctcactgctgaattataccaaacatttaaggaagaactaataccaatccttctcaaaatattccacaaaattgaggaggagggaatacattcaaactcattttgaggccagcgttacttggataccaaagccagacaaaacactacaaggaaagaaaacagcagaccagtattcccgatgaacatagatgcaaaatcctcaacaaaatgctagcaaactcaattcaacaacgcattaatgggtcattcaccgt

SEQ ID NO: 50456 - DNA, 1050 bp, Homo sapiens
aggcatcatacttcccaatttaaatttatattacaaaacgagagtaatcaaaacaatacagtattggcataagagatacacaggacagtgaaatagccagaaataaatccaaacatgtatggttaatgaatttttgacaagagcaccaaaaagacaaaatgagaaaagggtagtctcttcaataaataggtgctggaatttccacatgcaaaagaatgaaattagactcttacattacaccatacacaaaaatcaatccaaaatggataaaagatctgaatgtaagacctgaagccataaatctagaagaaaacataagggaaaagctccttgacactggctttggcaatgtttccttggatatcacaccaaaacctcaggctacaaaagcaacaataaataaatgaaattatatcaatctaaaaaacttctacacagaacgaaaacaatcaacaaaatgaaaaggcaatgtacagataaggagaaaatatttgcaaaccatatatcaggcaaggttttaatattcaggatttaggaagaactcatacaactcaatagcaagacaacatataacctgattaaaaaaaagtggggaaaggacttgaatagacatttcttcaaagatgacagaaaatgaccaacaggtatatgaaatggtgctcaatatcaccagtcatcaggaaaatgcaaatcaaaactactttgagataccacctcatacatgttaggatagctattatcaaaaagacaagagctaacaagtgttggtgagggtgtggagaagagggagcacttgtacactgttagtgggaatgtattatatattggtgcagccattatggaagacagtatggaggttcctaagtaaattaaaaatagaactaccatatgacccagcaatccctcttctgggtatatccccaaagggaatgagattatctctgcactcccaagtttattgcagcacaattcacaatagtcaagatacagacacaacctaggtgttcatcaatgggcaaatggataaagaaactgtgatatagagagatc

SEQ ID NO: 50457 - DNA, 1042 bp, Homo sapiens
aataaagctgttataaacattcatttgcaggtttttgtgttatcatgaatttccactcatttggttaaatacctaggaatataattgctagatagtatagcaattctgtttagttttgtaggaaactgcaaactgtcttccaaagtggctgtatcattttgcatttccactaacagtgactgggagttccttatgctaaacatcctctacagtatttggtgtggtcagtgttatagattttggctattctttcaggtgcatagtggcatcttattgttgttttaatttgcaattccctgatgatgtatgaggggacttcaaaaatttatggaaaaattgaactaaaaggtaaaagtaaaaaatataaacttcttaacataagctccatcgagttcaagatactttgtaagcaatgataccagccatttggttcatccctaaggaactgagggttctgagaatttaatcaggtcaatgaagtcttttttacgttatgaactgaagaaaaatgtgtgcaatttaaaggtttgttaagactttgaaacaaaaagaagtcagaaggagccaaatcaggactgtaaggtggatgaatgcctaatgatttcccatcaaagctctcacaaaattgcccttgtttgatgagaggaataagcagaagcattgtgatggggaaggactctctaatgaagctttcccaggtgtttttctgctaaagctttggctttctcaaaacactttcataataagcagatgttgttgttctttggccctccagaaaaccaactagaaaaattcctttaacattccaaaagactattgccatgagctttgttcttgaccagtccagttttgctttgactagaccgcttccacttcttggtagccattgctttgattgtgctttatctttaggatcatactggtaaagccatgttttgtctcctgttaaaattcttcaagaaattgctacaggatcttgatcctacttgttaaaatttccattgaaagctcagctcttgtctgcagctgatctgggcacaac

SEQ ID NO: 50458 - DNA, 1082 bp, Homo sapiens
tcaggtgatccgcctgcctcagcctcccaacgtgctgggattacaggcgtgagccaccatggtcagccttcattcattttcatggagaaaaatatttcattgtatgagtataccacattttgtttatccatttatccattgattggttgtttctacttttttttagctattatgaataatattgctgtgaacatttgtgtacaaggttttagtggacacaagtttttatttttcttgggtatatatctaggagtggaattgctgggtcatattgtaattctgttcaactttttgaagaacttcccaactgttctccatggtggctgtgccattgtatattcctaccagcagtgtatgaagttacaaatttctccacatcctgagaacccctttattattttctgtttttctttttgattatagccatcctagtaggtgtaaagtggtatctcattgtgattttattttgcatttccctaaatgattaatgatattgagcatcttttcatgtgcttcttggccactagtatatcttctttgaagaaatgtctattcaagtctttggcagtttctaaatgagttattgtctttttgttgttaggttgtaagagttataatctggataacagatccttattagatatgtaatttgcacatattttctcccattttgtgggttgtcttttgtcttttttattttttattgcttgtgttttggtatcattattgataattcattgttaaattaaaggtcatgaagagttactcttactttttcttctataatttttagttttagctcttgtattcatgtctgtaatcaattgaagttaatttttaatatagtatgtgttaggagtccagcttcattgttttgcatgtatctatgcaattgacccaaagtgatttgttgaaaaatattattttctgatggtatggtcctgacacccttgtagaaattcaattgaagatatatgtatgagtttacttctgcagtctcaattctattctattggtctaaatgtttatctttatgccagtaccagcctgttttggttattttagttttgtaataaaataga

SEQ ID NO: 50459 - DNA, 1078 bp, Homo sapiens
gacatggacttcagagagttcttggtagaagactcaaagagccacctgtcatgagacatcccacttccttccccaggttacttccaagactgagcagccaggtttttggtagatgagaacaaatgtttcttcctgaagccctggggcttcaggtaggaagaaggactgctatacttgttctcacccttggcttctggctgctccagttaaacatggttcccattgatacagacattagagtgggaaaggacttcgttcatagaccgaagaccctcaaaggaaagtccttccattttgggaagggtgacattgatttcgtttagctgcttaagatatgtacttgctgttgtcttgtgagacatgacatctgaagctgaagaggagtccctctcattgttgtcattgtcccaccgggactgaaagtctcccagttgaggcagcattttagctttgatgtctacagggcaatcatggatcaggaaatttctgcaaattagacttggaaaacaaggtcttgatccttcttgtctttggacgaagactaatcatcacttttgactgaaggtgtagtgctggagactatgttggaggcagcacctgatgcactatccatattcttccccttgatcttgtcttaaagttttccaaatggattccgaggcttgtctttgatgaaaaggtcaaacatactggcagtcatgttgtttctcataagctggatgtcaacctcaatttctcctctttatccttctctcctggtttggatttcaaggtataccaccgcatcttcctgctcccctagtctgggtgcaggtcctgcaggtacacctcggcgaagcccaagtacagtagcagcagcacctcaaaggtggcctcctcctctgacactgaggtggcatacttctccttacccacctgaatcaccgagtacatgttgcttgtaccgtcaggctcttggttcttggcccctggccctatgcctgcaacactgtcacctgcacgtggattgggaaccacatagcccccggacctgctaaggccattaaggacaggatggtgatgcctcggctgactgacg

SEQ ID NO: 50460 - DNA, 2386 bp, Homo sapiens
agtggcgaagaggggataacctcttaggaagttataaaaatttagtcatgcattgcttagcaatggggatatgttctgagaagtgtattgttaggcgattttgtcatgtgaacttcatagagtatattaacacaaacctctctaaatggtatagcctattacacacctaggctacaaacctgtacagcatatgactgtactgaatactgtaggcaattataacagaatggtaagtatttgtgtacctaaacatatataaacatagaaaagctacagtaaaaatatgatatgattttgtggtgggacaactgtgggacaactgtcatatatgaggttcatcattgtcctaaacattgttaggcagcacatgactgtatagacataatagaacttataggaaaagttatagaaaaacttatagaaaaagaccttgatgaaaaatactgtcatattctttggatgaatgttgcaattaactccttttagatcataacttgactgtacagattgtgcaagattgttttctgggaacagctgtatatgaaatgttgattctcagggagacacctagacacctgaattgcagcagacattttatggtgttgctaagttgctggtccttctcatcagtagcaggcctactctcactgtcacatatctcccacggtttttttttttttttttttttttttttttgtaattaaccaaaagtgaaggcttttatatcaaagactcaattgaggaagcagtggccttagtcattattggcataattgctttagtttgcttatggatcttaaaacgtttatgactatatctgcaagtaaaaaaaaaattcaataattaaaaacctaaacatatcgagtgtttattttctctttttgcaaaggtatattctaaactcaatgttcttcgggaaattttccaattaaggctctgagtattgatatttgggatttagagaatggctttctatgaccagaatggttagtgatgagattttatgtaagtaggactgggtttttcagggggccttgtgtaacttgccatcaagagttgggaaaggaggccctgagcagtgcagcagagctatgtaaagtgagagtttgggtcttgggaccaggtagcctgggctcaaatctgctctcacacttagcaatgtggtcttgagcatgattcttcacttccccaggactctgttttctcttatgtaaaataggaataatatttattttcaatgatgggggtaaaaagtacttaaagggactaattatgtaaattgcttagaacaggcctggaatatacagctaaatgctgtgtcaactgttgttgctgataatggtgttgactatgacaagtattaaaagaagagatttgactagaggtacttatattttgaatgatcagtgacgatgttagggttgagaaagaaaaacagtaactgacttgaaggttttcaatggtatgtaagtgtgaggtcatttcaccttttatttctctgccaggtagagtgggaaaccaaattaatcactccatgatctagtgactaatctattgcctttgcttttagttccaaatagaaagctgttgaaaagttgttgtattacacctgcataaaggttatcctgaaaacagaaaaatgcattagactttgtcaaaactggatttgaaacctaattcaactgcttgctggctgtgtgacttaaacttgttgaacttcagtttcttcctctaatataactattaattttcagagtttccatgaagatatttgtaaagtgtttgtcataggcactctatacattaattacagctattattgttagatcttgggacacccagcacgtgacaaaaacaacagcagaccctggtgcctgggaggacttcatggatccagcagcaacctggagtggtgctcctctgaagaaatcctactcggatggatataatacaacctgctaagtgtcctagcacttagcaggttgtattatcattgtccgtgtctatggctctcgtctaccagactttaaattccttaagggcaaggacagtgccttactcatctttgtattcacagtgcctaatccggtgcacattgtaggcctcattaaatgtttgttgaatgaaaaaatgaatcatcaacagacattaattgggcgcctgctctgtgatctccatgggctcagcttgtccccgccagttgccaacaacgtccaagctctcttcagaatgcttactcctgaagcttattcctgtcttctaattcttttgttgaggacttttctgtgtagtgcaatgatagcaaatacacttcatctcaagtaccatctccaattgattgataatgcctgccctgattatgttttataacaagattctgaaacca

SEQ ID NO: 50461 - DNA, 2521 bp, Homo sapiens
aggttgaatggttcctgaggtactttaacttgccatattatgaaagcacagcccatgatttgtcatactgcaaagattgacttaactactttaacaagaaacgtattccagaattttatcgtggtgtgcagtcattgcttctatcttgctgtcctttattaaatagtattaatttacaccatagtcaccaagaagactatattttggtaggctttggggtttatctgcctgcaagaaaatttattttccactgctttatactggtaattagatattattgtactttcaaatctttcactgaaaaatatctagttaggtcagcatgccctatgtattgtagatgcggttctgctatggtttttcaccaccggtggttgaatgtagggtggtacctttatctagttttgagtttctttagtgactcatttttgcagtcttacatctgctactcctctattagattattatttagcccaaaagtattatgggatcatttgacttcatggcgtcactggaaaacttaaatgttctgttggatgaaagtgtttcacttatagtactaatcgccatgtggtattcctttactttccctaacatttgcttgtttgtttttattgtgtatctacatgtattgagtagttaggtgcttgtacaaatcttctaccttcactcatggtcaatcaactgtaaaccttacctggggccaacttgccaaaggttttacagttaacaaatggtatttgaaatttgtagtaagagtaaatgctttggagtaggaatgcctatctcagcaatcctgctaagcactatactctggataaggtaattaccttcttttgtagaaaagaactcgtgatataattcatataatataaagttcaccattttaaagtttagtgacttttagtatattcatagagttgtgcgaccattgccactattatagtttacaacactttcatcaccacctcattagcacttattccctatttcccttttgccaaccctgacaactactaatttagctttttgtccctatggatttgtctattctgggcagtcatataaatcatgcaatttcttacccttgttactggcttcttttaactaccatgtttttttgagattcatctagattatggtatatattactgttctttattgatgaataatatttcactgtatggatatatttcattttgtttatccatcatttgacggatgtttgcatttacagatgttgtcttttgtcagtaatggtgctaaaaacattcatgtacaacattttatgtgggcatgttttcatttttcttgagtatacattaaggagtataattgctttgtcatggcatgtctaggtttaatgttgtgggtaattaacaaattttaataaggtgcctgcaccattttacattttcatctgcaatatgaggaattacatttattcatattctcacttgttattttctgccttttaaaattatggccacctagtggatatgaaatatcttattgtgctgttgacttgtatttctgcattgagcaacttttcatgtgcttagtggtaatttgtgtatctttggagaaatgtctgttctaatcctttgctcattagaattgggttatatgtggttttgttgttatcagagttctttatataatctggataacagactcttattggatacatgatttacaattattttcttccattctttgtattgcctttccacctttttgatgacattgtttatagcacagaagtttttaatattgatgaaatctaatttatctatttttttttgttagttgtgattttagtgtcataacaaagaaaccattacctgacctaagttgtagctcttacatttaggtgtgtgattcatttggaatttacttttgtatatagtttaaggaagaagtccaacttagtccctttgcatatggatatccagttttctcagcaccatttgttgaaaagactacttcatcattgaattgtcttggtacccttgttgaacatcagttgattctaaatataagagtttattttggactctcaattttattttatttatctctatatctatccttatgcctgtactacacagtattgattattgtagctttggagtaaatttcaaaatctggaagtatgagttctccagctttgttctttgctttggccttgattattctgaaggctttgaatttccatatgaattttaggatcagcttgtaaatttctagaaaatgccagaattttgctaaggaaagcatttaatctgtagatcaatttgtggagtattgccatgttagaaatattaatattcccaatccattaacaatagatacctttctattcattttatttttcataatattgaaaatggaattattttcctaactttaattttggattgttcattgctagtgtattaaaatacaattagttttctgttgatcttgtatcctccaatgtttctgaacttattggaaaagcttttctaatagtttcact

SEQ ID NO: 50462 - DNA, 1433 bp, Homo sapiens
aaaggggtgattctttttgctggacagtttgagatttcattacattactctcaacggcagacaatttggaatttatgaattgtttattcttggaattttccatataatgtttttgaaccacgtttgaccccaggtaatagaaactttgtaaaggaaaaccatagataaggggagaatactgtaacgttaggcttctttccccccatttctgttttattttgtttcccttattgtcagaaagtatgttcagtatggcctccttgtgtacacaaagtaatttttggtggaaaagaaagtactaccattagtccacagcatgtccttctgaaattatgttggatgcttgttatcatggatttggttctcatagggatattaatacagtaccctagtcagtgtgttagtgagccaaaaatatgtttgaaaatgttcatggatgtttgcgtcttttttttttttttttttggcttgttacaagttctggtttataggttttgacatcctttgcattgttggaagtgtgcccagtgttgctacctaatttgtggaaattctgtagtaccaccttagtccacagtgcgtccttctgaatagttgcatagcttgcataactaatttggtgtgaaattctagagtgaaaactaatatggtaacctaatcactgtgctatgttgaggatttccaagggtgcatgatgtattttacgcatttttctaattacaattcctggcttatagactgcataggtatttaatattgtctagtaaagtgtgttgatgtacaatttcttgtttaattcagtactattattagctacatggttctgctttatcgttgccattaaactaaatatatactgattattttcatcaggcaccagcgttaatgtgtttctcctaagtgagttgacctcatgggaattcatcacatctgtggactatattttagtgttaaaggcttaatgtactactgtttcaaaacttacaagtattggtatttcacatgcttttaaaagtactgttgtactttttttttttttttaagacaaggtctctctgtcacccagactggaacatggtggagcaatcatagctgatggcagctttgaactcctgggctcaagccatcctcccgcctcagcctcctgagtagctgggactacaggtgtgcactaccagcccaactattttattttatcttattattttatctgagacagcatctcggtatgtgacccagggtggtatcaaagtcatgggctcaagtggtcctcccaccttggcctcccaaagtgctggaattaccacacctggcctacatgttgtagttttgttgcagtaagttcagttgacttttgttaaatgtaccccagtaagcacatgccctgtggtaagtcctgttgtgtaataaaaaacatggtatgtatcaatgtg

SEQ ID NO: 50463 - DNA, 1038 bp, Homo sapiens
aagtgtagaggtatatatgctttgatcctttagcctgaatgtttcataaccaaatttgatttcttaaccattgtcatttgcaagtaattttagaactccctcccctgtaatggtagcatgtatttatctagcacatttgtaatcttaaaatttttaatttggtgcttcttcagggacttggtaatgaatcaactggaagttttgtactaaatttgtctacacagcagcgctctttagctggtggcatagagtccaaagttaagaatctgtatctgctcctaattaatagaaatatcattcttgtcctacagacaaaaatagtttttataaggacttttgacaaagtatatacagtataggtgaatttagtcaaaaatatttgccagattctcttggttctcatatggccatttgttcaatcccagtagctccaggataatagtgttcagttttcataggttgtaatatattgggcctttccagatttgttgtggaattctggacagttgatgtctaatcacaagttctgtggtacataatttgtaccatgcagtgttgcattttgctgatatagatggttggaggttcatgtgagtttaggaaatcagttccattagcactacagtttaatggctcagtgctatttgcccagaaatatattgaaattggtagagaccttcaaagttttaaaatgtaattttttattgtacactggtactgtaattctttggttccctgttgtctcattacagttatgcccttttaaagtcctctaaaattaagggccctgtagaagtgatggtcaactctattttccatatgaattattagatttggtgctgtcttgtgaagtaacttgatacgatagatgtgtagtatgaattttgtccacatggttgtgcccttggcagaactgcacgtacctgaaatggttccctaatttttttctagtattactatccaacacttcctctcataatcactagtgtattgtataattgttaagtgtcctttattcatatatttaaattaaaagag

SEQ ID NO: 50464 - DNA, 1062 bp, Homo sapiens
cagttacttgggaggctgaggcaggagaatcacttgaacccgggaggcagaggttgcagtgagccgagatcatgccactgcactccagcctgggcgacacagcgagactctgtcttaaaaaataataaattgtccatctgctcctgttatacatgttgatatatgctgctttgcagttgcattgtcaacatccattcccagattattgctgtcctgaagtaggataaacattttaagtagtgctactctatcttctagcttcactggttactttttaaattttatgtggagacaaggttttcttgctatgttgcccggggtggtctcaaactcctgtgcgcaagctatcttaccacctgggctcctcaagtgctaagactacattacaggggtcagccacggcacctgccctggtttttcaaattggatttaacatccaattagcagctaaactcagcaaatgggatattttgatctgtgtataattgaaattccaattttggcttctctggacaaaatgggaaacaatggaaatctttcatatgtatttgcatggccttgtcttttggaaataacaggtacagtgctgtcttctaatgttgagacagtaaaattttagtaagatttttcagctgaggaaaatacaggatcttaaggacttcttggagatagtattcatgctttctcatatacacagtgataggtgaattgtgtttagggttttgttttgggttggttttggtgcaatgtctaattacatttgccaactcatgttacctagtagggatatttccattctgtgccaattgatatttggtacagtgaatgtactcaataaaattaaaggtttggtacttgtttttgagatggtgaacaactaacgtgcaaatctgtagtccctaatgtagccttttgctatctgacatctgtttgacatatgctttgtcaaattgattcaactcaaacttgaatacttatgttttgccaaatttgtgtgatcacattgtgttactaatgtgtaacatcagcctgtaacttcagccacctactttttatttgtgg

SEQ ID NO: 50465 - DNA, 1271 bp, Homo sapiens
tattctagatgtgatatctttggcatcactgttcattcttttcctccttgattaaagtgaaacaattacattaaaatagttttatgatttaaaaatcattctttttttaagctattatttttaatgtaggtcagtgtgttatgtaaattgatgtccactacctgaacatgtgatgctttctcttttattccttggtatttcctccatattctctgagggccttcagtcaatttttttaaaggaaataataagttcaaatatgtatctatgacttagggttacaaagaatattttctttgcctccagtatactttgtattaaaaaaattataaaaggccataggtattcattttcaaatatttgaaaaaaaaaggcatggcacaattaaagcatatgcagaaccaacttggattattgctatatttctttctttctagtgtgtacggatattgatgacatttttaggtggctcttaacaagaacattttcctctctttagatgtgaatgcatagaattctttcatttggaccaggatcgttttaaaacatttcctttattttttgattaaatttttttccttttaaatattaggacttagttttttattaaatttgaacataatatatttaacatacttacggatacatttttgtgggcatatttctctgacaatttctcttattacaaaccaaacttgttagtgacctgattttgtgtgtgtgtgtgtgtgtgtgtgtgtgtgtgtgtgcgcgcatgcgcgcgtgttttgcatttctattctttgttttctagtttcatccctatgctaggacatggctgtgttcgtttctctttcactagatttttttaatgactgtaaggttattctacgcttgtaatctgcttttgcagtacttttccatcaaaaacaactgtgttacttctcatttaaatatttatttatttatttttgagacagggtttcgctctgtcacccaggctggagtgcagtgtcgtgatcttggctcactgcggcctctgtctcctgggttcaagcaattctcctgccccagcttcccgagtagctgggactacaggtggacaccaccactcctggctaatttttgtatttttagtagggacggggtttcaccatgttgaccaggctggtctccaactcctgacctcaagtgatctgcctgcctcagcctcccaaagtgctgggggattataggaataagccactatgcccggcctcatttaaatatctcttaatcatcttttacctgtt

SEQ ID NO: 50466 - DNA, 1336 bp, Homo sapiens
ttccctacttcaacagtttactagtctccatcttgaatgtttttattaatctattttgtgttaattctacccaggttttttgtttttccttgctactattatatatatttctgccagatgtcacatggtataaatgcctatatggacttttgtaacagaaaatttacttactagaattaatgtagggggctttttaataagagtgcatgtaacatagtaacagtagcagagctatatcagaaacagttctgataatatttcatgatctatagtttgttgcatgcccattgcttcatactgcttgtgttcttggttgagtcataagtaatttttatggggtgtgtcatgactgtcatattcatagagagttgtctgccttgccccatggtctttgcatggcttaaacaggaccccttttcatacacaagtcattcaattttatgtttttaatagcatcaattttagtgtttaacatgtgtctctggactatgcatcagaatacttgactgttagtgtgaaatgaaaattcatggatatcataatttatgtaacataatttaacatttctttattaataagactttagattgtccctttcacaaaaaaatggtgcggttaaaacttaatccttgtgtctttttgtgagtagttctatgatttctatatgatggcatccttgaaaaagttggtaaaaataagaatagttcttatttattaaagttcttctcaaattgctcttccaaaacattttagtttatactgcaatgttaaccattttacacttgcttaagtaattttcttcaaatacacacgagtccaggctatttaaccttattttaccgctatagcacaaaacaggttttccaaaattgtccttgcacacctgggattttacaaggatattataatcttggttcagtttgacttactgaatttgtagtaagtatattttagcacatagaaaattcaaaatatgtgttaatctgtttatagggtaaatttttatgagggtggatgtcatcctgttttttttttttttaataaatgttttgtttcagaatgttttttatttacagaaaagttacaaacatagtacagagagttcccaaatgctccacaccgagttttccctattgtttttttttttttttttgagatggagtctcgctctgttgcccaggctggagtgcagtggtgcaatttcggctcactgcaagctccgcctcccgggtgcaccccattctcctgcctcagcctccggagtagctgggactacaggtgcccgccaccgtgcccggctaattttttgtatttttattagagacgaggtttcact

SEQ ID NO: 50467 - DNA, 1050 bp, Homo sapiens
ggagtgcagtggcaagatcatggctcactgtaatctcgacctcctgggctcaagcaattcttccactccttccacctcagcctcctgagtagcccgtgccaccacgcctggctaattttatttttttgagacagggtttccttttgtcacccaggttggagtgaagtggcaccatcttggctggctgcaacctccacctcctggcctcaagtgatcctcccaccacagcctcctgagtagctgggactataggcgcaggacaccattctccactaattttttaattttttgtagatatgagattataagttgttttaaaaaaagtaatatgtgcaaatggtaaatagtacaaaattcaatttgtactaaagttgttttagttaaaagtcttctttctgcttttagattcccagttctcaatcttccttcctccttacaagatacaagcaaccttcaaccttcccagagatggtctctgtatatgaaagacaatggtcttattatgaagtcggcatatttatagcttgataaaaactgaaaaatctgtagcctatttttaatagtgatatataaggaaataacataaataaaaatttggcaacaagaatccaggagcaaatttatgatcaatacacaattgggcaagtggtgttcataccaaccatgcaaaaatggttcaattttaggaaatctttgaatatagcttttagtaggtcagaggaaatcagtatctcaaagtactttcatgatttagttatttttaagttattgatcattttggattttattttgaggttgatagccatataatgatttcacattttattttaaatggctagctgttgtcccaatactatttactgaaaaatctacattttgctcactctttttttttttttttaagagacagggttttaccatgttgcccaggctagatttgaactcctgggctcaagtgatcctctcgacccagcctcctgagtatctgtgactgcaggcaagtacccctgtgcctgctcacttatttaaagttctacacatcaaatacta

SEQ ID NO: 50468 - DNA, 1050 bp, Homo sapiens
atattagatttttattgtgtggtttcacatcagtgtaattagaatataggaaatttgtttaaaataataggccttttcatttgacgagatttaaaaacacagattggctgtggtatctgggcataatttgatatagataatagtattttcctccatatcgaaaattgaggtaagttttataacctctttgatgcattttcctagtagagttaaaaatgttgaagtatagccaccaaaacattcatgttggttatccttttttttttccttaatgaaaatgtactactttggtggaaaaaagttaataatttcgttagttggtaggtgaataatgagtgatagagactgttctgacaccaattgtctgacaccaactgggtatcctgcaattcatttcaattctgacactaactacccagagttaacacaaactaccaggcacacaaagtgttcatccaccaggaagctccttgaactttgagtttgcagagttttattggccacatgattaacttccttctccagctcctctttaatctctgaacatctgggggtgtggctaaaagttccaaccctctaaccatatgcttggtctgtctggcatggccagctcgtcctttcaaactatgtgagggcctaccttgagtcacccccaagtataaactcagatatagtccaaaggggcttcttatgaataacaaagacacttccattaatcaggaaattccaagcctctctaagctctgtaccaggaacaggagacaaagactagatttattcttcattatatgacagatacatttttatattttgcctctggttttagtaaagtttttgttgtgaagaacacaaatgccagatcaaatgagggggctgtaattagcaaggctgcaagggattgtgagcagtaagggagatagggattttactggaaatccaccaaaggaactggtatgtagctatgcctctcagtaaggggaactagaaagctattaggaaatcaaggcatctggagaaactatgtgtgtgtgcccaccaacatgttcatgt

SEQ ID NO: 50469 - DNA, 1274 bp, Homo sapiens
atgattgaattttccttttcccgcccatgcaccaaaatgatatggctctgatgagtggaggaacaccagggttcttgttcctcaggctggtttagataaaacaacatggacacatgtggagtggttttaaggagtggagagtttaataggcaagaaggaagagagaagacagatggaagaagctcccccttacagagacagagggaggggggcaccaaagctgaaagaggaggtcccccaagttcctgtttttattagcctggaacttgatagtaatgacattaactgaaagtaggacataaactatatattttagtttaatatgtaaaaggatcttctgcatcactaaagaagaaaagtgtcttgctgggaatgagattaggaaacaaatttgggaaataccattgttccttttttgtggagaaaggtaccctgtccaaaaagaaaaatgtcttgctttgctagataaatgcaccgttttgcctaaaaaccagtgtaacattttattctaagtcagaagtaattactgagctgtggttttgtgttctgtatgtataatctcatttattgacagttctaacctagtaatgaaagtgcaacaggagaattataaccagaaacatctaactgttatattatacatacatgtactgtttaactgtaattgtgaaaatgcattttgaaagttggaaaaaaagaaaggttgcctctatggtttggcagcttaataccgaaaagtagacagtgtcttgcgggtcatagatcatgggactcaacataaagtcatacagctaagacttgttacagcaacataataagcatatatagcctttctaaggttagcataagggaaaaagagaaggtagagtctggaggaaccagcgtgcaggtctccttatgctctctccctctcatgagtggtcatacagagcgcattcttgtagcaataaaaatttggcaacacgtgtgccatgtttctgctcgaggagcccattagagacttggcacccaaagtttctattgtaggttggtcctgtaggcactttctgctttgcatgtaccaaaattccacattcccagaaggaaagcaggtattcaacatgacccacttttatttgcacaaacaatctagtaaaaggccaaccttggcagcaggtcttcctaaggatactagtctcagtctgtgcacataagctgaatgtgtaaaatggttaaatactggacccttctgtaactgatcacatgcaaactgcttaagggcagaagtgggccag

SEQ ID NO: 50470 - DNA, 1050 bp, Homo sapiens
tgctgggattacaggcgtgagccactgtgccttgccacctattctgttttgaacttcattttcctaacaacatcctgaattactgagcttttgtatcacttcatgttaaagttttcattcttatgtaccaaagtactaatttgaatttgtaatgagtctgatggtatatttcaattttttgctttgagggactggctgctacattgcagaatatcttatatccctgactgctttccactaagtgtcagtggtgaccccaatccaattattatgacaactgaacatgcttatgcatccctcatgcctttattttttattttgggaaatctttcagcttcagtttttgctgatatttatgtgattctttgttctgcaattcaaatttctgggagccaaacagtctccttggttcagattactgttttttgactagagcttctcacttcagattctgtcataagattatggcttaacctatggttgtcctttgatttggtgccatatgaaataaaacattattttctatggctatgtattaagaattttgtgcaattctgtttttcttagaaggctgagggtgtgttgtcagacaccatgactgatgtgacaggtgtattttattatgcggccgccaggcagacaggcatttcttcatatttatatattacttaaatttaatattatttacataatttttttttttttgagacagagtcttgctctgtcgcccaagctggagtgcagtggcacgatctcggctcactacaacctccgcctcctgggttcaagcgattctcctgcctcagcctcctgagtagctgggattacaggcacccgacatcatgcctggctaatttttgtatttttgtatagatgggaggtttcaccatgttggccaggctggtcaagtgatccgcctgccttggcctcccaaagtgctgggattataggggtgagccaccacgcctggctatttacatatttttaaactagagccccttaacatattacaattttcatgtatggaatctctaatgtattcacccctgc

SEQ ID NO: 50471 - DNA, 1021 bp, Homo sapiens
tttcttactatgggttaaacaactttataagacattgtgaggaacctggtatcctctggactagatcattcccgtagacagttccattgtgcacacatagtatttcgttaaaatcaggtgactgtttaaaaattaaaaagattttagataaaaatctagatttttactttctcctgaaatatcagaagatggggtctaaattcacactgaggccaagcagtggtaggctcattttaaagaagggctttctgctctctggtttaccccattgtatactaattagcctggtcttacttttatatattacctgaatagccacttagggcattttgaacacgtggcttgcattgctttgtctttttgaaatccgctgtggcaggcccaaaccttgcctttggtgggcttaagtaaggtctggtttccagtacaaaggcaaaggcaaatgaggattattagtattccattttgccctatggatattctcagtgctttctactggaaactcacaaccaattctgaatatgccacatactgtgtgatttgcccttgctgtccaaccctgttcttgctgccatttaaaaataatcaggccaggtgtggtggctcatttctgtaatcccagcactttgggaggccaaggtgggtggatcatttgagctctggagttcgagaccagccagggccacatagcaagacctcgtctctactaaaaattaaaaaaaaaaaaaattagctgggcatggcggtggttcatgcctgtagtcctagcactttgggtgccaaggcgggaggatcgtttgagctcagcagttcaagaccagcctgggcatcatagtgagaccctgtctctatttataaaaaaaaaatgaaaaaaaaaaaaaaaaaaaaaaaaaaagaaaacaatcaggccaggtgcggtggttcctacctataatcccagcacttcaggaggtcaaggtgggtggatcacttgagcccaagagtttgagaccagcctgggcaacatagtaagaccctgcct

SEQ ID NO: 50472 - DNA, 2070 bp, Homo sapiens
gttacagaaaaaggtagtgggctggatttggtttattggcggtagtttgccaatacctgctttatgacactgtactcttacaacttctgctcacctagtttctgcttcgtcatagtgggctttctcatagttatgcctctgattttcccttgtaacttcttagaataccttcttcacctctcatctttgctactgattacctgtttccatatttcacaattttaagtttccgagagcacaggcgatagctaaattaagatgctttgcatgttaccactattatgtactttgcttggctgtctaccctgttgcttcaatataaccaattccaaatagctgcattccttttgagggtctcttccttgcaatccagagttcattgcaagaaatggggtgatttggatcattttaaggaagtttatggaattcaactctagtgtggtatcattaatgtaattaagctcttctctccttatgtgtatcatgttggtcctactacagtttggtttcctcatactctgtcttcctctaacctcctggttactgaatacttagattttttttctcattcataacttgagcttttgcaactactataggtgtgaccttccttctacattatctttctctctacagactatcgactttagctcttgctactctccatgttgccaagttgtcattaaactgagaatctgattccctgtgggttaagtttcctgagaccgcagggatagtagttgctatttggcaggtctaggacatttccccctactgattactatgtgcaaatgtatctctttccctatttatgatgcaaaattgctttagcctaacacaatccagctactataagtgtatccagaatcaagctctaaaactagaatgcaacccagtcatgtagcatccagaagtacctgaaccatctttggaacttgacagtttcacagttaactctgcaaccttactctccttatatcctgatgctattttatatgcctgttaggttgtatcagatctacattctgatctatagtttggagattataattttctaagcaaccctttgtgaggtcacagatactttttgtttgttactggttataggcattattggttctcatcactcagtattctttcccttttcccttacaccagatcataatatagtattctctctctctttttttttttttttggaaacagggtcttgctctgttgcccaggctggagtgccgtggtgcaatcttggctcactgcaacctccgcctcccggctcaagtgattctctcacctcagcctcccaagtagctgggaatacaggcgtgtgctaccatgcccagctcatttttgtattttttgtagagatagggtttcactatgttacccaggctgttctcaaactcctgagctcaaagcgatctgcctgcctcagcctcccaaagtgctgggactataagcatgagccaccatgcctggcccataatatagtattctgacttgacaacttagctaagtttattaggaatgtctttatttaattaatttggtaaattactaggaatgtagtagtttacattactgctatgaactcccttcttgctacatactcacttcctcatttctattctttatcccattgctaatggatagtttctgcttatttatttatttatttatttattttttaactaatagagacagggtcacgctgtgttgcccaggttattattgaactcctggcctcaagtgatcttcctgccttaacctcccaaagtgctaagattacaggcatgagccaccatgcctggccagtttttgcttatttatagcttctgactcctgtgcctattcctcacaagttgatcttatttaaatctttcatgcttcttacgtagctgtggtatgttcttttaccatgtatccattcacttcagctgagtttctgttcttctgtttttcccaattgcaaatttaatctaattttctcacgtcatccttgtttggggagggctttcatgttacaagtcataggctgttgatcagcgtgtagacatatgcctttgagtc

SEQ ID NO: 50473 - DNA, 2200 bp, Homo sapiens
gccactgtgccctccctacaggttttaaaatttattattatctaaatattcattttaaatgttaattttagtgtacttctttgattattttctttagagaaatttctgatttcagaaccaagtttattagcattcactgtatacattagcaccattaaaactagctagacccaagaagcagtattgaatgggtaccccttctttactttcctctgattcactctactctggtgctcacagctaagtaagtatgtacagcaatggcctgtcatttggtcgattatcttttgtgctctgaaatgtctttgttttttcatctgctctcaatacctctgtgctctgatcctttgtatataagggtaaccatatttgttctttcctgtgaaataataattcttttccttccattcagagtagctgcctgactcatacaatgaataaagtcacatagactcaaagagtggagatggaggtcggatgtggtggctcgtgcctgtaatcccaacactttgagaggctgaggtgggaggatcgcttgagcttgagcacaggagtttgagatcagtctgggcaacgtagtgagatctcatctctgccaaaaaataaaaattagctgggtgtggtggtgcatggctgtagtctcatgtagtcccagctacttgggaggctgaggtggggggtcacacatactttttgttgttactgcttcatcattggttctgatcactcagtgttctttcccttacaccagatcataatacagtattctgactaggcaacttagctcagtttattacgaatagccttaattaatttggtaaattactatgaatgaacatttcattcattctgctaggtctaggttttgccagctgttccattaagggacactatggcacgggttggcaaactttttctgtaaagggctaggtagtctctctattcaactctgctgttgtagcatgaaaacatccatagacaatatggatacaaatgagcatgattatgttctgataaaacctgatttacaaaaacaggtagtaggttggatttggcccaggggccatagcatgctgacccctgctctacagtatacatacacaaagactttcaaacaaagatgtatacaataaaacaaccattcagagttatttgattcacagtgtgtataatataataaaaataatacagctgtatttgagtcagcactgaaaagtctcttgtgatctgtgtcttacgtgcatgaattgcagaatattcatacgaataccatgaatattcttcacgggccatgttattaccatcccttagaggaatctcttccttgtcgtgggtctttctttgtatggcttagaagtgatgttgtctttatattgtgttatttgttcttaactttacattatcagctctggtgtgcttacctttttcaccaacgtgtcttctaccctacttacctcataagtgaatctaatacagaggttattttggatataatcattatcttaacaggcaagatagtgggctgtgctatttcaaaccctaaatttggctttcaggattatgaagtattaattcttccactgatatctcaaaaggtgatctggacaaaggaacaggtatctcaggtaagcaattgttgaatatgaaagtaaatattcttctttgatcgtttgttgtatttgttatgtttaatagctttcctaataatgaaccaactttgcatttctggaagaagattcgtacttttttgagacggagtcttctttttttttttttgagatgtagtctcgctctgtcgcccaggctggagtgtagtggtgcaatctcaggtcactgcagcctctgcctcctgggttcaagcaattctccagcctcagcctcccgagtggctgggattacaggtgtgcatcgccatgcccagctaattttttgtattttttttagtagagacggggtttcaccatgctggccaggctagtctcgaactcctgacctcgtgatctgcccacctcagcctcccaaagtgttgggattacaggcatgagccaccacgcccggccagattcatagttttcaagaattttgaattatatttgctaaatttgatatttcaaattttattttctattttatttattatttttttcctttatttatttattttttttgagacagggtctcactctgttgtccaggctgg

SEQ ID NO: 50474 - DNA, 1172 bp, Homo sapiens
gtgctttatgtaccctgtctcgttgaatttttacaaaaaactgaaagagttagttttgtgttattactacctccatctcaaagatgagtcttggaaagcttaagtaactttaggtcacattgtaatcagtggcagaactgggacttaagaacataattcatgactgcattttcttttctttctttctctttctttctctctctctcttttttttttttttttaaagagatagcatctcactcactatgttgcccagactggtcttgaactcttgggctcaagcaattcttccacctccgcctcccaaagtgttaggattataggcatgagccctcatgcctgccccttgcattttctatttaagtgatcttgaagtttttttttttcttttttaaatctcggaatttggcctttagtaagcatagaatagcaaagtgtaatacctgagctgggggaaaaagtccttgaattctttaggaaagacttaattggtgggtacaaagtgaaatgctcactggaatcaggaatcagaaaccagttctgatcacctatccctacatatccttcttcactctgccctggcatatcatggttgatgtacatagcaatgatcatcccttctgtaatcccacttgacagtttagaagtggattgataatactcttctggcttaaaacccttcttctctgggcaggtgtggtggctcctacattatcccagcaccttgggaggccgagatgggaggattgtgtgagcccaggagtttgagaccagcctgggtaacatagcaagaccctgtctccacaaaaaaataaaaaattaactgggcacggtggtgctcacgcctgtaatcccagcacctggggaggccgaggcgggtggatcacgaggtcaagagatcgagaccatcctggccaacatggtgaaaccccgtctgtactaaaaatacaaaaattagccaggcgtgatagcaggcgcctgtagttccagctatgggaggctgaggcaggagaatcagatgaacctgggagacggaggttgcagtgagctgagatcacgccactgcactccagcctggtgacagagtgacactccgtctcaaaaaaaaaaagaaacgatcacatccagatgtcctgttactggaagggcaccatagtttatcctgcacctaa

SEQ ID NO: 50475 - DNA, 1022 bp, Homo sapiens
tattatctattttgtatttaataacattctaactttttttttccagtgaaggatgaggattattggatttagaagtgccaaatgagctattacttactgctttttgctatccggttacactgggttaatccagttagttgtaagctcccatttttcagcattttgctagctgtagatattaaaccaggctcatgtgggtagtagggtggggaggttaagaggagtataagcaaaaaggaaaaaaaaaagctcatattttagaggaggggattgagaagttcctttattggaagtctgtgcatggaagtcccattttacatcatgccagtgtctagttcccaattccgtctatggccacgggttagggaaagcctgaatatttgaaataaccgaaaagcatttaacctttgatttctataatttgttcctcacctctcttgatgttacagccagcagcagcctggagcagcaccccctgggaagaaattttacatcggccattataatacaacctgataagtgttatagcacttatcagattgtattgtaattgtctgtgtatatgcctgtctctcttcctgttatcagttagactgtgagctccttgagggcaaggaaggtgtcttcatctccagagcccagcctggcacattagtaggcctcagtaaatgtttattagatgaataaatgaatgactcatcagcaaacatttattgtgtgcctgctaaagtgagctccacaggctctggattgtcagctgtttcttcaaaaagcatgtggtcagaaatttgatatttctgtatatatcttcctaagagtttctcatgagacaatgccatttttgtgtttggatttcagtccttgatatttacagatgttgcaactgttgctattgctgacacttgctttcttggtgggacttgagtgataactgttagattggggcctcatcctcagggcccaggtaatcatccaaatagtattcttagataggactttgcatttttctttctttttttttt

SEQ ID NO: 50476 - DNA, 1033 bp, Homo sapiens
tcgagttccagttccagttcgagttccagttccagttcaagttccagttccagtcctagttccagttccggtggtgaaagttcagaaactagctcagatttatttgaaggcagtaatgaaggaagctcatcatcaggctcatcaggtgccaggcgagagggtcgacatagggccccagtcacatttgatgaaagtggctctttgcccttccttagcctggctcagtttttcctcttaaatgaggatgatgatgaccaacctagaggactcaccaaagaacagattgacaacttggcaatgagaagttttggtgaaaatgatgcattaaaaacctgtagtgtttgcattacagaatatacagaaggcaacaaacttcgtaaactaccttgttcccatgagtaccatgtccactgcatcgatcgctggttatctgagaattctacctgtcctatttgtcgcagagcagtcttagcttctggtaacagagaaagtgttgtgtaattaagatctgaactctcagctatgtagctgatatagtgatgggcaaacaggaatcacttgcttttatgtccactttttgagtggtacttaaatgtaaagtaacaacctgaattgagtcattgctttctgaaggaatcattgtcctttctccagtttttgttccagaataaaaggaaatattttaaaagccacgttataggacctaaaaatctgatttccgtaccagttaaattggtagcatcactgttactgataatttatcatatacacttgtcaatttttcctttgttatcttaaaagatctgccttagcaatggctcctttttcatgttgatctttaaattttcccacaccataagagaggagcaaaggaaattaccagtttagactaagttacagtatgtgtttcataagtgattaaagctatatcattcccagttattagttaacacaaattcagccacattctgagtattgtttgttcacctttcagacttggtgatactggacatgtcagtgtaaataacactaa

SEQ ID NO: 50477 - DNA, 1072 bp, Homo sapiens
acgtccttcagttttcaaaatgggaaagcgaaggttcccacaattctcagaacgcaaatttctcgccacaattcaaaatggcggaggagggtggggcctgtcacatggtgggcgtcataacagctttccttttccaaaccgccgcccgccttgccgcgtcgtctgccgtccccctcctcctcccgcggagccttttcgaggaatcgactgggattggctaataggctgggagtggggctgcggtgccgggacgcggcatcatcacttcctgttgtgggcagtcgtttcctgtcgctgcttggtaacaatggggaagataatggctgcctgagcaacgtctccgagcaggcgctgggctagaggcgggtctcaaccagctactcattggaggcgggcttgagagcggcggccagggaggtgcggagcagcctcggcggcggcggccgaaccaaccgagtcggatcctgaccctaaaacctagtaagtgaagacttgggaatcctgtgagaaatgatgtagagcgagaggaagacagcggagccgcggctgccgcgttctctcaaaatggcccgagtgacgcgtcgtggcagaggctcagcgccgcctccggaccccaggcccgttgctgcggggggctccgtggcgtagtcgccgctgccattttagttgagtggtatagtcgacaggctctttgaaggggaaggaggtgggtagtacttcctctcggtggccgcgcgagctgcagcccaggccctccggagccttaggaaatcgggggaggcagtttttgagttttggcctcaggcgtcagaatcttagaacgtctcaggctttttcttctctgttctctggaggcttccctgacctccccgcgttttccatggcgggcttgggtttgggaaaagggaagtaaaaaatcaggctgccccaagtgagatgctggcaactcttgggcctttagatttccaaaacctcattttgagcccttctgcagggtattaccaattaggcgccccctggggccgcgatgacatcttccctgaggatctgaggcaaatgtggtttactccct

SEQ ID NO: 50478 - DNA, 1025 bp, Homo sapiens
aaggaattagtgggagccttttcatgtattcctttataaactgagcaggagagaaaagaaagagctagaaaacttttctctcttactacctgaccactccttcaatcttaaaaccagttcgtgcaaaccagaaattgtagtatgtacagaatatttcaagtcacaactttctgggatgaatggtttccatacccaaagagcctcctgcctttaaggagtcatcagttgaaaagaaacagtcagatatctgtggcattacctactggccagagtgggatggagaaagtggtctgaagtttagttagcaaatgttgaatttcagggttgaggaaggggaagtatggtatctagataaggaagaaggcagcaaaggggctgagagcttttcaactttggtgacaaggatggggaggagtaagtgggaacagacactatccttacttggagagtggtggttgctgaggagaaggacttattgctttatattgaattttagcattaatactttctggatctctgagatggagagttgacagaagaacctaggaagcatgactaagtggttgaatctgctatggaaaaaggggaaacggggcaggcttttacttatttgaacctaggtactttgtttctttgccacctaaaagttctgggatgaactgaatgaggaatatgaattgagcagataagattccttttactggagaaaaactaagtcctttggaaacttgaacttttttctcattcaaattcatttctaggccttattcattcattctatgtttttttttttttttacacagtagccaccgcccccgcttcacacccctaccccctacccttcccagcctctggtaactatccttctactctctgtcttcatgacttcaattgttttgatttttaaatcccacaaataagtaagagcatgtgatgttcttggcaactttgtggaaaatgagttcactgtaggtgtgtggaattgtttctggattttttattctgttccattggtctatgcacct

SEQ ID NO: 50479 - DNA, 1032 bp, Homo sapiens
tgatatttaaaattgggtctgtaattggatcatcttttaaaaatccattctgacaatctgttttttttaatgccatcagattcagccatgatgacaatctgtgttttaattggtgtagactattcacatttaaaatgattaactgatattgttggattaatattgaccatatgtgtaactgttttctgttcatttcctttcttctttggtttttgcttttattttactttttcttcaatctttttcttccttctctggctttaattaaacattttatatgattttgttttttctaatcatttaacattccgattatactttttaatttttaagtggttgccatagagtttgcattatacatttataggcagtctaattccactttaatatgacactattactgcttcatgggggtggtacacataacagtactcccaattcattccccctatcacttacacactgctgtgattcatttcacctatttataagctttaattaccaatacattgttgctgttattattttgaagaaacttatctgttagatgaattaagaataaagataaattattttattttacattaatttattccttctctaacattgcttcccaattaaatgtaaatctgaggttttgaccaatatcatttgcattctctctggaaaactttatttaaaaacaattcttgcaagatccatgtactagcaacaaatttcctcaatttttgcttttgtagagagtgtatgtttttccctcacttgtaaaggacagtttcactaggtgcagaattctaggttggtggattggtttttttcaacagtttaaatatttcattccactctgttcttgcttgccttcactgttatttttattcttgttcctttataggtgattcccctggcttcttttaagattatttttgtctttgatttttgtagtttgaatatgatatgccaggctgtaccttttgggagttttttttttgttgttgttgttgttgtgtttttttttttgtttcttttgttttg

SEQ ID NO: 50480 - DNA, 1044 bp, Homo sapiens
ccagtattgttttcttcttcagtattctgttggctgttttgagttttttgcctttctttataaactttaggatcagtttgtccatatccacaaaattacttactgggattttgattggggtcacattgaatctatagatcaagctggagaaaactgacatctcaacaatattgagtcttcccatacatgaacatggagtatctctccatttatttagcttctttgatttctttcatatgagttttgtagttttcctcatatgctttttgcacacatttgttatatttgtactgaagtatttcattttttgttgttaatttaaatggtgttgtattttttatttcaaattgcatatgttcattggtggtatgtgggaaagtagttgacttttgtatatgaccttgtatgctgcaaccttgctgtaattgctttttagttctagtagggttttttgttgatttttttttttcagattttctgtatagacaattatatcacctgcaaacaaagacagttttattttgtcctttgtagaatgaatacctttatttccttttcttattgcattagctatgacttctagtacagtgttgaatataatgtgataaaagaggacatccttgccttgttcacagtttagtttcccaccattaagtatgttgttaactttaaggttttttataggtgtttgtaatcaagttgaagttttcctctattcctagtttgctgggagtttttgtaatgaataggtgttggattttgttaaatgattttttttcatctgccatcatttgatttttcttctttagcttgttgatgtgatggattacattaactgattttcaaatgttgaaccagctttccatacccagaataaattccacttggttatgtcgtgtaattgtttttatacattgttgggtatgatttggtaatattttgttgaggatttttgtatctatattcaggaaagagggtggtctgtagttttcttgtaatgtctttggttttgatattagaatggtgctgttttcatggaatgag

SEQ ID NO: 50481 - DNA, 1034 bp, Homo sapiens
atccccagatttttaaaggattttggagctttattcctgcatttaaatttttatttatatgctgctttgaagaggcatctgctagtaaatttagttagccatgtatcttaataaggacacaaataatgaagaccctaatgaaaggattctttctgagattttgcttgacatactcttttttatgttagaaacacattcttattgattggacacagtcagaagctagtagtttttaaagagaaattttcacttacttaagcaattggagagcttgatgtaatcagaagaagtgaaacagtaacttggaatattaaaaattggtattaaaacttggagtaacttggaggattaaaaattggaagattgggaagaggtttgttaaaatgagtggacacattagaccagtgggcaagcatacctggatgacatggtgaggctgtattccagctctgatttcatacataatcaaatagccttatgatcttcatttgatttctaaaattgtctttcctttgggatagaaaattcattgactggccaacttgaatatcagtctggcgggtagttctttttattgtaaattattaaatggactgtaaaatacaaatccatcttatatgtagcataatccatttaaggaaagggtctaatcaccaccgaataagttcttcattgaactttcagaccaacaaagctcggaaaacaaaccctgaagtataatgtaacaaaaattgtaaagcctttcctgacaactcatacatattttcttctcttatcccaaattcactatatgtatctctccaacaacacaataaaaattttccagttatactctggattttttagacatcgactgaactcgctagtttttgaccttctttttataaatccattgttatctttaatagtactgaagtggtttcttccttttattgcagttgttgggttgaggagacagttcttttctctggatagtttgcttatccctgaaattatggacacttccaaattttcttctagattggttctttagg

SEQ ID NO: 50482 - DNA, 1035 bp, Homo sapiens
ttatgcaacttgccactgtttgccttataagtgtagcatttaactcatttacatttaaggtgaatattaattaaggtgcatatttgatcctgtcatcgtgttgttagctgatttttatgtaggcttgattatgtatttgctttatagtgttgatggtctatgtatttgagtgtgttttgtggtttttggtaatggtcttttgtttccgtgtttagcactcctttaagggcctcttgttaaggcaggcctggtggtaatgaattcccttaacatttgcttgtctgaaaaggattttgtttctcctttgcttacgaagcttagtttggctggatattaaattattggctagaatttcttttctttaaagatgctgaatatagttccacagtctcttctggcttttagggtttctgctgaaatgtccactgttagcctaatggagttccctttgtagatgacctgccccatctctctagctgctttaatatgttttatttcatttcgaccttgggggatctgatgactatgtgtcttgaggatggttgttttgtactgtatctcacactgacaggaattctcgcagaatttcctgaacttgtatgtcagcctctcgtgaggttggggagatttttgcatacagtatcctcaaatatattttctaagttgctttctctccctgtctttcagggatgtcaattagtcatagatttggtctgtttacttaataccatatttctcccagattttgttcatgaaaaaattatttcttatttttgtgtaactgagttaatttgaagaacctgtttttgagctttgagattctttcctcagcttgattcattctgctgttaatactcccccttgtgtttcgaaatcttgtagagaatttttcagctatttagctcattttggttctttcttaacatggctattttgtctttcatctcttaaatcattttattgtatacctgggattcctcagaatgggtttcaacgttttcctgaatctaggtgatcttcatcgtggtcccaatt

SEQ ID NO: 50483 - DNA, 1034 bp, Homo sapiens
atttgtactgttaattatcttggacacataacttgttcttttggacatcagatcctgtaaactagtaatatttgactaccagatctctaaggtttcttgcaactctcttgtttctttactgtaatcctttaggaccagccctttttatatagtacctctactttgtgatcctagtttactactggtgtagtattcaggagcaacatagggtaagtttatgttcacatgaatttttaatgggacaaatttgtattgttcttgtcatatttgtatatctaagagtaggaatagaaaaatgtaatttaattatgagcttagtatttggtagtgttgggaggatggaagtagtgtggaggaaaaagtaagctaggttccgaaatcatctgggatggtagaaatagattctaaggggtggtgaagaataacagtaatgctataaaagttgtaaataaagatataccttacatgggctgtatatggtaaggaatggaaagtggcactgggacttgagaagaggaattcaggggattcttttttcagatatagttgaataaataacattctctaagtcattgacacattggttttaactagttattaagattattaggaagaggaagaaaatttcatgtttctaaactttcttttagaacacgaggccctttgagaatctgatcaaagccatagaccttctccctagaaaaatatacatacgtatgtgcttcattttgcatgcaatttcaggggaatcagaaacctatcccctcttccagtcagtaatccctgattaatacaatattgctggctggtgggtttctaatggtgttcctgagtagccagtggcaagataaagagcacttgtcactgggcagcggggtagaaatagagtggaaacttacatcaaaattttgattaaatgataaatgcataattgatcatttaattattgttatacaattgttataaaattaatatcatttattgctgtattgttgtcagtgttatcttaaagattttgctttttcaaagaaaag

SEQ ID NO: 50484 - DNA, 1027 bp, Homo sapiens
aacatcttgagttgatggaagatattgtggatttggcaaagaaagctgctaatgattcactccttattggaggcttattgagaattggttataaaatagaaaataaaatcttggcaatggaagaagctctgaattggataaaatatgcaggcgatgtaacaattctaactaaattaggatcaattgacaattgttggcctatgttaagtattttctttactgaatacaagtaccacataactaaaattgtaatggaagactgcaatttgcttgaagaacttaaaacccaaagttgtatggattgtatagagcaaggagaactaatgaaaatgaaaggaaatgaagagttttccaaagaaagatttgatatagctattatctattacaccagagccattgaatatagacctgaaaaccaccttctttatggtaaccgagctctttgttttcttcgtactggacagtttagaaatgcacttggtgatggaaagagagccactattctgaagaacacttggccaaagggtcattatcgttattgtgatgctctttctatgctgggggaatataactgggccctgcaagcaaacataacagctcaaaaactctgtaaaaatgaccctgagggaatcaaggatctaattcagcagcatgtaaagttacaaaaacaaatagaagacctacaaggtcgaacagcaaataagaatccaattaaagccttttatgaaaacagggcctacacacctaggagtttatcagcacctgtatttagtacttcacttaactttgtggagaaggaaagagatttcagaaaaattaatcacgaaatggctaacggtggtaatcagaatctaaaggtgatggatgaggcattgatggtagatgattgtgactgtcatcctgaattttcaccaccatcaagtcagcctccgaaacataaaggaaaacaaaaatctcgaaacaatgaatcagaaaagttcagttctagttcacaattgactttaccagcagatttgaagaacatctt

SEQ ID NO: 50485 - DNA, 1006 bp, Homo sapiens
cccacgtcttgcacacactatccctgaatatgctgagttcaaacgaagtgcctgcctgcgattttttccccctttacttctccaaaggatctttccccaactgtagccccctgtcacctccccaccccaccacacacaccccttatattctgatgcctaagtgtgtgaggtcgggaggacttgtagaaccttagaatgccagggatggtaggggtcttagagaccatgtagcccaggcccctacctttacaatcaggaagacaaagtcccagagaggggaaaaggtgccctagggcactcatgtcttctagcttttattccagttctcattccactccattcagatgcctcttactgcatttaaattctaattcattttcttcaatccgccagaccgcattaagcaaattttcagaataatgggtactgaatgaactaagctttaaaatgagaaatgttagtgagaagtagaatatgtaaaccaaaatgaaagggaaacattcttgtgataactgtaaaacaggaagccccctgacacatcccctaaacctttaatttggcatccagtatatgggcttcaggattttgtttcagagggatatttaatttctttaaatggttctttcaccacgctcagcatggtttaggccaataggatctagaagctctgttctattttctggatctcagtatccagtgacaaggatagaatcattcagccttccttagaccaggcaagtttatgcaccgagtactttaaaatcctctatttcaaatgagaaatgatgatatattcacaagaaaacaaaatagaaagctctgtgttagtatagtgatctctgtcagaataagggtgactgttattgagttacagagatgtaccacatggaccatgaacagttttcatatttctgaagaaatgaaagacagcaaaatgattttttttttttttgagacaaggtctcgctgtgtcacccaggctggaatgcaatggagtgatcttgac

SEQ ID NO: 50486 - DNA, 1049 bp, Homo sapiens
caccagactcagtctcaagtgacttggctatctccaaatcagatctacccttagagaataaacatttttctaccgttattttttttcaagtctataatctgagccagtcccaaaggagtgatcaagtttcagaaatgctttcatcttcacaacattttatatatactattatatggggtgaataaagttttaaatccgaaatatatactgtgtcaaagctcaatatgtgccaggtaactaaactgttaacatcactagcgttggatgtaataacaggatagtggctcacccccaagagctgccataaaattccattatgataggtactaccaccgtctctttggaacaaccttcctgacaccattgtgccactaaactaagggaatcatccttcctcgctttctagggatctttttgatagcgactgttgcacacaccttcaccaagaaagagagcatataaattgaggccattagtaaagataaggatacaactataattgaaagaatgaaggagtgaggcaaatcctaaaatactgcaggcaggccgtctttaatacagcatatcacaagcaatctctacccagcaacactcccccacattaagttcctgaacattctacccttctctgatagaaacatgtaagggatgagggagcttggctgtaatcttcagctttgcaaatacaatgactattaagagactttcctattaagtatacccaggtccatccctatgctccttgtgtcgtatatgtgttgtttttcaagaaaggtgaagaaagatggcttatatgcaaggatgggatttgttttagttatatggggagaaagtatagtactgaaagagagcaaagaaggatcgggaaagagactaaattggagtggattgatgaagagccttgaaatcctgaatgagtaattcagtacagaggataacaagggtttgtgaggcagatgataatgtttagcaagtaaagatggctatttgggtgagggtaatttggtttagaatgcaaggtggaagattggagacaggaagataattgg

SEQ ID NO: 50487 - DNA, 1068 bp, Homo sapiens
cataaaattgtcataaaattaataaatttaggaaagaataaagatttatatattcattctttacatataaaaacacacagctgagttcttagagttgattcctcaagttatgaaatacttttgtacttaatccatttcttgattaaagtgattgaaatggttttaatgttcttttgactgaagtctgaaactgggctcctgctttattgtctctgtgactgaaagttagaaactgagggttatctttgacacagaattgtgtgcaatattcttaaatactactgctctaaaagttggagaagtcttgcagttatcttagcattgtataaacagccttaagtatagcctaagaagagaattcctttttcttctttagtccttctgccattttttattttcagttatatgtgctgaaataattactggtaaaatttcagggttgtggattatcttccacacatgaattttctctctcctggcacgaatataaagcacatctcttaactgcatggtgccagtgctaatgcttcatcctgttgctggcagtgggatgtggacttagaaaatcaagttctagcattttagtaggttaacactgaagttgtggttgttaggttcacaccctgttttataaacaacatcaaaatggcagaaccattgctgactttaggttcacatgaggaatgtacttttaacaattcccagtactatcagtattgtgaaataattcctctgaaagataagaatcactggcttctatgcgcttcttttctctcatcatcatgttcttttaccccagtttccttacatttttttaaattgtttcagagtttgttttttttttagtttagattgtgaggcaattattaaatcaaaattaattcatccaatacccctttactagaagttttactagaaaatgtattacattttattttttcttaatccagttctgcaaaaatgacctataaatttattcatgtacaattttggttacttgaattgttaaagaaaacattgtttttgactatgggagtcaactcaacatggcagaaccatttttgagat

SEQ ID NO: 50488 - DNA, 1049 bp, Homo sapiens
ttgaatgtataaattgctttgggcagtatgaccatttcaacaatattgattcttcctatccatgagcatggaatgtttttccatttgttttgacatctctaatttcttttagcagtcttttggagttctcattgtagagaccttttacctccctggttagctgtattcctaggtattttattctttattgtggcagttgtgaatgggattgcatgcctgatttgcctctttgcttgacttttgttggtgtataggaatgctactgatttttgtacattgattttgtaccctgagatattgctgaacttgtttatcagcttaagaagcattttgggccaagactagagttttctagatacagaatcatggcatctgcatactgtgatagtttgactttctctcttcctatttggataacctttatttatttctgtttcctgattgctctgcccaggacttctaatactatgttgaataggagtggtgatagagggcatccttgtcttgtgccagttttcaagatgaatacttccagcttttgcccattcagtataatgttggctgtgggtctcctcctggcggaattccagaggcccgaggcaagagccagttgcttcttgccacttcaactcactcattcccctggagttcttgtgggccaggaatgagtcctggtgtgcggtagccccattcagggttcccagcttcctcctccaaccaagcttctgtttcttccctccgcccactctcattgccttctctctgaagatctgttaggagtgtgccagtcatccttgtctttcggtggcagcttttccaccttgctgcatctagtcatccatcttgcccaaccccattattcttttttttttttttttttttttttttgagacggagtctcgctctgtcgcccaggctggagtgcagtggcgcaatctcagctcactgcaagctccgcctcccgggttcaggccattctcctatcttagcctcctgagtagctgggactacaggtgcccgccaccacgcccagctaattttttgtattt

SEQ ID NO: 50489 - DNA, 1106 bp, Homo sapiens
ctgactcgcttgggaaatagcaccttcttcagttataaaatagttataataaattgctatcttactgtttgaaagtaagataaatatactcattaacttctattctagtgcattatagatgcacaattaaatatataatgcccaatattatgaaataaatgatttaaagctagaatcaattgtaaattaaataggaaagactgggtttttattataccaataatgacttaattgaatctgaaacacattataaaatgtgcttatggattcttctgcattattaaattattggtgtgataaaactcaaacttttttaatcttcctaacaagactctttgagcattgatatggtttactccactttattgatactgaattttgctgttctcttcaattatttaaagagttttaaaaccgactgctctaagttggcaaatggaaggattccctatactttaacactatgctgtctttctgccttatataacttatttcttgcattcttctaggacctcattaatcaaggaagagaaaaagttgtagaagcaacaaacagtgtgacagcagtgaggattcaacctcttgaggatataatttcagctgtagtaagctaattggcaattgtcttattccaacctccaatttgtaccctccaccccctactgccatttttttaaatttttaattgttccttcttataaattgatttgcaatagtaaaatactggtaaaatggatggataatgccaaaccgtaacccagcaattttacatagatgttggcacaagagagaaatgggtaaaatgtaagaattgagaaatcaaacatggaaatgtatgcattgtttatataaacattttaattaccagttgtacaaattaaatctaaattattgtttcattccagagatagccagcccaggtacagcagtgaacaacttagtaccctgttttgcatcatgtttttcttcagaaaagaataaaggaaaaggggggtttgaaaccttgggaaatcccgaatatcttaaaataccttaattatttttcctcaattgtacagtaataaggagtaaatagaaaatttttcttttagtggaaggagaacatg

SEQ ID NO: 50490 - DNA, 1042 bp, Homo sapiens
aatctgctttagcatcatcgtgatgctagctggttattttgcagacttgtttgtgtggttgcttcatagtgtcactggactgtgtacttcagtgttttttttagtggctgataatggttttttctttccatatttagtgcttccttcaggacctcttgcaaggcaggcctgctagtgatgaatgccctcagcatttgcttgtctaaatgggatcttatttctcctttgcttatgaagcttggtttggctgtatatgaaattctgggctggaatttcttttatttaagaatgttgaatattggcccctaatctcttccggcttacaggttttccactaagaggtctgctgttagtctgatgggctttcttttgtgtaagtgacctggcctttctctctggctgccctcaacattttttctttcatttcgaccttggataatctgatgattatgtgtcttggggttgatcttctcgtggaatatcttactggggttctctgcatttcttgaatttgaaatttggcctgtcttgctaggttgtggaagttctcctcgatgatatcctaaagtatgttttccagcttggttccactctccctgtcagttttagggaccccagtcagtcgtaggtttggtctccttacataatcacataattctcagaggttcattccttttcattcttttttctctattcttgtctgcctgtcttatttcagaaagatagtcttccagctctaagattctttcctcaccttggtctcttctgctattgatagtttgcattgtgaagttctcatgttgtgtttttcagctccatcaggttggttatgttcctctctaaactggctattcttgctatcagctcctgtattgttttatcgtgattcttagcttctttgccttgggttaaaacatgcttttttttagcccagcgatatttgttattactcaccttctgaagcgtatttctgttatttcatccttctcagcctcagcccagttctgtgctcttgctggagaggtgttgcagtcatttggag

SEQ ID NO: 50491 - DNA, 1469 bp, Homo sapiens
gttcgaggctatgtagtacataatcacacctatgactagccactgcattccagcctgggtaacatagcgagcccctgtctcttaaaaaacaaaagatgtggccaggcatggtggctcacacctgtaatcccagcactttgggaggctgaggtgggcggatcacttgaggtcaggggttcaagaccagcctggacaacatggtaaaaccctgtatctacaaaaatacaaaaaaaaaaaaacacaaaaaaattagccaggcatgtggtggtggcaggcgcctgtaatcccagctacttgggaggctgagccaagataattgcttgtacccaggaggcagaggttgcaatgagctgagattgcgccactgcactccagcctgggtgacagagtgagactctgtctcaaaaaaaaaagacataatttaaactgctaaatagctgctttcattcctatttcatatcttctgtttcctttttacattgtacctataattgagttagagaatgtaacaatgtttgtgaaatgttaactcaagattgtgtagaatgaaaattgagtttcgattcaggctatacttggaaagctgcaacctctagaatgtcactgcagtcatataaaatctagaatgatgactttctacctcacagtggcatgtggcatatgtaatagttgtaatggatatccaatttttaaaggtaaattgctaaatatagtatctagttctttaagtgttaaggagaaaacattcttatcaaaggaggcttttaccttccacctaagtcattttggcaggcctgccttttctttcatttaaagtgataagttctgtagttgtcactatcttattcataccaacaatttgggaatctggatatatttataaatgctctttggcaaaggttatgtgctcgtgaccaaaaaatctgatacaaggtgttatgtgaatttcattcaataagctctctagttacttatcaaattcactgcattttttccagcgtagtttgggaagaaagaaccttcaaatttgaaagtagaggctttttgaccaggaatattaaatttctttactaagaagctagatttatttaagcaataaaaggaatttttcatagctttttgagtgggtcatgtggcagttaagtattctggtgattttatttccagatattacaaaactcaaattgaaagtaatggcaagcaaaatatttttgaaacgtggcaaaccccctcccttacccccaggcaaagccttgattatttttttagatattttattttcaaggttgaatttcagaattaattagatgggaatttttgtcagcttgccaaatactttaaacttctaagtaaattaacttaaacttataatttatcattaattttgttttattaattgaactagtcgttttaaaagcttaaactaatttagattgtgagctagaatatagaccttgcttttccctgtg

SEQ ID NO: 50492 - DNA, 1049 bp, Homo sapiens
aaaccaggcactgtactcagcacttcatgtgtagtatttaatctccacaataatcccatgaagtagatgcttagtagcccattttatataccagaagactgagggttcagcaagttaacttgctcaaggacaaagggctaataagtggtggaactaggattaaaatctgcttgagactcactgttcaatacaagagccactagctccatatggctacttacatttacattaaaattaagttaaaaaatcagtttctccatcacattagtcacacttcagatactcagtagtcacatgtggcttgtagctactgtcttggatagtgcaaacacagaacatttccatcgttgcagagagtactattagagagcagtattccagagcctgtgatcttaatcactacacctaaagcctcccagttgacaaagttaccacctttttttggtgtgtgtgcacgtgcgtgtgtgtgtgtgtaagtatatataatttaaatcattccattaaatttacctctgaaattcaaaagactgaaacagatcttctttttatcaaataagttgattgcagagattatattggtgtttacatttcaggcaacctgctcatgaaattatccattgtagagagaaacctgggaaacaaagctatacgtcctttaatttttttccccattttcatttaaagttcagaagaacataatatgttggaatgatcaatgattctgaattaatatagatatttgaatgtcacagtatctgtatattaatatcctaaagtggtgttactatattggttaggttgactgattcatacatgtaagtcttttaacactcctggagtaagagtagcaagaaactgaagctatgatccttttaagggtttaagtaggtgaatacctcacttttgtctcttccattactagtgttttcatgaccaagttttttacatcagatttattattttggacccttaaaggaatataaattgcaagagagattttgatcagtgtaagaattactagatggccttatttatttccttctttatta

SEQ ID NO: 50493 - DNA, 1035 bp, Homo sapiens
gtgtgagtgggcatcatcctacccattgagggcctgaatagaccaaaaatgcagaggaagggcaaatttgctctctctttctttgagctgggacatccatcttatcgagcccttggagattggtaatcatggttcttcagccttcagactcagacagactaggacttataccaactgcccccacccacaaccctacccccggattttcaggcctttgaactgggaccaggatttatacgattagctccctggttttgcagcttgtgaacagtacattgtagcacttcacagcttccataatcacagtgaggctaatgccgtaatatgtctacacacacacacacacacacacacacacacacacgcatgtacacacaagttcttaactccttttggttctgtttctctggaaaaccctgactaatacaaacgtcatttcacattaagagtgtaaaggcaagccacaaagttggagaagctatttccaatatatagatataaaaaggtctcatccaggatatataaataactcttaaaaatcaattggataaactagacaacccaatagaaaaatgggcaaaaacttgaacaggactttacaaaagacgatatctgaatggccaataaatgtatgaaagcatggtgatccttattaattatcagagaaattcaagttaaaaatggttttgacaaaagatgcaaaagcaattaaatggagagagcatagccttttcaaaaactggtattgaaacaattagactttcataggccaaaaacaaacctttacttaagccttacccatattttaaaaaatcaagtcaaaaggaatcataaatctaaatgtaaaactattatacttgtataagaaaacagaagaaaatcttctgcatctagggttagtcagagttcttagtcatgatgccaaaggcatataacccattaaataaaaaatcaataattggacttaatcaaaaataaaaacttttgtctgtgaaagactcttagggaaaggaaaagacaacttatagacttgga

SEQ ID NO: 50494 - DNA, 1439 bp, Homo sapiens
gacttatatttattatttgctgttacttctccctaatgtttcagtattcctttttatatcatttgctttgtatttagagaacttattgtagccattcctttttttttaagcagggtcttgctctgtcacccaggctggcatacagtggtgcaatttcagctcactgcagccttgacctcctaggcttaagccatcctcccacctcagcgtcccaagtagctgggactacaggtgggcaccaccacacctggctaatttctgtattttttgtagagatggggttgtaccatattgcccaggctggtcttgaactcctgagctcaagtgatccacctgctttggcctcccaatgtgctgggattacaggcgtgagccaccatgcctggcctagccattctttaacagcaagtccgctggcaacaaatgatttccccttcattcttgaatggtatttcagctggatatagaattctgggttggcaattctttcctttcagtacttgaaaaatatgtgtcactaccttctcgtctccctggtttcttatgagaaacctgctgtttgaattgtttttccccccttagataaggtgtcgtttctctcttctttcaagattatttttctacgtttttggaagatgactgatatattttgtcacgtatttgtttgggtttatcctgtttgtggttcattcagctacttaagctgcaggtttatgtttcttaatacattttggtaattttcagtcattatttctttgaatttcagcccctccttccttctcctcttcttttaggactctaatgacaaaaatattaaatcttttgttatagtcccatgggtacatgagtctcttttccattccatttttctctgttgttcagattaggccatttctgttgtttagtcttcaaaatcaccaaatcttctgttctctgctttctactgaacacattctgagtttttaatttctgttatatttttcagttctaattttttttttttttgagacagggtctcactctcgcccaagctggagtgcagtagcaagatttcagctcactgcacactccaccttccaggttcaagcaattctcatgcctcagccacccaagtagctgggattgcaggcatgcaccaccacacccagctaacttttgtaattttagtacagacggggtttcaccatgttggccagactggtttggaactcctgacctcaagtaatctgcgtgcctttgcctcccaacttgctgggattacaggcctgagctgctgtgcccagcctaaaattttcagttgattctttttttatgtcttcttgtttctttgctgagactgtttgtttcatttgtctcaagtatgttaataattgcttatgaggcatttttataatgactactttaaaaatccttgtcagacaattctaacatctatgtca

SEQ ID NO: 50495 - DNA, 1630 bp, Homo sapiens
gattggtttttgaatactgaaccaacttttcatgcctggaataaaactccacttgatcgtaaggataattcttttgatatagtacttggttctgtttgctaatactttgttgagagatatttatgagagttactcttatatattcagttgttttcgtgttgtcattgtctggttttggtatcaggttaatatcgacctcataaaataagtcaataattgttttctattttctgacaaaaattatggggatttgtgttaatcttaaatgtttggtaaaatttgccagtgaaaccagttctggccttgaagatttctttttttgggagtttaaaaatcactaattaaatttcctcagtagttttaggattattcaaatgatctattttatattgaatgtgttgttgtagtttgtgcttttgtaagaattggttcatttcatcgtaatttcaaatatatgtgtagaattgttcatagcattttcttaatatccttttcatgtctttagggtctatagtgatagcttctgtttcacttctgatactggtaatttgtgtgttttctttttactagtcttgctagaggtttgtcagtttcattaattgttacaaataactagtgttttattcccttgattttctttttctttttttttttttcctattttaatttcatcttgcttttggtttgttttgctcttgttctactttctggaggtagaagcttagattactaatttgatttgagactttttttcttttctcatgtaagcatttagtgttataaatttcgctttcagcactgctttagttatacaaactttgatgtgttatattttcatttagttcagtatatttttatttcagaattcatctttggctcagctagaagcatgttgtttaatttccatgcgtttggaggttcccattatttttctgttgtggatttctagttcaattatgttcaggaaatataatctgtatgatttcaattcttttaagtttgttatgctttgttttatgtctcaagtagactggcccttgaagagaatatgtactctgctgttgttgggtggagtgttctataaatactgattagattttgtttttcgatgaggttcttgtatttttctttacttttgctgattttttttttttggctatgtggttatcagtttttgagaggaaggttgaaatctccaactataattgtggatttttctgtttctccttcagttctgtcaggttttgcttctgatattttcagctctgttgtttattatgcacatttagtattgctgtgcccctgtctatccctcataatcttctttgctctgaaatctgttttatctgatactaatataaccactcttgttttattttgattggtgtttgcacggtatatagtttttcatccttttacttcaactcacctatgttgttgtatttgaagtgagtttcttgtagacagcatgtgattgggtcatgttttttgttttattttttatccacttaatttttcttttaaatggtgtatatagaccgtttatatttaatgtaaggcttcagtctaccattttatttttttgttcagttggttctctttcattttattttcttttgtttatgatttc

SEQ ID NO: 50496 - DNA, 1035 bp, Homo sapiens
actgcacagtcaaggaagaagtgggctgaagaatttaatgatgaaactaatgtgaggtaggaaaaattttctgtatatgtagaaacattaaaataattaattttaaaatttacataaagttcactatttttattgtgtatttgaatgtttttagcaaatgcaaggtacagtcaggttgcaaaacagtgtcatcactccctaaccactgaattcacttatggaatcatataatttgtagccttttgagtctcacttctttcacttagtgagatttatttgagaatcatttacattgttgcatataccaataatttttaaaaattgttgtatagtcttccattatagggctatatcacagtttgttcagctacttccacttgagggacatttgagttgtttccaggttttggaattaaaatcaaagctgctctaagctttcatgttcaagtttttgtgtgaacataagtatttacttaaatgaaacaaaagcctaggattgtgattgctgggtcatatagtaagtgtacatttatctttgtaagaaactatcaagcagttttccaaagtgactgtacaatttttcattcccacccgcagttgtatgagagttccagtttccttacattcttgtctgtacatggtattgtcattttttaaaaaaattattttactcattctaatgtatgtgtagtggcatctcttgtgattttaatttgctattccctaatgataaattatgttgagcatcttttcatgtgcttattgaccattttaatatcattaactgtagatacaaggcaatttgtgtgtgtattgatattgttttaagctgttagtaattgacaaaatcaagctacatttggaaagaaaaagttttatatatagtcatatgttgcttaacaaccagtatacattctgagaaatgcatcattaggcaattttgtcactatgcaaatatcatagagtgtactgtacatcagtaggctttctgtgatatagcttattgctcctaggctgcaaaactgtacagcatgt

SEQ ID NO: 50497 - DNA, 1052 bp, Homo sapiens
gacctcaggttatctgcctgccttggcctcccaaagtgctgggattatataagtgagccactgcgtctggctgggattgccggattctatggtagctctatttttaattttttgaggaacctctgaactgttctccatagtggttttactaatttgtgttcccaccagcagtgtacaagagttcccttttctccaaatcctctctagtatttgttactccctgactttggataaaagccaagttaactggggtgggaagatatctcatagtttgatttgcatttttctgataatgaatgatgttgagcaccttttcctatacctgtttgccattggtatgtcttcttttgagaaatgattattattttgtccattttaaaatcagattattaaattttttttcctgtagagttgtttgagttctttatatattccggttattaatcgcttgtcagatgggtagttttcatatattttctcccatcctgtgggttgtctcttcactttgttgactgtgtcctttgttgcgcagaagctttttaacttgatgaaatcacatttgtctgtttttgcttttgttgcctctgcttgttgggtattactcaaaaaatctttgcctagtccaatgtcctggagagtttccccaatgttttcttgtagtagatttgcagtttgaggtctaagatttaaatctttaatccattttgacttgatttttatatatggcgagagataggggtctagtttttttctcctgaatatgtatatccagttttccccagcaccatttgctgaagagactgtcttttccccagggtatattcatggcaactttgtcaaaaatgagttcactgcagatttatacatttatctcagggttctctattgtgttgatctatgtgtttttatgccagtaccatagtgttttggttactatagttctgtagtataaagtcaggtaatgtgattcttacacttttgttcttttggcttagtatagctttggctattttgggtcttttgtggttccatataaatttttagggttgttt

SEQ ID NO: 50498 - DNA, 1014 bp, Homo sapiens
accgtgttagccaggatggtctcgatctcctgacctcgtgatccacccgtctcggtctcccaaaatgctgggattacaggcgtgagccactgcgcccggctaccaagaccattggttaaaagactatccttttaccattgaaatgcctgggccctacaattaattatcctatgtggctctctatctggactctattctgttctattgatctgtgcctgtccctttactacactgtcttggttactgtaactttgtaagtaatgaaatcatgaagagtcagccctccaactttgtttttctttttcagaattgtcttccctcctctgaggtggcattctcatatacattttacaatcaccttgtaatttctacaaaaaaatcctgctgggatttttgttacaattgtgttaaatttgtagatcgatttaggaagaagtgatatctttactaggaatcttctaatccataaacactaatctgtttttttagccttgttttcagccagtccctcatatctctggacttgattgaagattttcttgaattagctagtagggagaagacagaagataaagataaaccccttatttataaaggtgagctacaaatatttctgtgtcgtaattttaaaaatactgatttaaacataccatacaaacattttagcaacaaaagaaacaaaactacccagtctcacaactctatcatatcaaaatttttttgcaatgtctatttgtccttatccatatatatgtatagtctttttcaaaataaaattgtattgtttatatttgaggtttacaacatggtgttatgggatacatatagatagtaaaatggctactgtagtgaagcagatgaacatatctatcatctcacatagttttttttggtgacaagagcagctaatatcaacttaagaaaaattcctaatacagcagtctttgttgttgaaattgttggataaattaaaactttttggtttctaaagcagttttattgagagataattca

SEQ ID NO: 50499 - DNA, 1050 bp, Homo sapiens
gtggtaactgagcctttccatctctgttgattcctgtctcatggagtatgtttgggggcattttactctcttagggcctggtgggaaggggatggtttctcttctctttgggtctctgtctttctgagctccactcctaccccgagggtttgtctcttacacttgcactctctcagagtcaatctcttgcttgttctcttatttggcatctccttcctttctctttttctatctagagctcactcttctgggatagtctctgtccttctgtgctgtatgtgcgtgtgcctgcctttctcttttttccctcccctctcccaagtccccatcagtttctttcttactctccccatgggtaggtctttttctgtctctcttgctctctttccatttcttttctaatttacctacttatgttccatttgtcttatttaggtaaagctacttcttcttctaatccaagcagcccagctccagactggtacaaagattttgttacagatgctgatgctgaggttttagagcattctgggaaaatggtacttctctttgaaattcttcgaatggcagaggaaattggggataaagtgtaagtgctttaccatatttattatataaattaaccttttgattatgtttttattgcttaaacaatgtatttgaacaaatctgttgcttttccttccttcctaaagatgtgatttatttggtcattgtagtgctaggccaatacaagcaactatcttttttgtaagccactagttctgattgcatattcaggttatttcttcagtgtaaatttctgcttctacctgttgcaacttgaacttatttccttgggtagagctcttagttgaaatttgtgtttctccatcttcaaaatcatttttcggtttatgtagtgtgacttctaccgtgttgctttactgagatttccccctgtaaagtcactagtgaccttctaatcctcaaatctagtggacatctctcaggctttattttattttacctgcttgattattctttcttcttcttcttcttttttttttt

SEQ ID NO: 50500 - DNA, 1028 bp, Homo sapiens
tagctggtattgtataactttaaaaaaaatgactttcttacagtaaatataagaaaatctgaataggaagtattaaggggctagtctgcctccttagcgcagtaggcagcacatcggtctcataatctgaaggaagtattaaagggttaacaatgttgtacctggaatttgaaatggatattaaataattaattacctataattgagctacaatatgatttttgccacatattttattttcacgtcaaagagttactgtttgctttaatccttttgtagtagctgtctcgtttttctgagaagcagcatcttgaatgagtcatttaagtttagcttacatcatccccatttctgtgttttaaatgttttttattagaaggagagttcatgatcacgaaatgactatgtaaattacttcaaagtgttagatttattattacttaagtatttttagagtaagcttcattggtaagcatttgcattttaaaacgtatgtaattgtatggatataaagttttgtgacagaatccttgtatatgatgtagagccgtaatattagtactaatataccatatttattcactcaacagatatttataaagtgcttactatatgcccagacataaggagggaactgataagcctaaatggtaaattgaagaaggtatgctatggaaatcctagggagatgctagtcttgagactagcagctttgattttcatttatccagggacaggatttgagacttcgagccctctataagttggagagttctgtgaccccttctcaaagctgaatccctttaaagtttacaatcccatcgacaatccagggagttgacaaggaagcttatctatttcagccagggctcttggttgggaaaaatagttacattgaatttacggtcatggccttcacctcacatactttatggtttgaatttatattactcatatagtctaaaagatccgaaactgaaatattaacttcacaagtaattctgagttggtgattccctggagacctg

SEQ ID NO: 50501 - DNA, 1060 bp, Homo sapiens
tctggaattcaagatctcggggaggtggtgaaggaaatgtggatgaaacaggaaacaatccttctgtttctttaaaactggaagaaagtgagtctaatgaatgttgcctttatcatggaacagtaatttggaaaatgtcatgtcgttagtccttttttcagtcacttacctgactaattgactcaaaggaatctttcctcaattgatgagtctaatcaagtactcataattacagtaaatatctgatgaatctttaattataagcaagctactctgtgctctctggtatttgggggaaaggtaaaaagaaaaactaatgtttatttacttgtatatacctaaactctattattttcactacatgtgttagctaactgaattcttgagcaggcttgcaatgtagttgatagttttaaaaatgagtaggagaactggtattcagacctaaaaatgtctaatctcaaagccaccatgatattttcacttaactgtatgggaataaatggaaacatttcagataatcaagtgtgattgtagttaatttttagtcagtaatatacagtaaaactaattttaatcatttagtgtttttcctttgtgattcttcataatctgcaattatctactttaggtttcctgtgtattatgtacagtttctatcacctcttttgttttctttctgtctctcttgtgcatgaaagtgaagtcttagattgaactctgcagtggtttaagttgtctttacctatatgtaagttgaaggattagtgttgagacactgtatcctactagtgcagcctgtatgcctaggagcttaaaaactgggaccaaatgtctgcctatttgaaatagcagattatgaagagagaacaaggtagtggctctaaatatttggcatttgggagttgtggagcaaagcagttaactgtctataaggagaagagagttgtgggggccacctaggttagtgatcctgtgatcagataaacttggctggtctcaggcctacagctgaaataacttggtgattaattattttaattttatttttataatttca

SEQ ID NO: 50502 - DNA, 1066 bp, Homo sapiens
atggcttgagcccgcaggagttcgaggttgcagtaagctatgattgcatcactgcactccagcctgggtgacagtgtaagaccctgtatcaaaaaaacaaaaacaagaacagaaagaaaaatgacctaaagtaaggaatgaaagagtatcactactaaccttacagaaataaaaagaattataagtgaatattgtgaacagctgtatgccgagaaattatatacctcattttcatagcagtgatttctgttacacaatggaaataacctctatcaggcaaaataatactcagcagatttttatgcattattaatgtttcatatcactactaaattttctctcactcgtggaggcaaaatttgctaattatttaaacaacttacatagtttaaaaccgtggataggaaaatatgttattgcttaaatgctgttttttccttttaatcagttttgttcttttgcatattaccttcttgataattttattatattaatgaaacgtgcattcattttctttatgttttataggaaaatgataattctgttgaaattattctggatagagcagagctaatatttacattttatacatcaaaaacataatttttggaaggtcttttttttttttttttaagagacaaggttttgctctttcatccaggcgggagtgctgtggtgcaatcatagttcattgtaacctcaaactcctgggctcaagtgattctcccacttcagcctcccaagtatctagggtatctagggctataggtgtgtgccatcatacctggctaatgtttttgtttttcttggtggagacagagtctcgctgtgttgtccaggcctgtcttgaactcctggcctcaagcggtcctcctgcctcggcctcccaaagtgctgtgattacaggtgtgagctactgtcacttgcctagaagtaatttttttgagtgagcatagttggcgagagtcagtaaaggactatctgcatggagcaaagtttatttataacaggagtttgtaatctagggtccatggatagaatttaggggattatatgtacctggata

SEQ ID NO: 50503 - DNA, 1052 bp, Homo sapiens
tttgagaaatgtctactcagatcttttgccaattttttaattaggttgttagaatttttttccatttgacttgtttcagctccttatatattgtggtcattaatcccttgtcagatgcgtagtttgcaggtattttctcccatcctgtgggttgtctcttcactttgttggattgtattctttcctatgcagaagctttttaacttgatatgatcccatctgtccatttttttgtgttggttgcttctgcttttgaggtattactcaaatctttgcccagtccaatgtcctgtagagtttctccagtggtttctcttagtaattccatagtttaaggtattagatttaagtttttaatccatttgaatatgatttttatatatggcaatagataggtgtccagattcattcttctgcgtatggatatccagttttcccagcaccacttactgaagagactatcctttccccagtgcatgttcatggcacctgtgtagagtatgcgttcactgtaggtgtgtgaacttgtttctgggttaattattctgtttcattggcctatgtgtcttttttttttttttttttgagacggggtctcgctctgttgtccaggctggagtgcagtggtgcaatctcggctcactgcaagctctgcctcctgggttcacgccattcttctgcctcagcctcccaagtagctgggactacaggcacccaccactgtgctggactaatttttcgtatttttagtagaggcggggtttcactgtggtctcgatctcctgacctcatgatccgcctgcctcggcctcccaaagtgctgggattacaggtgtgagccactgtgcccggccggcctatgtgtcttttttatgctagtacgatgctgttttgattacagtagttctatagtatactttgaagttatgtaatgtgattcctccagttttgttcatttagctcaggatagctttcactattctgggtctttcgtggttccttataaatttcaggatagttttttcaatttctgtgaagaatatcattggtat

SEQ ID NO: 50504 - DNA, 1032 bp, Homo sapiens
tgtgggggattggttctaggacctgcctgtgtataccaaaatttgctcatacacaaatcccgcagaacctgcatatatgaaaagtcaaacataggtttcacattctgtgaatactgtattttcaatcaacatttggttgaaacaaagtctgtataagtggacccgtgtggtttatacctttggtgcgcaagggtcaactgtatgtaaagaactcctacaactcaacaacaaagaaacagtctgtttcaaaaagaagcaaaggatttgaatagacatttctctaaagaagatatacaaatggccaataagcacataaaaaaatgctcaacatatctactcattagaggaatgcaaatcaaacgtacagtgagataccatttcacacccattgtggtggccattataaaaaaaaaaaaggaaaataagtgcttatgaggatgtggagaaagtggaaccctgtacattgctagtaggaatgtcagatgatgtggctactatggaaaaacattgtagtaactcagaaagttagacatagaattaccatttgatctaatagttccacttataggtatacccagaagaattgaaagcaggaactcaagcagatactgggacacttatgtttatagttgcatcattcataatggcaaaaaaaggtggaagcaacccaaatgtccattgatggatgaatgcataaacaaaatgtggtatggacatacttcagtggaatattagccttataaaggggggaaattccgacatttactaccacatagatgaagcttgaagacattaatgctaagtgaaatatatcagacacaaaaaggcaaatactgtatacttctgcttaaaggtacctagagtagccaaactctacgagtagaaagtagaatggtgattaccaggttctgggggacgaagggaatgggaagttactgttaatgggtactaagttctgtttggaatgatgaaaaagttctagaaatagagagtgatgatgtttgtacaacattgtgattatacttaatgcca

SEQ ID NO: 50505 - DNA, 1115 bp, Homo sapiens
acttattctttttagggcttaatttacatagctataaattaggttttcctttggacaaaaggtgttagagggcaaaaataaaacctttagccaggtagtctccatcactctgtatataatttgtgatttggagaaaaatgacctgaagtttgtaattttttggcttctgaatgtactatgattgttctatatgttatgatcttactgaaagttgtcgctaagttgtacttctacagtatgtggatctgatttcactttatatgatttattaataggtatacaattgtattttatctcatgtacatcatatttcttagtctaatgacaatccagaacttgagaatgcattaagtaggtttatgtattgtgactttccgttttttagtagacatattctttggagactgggatttgaaagaagaaaaattgtgtgatttcctacaattaacaaccaaatctttatagttaataggaattttttaaagactttttttgaacttgtaaacacaaactgaaatcaggttgttgaactaggctttcaagtaactagattaggaattgtatttttgttggctgtttagtgttcaacccaaatgatggtatgagatcttgtacttgcaagtaaactgtgtttttccatttctaatccagtattcaatgcttcacatattttatacacacacacacacacacacacacacacacacacacacacatatttattcgtcccaaaattcattattcagattagtttgaggaagtttttctggtccatgagaaatgacagtgtagtattactaaagatggttttaatatataccaacagaaaaaaaaagtgctgtgccagacatagaaatttgctgctaacattttattttagtatcttctagtcttttttagggacatacaaattttagaagttttttttttttaaatagaactatattgtggtttataaattactttttcactgaatattaataaatattttctatcttaatcttatttagaatatcattttaatttctatctcttatggataatcatgtgaaaatactatttaatcagtttctgatattgaatgtttaaacgttttctcaccctttgctattgca

SEQ ID NO: 50506 - DNA, 1030 bp, Homo sapiens
ttgtctggaaaaaaaaaaaaaaggcatcatctgtatttgcccaggcactcattagcatacaagtattaacaagtagagggtatagtgctggcacagtaaaattaatagcagattgggatttaggatcttaggttctactcctgactttgccactagttagctttgtttctttggctgagtcatttcctatatctaagcctgtttcctcatctgtagaatgacaaagctgtactctgaggtttgtccttctggctctaacattttgtattgcttttgttaatggctcgaaagctccctggtgcaggaggtccttctcttgattgcattttaagaaactcaacatttcgaattattgatttacctatcagcaagaggtggtttactttcctttcctgtttgagcgtttaaacaagcgacattactcatttcctttctagataggattggagttaataaaggctttcttggctttctcctatgtttttttttttttttccccgattgcttgtttgtcattgtgttgttgggctcacttcttattattttatttgtgctttcttttagtaatggtgttatcttggtgttcattatgtactttggaagacttagtatatgtgggttttggggtcctatttattttctcatgcgccagttccgatcattgtttgtttgtgggtttttacccttcctcccatattgttttgctttctccccctctcccttccctccctttcaggaaaatggaggagtggctccattacttctggctctgcccaggttttctgccacaagagtggcacggcctgtgcctctaatgcttctgatagagtcgtgactgctttggatgctacacctgccccaagatgtaatattgagcattgagattccaggggcagtacatcgtcctggaaagcctcaagaaaggaaacttcagagcaaacagaatcaactagggatcatgactatacatccagcatgatccagcatgggtccagccgaggcctccaaaatgatgctttgccagcctcag

SEQ ID NO: 50507 - DNA, 1040 bp, Homo sapiens
atttattaacttgtttaatattcactataccaaagaggtatctaatacccatgggttatgtagtcatgatggggatacaaatactttcttgcactattttagtatagattatatatttgagcatatttgaatatgcactaagcaacttaaaaaattcatttgcagatcacgattaagtcttagaattatttttctaacttcctaatttttgagtaggttgtattttggtagacagcatattgtaattgtatgtaaatttgtacacaattgtgtgtaaattgtgtataaatcttatatgctttgtctttttagcagtattgtaatacattttcagtgttggtgtttatgaagcgatagtgtattattgcaaatggttaactatttggatgcaataaatttttgtaaaccttttttcttgttcaagcatttaattttaataataatgttacttttttatatcatgagagttgacataatttgttattaaaatatagaggctagtttgtagccaaagaagttttgaaattttgaaatttaggacgtaaatacttttaattcccctaacatatatacttatatatatttgtgtgaaagttttacaacagatttaactactatttactttttctgttttaaagctatgatggcttttgggggcatttaaaaaacttagtcatatcctgaatattttagtaaatgtgaatacatttctgttttagcatgctattatgtagcgtcactcatatttgaaagtaaatgtataatattatgagacagtggtctaacctataaattaatttctatttaattggatttacttaatgaacaaggacagaatattatagattgatcaacacttgtatgtttctggtttagctttttataaaaaaaagtagactaatcatatattttgaattttatataactgaaaatttagagcttaggctttatgtagtttctcaatggcagaataataataccaaataggttgtcaggttttcacatttatacacgtaattttaaagtaatatacttgaaag

SEQ ID NO: 50508 - DNA, 1051 bp, Homo sapiens
ttcaactgcattttaaaattacttgctactaccaaaatattaatactgtttttgctattcctcgaagatacagcaccagttaacgtcaaaattaaaatggaccagtacgaaggttattgtggcaagaaacttatgctaatatgatggctgttgatacagaattgttactgagaagggtggactttaaaagccttgtgccctgggaaggaactctgaaatatataaggtccagctatttatcattttactgctggcacttcacaaataacctgttatgttttctataagaatgctttttactcatattttggagtccagagtttagaccccacttagtttgctttaaagtttttggctttcagttttattttacatggttttaattatatagcttatttaaagctaattttaagtacacttttttccctcaaggagatgaagccttatctaaatcagtgcctgtcacagtggatgatgatgatgacgacaatgatcctgagaataggtatgattccatctgtaaggactttaaaaagattataacacaccctaggcatgggcacaaacagcagcaacggaacagcaagcaggttgtaaaaaccaggagtgcctgccttagaaagactcgctcacagtcttcctgcaagtttgaaagaaaggccagaaaatgggctaaaactcagaaaccttaagagaaagtaatatcattatttacacacctagcatagggtgtgttataaatacagaactgtcaattttatgttgctatgtaaactgcagtaatttttttggaataatttattttgacagattattgatgaaagtaaatcatatctcagtaaattggtaacaacagacatctcctctatatttgactattgttaattgccatccaatatggtggtcctatttattaaggcctgttgagaagaaacaaaaagagagattactcagatatttaagattaagaaattgctttcaaaataagtgtcagtttacaaggtatctagactgagttagagtttaaccagttttcaaataaaatagaaat

SEQ ID NO: 50509 - DNA, 5324 bp, Homo sapiens
gacatccttcattagttcatccatgagttcaattgttttgatttttagatcccacttataagtgacaacatgcagtgtttgtctttctgtgcctggcttatttcacttaacataatgatctccagttccttccatgttgttgcaaatgacaggatctcattcttttttatggctgaatagtactccattgtgtatatgtaccgcattttatttatttacttatctgttgatgggcacttaggttgcttccaaatctttgctattgtaaacagtggcccaacaatcataggagtgccagtatctctttgatatactcatttcctttcttttgtgtatatactcagcaggtggattgctggatcatacggtatctcaatttttagtttttttgaggaatctcccaactgttttctatagtgattgtactcatttacattcctaccaacagtatacaagggttcccttttctccacatccttgccagcatttgttattgcctgtcttttggatataagccattttaactggggtgagatgatatcttattatagttttgattaacatttctctgataatcaatgatggtgagcagcttttcatatgcctgtttgtcatttgtatgtcttctttggagaaatgtccagtctaatcttttgcccattttttgattggattatttgattttttcctatagaattgttggagctctttatatattgtggttattaatccattgtcagatgggcactttgcaaaatgttctcccattctgtgggttgtcttttcattttgttgattgtatcctttgctgtgcagaagctttttaacttgatgtgatctcatttgccaatttttgctttggttgcctgagcttgtgtaatatgctcaataaatctttgcccacaccagtgtcctggagattttccccagtgtttttaattacttaaaaaaataaagtttttgtcctttatgaatgttatcaattttgaattaaatttccccttcctcttttcttttaatagaattgctttaagtattacatgagtgatgatattagccgtgactcagatggaatggatgaacaatgtaggtaggtaatatagatgagctaacattcagtgtttcctacttttgggaggaattgttacataatcatttatgaggtttgtctttcatagtatcgtcattgatgtctttaatgaaaggttgttcttttccataaaaccctggatttatgtctagtttaagtttctaataaagagtaagcagatgacctaaattaccactaaaattactggcagtaaaatttaaattgcattataacaaagagattaaaatgagttttgttgggaataatgtttatttttatttttttacatatcttttcagtttcctgaaagaagggaataatgttttaatctttaaaacatttcaggtggtgtgcggaaggtggaaacttgatttgttgtgacttttgccataatgctttctgcaagaaatgcattctacgcaaccttggtcgaaaggagttgtccacaataatggatgaaaacaaccaatggtattgctacatttgtcacccagagcctttgttggacttggtcactgcatgtaacagcgtatttgagaatttagaacagttgttgcagcaaaataagaagaagataaaagttgacagtgaaaagagtaataaagtatatgaacatacatccagattttctccaaagaagactagttcaaattgtaatggagaagaaaagaaattagatgattcctgttctggctctgtaacctactcttattccgcactaattgtgcccaaagagatgattaagaaggcaaaaaaactgattgagaccacagccaacatgaactccagttatgttaaatttttaaagcaggcaacagataattcagaaatcagttctgctacaaaattacgtcagcttaaggcttttaagtctgtgttggctgatattaagaaggctcatcttgcattggaagaagacttaaattccgagtttcgagcgatggatgctgtaaacaaagagaaaaataccaaagagcataaagtcatagatgctaagtttgaaacaaaagcacgaaaaggagaaaaaccttgtgctttggaaaagaaggatatttcaaagtcagaagctaaactttcaagaaaacaggtagatagtgagcacatgcatcagaatgttccaacagaggaacaaagaacaaataaaagtaccggtggtgaacataagaaatctgatagaaaagaagaacctcaatatgaacctgccaacacttctgaagatttagacatggatattgtgtctgttccttcctcagttccagaagacatttttgagaatcttgagactgctatggaagttcagagttcagttgatcatcaaggggatggcagcagtggaactgaacaagaagtggagagttcatctgtaaaattaaatatttcttcaaaagacaacagaggaggtattaaatcaaaaactacagctaaagtaacaaaagaattatatgttaaactcactcctgtttccctttctaattccccaattaaaggtgctgattgtcaggaagttccacaagataaagatggctataaaagttgtggtctgaaccccaagttagagaaatgtggacttggacaggaaaacagtgataatgagcatttggttgaaaatgaagtttcattacttttagaggaatctgatcttcgaagatccccacgtgtaaagactacacccttgaggcgaccgacagaaactaaccctgtaacatctaattcagatgaagaatgtaatgaaacagttaaggagaaacaaaaactatcagttccagtgagaaaaaaggataagcgtaattcttctgacagtgctatagataatcctaagcctaataaattgccaaaatctaagcaatcagagactgtggatcaaaattcagattctgatgaaatgctagcaatcctcaaagaggtgagcaggatgagtcacagttcttcttcagatactgatattaatgaaattcatacaaaccataagactttgtatgatttaaagactcaggcggggaaagatgataaaggaaaaaggaaacgaaaaagttctacatctggctcagattttgatactaaaaagggcaaatcagctaagagctctataatttctaaaaagaaacgacaaacccagtctgagtcttctaattatgactcagaattagaaaaagagataaagagcatgagtaaaattggtgctgccagaaccaccaaaaaaagaattccaaatacaaaagattttgactcttctgaagatgagaaacacagcaaaaaaggaatggataatcaagggcacaaaaatttgaagacctcacaagaaggatcatctgatgatgctgaaagaaaacaagagagagagactttctcttcagcagaaggcacagttgataaagacacgaccatcatggaattaagagatcgacttcctaagaagcagcaagcaagtgcttccactgatggtgtcgataagctttctgggaaagagcagagttttacttctttggaagttagaaaagttgctgaaactaaagaaaagagcaagcatctcaaaaccaaaacatgtaaaaaagtacaggatggcttatctgatattgcagagaaattcctaaagaaagaccagagcgatgaaacttctgaagatgataaaaagcagagcaaaaagggaactgaagaaaaaaagaaaccttcagactttaagaaaaaagtaattaaaatggaacaacagtatgaatcttcatctgatggcactgaaaagttacctgagcgagaagaaatttgtcattttcctaagggcataaaacaaattaagaatggaacaactgatggagaaaagaaaagtaaaaaaataagagataaaacttctaaaaagaaggatgaattatctgattatgctgagaagtcaacagggaaaggagatagttgtgactcttcagaggataaaaagagtaagaatggagcatatggtagagagaagaaaaggtgcaagttgcttggaaagagttcaaggaagagacaagattgttcatcatctgatactgagaaatattccatgaaagaagatggttgtaactcttctgataagagactgaaaagaatagaattgagggaaagaagaaatttaagttcaaagagaaatactaaggaaatacaaagtggctcatcatcatctgatgctgaggaaagttctgaagataataaaaagaagaagcaaagaacttcatctaaaaagaaggcagtcattgtcaaggagaaaaagagaaactccctaagaacaagcactaaaaggaagcaagctgacattacatcctcatcttcttctgatatagaagatgatgatcagaattctataggtgagggaagcagcgatgaacagaaaattaagcctgtgactgaaaatttagtgctgtcttcacatactggattttgccaatcttcaggtatgcaaaaataaataaaaaattcataatttgtacttccccctcttgagttactacattgtttaatttcctctgaagctaatcaaatttagggttactacttaggagaataccacttaaaaattatttaggagtttattaaaaaaagtttccctatttatttttatgctgccattggaagatattttgaacattgctagtattcagtatcagggatctcaaatttgttgagtaaatgacaaaatttctttatcaatgtttagtgcttttctctggagtaatgagcagaaggaaaagcggactggtgccagtggttcagtagctatttagttatataatggaagtgagtgcttggtactggtatgacatggtgtgtcaaaattttaactgccatgcatatggctttttaagtttgaacatataactttgtgtctcatgaaatcccctttaattatttttaatttacctcattaaaaccctttgttgatgcttattaactagtttctaatgacatgaacagatgtttttcttttaaaaacactgtcaaaatgaaggaagaaaatccaaacattagctggattagcctaccctgatgaggtagagtactaggaacattaaagtttgggtcagctggtgaatgaaaatatttttatgaattaattaaaatctttaaaatttatgaaaaataattttaaaaataagtttttattattgaagttattttaaaaatcagttgtataataaatgtgtattggtcatttgtctttttttttagtcagtaagacctgtcagttctatggatactcagaatttat

SEQ ID NO: 50510 - DNA, 2260 bp, Homo sapiens
tgtatatatcatttgggaacgtttttcatttaacattgtttttgaattgtattcatgtcagtaaatgtacatctagtttgtttatttttcactgctctatagaattatgttatatcaataagccactattcatttcccacataggaagttattcccaatttttcattttctaattttctaattagtgctgtggtgaatatccttatatttgattccttgtgcacatgtgggagaaaatctccaaagaattacctagttttgtttaattcttgagcgatgtatgcaccaaagcacatagaagatacttagtaagtattacttaacactggatgaacattcagattctacattttatttatcttgttagtttatctgaatgaaatcattgtttgaaatgaaaaagtatggtgtggtgtatttgtttctgttaaaacaaatacagaatatatgaatacccaagatcaaactggtgtttgtaaataatgtgattataatacattaggcttgtaatgcctgctattaggtaggttgagataggaggattgcttgaactcaggcgtttgaggctacagtgatttataattgtgccattgtactccagtctgggtgatggattgagaccccatctttaaaattaaaaaaataaataaataaaaatattagcaacataaatagtaaaccttcaagtttacttttctaaaaaagtatgatggtgttcttatacattaacgtttttagcttctggctaggtgtggtggctcacacctgtaatcccagcattttgggaggctgatgccagaagattgcttgagcccaggagttggagaccagcctgggcaacacagtgagacccagtctttaaaaagaattagctgggtgtagtggtgtatgcctatagtcccagctactcaggaggctgaggtaggaggattgcttgagcctgggaggtagaggctgcagtgagctgaatttgcaccattgcattccagcctaggtgacagagtgagactctagctcttaaaaatttttttaaagtttctacaaataaaaatattcatgataatatttgggtccatggcgctttggaccttaaacctaacagaaacccaaaagagaaaattaaaagggtgaaaaatatatgtgatgttttgttttttatttaaggatggagccaatttgttttttagttgtctcctttttatttgtgaatgtaagcattttgagtgacttctgaattataatctaccatcttattttgatcaaggtcttggttgcacatcaggatcatctttgaaactttaagaaaatgcctgagagattttaattcagtggtttaggggtgggaatggctgtttttaaaaagattcttcagatgactctaatgtttagctcagggtgtgaaacactgccttagcagaactagggacaagagggaggctggagaggtttctgtaggttttcttcagtctgtttatcaggagacagtacagaatgggactctgcctttttcccccagtcgttctgatgttttgctgccaaaatagatatacctgcaatgtcttgtttgtctttatttggaaatagtagacagtattgatatggagtggatagtggagtacacatagaaaaaaggcagtttaatgacaatttatgtatagtgttgaagtaaatattagcaaggaaattggtaatatcataaaattaccaagtttttacataccatattgataggatctgtgcagacaattccaatgagaataaaaacctttatggcatacttaagtgtaggattgcaaaagaatctgttccgtatatgttacttacttccccattctttaaggactgatactgaatttatttgcaaagcaataacaaaataagagctcttggcccctagttttagaactttttatgggttctcttaatgttatttcaagttgtaaaaaatggcatttgcatctgtaaaaggaaacaattaggatttgtaacttggaatttgccaaggttgtcatgtgcttagtaagtcgataaaatattaaccttttttacttgtgtccaatatgccatttttctaaggattatgaggtatttcatgtctaatacaaaagttacaaaatgctgactaaagtaagtatctttttctgtgtataaatgtgtgaataatagccactcctttctcctagaagatgggcttcatgggattgtgagctgcactgcttgtggacaacaggtcaatcattttcaaaaagattccatttat

SEQ ID NO: 50511 - DNA, 1070 bp, Homo sapiens
aacatattttatatattcattttccgattaaataatttgtaaggttgttggcaaaaataaaggaaatattatatagtcttttgtccacaaaggggtagtcaactccttttgagcataaggaatctttctgagaatctagttcatggtagggaaactgccattgcagcaacagagctcattaaagctaaggtagtagtcttaaaatttaagagaatcctcaattataaagtgatggtaaagatcagtagtaagagtttctttcctctgatcataggttctctagagaagacaaataactaagtgttctgcattgtgtacacttagtgtacagagtgtctaaatggtgttatttttgggaagggaccctgtagcagtcagtgtctgaaatgtggataagggctgaaagaataaaagaaccactgttgttgacgagggtattcctagtgccactttggtatgctgctgacatttggtctcagctgataagtttcaggaacattttattgaatgatctgtgtaggaatgttttggtatcacgcttaagggaatacatgcatttatagccatcagtagcacttaaatctttcacatctattttcatcttaatgatttgttacatttttaagctgtcagaaatcacacaggaaatttaacactaggtttactttatatacacatatatagataaattggtgatctgaaatactgaattggtgtagttaatatttaaactttttaagaaagctggttccaaattgaagcctaacttaggaaactgtcaagaatgtaaactttcttgtattacaagaaatgtaagacattacaagaatgtaagacaatatataaagtcttatattgatttggaataatattataacacaaagatacggttaaagttaacatttcaggagctgattttttaaaaaattttcagtatcataccctattttgacattctcttcccagtttaattgttagaaagtatattttacacctaacttttttacatgacacaataattttgttctatttaaaaccattaaaatctattgagctcagaaatgaaaatg

SEQ ID NO: 50512 - DNA, 1071 bp, Homo sapiens
gcaaggaagaggtaaggataattatttagagatatttgttagttacgattaaccaagtagagcatatgtctttagattgcttctggacacatgtatgtgtcgaaggctactgatacccagttgtcattatacttcagtttcgttgttttccagtttgagaacaggtgttcattgtttctgttattgttgtggttcacttcagtggtttacctaaagtcagacaactgaagacttccaacagatagatattaaactgtctttatattgccccaaaggtgtttgaggtggatgttaagggcatgaactccatggttgtgaaatctctcaaaacttggtatctagagtctgctaagcattattatagcaactcataacaaggtcctttgcctgatacacaggtccacaactgtggttttgggaattttttgacctactgtaaaaaaaaactgaatccagtaaaatatattgattatactggcaaaatgagggtaagtttagtatctcaaagcaagttgtagaagttacttcatgccatatgttagcttagagaagaatgaaacatatttagatccttgaaactccctacttctcttgagatctgattacttctgcatctttgttttgtctttgttgactggggccatgatcattttgcagcagtgtattccccgcagcatgccacagcaaccatgtaaaaaacgagaaatttaatcttcagccaaggaaacctggcagtaaatgagaattagttttaatttttatttttttgcatctgtgttccttatgtggtagagaattagtttttgaagttccttttagaaaaatattctaggcacataaatagcatctcattatatcactgtattgaagttgctatagggaaatagctaattgtagggatgccgtttcgagaattttattcacttttatatttatgtctcacatctagggaactagctcttcagaaaaatccaagtcttcaggatcgtcacgatcaaagaggttggttgatgttgaagggacaaaaagttattttctttttcaggttattttctgtttctaaaaccatgt

SEQ ID NO: 50513 - DNA, 1029 bp, Homo sapiens
ggtgcatgccaccacgcccagctaatttttgtatttttagtagcaacagggtttcatcatattggtcaagctggtctcgaactcctgacctcaggtgatctgcccacctcagcctcccaaagtgctaggattacaggtgtgagccaccacacctggccagaaaaaaaagatatttttaaagagctgttttaggttcatagcaaaattgagcaaaaagtacagtgagttcccatatgtccctgcttccacacatgcacagcatctcccactatcagcattccgtaagagagttgtacatttgttatataacgttgatgaacctacattgacatgtcattattaccccaaatgcatagtttatgttaaggttcactcttggtgttatacattttaaagatttttgacaaatatataatgacctgcattcaccattgtggtatcatacagaatagtttcactgccctaaaaagattcctgtgctgtgcctgtttcttcatccctttctcccctgtgagcactggcagccactgatctttttactttctccatagttttgcctttttcagattgtcatagttgtaatcatatgtatgtaacctttccagactggcttctttcacatagtaatctgcatttgtttcctccatgtctctttgtagcttgatagctaatttatttctagtgctgaataatattccattgtctggatgtactacagtttgtttatccattcatcttctaaaggacatcttggttgcttctaagttttggcagttatgaataaagctgcttataaagatatttatataagtaaatgaagatgtttacataaaataaagacatttataaatatctccatgcaggttattttgtggatgtatgttttcagcttctttggataaataccaaggagtgtgattgctgctttatatatggtatgcttagttttgtaagaaattgctgaactgttttcctgagtggctgtatcattttgcattcccaccagcaataaatgatagtttcttttgc

SEQ ID NO: 50514 - DNA, 1038 bp, Homo sapiens
tggtgcagaagcttcatgacttccttgcacactcatcagaagaatctgaagaaacaagttctcctccacgacttgcaatgaatcaaaacacaggtaaattgaaaaagaatgtgctataccttctagtcttttttctattttttttttacacttatggaggtaaccatttattttattcagagagcagcttttaaaagagatttcagtttgtggaaaatgacagattagcaagctttatagaagcccctattatgtatcttagctatatctgatacaggagattttaattttggtaagtatgactatagaaagcttagaaaaggaagcatttatggttttatatgtaatggaaatgtgttatagaatggctagtgaatgttgactgtgaaaaaatagtattagaagaggcaggagtagtataggaatgttttgtcctagcaatcattcatgtattaggagttaaatttttatttttatttttgtgatggagtctcgctctgtcacccagtctggagttcaatggcatgatcttggctcactgcaacttccgcctcttgggctcaagctattctgctgcctcagcctcctgagtagctgggatcacaggcgtctgccaccatgtttggctaattttggtatttttagtagagactgggtttcaccctgttggccaagctggtctggaactcaagtgatctgccctcgttggcctcccgaagtgctaggataacaggcatgagccatcacacccaacataagagttaaatttttatgttgtttgataatatccctgagtagatttggtgtatttattttttaaaataaaaccacttaacacctcctctctacctccctgtctctctcttttaaaaagatatatatatatatatatatatatatatatattttttttttttttttttttttaaagagacgaggtcttgctttgtcacccagactggagtgtagtggtgtaatcatagctcactgcagcctcagacttcttgggcttaagcaatcttctcacctcaccctccc

SEQ ID NO: 50515 - DNA, 1013 bp, Homo sapiens
aaaaaaaaaaaaaaagacacaaaagagaaacaaaaaaaacatattgttagttttgatgattatctactagggtaagtacttttctactcattaaattccattagtgactgtgccttgatttccctgaaaggatgcagtatagagtaggcttttgattggagatagacttcctgattttccacttagtatttaggagtgaaaattattattattattatttattgttttttttttttttggagacagggtgtcactgtatcgcctaggctggagtgcagtggcttgatcctgactcactgtagccttgacttcctagggtcaagcaatcttcccacctcagcctcctgagtagctgggactacaggcacgtgccaccacagccggctaatttaaaaaaattctgtagagatgggatctcactatgttgttcaggcttgtctcaaactcttgggctcaaatcatcttcccacctcagcctccctaagtgctgggattataggtgtgagccactgcacccagccggaagtgcaaattatttaactcctttattttattcagcaaataaatgtctttctgagcctcagtttcctgtaataaggttcttataagttttaaatgaggtcagtgtgcattaaatgtacatgttagaatttggtaaggttagtaagaaaaccaaagacatgtggaccctttacaaaaaattccagcatttaccctaagagatgctttttaagtggttgaaatttggtggcatggaggaaatgtatatgggctcgtatcacatttgggagtaaaattaaggcatgaaatttaaacaaaaaataaaattgtgggtacatagtaggtgtatatatttatgggatttatgagattctgagacaggcatgaaatgtgtactaatcacatcatgtaaaatgggctgtccatcccctcaagcatgtatcctttgagttgaaaaacaatccaattttattctttcaggtattaaaaaatgtacaattaatttaatacag

SEQ ID NO: 50516 - DNA, 1034 bp, Homo sapiens
tataggcgtgattcactgtgcctggcctagtttctttgttttaatttttttcctccccatttgtcttttgagtttccctgagaatctgtcttgctgctgtctcagttgtcattcactgttattacactggaaccctattgatgtagtggtaaggaattagggaggggaagtgttttgtaatctcatgattaaatgtcatttcttttttttttaattggtcctgagtccctgaattgtgactctcagaagtgtttcttagcccttgccctcccacttagatgagacaggaaggctataagcctcgggggttttctaattgtctttcctcttggtagataatggtgtgagcatatttgaatatagtttctttcctctcctcctgctcaaggcacaaggaaattttcctcaaatatttgcagtgaaaacatactaaaacccttgtaggattcctggaggtaaaacctaggaaagtgtaggggcccctctaagactgggatgtcaggatttttaaactctcaaactaatccatatttggcctccagaagttgtcagtttctacttgagtgtttctgttctaggaaagctgtgatattctgtatctgtctttctagttttttttggtggtggtttgccttgtgacctcagtttttggattgatctaagataaattactgattttcagttttctcagcgttttttcttgtcaggatagaagtgaggacctccaaaatccttacatattatagctgcctggtgagttttgtttgtttctttttttaaaaaatttttttttttttttttttttttttgggatggagttttgcgcttcttccccaggctggagtgcagtggcgcaatctcggctcactaaaacctctgcctcccaggttcaagcaattctcctgcctcagcctcccaagtagctgaaattacaggtgcccgccactatatctggctaattttttttatatttttgatagagatggggtttcgtcatgttggccaggctggtcttgaaatcctgacctcaggtg

SEQ ID NO: 50517 - DNA, 1116 bp, Homo sapiens
taatattgatacagacatacaatgttcaataactacatcagggttgtatccatcaccaagcatttatcctttcttggtgttagaaacaatctagtttctaatctctaatagtttctaatctctagtagttatattaaaatgcataatgaattattattgactgtagtcaccccattgtgctatcaaatgctaggtcttattcattctatctaactatatttttatacatattagccatccccactgtgccaccatccccattagtgccctggcccccactacccgtcctagcctctggtaaccatcattctactctctatctctatgagttcaattgttttgatttttagataccacaaataagtgagaacatgtgaagtttgtttttctatgtctagattatttcacttaatataatgacctacagttccatccatgttgttgcaatgacaggatctcatacttttttaagggctgaataggactccattgtgtatgtgtaacacattttctttattcgtccgtctgttgatggacactcaggttacttccaaatcttggttattgtgaatagtgctgcagtaatcatgggagtgcagataactctttgatatactgatttcctttctttggggtacatatttagcagtggaattgctggattatatggtagctctctagtttttttttttttttttttttttcatttttgagacagggtctcactctgttgcccaggctggaatgcagtggcggaggttcacttcagcctcaacctcgcaggcttaggggatccacccacttcagtcttccaagtagctgggactataggcgcataccaccatgcccagctaggtttttgttgttgttgttgttgttgttgaggcagagtctcactctgtcacccaggctggagtgcagtggtgcgatctcggctcactgcaacctctgcctcctcggttcaagccattctcctgccttagcctcccaagcagctgggattacaggcgcccaccaccatgcctggctaacccagctagtttttaattgttcgtagagatggggtttcaccatgttgtctagactggtctcgaactcctcgactcaagtgatcct

SEQ ID NO: 50518 - DNA, 1082 bp, Homo sapiens
gaccaagcagacctaatagtaacctacagaactctctaccacagatcaacagaatatacgttcttctcagcacatcacacttattcactcaaaaccccacaactacatggaaactgaacaacctgctcctgaatgactgctggtaaataacgaaattaaggcagaaataaagaagttctttgaaaccaatgagaacaaagagacaacgtaccagaaatctctgggacacagataaagcagtgtttagaggggaatttatatcactaaatgcccccatcagaaagcaggaaagatctaaaatgaacaccctgatatcacaattaaaagaactagagaaaaagagcaaacaaattcaaaagccagcagaagacaagaaataactaagttcagagcagaactgaaggagatagagacatgaaaacctctccaaaaatcaatgaatcaaggagctggttttttgaaaagattaacaaaatagaccatgagccagactaataaagaagaaaagagagaagaattaaatagacacaataaagaatgataaaggggatatcaccactgatcccacagaaatacagactaccatcagataatattataaacacctctacgcaaataaactagaaaatctagaagaaatggataaattcctggaaacatataccctcccaaggctaaaccaggaagaagttgactccctgaatagaccaataacaagttctgaaattgaggcagtaattaatagcctaccaaccaaaaaaagcccaggagcagatggattcacagccgaatgataccagaggtacaaagaggagctggtaccattccctctgaaactattccaagcaatagaaaaagaaggattccttcctaactcattttatgaggcaagcatcatcctgataccaaaacctgtcagagacacaaccaaaaaaggaaatttcaggccaatatccctgatgaccatcgatgtgaaaatcctcaataaaatactggcaaacagaatccagcagcacatcaaaaagcttatccaccattatcaagtctgcttcatctctgtgatgcaaggctggttcaacata

SEQ ID NO: 50519 - DNA, 1696 bp, Homo sapiens
gcataagaggggcctgttagatgaaaaactaacaaatagaaagcaataatatcaacatcaacaaaaaggacccccacacaaaaaccccatcaaaaggtcatcagcctcaaagatcaaaggtagataaatccacgaagatgaggaaaacccagtgcaaaaatgctggaaattccaaaaacccgaatgcctcttctccttcaaatgaacacagctcctctctagcaaggccgcaaaactggacggagaatgagtttgacgaattgacagaactaggcttcagaaggtgggtaataacaaactcctctgagctaaaggagcatgttctaatccaatggaaggaagccaaggaacttgataaaaggttacaagaactgctaactagaataaccagtttagaggacataaatgacctgatggagctgaaaaacacagcacaagaacttcgtgaagcatacacatgtatcaatagtcaaatcgctgaagcggaaaaaaggatatcagatattgaagatgaacttactgaaataaggcatgaagacaagattagagaaaaaaggttgaaaaggaacaaacaaagcctctgaaaaaatatgggactatgtgaaaagaccaaacctatgattgattggggtccctgaaagtgatggggagaatggaaccaagttggaaaacacacttcagggtattatccaggagaacttccacagcctaccaagacaggccaacgttcaaatcaggaaatacagagaacaccacaaagatactccttgagaagaccaaccccaagacacataatcgtcagattctccaaggttgaaatgaaggaaaaaatgttaagggcagccagagagaaaggtcgggttacccacaaagggaagctcccagaggaaggatatctgggcagaaaccctacaagccagaagagagtgggggccaatagtcaacattcttaaagaaaaaacttttcaacccagaatttcacatccagccaaactaagcttcgtaagcgaaggaggaataaaatcctttacggacaatcaaatgctaagagattttgtcaccactagacctgccttataagagctcccgaaggaagcactaaatacagaaaggaaaaactggtactagccactgcaaaaacattccaaattgtaaagaccatcgacactataaagaaactgcatcaactaacggtcagaataaccagctagcatcataatgacaggatcaaattcacacataataatatgaaccttaaatgtaaaagggctaaatgccccaattaaaaggcacagactggcaaattggataaagagtcaagacccattggtgtgctgtattcagaagacccatctgatgtgcaaagacacacataggctcaaaataaagggttggaggaatattaaccaagcaaatggaaaaaacaaaaaaaaaaggggtgttgtaatcctagtctctgataaaacagactttaaaccaacaaagttcaaaaaaggacaaagaagggcattacataatggttaagggatcgatgcaacaagaagagctattttaaatgtatatgcttccaatacaggagcacccagattcataaagcaagttcttagagacctacaaagagacttagattcccacacaataatagtgggagactttaacaccacactgtcaatattagacagatcactgagacaga

SEQ ID NO: 50520 - DNA, 1091 bp, Homo sapiens
ttaagttacaaatggaaccagccaaactatgttattgcttacccattgtttttccagcgttagaggagtttttcaaagaatattttttgatttagagattattttatttattatctatttagagattattcatcatttagagattgccatttaatttcagtaagagttccatttgcatctgatattttttagtttcggagaaaggaaatggtggagaaatggattcatctccaatcctttggaataaaattcagacagtttaagctctagtctcaacttgatttaatttggaattgcatgatgtggtgtcagatttgggttcacatccagttctcttgctgtgtaaccttgggaaatttacccagcatctgagttgtttcttcatgtgtgcagtggagacaataccaagatgaagatttcatgagatgtctagtgtagacatctatttttcagagtggatgcatttaacagttggatgctgaatttataagagtatggatttcataaaaagagcataaatttcatgatatgatgtatatatcaaaagatataggtcgggtgcagtggttcatgcctgtagtcccagcactttgggaagttgaagcggatggatcacttgatgccaggagttcgagaccagcctggccaacatggtgaaacttcgtctctactaaaaatacaaaaattagccaggcgtggtggtgtgtgcctgtaatcccagctacttgggaggctgaggcaggagaattgcttgaacccaggaggcagtggttgcagtgagccgattttgtgccactgcactccagcctgagtgacagattgagactccatcttaaaaaaaaaaaaatgatggctgaataggaacagctctggtctgcagctcccagtgagaccaaaatgtagaaggcgggggatttcttcatttccaactgaggtacccagttcatctcattgggactggttaggcagtgggtgcagcccatggagggtagcagaagcagggtggggcgtcgcctctcccggaagtgcaaggagcgagagatctcccttccccaagccaaaggaacccgtgagtctatgctatccggcac

SEQ ID NO: 50521 - DNA, 1121 bp, Homo sapiens
ggctactagaaaatttaaatatatatttgaaatgccttacattatatgtctgttgggcagcactgatctatattgcccacttttcattcctgtttatttattattattttatttttatttttattttttgagacagagtctcgctgggtcgcccaggctggagtgcagtggtgctatctttgctcactgcagctgctgcctcccaggtccaagcaattctcttgccttggcctcccaagcagctgcgattacagctgtgcaccaccacacttggctaatttttgtatttttagtagagacggggtttctctgtgttggccaggctggtctcgaactcctgacctcaagtgatccacctgccttggcctcccaaagtgctgggattacaggtgtgagtcactgctcccagccttcactcctgtttagtattaagttatatagataatagtttgctactggtggatagttgttgttttttttttttacgaatttggtgctactaaagactgttctcatgagcattcttaaacatgtctcctttgcacatatgctagagtttctttctccctaatggttcttctgatttatacttccactggcagtttgagaatgttcttgttctgcagttcttcatcctggtcgatgtttttgtgtagataactgtaatttaatacttaaagtcaaaagcataaggaagcattggtaattatttaagtgaatataaaatgtcagcttatttttctcagtgaatcttttgtaatagtcaactcacattgcctattttttattgtagtgcttctgatctgaataaataaatttaaaatttaacagccatgttatgtatcttattagtaggcagctgcagttatgcaaccaaagaatgtcccatctttaagttccattagcttgaaaaagaaatggcagctttacgtcatggaatactgtgctgccactaaaaatgatgttttagaagaatatttaatgatgcagaaaaatattcacagtatcttaatggaaagaaaagattataaagcagtaaccatttcgttttgttaaaatcaggtctatgttagctttttttttttgagatggaatctcgctctgtcacccaggctaaagtg

SEQ ID NO: 50522 - DNA, 1068 bp, Homo sapiens
ttactttaaagcaggatttctcaaagggacactgttgacattgatttcagaagtgagattttcatggtttttaatgttattattataatggtatggatagtgttttgccctctaagaagtagctaggagtgtttccatagatgcatttagtttatatcacttatgtattctgtctctattttgtaagaaaattgcctatgaacagaattttttctgtatgtggatttaatgtcttcttctaaaggaaacatgggtgtggttcacatttccttagttttgagtagcatggcttaagttgtgatccaattttaaaaaatcagttgaataaataaatagaaaataaaaggataatttctgtactaaaaaagtcagctggacagttaaaacatctccttttattcgtaagtttttcaataaaaattgttaaaagcagtattcatttgtgtaatgatataatctttgttattgttttatgtgcttttctaaaatgcaggaaacataaggtaaggagaagtctttccttaccctgggaccagatgtctatgaggactgttgacttttctgctataaacaggatgataaattaacagtggtgtgataggtaaagtagatttgttatgacatatcttccattaagcgataataacttgatttttacttagttgatgaaataaaataactttgaaaccttgggtaacatgaaattgaatcaaaatattttcaagttatggaacatagtgttattaatagaatggagtgttgaaaaagcactggattatgctttctgtaacttttagttctgggtcttatgataactgtgaccctgagcctcagtgttttccttttaatctgtagtgatattttttagttcagtctctcattttaaactgcttttagctctaaaattttatctcagtgacctgttgagttatataacaatcgtatcaggtaacctagataagaagaggaaggcagtaacatttcagaaatacagtttggggttgggaatccttaagtgatccagacttctcctttggtccgaagatagtgtgaataaaacagctgagg

SEQ ID NO: 50523 - DNA, 1027 bp, Homo sapiens
cctggctgataaacacttttaaggcttaacatgagctaagtattattttagaacagattgtctcaaccttggcactatagacattttgtccagaaaattttttgttagaggctgtcctgtgaatgcattttatccctgacctctacccactagataccagtaacacccctaccctgagttgtgacaagcaaaaatatttccagaaattgccagatgttccctgtgggcggtatgggtttgagaaccacttttctagataataggcatttgtagataatgaatactgagctaagtggaggagtaaatggttgaaatagactatgtggttaagtacagttacagagatataaaccaagagatgtggaagaatagcaaaaaatttccttagagagttgatagcaagtattttcccaagagagacagcaattctgagttgggtcattggggatggtggggggaaatgtgctgaggagggggaaatattctaggtggtggaacgggttatgtctagagatacggtagaggagcccttgggtgccttgagaaaaatgagataataagtatgattggagagaatatgggaggtagaattggaaagaaggatgctagttggggtcaggtttgagaaaggcttttttttttttttgagacggagtcttgccctgtcacccaggctggagtgcagtgcctcactcggctcactgcaacctccgccttctgggtttaagtgattcttctgcctcagcctcttgagtagctggcattacaggtgcgtgccaccacttccggctaattttgtatttttagtagagaccgggtttcaccatgttggccagactagtctcagaactcctgaccttgtgatccgccagcctcggcctcccaaagtgctgggattacaggcatgaaccaccacgcccggccgagaaaggctttttatgctatgctaaaatgtttcattttccccctttcattatagaaaatcaacaaatacttttaaagtctgtagagttatatgatcagcttt

SEQ ID NO: 50524 - DNA, 1049 bp, Homo sapiens
aataaagttctattggaatacacctatgtccatttatttacattgtctgtggctgcttttgcactgtagttgcagagttgaatagctgcagcagagacctagtagcccacaaagcctaaaatgtttactgtctggccctgtattgaaagagtttgctgattattgtgctagatgaatgcaggatactacacccctctaaaaagagctgcatagaaatacatgcatatagatgcacacacgtctgacatctaccagctacctcatttcaccacttgggttataaaccacacatatttacatctgttgtacaattttcaatccgatttcagataaccttccttctaccacttcacaataattcatgagctgcaacccttttgatgcccacttcacaagcaaacttcaggtctttttcaaagtaaagtgccacatttattgttatatttgagcatttattatttaacatgtcaaactgtgctaccatttttctttggtttctttgttttaaaaaaagtcactgatgaaatttttgaatgttgtgcttctaacctcatttttcctatgagttctatggtgttaattgcacaattttacatagtttggtggtttttaggaacccatatgttacattattgaggaactgactaattatcatcctgtaaaaagtactaattcattcaccaaacatttctggggtgatgtaaatattaagtgagttaaatgggcataaagcacttatgtctttattgttactcaaatattagttattactgattactattaccatgtgtcaggaactgtaataagtagtgcattgatgaacaagacagataagggacctgtctccatgaagcttacattgtatttttaaaaatctattaatatacattttggctagtaaccgagcccttgccccacagaaaagttgtgctgttacacaaaataatattttaagatccatccacaagtcaaagacatttcacttaaaacagctttctcagcagtgtctccttgatagggtataatattttattgaattattgtttttg

SEQ ID NO: 50525 - DNA, 1030 bp, Homo sapiens
ttagttcagaattgtcaaaagtattatctacttttttttttttttttgagacagagtctcactctgtcacccgggctcagtggcaccatctcagcttactgcaacctccacctcctgggttcaagcgattcttctgcctcagcctccgagtagctgggactacaggtgtgagccaccatgcctggctagtttttgtatttttagtagagacggggtgtcaccatattggccaggctggtctcgaactcctagacctcgtgatctgcccacctcggcctcccaaagtgctgggattacaggcatgagccaccgcgcctggccagtattacctacttttaaataagattgtgtaggatttaatgcacagattttgaatcactgtgataaaaatgcatccttagttgtcttcattttgctcatttgaagtgctcagttgacttttgggtgggtaacatttgacttatagaatctaagataaaaaattatttctgagtaatactggatttgttattttgcttatttggattatattagttattttttggtttatttgatagcattccagatttagttttgctataatgcttgttttgaaaatgtggattttttccaaaagggttgatatttcagggaacaatttgaagcatacgacaaaatttgcatttgcttatgggggattttgtctgcagggtcagggatcagcatactgtggcctaccaaccagtggcctgttttttgtaaataaagttctttttttttgtttttgatctttgttttgttttgttttgttttgttgagacggagtcttgctctgtcgcccaggctggagtgcggtggtgtgatgtccgctcactgcaacctccgcctcttgggttcaagcgattctcatgcctcagcctcacgagtaggtgggatttcaggcatttgccaccacgcctggctgatttttgtattttttttttttttttttttttttttttttttagtagagacagggttttaccacattggcctggctggtcttgaactc

SEQ ID NO: 50526 - DNA, 1595 bp, Homo sapiens
tatcatgtatacctggttgtataaacatttattggaaaggaaaaaacatttttgttggaaagtttggtaattattgtggcttaggatatgttctattttgaaagattgctatatccagtatatttctgcccttttatgattgaagatgtacgtctgaaaatacctatgttagttctagccggttgttctttttgcgctgggaagtctttgaattttgcactgtagctgctattttcagatcctgtctctgaaactttgtctctcagttttagcttgaagtagccatttcctgtatctgtagtccagcactcttgttaactgtcccatacaatatttgttaagaaattattgttctggcagtagtattcacatgtatatatcctgcactccatattttgggggaatgctttattagttgatcaaatacttaagtatcaatttggggccaggcatggcactgtgttagggttatgccaaaggtaataaaattcctgccatcttaaggcattcttagtcaagtgagggagattggtaagtaaatgagcaattagaaagcagtgctaaaatatggaaatatattgattgcgctagggatcagaaatgaaagaaagcctaatttgggggatgtctaggaaagttttgcaaaggagatgttaactgtattgagtcttgaatgagttagcagttaagggttgactgtgagagggcagtccagacagctattagtatggttaaagattagtcttattttccatatatcagaggaaataagacatgtacacgattagttttggtgcaagatataaagtgataaatgctgcatgaagtaaaagtaagttgttgtgtgagttcaaagtagaaagacatttctggtggggaccaaggaaagctttatagagagatagcatttgagccgggcgccgtggctcacacctgtaatcctagcactttgggaggctgaggcgggtggatcacgaggtcaggagatcgagaccatcctggctaacatggtgaaaacccgtctctactaaaaatacaaaaaaaaaaaaaaaaaaaaaaaaatccgggcatggtggcgggcgcctgtagtgccagctgctcgggaagttgaggcaggagaacttcgtgaacctgggaggcggagcttgcagtgggccgagatcgcgccactgcactctagtctgggcaacagagcgagactccgtttcaaaaaaaagaaaaaagagagatagcatttgaatctagtccttggaatataggtacagttttgacaaaggagactgtgggagaattccagatgtgaggagtagcagcttgagcaaaggaatgttgtgtatattagcattttctatttggaagaaggtcaacatcgaattttaaacttaatttctggacaaatactgtataactattgtgcctttttttttttttttgagacgtagtctcgctctgtcacccaggctggagtgcagtggcatgatcttggctcactgcaacctccgcttcccgggttcaagcgattctcctgcctcagcttcccgagtagcttggactacaggcgtgtgccaccatgcctagctaatttttgtattttt

SEQ ID NO: 50527 - DNA, 2214 bp, Homo sapiens
ggccaatttttgtatttttagtagagacggggtttcaccatgttggccagccaggctggtctcaaactcctgacctcaggtgatctgcccgcctctgcctcccaaagtgctgggattacaggtgtgagccactgcgcttggccttaatttatttgcatataaagatttcagtattgggagatttggtgaaatttgtcattctaatccttatggcaattgattacttgaaaagctgacagctatattaccttgttattgatcttaaatataaaaaggcagaagttgtctaaattgagagattttgaatgtcttagaaagtatctgttaaggtggtagtttacaagcagttacattgtaacctaattgttgaaaaatgttatctgtgaaatacttgcatttccactatgaaaagcatgaaaccaggcccttggagggggaggagatgcaaattttataaaggtttttaaaaagcatttaaatatcaatggcttggttatgtaatgggttggggtgaaaagaaagacatttgtgaccttaatttttatcaggcccagttttattattggccacccttggcatagttggccttgagctttcagttatgtattgtatttctagagataagataaatgtagtacttaaaataatatttaagtattgatgtaggtgtgtgaaataattgtttcataagtaattgtatgtgtctttttcacttttggggtctgaataaacttatgggttgggtaataggatacgggcaattcttgaatttacatgaagtgctttcccccagaccgtgaatgttcttttggatatcagaaactatttaaatagttgaagccagtgaaaactgatgcatagatcttcctttagaaatgttgaatataacagggcagtgaaaggagggtctaagcagtctgtctctaattttatcctaatgcttgtcttatgatcagcttggaagctgacatgcaagatgtttaacttctatttttccatctgtaaaatgggaataagctcaaatgggagtaaatatcaatatttatcaataatagatattgataaagtctaaaggtattctgaaggaggtaacatgtttgtaacaatggttcttaaaagagaaactaaagctctggggtcctagttttttttttttttttttttttttgagacagagtctcactatgttgcccaggctggagtacagtggcacgatctcaggtcactgcaaactccgccctccgggttcacgccattctcctgcctcagcctcccgagtagccgggactacaggcacctgccaccatgtgcggctaattgtttgtatttttagtacagacagggtttcaccgtgttggccaggatggtctcgatctcctgacctcgtgatttccacccgcttcggcctccaaagtgctaggattacaggtgtgagccaccgcgcccggctgttaatttttaagagtgaaaagaggtgctgcgactaaatggtttgagaactgcttgtatagaggaatgaacactgaactgtgagccaagccttggtttttcagttatagctctgttgcttgattgtatgactgtggacaaatcatttatctgttccaggcttctgctttgtcatttgcagaacgaacaagactagatggtctgtagcattaatttttttttgggacaaggtctcactgtcacccaagctgtagtgcagtgacactgaacatggctcactgtagccttgacctcctggctcaagcaatcctcctgcttcagcctcccatgtagctgggaccacaggtgtgtcatcatgccccgctaattttttgatttttttgtagaaacagtggtctcactttgttgcccagtctggtcttgaactcctggacttaagcgatcctcctgccttggcctcccaaagtgctgggattacaggtgtaaaccaccataccctgcctaaagttagtttttaaaaaattctgcttacaggccacgtgcagtggctcacgcctgtaatcccagcactttgggaggccgaggcaggtggatcatgaggtcaggagttcaagaccagcctggccaagatggtgaaaccccatctctactaaaaatacaaaaaaaaatcatctcggtgtggtggtgggcacctgtaatctcagctactagggaggctgagacagagaattgcttgaacccaggaggcggaggttgcagtgagct

SEQ ID NO: 50528 - DNA, 2058 bp, Homo sapiens
tttgacatttgaattttcatcccacaatgtgaattaagtaatttttttactcggagatgcatccttggcgtccagtggcaaaataaaattacaaggagcatgggtcagaattgcatttcaagttggcgaaatgtgcctttgagtaactcttagattggcatatgtttttagagcaatttagctagaatgtagaattgggcaatgagcctatgatacgtatgtctgtatttctgcatgaacaagcagtagattatattttctttaccttggggaaagatatgcttcagttcttagattgtagatctctagttgtgtacacgattgtggccttggtttctgaatttgtcagtaggctcaaatacaacaaatctttatctgtggggtattaggcacgtaagtggtacccagtataacttgttggcctgtaattaccaggcactcatgttcatatgcatggatggtgtaccttacagttaaattatgacctctagattttactaagtttcacaaagtctacatttgaaactatagtttgaagtcggatcttctcagtttctttagaatgaacaaattacgtatatagaatttctgaatagaataattaattttacacaagggtcagtttttcttactagtcttggatttttgtagatcttgatgataagagtaataatcataactaagttgagtgcttattgtcgttctttataatcttgatgaattctcaaacctgtgaggtaagtacttggttttgcccattttaccgatgaggaggaaagtgagacatagatcaagaacttgaccgaagttatacagcttgtaattggtggagctggaattgaaccccatcttgacttcacagcttatgttcttaaccacaaggcattaatgcccccttcagctgccaggtctaacctgattatgaccatttaaatttagcccaagtgttacaatgaaagaagttcatattacctactctgatttgttgcaggtctatgattttgtagctgtttataatgttacattttttgtgtccaggtgtactatgtagtgagataactgaaatatttaatgctaggagagtcttaagctacatgaaaaacctctagtaaagaactgcatatatgcatgtagggaattaattaaaaagtgtgacactccctgatgatttactatgaaagagctccaagtaggtgttcagaactgtctcaggctgaagtgtcatcgatctcctaaaccataatcatggttaaaggagaatctgacaggtaatgcttgagttgaacccacagtaccaaatccctcttgagtcttttctaatgtgaggcagaaataatataagcattattgttaatattattttacacagtagttccagattttctctttatcaaatattttgtcaagcacttaaaaagcaggaacaaagactagttctaatttttacttgtgtttataaaaaaaagtaatattctaggattctgtggtggaaaaatggccagaagacaagaggaaggaaaataaaccgatgacctggctaaaacatacactgactaatcagtggctcagtctttaaaggttttgttgtttttaaaggatttttttggttgtttgtgttgtttgaaataagattgacttgcttctggcattataaaagataaggtcttttataatcaccaagctctcaatgtagtacttgggtacctgggtgtcactgctgattattttttaatttttaaatttatttttttgagacagagtctcactttgttgcccaggctggagtgaaggggcgtgatcttggcttactgccgcctccgcctcccaggttcaagtgattctcatgcctcagcctcccaagtaactgggattaacaggtgtgtgccaccacgcctggctaatttttgtatttttagtagagagggagtttcaccatattggctaggctggtcctgaactcctggactcaagtgatctacctgccttggcctcccaaagtgctgggattacaggtgtgatccaccgcgcctggctctctgctggttattcagggcccaa

SEQ ID NO: 50529 - DNA, 1531 bp, Homo sapiens
gctcagttagaaaaggactccctggccaggcgcagtgacttacgcctgtaatctcagcactttgggaggccaaggcaggcagatcacgaggtcaggagttcgagaccatcctggccaacatggtgaaaccccgtctctactaaaaatataaaaattagctgggtgtggtggcaggagcctgtaatcccagctacacaggaggctgaggcacgagaatcacttgaactcaggagatggaggtttcagtgagccaagatcacaccactgcactccagcctggcaacagagcgagactccatctcaaaaaaaaaaaaaaaagtaagaaagaaaaggactcccttagaatgggaaagaaaaatcataaaatattgagctgatgcctgtatatagaaattaagcgtttctcgaaagctgttctatgttttgctgttattttagtctttattctcttcctttaggtggagaaacaaagtaccaatttgaagggattttttttattttgtcttttggtttctgtcagtagaaataaccatatgtgctaaccaaatttctgtgaagaatgttttcatggttatcattatatctaactataacctcccccatagttatgaagagtaacctgaaatgccactattgtggaaataggataattgtaattgtgaaaaaataattttaaggaaatcttacaagtattacattaaaaagatactatgactgccacctgccatttaccttctaataaccctgccatgtggtttgcagaaagagatggatatagtagcctcagaagaaatattttatgtgggttttttgtttttcgttactagatttcatggatgaggggatatggttgaccttttactttttaatggagcagccagtttttgttaattactcacttgtaaattgtgagattctgaattccttacctgctattcttgtacttgtctcaggccaaatctatgctgtggttcttatgagacttgtatgaagatgccctgatttgtacagattgaccacgggaatactactgccatgtaatctgtatagttccagataatttgtcatgaacattgacagaatgacaattttttgtatttgctttttctccctttaagagcacattcttctgtaaggagaaaggcagcattctggctaaaatgtgtagaaggtaatttactacacttataaaatagtgtgacttttgtgaaaattttgaattagctttcatatgaagtgccttaagtagactcttcatttacttttctggtaatggtttaaatatcatttgttatgcatttttaagatacagttcagaatgacacattgtagtggcaaagataaccaaatgtctggctgtttgctttttgaccatatcaataaacttttacaatctaaattctgagtttttgattaccatctaaagaggagtgagttttaaacactaaactagaattgtaaaattaggattttacattttgaagttataattaaattaatttaaatttcatattgtcctaaggacagtttg

SEQ ID NO: 50530 - DNA, 1020 bp, Homo sapiens
gtttcagctttctgatgagttaaaaaggtcccagagatatatagacactggagtactggaaattgaaaaacgaaaatcgtgtgtgtttgaaaagaagaatgcaacttgtatattttgtattacctctttttttcaagtgatttaaatagttaatcatttaaccaaagaagatgtgtagtgccttaacaagcaatcctctgtcaaaatctgaggtatttgaaaataattatcctcttaaccttctcttcccagtgaactttatggaacatttaatttagtacaattaagtatattataaaaattgtaaaactactactttgttttagttagaacaaagctcaaaactactttagttaacttggtcatctgattttatattgccttatccaaagatggggaaagtaagtcctgaccaggtgttcccacatatgcctgttacagataactacattaggaattcattcttagcttcttcatctttgtgtggatgtgtatactttacgcatctttccttttgagtagagaaattatgtgtgtcatgtggtcttctgaaaatggaacaccattcttcagagcacacgtctagccctcagcaagacagttgtttctcctcctccttgcatatttcctactgaaatacagtgctgtctatgattgtttttgttttgttgtttttttgagacggtctcgctgtgtcacacaggctggagtgcagtggcgtgagctcggctgactgcaaactctgcctcccaggtttaagcgattctcctgtcacagcttcccaagtagctgggatttacaggtgtgcaccgccatgccaggctaatttttgtgtttttagtagagacagggtttcgccaagttgtccaggctggtcttgaactcctgggctcaagtgatccgcccgcctcagtctcccaaagtgcgaggatgacatgtgtgagctaccacaccagcaatgtctatgcttctcgatagctgtgaacatgaaaagacatctattgggagtccgaggcaggt

SEQ ID NO: 50531 - DNA, 1055 bp, Homo sapiens
gatgaaaattgttgaaaagttgagatttatcaataatgtataccccttccttttcactctctgaaagtatagactgccaggccgggcatggtggctcaagcctgtaatcccagcactttgggaggctgaggcaggcggatcatgaggtcaggagatcgagaccatcctggccaacaaggtgaaaccccgtctctactaaaaatacaaaaaattagctgggcgcagtggcgggcgcctgtagtcccagctaccctggaggctgaggtaggagaatggcatgaacccaggaggcggagcttgcagtgagccgagatcgcgccgctgcactccggcctgggcgaaagagcgagactccgtctcaaaaataaaataaaataaaataaaataaaataaaataaaataaaataaaataaaataaaataaaaaaagaaagtatagactgccatggttatttattatactcaacctgctcattttactctccttttatttttctgcagtaatgtgtgtggctggtattggacttgttgtattattcttcagttggatgctctctatttttagatctaaatatcatggctacccatacaggtatgattcttattttttgtttatacagtgattaccaatacctggaatgattagagttgatattgctttataatatccttctttttgctttgcttccaaactattttagcttataaaggaaagatataggctttatttttatttattcatctatttatttattatttatttatttatttatttatttttgagatggagttttgctcttgttgcccagactggagtgcaatggcgcaatctcggctcactgcaacctctgcctcccgggttcaagcgattctcctgcctcagcctcccaagtagttgcgattacaggcgtgtgccagcatgcccggctaattttgtatttttagtagaaacggggtttcaccatgttgatcaggtcttggactcctgacctcaagtgatccacccgcctcatcctcccaaagtgctgggattataggcatgagccactgagcccg

SEQ ID NO: 50532 - DNA, 1126 bp, Homo sapiens
tcccgagtagctgggattacaggtgcctgccgccacgcctggctaattttttttgtagtttttagtagagatggggcttcatcatcttggccaggctggtcttgaactcctgacctcgtgatccacccgccttggcctcccagagtgctggggttacaggcatgagccacagcgcccggccgaaaattgattttcttatcagtcactaagtatgttaccctagaacaaacttgtccagtctgtgggccacatgcggcccaacacaaacttgtcaacttccttaaaacatcatgagggtttttttctgcaatttttttttttttcagcttatcagctatcattagtgttagtgtattttatttgtggcccaggacagctcttcttccagtacggccctgggaagccaaaagattggacacccctgccctagagcttcctttgctgttggacacatgcttccctacatccctatctctatagttcttagccatttttagtccggggattgaaagagcttcacatcatgacaatccatacttgcgcatttggggattagtatttgtagttcactttaataactgctgtgctaatgtaggacatgacatgtgggattagtggagagagctatgaatctagggctagggatcagattttttttctcattcaaataagaaatccatgtttattgagttacatatataaggctgtgtagttatctgtgcatgaataaagtactttcaagtgaggctatcacaatgaagtcatcagatgtctaagttaatgtttatcaatactacaaggccacttttaggggttttaaagttcaataaataagtaagccgggcaccgtggctcatgcctgtaatcccagctctttgggaggctgaagcggaagatcacttgagcccaggagatcaacaccagcctgggcaatgtagtgagacaccgtcttctcaaaaaaattaaaaaattagccaggcatggtggcacacatctgtagtcccagctactcaagaggctgtagtgggaggattgcttgagcccaggaggttgagactgcagtgagctgtgattgtgccactgcacttcagcctgggcaacagagcaagaccctgactcaaaaaaa

SEQ ID NO: 50533 - DNA, 1083 bp, Homo sapiens
acagtgtacaacagtgtacaagggttcccttttttccacatcctcgccagcatttattattgcttgtcttttggatataagccattttagctggggtgagatgatagatatctcattgcaatttttatttgcatttctctgatgatcattgatgttgagtagtttttttatgcctacttgccatttgtatgtcttcttttgagaaacgtctattgaaatattttctttttttgcggtggctcacgcctgtaatcccagcactttgggaggccgaggcaggtggatcatgaggtcaggagatcgagaccatcctggctaacacagtgaaaccccatctctactgaaaaaaaatacaaaaaaattagctgggcatggtggcaggcacctgtagtcccagctacttgggaggctgaggcaggagaatggcgtgaacccgggaggtggagcttgcagtgagctgagatcacaccactgcactccagcctgggcgacagagcaagactccgtctcaaaaaaaaaaaaaaaagattttatgttttttcgatcagatcattagtttttttcctgtagagttgtttgagctccttttatattctggttattaaccccttgtcacatgggtactgtgcaaatattttctcccattctgtggattgactcctcactttgttgattgtatcctttgctctgcagaagcttttaaacttgatgtgatctcatttgtctatttttgctttggttgcctgtgcttctggggtattactcaagaaatttttgcccagactaatgtcctggagagtttccccattgttttcttatagttgtttcatattaatagtttgcagtcttaggccaggcacagtgactcacacctgtaatcccaatgctttgggaggccaagaagggcagatcacttgaggccaggagttcgagaccagcctggccaacatggtgaaaccctgtctctactaaaaatacaaaaattagccaggtgtggtggtgtgtgcctgtagtcccagctacttgggaggctgaggcaggaggattgcttggcccaggaagtggaggttgcagtgagccaag

SEQ ID NO: 50534 - DNA, 1026 bp, Homo sapiens
cctgggaggtggaggttgtagtgagctgagattgcgtcactgcactccagcctgggtgacagagccagaccctgtctcaaaaaaaaaaaaaagccatttaatatttttaaatgtgtttgaggtcagggcaataactgaatgtccagacaggttatttcaaagtacaatttcgggaaaactcatatttcatctgtaagttatggtgggacatttgtttaaaatatcaatttttctttgcacaaatgaagtaatcttccaattttaattttttgtatcttcatagtaaataattgtcatgccgtatagatacaagattccttattttggttttttataatgaagagttgaaggtttatatattcattttaattttcttcatgagaaactggaaatagtaaaatggtatgtcttttttgtctgtgcgaatttctccttaaacaatttttcttagatggtggagttaccttaggaatggtgcttttatgtgaagctgctacctctgacatggatattggaaagcgaaagagtaagtcaccttactcaaaatgtaacagtgctgcctgtactatggaaaaagagtgatctcttaatcacttttcctcttacttataggataagtaggttattttacccctttactatttttttctttaaatgtcatatctgttattaaactcctttactattttaaaattaatatatgctcattatagaaaatgtaaaaaaacaggagcatgaaacattccaccactgaaaaactaattatttttaaattgtaatatatttctttccacttataaaaaccttaaaaactgtatatataaaattttgacacttcacaccccctttttaaactggagttaaataactaataactttttctatatacataattttaaacttatactctgttattgtttgttttctttaagatagggtctcactctgtcactcaggctggagtgcagtagcataatcatagctcactgcaacctccgcccctaggctcaagctgtcctcacacct

SEQ ID NO: 50535 - DNA, 1046 bp, Homo sapiens
tggccaacatgacaaaaccctttctctactaaaaaaagtacataaattaactgggtgtggtgctgcgtgcctgtggtcccagctacttgggaggctgaggcaggagggtggcttgagcccaggaggtagaggttgcagtgagctgagatcacaccactgtgctccagcctggctgatagagccagactttgtctcaaaataaaaaaaaaaaaaaagaaaacacaataaatggaatcccagaataaatatatatggattttttttatgtttatttttttagagatgaaatcttgtgttgcccaggcttgagtacagtggggtcaccatagctcactgtaacctcgacctcccagaatcaagcagtcctcccacgtcagcctcctgagtagctgggactataggtgagcactaccacacccagctaatttttgtatttttttctagagatggagtctcgccctgtcgtccaggctggtctcaatctcctgggctcaaacaatcctcgtaccttggcctcctgaatttttaaaataaagtagcagtctggaaaatgttcacctataacctgaaaccctaatagtataaactacatttacttttgcatattatcttgcattcatttctatatgaatgtttcatggtaagggtgttcattttttatacttgtagacatgttgtgtatggagtttgctatcttaatatattataagcattttctatgttgtatggcctttatatttataaaaatacataaaaattacaaagaaatctgaaaatacgaagaaaaagaaaagtagtcaatatttttaatgtttatataatggatatatcatatccatgttgcccaggctggtctcgaactcctgaccttaggtgatccacccgtcttggccacaagcgtgagccaccacgcctggccttctactagcttttaatagcctagttgttgtatgttatggaataatgtctcctctatttctgctcagttctcctggagtaacatttaatcaggactgtgtaatttatgtatttcattgtttgtattc

SEQ ID NO: 50536 - DNA, 1044 bp, Homo sapiens
agccagaaacggtagtgtgcacctataattccaactactcaggaggctgaggcatgagaattgcttgaacccaggaggtggaggttgcagtaagccgagactgccactgcactccagcctgggcaacagagcgagactctgtctcaaagaaaaaaaaaaaaaaagaacagaaaagaaaagtatggtttgatggattaacaaattattataccttagaaaattttcagtatcttgaatcagttcttctcactagtactttgaaattgaataatggagcaaaagagcaattaaaattgtaaagtattaattagttgatttggggtttgttggtcttttagctttgtcttaaacttttaaatatataagaagtttaagaaattagaaaattgtcattttacctctgctttaagactgagcatcagcctaaggtttagtatacatttggaacggattacaatcctgttgggatatagaatgtcttgtgtttggttattaggatgcaaaaagtgaacttttttcagagtcagacatgtatacagattataagacagtgacttaagtgctgtgtaccagaaatagtgagaaaatgaataattttgtcagaggtaaggaatattagaaaaggcctaaccactccccacccccccccccttttttttttgagtggagtctcgctctgtcacccagactggagtgcagtggcaccatcttggttcactgcaacctccacctcctgggttcaagcgatcctcctgcctcagcctcctgagtagctggaattacaagtgtgcaccacctcacctggctaatttctttatttttagtagagacagggtttcaccaggttggccaggctggtcttgaactcctgacctcaggtgatccacccatctcagcctcccaaagtgctaggatttcaggcgtgagccacctcacccggcccccactttcttttaaagtaaatatgaaacctcaagaccggtaacattgtttacagcttccaggttgataataattaatagactgaggccacctctaagtagt

SEQ ID NO: 50537 - DNA, 1049 bp, Homo sapiens
caccggagccaggactttgggattgcaatgagctatgatcatgccgctgcactccagcctgggcaacagagcaagaccctgtctcaaaaataaacatagtattagtacaatgaaaagacaaatcgagaatagataatacaaaaatagccttatagtaaccagacttactgatgaatgccacagacccggagtatgtcacatggtttatcaggtgaattaataatttcatagtttaaaataccccgttttagggttagcataccaacatttaatgtatacttaaagattccattttgtcttttttccctcctagaattatatccatggaagcagtcaagcccagtttgtagctgaaacacacattgttcttctgtttagtatccttttacaataagtctttcttgctgtattttgtctgttttctcacagtctagtattctctctacagcatttggctggggctgttctcttaatgcaagtcacaatatcctttgaaaatcattactgtatcatcctctccagcccaataaaccaaagactactagggacaaatctgtagtctgatagggccaggtttattggctcattaatatgaggaatactgtacattagaagaaccatggaacatcttaacaaagaaaagatagagttgtaataggatttgggagaatagtggagtttatgtgaaatttaaacaaagcattgttttgataggctaaaagcagtgtaaggctgtgtaaaggggtcaacatcaggtctgaactgtcaatcagacccagggttctgtttgcttggaaactacaaagttaacataaatgtgggatttttgtcttcaaaaacttcttctttgaagctctataccttggttgtaaattgaggctacttagaaattatacgtgtaaattgagtgacttagatctgccaagcaagaatatttcatttttactcatataattgcaagaagtctatttaaagaccaatattcctcagtaagaaaacagtaattactcaaagatggggatattttgacattttacagctgaagtgtg

SEQ ID NO: 50538 - DNA, 1003 bp, Homo sapiens
tgaatcttactgggaggccctaattagtcttgtccccatatcactgaggtggtactagtttggcagtcacttcataagtagcattaaacagaatcatcttgatgaatgagtgaaattacagaacactctctattaccctattgaattcagcatggaaaccactctttcgaccttaagtccatggattatctagttgtacttggcaaatccttcttaatctaaaagatgttatgttgtggttaaatagaatattgtacctattctatcctattttaggttatattatagactagtttgattgggataacataaaaaggatcatttttccgaaagtaaccacaataattttgattgctttcatttcagattttattttgacccatataattagtaaaaaaattttatactttaacatgtttttctctcctttccattagattagagtgattagacccccaaattatgctggtccccttatgttgggattgcttttggctgttattggtggacttgtgtatcttcgaagaagtaatatggaatttctctttaataaaactggatgggcttttgcagctttggtgagtgaatttcagaagacaaaaaattatttgaataaaattcctaatagtgtatttttaggtaagcttttatttatgtgagaagtagcattttatttcttacctgaggaaaatagttttatatattttaattttctgtcttaaaatcagtttgtttcattcattatctcataaggatggccagaacttcaaggaactgattgtacctgccttttattcaacctaaatgacagactgtcatctctatgaaaatctctagttgttctgaaaatattattcttttttttttttctttgaggcggagtcttggtctgtcacccagactggagtgcagtggcaccatcttggctcactgcaacctctgcttcctgggctcaaatgattctcctgcctcagcctctcgagtagctgggattacaggcgtg

SEQ ID NO: 50539 - DNA, 1101 bp, Homo sapiens
ctgtcggtagctgaggcgggcagattgcttaagcccaggagttcaagacctgcctgggcaacatggagaagccccatctctacaaaaaatacaaaaatcagctgagcatggtggaacacgtgtgtattccaagcacttgggaggctgaggtgggaggatcccttgaggccaggaggtcaaggctacagtgagccctcattgtgccactgcactgcagtctggatgacagagcgagacagtgtcattcattcgtttattcattcattcattcattcataattaattacatcaaaagtgtaatgtctgacaaaatattatgaaataatgtattttaagaataattatcatccagcccaactaccaaattttggctttaggtctcacattttctgtatacctctgcttgttagtattggttttaagtaagctgcctcattaaaagaactttaaatgccaagttgagtatattaatagcatgctcactttgtcttttttagatggtgttatctgaaaaggttagtcagctgatggaatggactaacaaaagacctgtaataagaatgaatggagacaagttccgtcgccttgtgaaagccccaccgagaaattactccgttatcgtcatgttcactgctctccaactgcatagacagtgtgtcgtttgcaagtatgaactccaactacgctttaaaattaaataactcatataacgttaaccatttctcaatcccagaagggccaagttagtgcagtaggtacttaaataatgtgtataccttactcaggatgtctatggtagcaatactactgctcttttatagtcaattcttgattatccgtatcagtgggggaagcatggataaataattgtggtagccatcataaaagtaacttaaagatcaaacagtcatcttataaattagtatcaacttggcggggcatgggggctcatgcctgtaatcccagcactttgggaggtcgaggcaggtggatcatctgaggtcaggagttcaagaccagcccagccaacatggtgaaaccccatctctactaaaaaaaaaaaaatacaaaaattagctaggcattgtggtgcatgcctgc

SEQ ID NO: 50540 - DNA, 1072 bp, Homo sapiens
ctcatgagctactttttattttctactacatattacccagtgtttcaccagcactagtggtgcttgggtcttgactcttcatattaaaaaattatcccttagagagatacttaactgaaatagatctcttttctataggaaaatataaatgcatattatatgagacctatttcttgaaatgtcaatggagtaatcatgaataattaataattttatattaaataagcatgtcatatagaataaggtttttaaaaaatactaacacttagatacaattttagcaaataccaaccactacactgttcccctcctttccgattcttgtttaaagagaaaccttgtttaattcttcttccagtatattttccagcttgtacactgcatattgggaaagtttggtgtgagtctccctctatcttttgttctacttgctgctccagtggggaaagttaactgtgattttatttcccgtttatttgtaaatgtccatctaatttatatgactttgaatgtaacttaacgtcttttcccactcttcctttttaattaaggatacagaaattgttgatttagattcagacggtcctggtacttcatctggaagaaaggtgagtaaataagtgaactgctgaggagatatgttttcaggtttcctgtgtcagtgatccctaagaccaaccccatatttggagaattgctagaaggattcttgcaactaagtatattaggtatgctcattgataatatttattagagtgatgcagtaagggtacccagttgagtcatgggtgaaaagacacaggcagagtctggagaaaattatgtacaggcttccttatgctattattatctttcccctgtgaggggtcacatattacactctttttccagcatgtgtgtgattagagactcagtccccaaagattttactaggggctggttatgtaggtaccctctgactagcacgtactaagattccagattcccagaaggaaatcaggtattcagcacaaatcacattgtttatactgtctaggtgcagtaaactgtcttaataatttaggaagccatt

SEQ ID NO: 50541 - DNA, 1067 bp, Homo sapiens
ggtccctctgtcatccaagtctcctactgacgacagtattccatgactggttaatctgcctttgcaattgagaactggttgtatttttataatatattattttgatttaatatttatatcataaaagtaattagataaaaatctgtcattttttataatctgtttttttttcttgctcttcttggctcttcccctgaaaactaaactaaacattcttttgaccttgtcaaatgactctttacctataatgtcctaggtcagttctatttgaagttttgtatatacattccagtggttcagaatccctgcttgtgctttaaatactgtaactatatcatctctttttagtgctcatcagtcaaatatattgagttatatgcatattggaacacctttgacacactgtgtttaagtacatatttgttccatattgtatattcctaaaatatactttaaatatattagccaaggctaacagagtattttttctttcacaggagaatatcagcattaatgtgggaggtacgctatattgaacataatgccaggactttcaatgagccagacagtcctatagttaaagcagctaaaattgtaactgatgtcttacttcgatttattgggtaagaagcagttttagcttccagagagtctaacttaaggtttttaaaaaattaattttaaaaaaattaattgaaaaattgtaaaaattactgaagcttttgaaatgacttgtttcttagggatcagagctgtactgatatactggatacttataataaaattaaagcagaagaacgaaacagtactgatgcagaggaggtaagaatcacagcatgattagtaggaatgagttacttttctcttatttgaagtacagtattatgtgtaaatgttgtaattggccatgaacagcaaaacagatttttgaaatctggctgaataccagcgtcttttaaagtgtacttagatggcatataccaaaaataaaatagagctacagggtttattcagagacaggtggccagtcatcatatttgacacagtggatgtaagtgacgagaaat

SEQ ID NO: 50542 - DNA, 1050 bp, Homo sapiens
taatctcttcctaaagattgttgtgaggaatcaaagacaaacctttataattccctaattgaatgtttgaaacatggtggttgcttttatttctgttaataataataggaataataagtcagaggctctttatgtgaagttgagtttaaaacgtaaggagattaaagaacattaattcatactccttaatataaaatacctcatattaaggtttataaacctgtattggcatctttatatttttaaagtaatatggcagtaggcagggcactcccaaacaggtcagagaaggtgatgtttaagtaaaggcatttctagggactgtgaggtttgcaaacttttctcaatgggtctacaataaacatatatccttggacatttagtaacatatattgttatatctctatattgattcatatgtgctttattttctgtataggtatcatgacatgccggatgtcattgacttccttgtgctacatcagttttataatgaagccaaagaaaggaactggcagattggtaaatatagaattgttgtttaataactattaagcttatgtacagtaagtaactttttaactgtgatttaacagaaagaaagtagcttatcatttagctgaaaaaagctaccagagaaactagaaaacttaagttaaaatttccttttagttatttcttatgcacattgtgtgtggcttataatctctaaaccttctgcaaatacctactctattagtatacaaacaggaatataaagaaaattctcaaatgtctgttgccctaaaatagagcactttacacttaggttctaaaacacatgattactgattgtgatttgtttccttttttccttcctccatccttgtttccctccctgtcaccttcccaccctcttttgctcttttacccttctttctttacttttttgattataaaaagcagtatagcaataatgtaaaggaaaatattttataatttaaataaatttgcttatagctctattgtataacaatacaatacagaacataaggatttttaaactatcaa

SEQ ID NO: 50543 - DNA, 1050 bp, Homo sapiens
tccaggatagatcgtattttaggacacaaagcaagtcttaacaaatttaagaagattgaaataatattaagcatcttttctaattacaatggcatgagactaaaaataacaggagtaatcttggaaggctcacagatgtatgcaaattaagcaacatacttttgaaaaaccatgagtcaaagaataaattaaaagggaaactgaggcaaatgaaaatggaaacacaacctaccaaaacttatgggatgcagcaaaaacagcccggagaggtaagtttatagcaataaacattaaaaaagagaaaatattaacattgaacctcaaggaactagaaaaagatgaacaaagtatgcccaaccttagcagaaggaaggaataaggaagattggagcagaaatagacaagatagagacttgaaaaacagcagaaaagattaacaaatcttaaagttggtttgttaaaaaggtaaacaatattgacaaatttttaggtagacttaggaaaaaaaacaaaagaaaagactcagaatcagagatgaaagtggaaactgaacagacaaataacaagtaatgagattgagtcggtaataaaaagtcttccatcaaataaaagcttaggaccaaatggcttttctgttgaattctaccaaacatttaaagcagaacttacactaatgtttttcaaactcttccaaaaaattgaagaggagagaatactttcaaattcattttatgaggtgagcattaccctgataccaaattcaggcagtgttaatacagggaaactaaaggccaatatcccttttgagaatagatgcaaaaggctgggtgcagtggctcatgcctgtaatcccagcactttgggaggccgaggtgggcagatcaccaaacctgtgtgatcatttcaatagatgcagaaatagtatttgacaaaattcaacatgtattcatgataaaatctcaacataagaggtatagaaggaatgtatctcggctgggcatggtggctcatgcctgtaacaccagcactttgggaggctgaggtgggcga

SEQ ID NO: 50544 - DNA, 1052 bp, Homo sapiens
caaagtgctgggattacaggcatgagccgacgttatttcttaatgtatagagactaagacttgtttatattaacaatcactgagaaaaaatatatagatatcatttccagtgccagatgaataaataaataaaccgctgaactgggagaaggaacatttaatgatatatgtcataccttatgttagatttttcttgaataggtattagtgactattgggaagaacctaatagaaaatgtatgtttaagataaaaatgtattttgaaaagtattaagtgaaattttaaaaatttcctcattcttttaacacaaagcagttggcttcatttctcttgtttctttatggtccttatccatacatttgtgcataaatttacatagttgatagtgtacacataattttgtattttacatttttgctgtgtaacccctaatttttttcacattgctttttatattattgattgctatgtaatagtctatcaaatattccataatttaatacgtaaccattcccttgatactggacttgtaggttgtttttaattcactggctttataaatagtactactttaaatattttatatatgtaactgttttttgctaatcagttatgtccccaggatagatgcccagaggtggagtaatagatgtgcatgttttcatggctcttcaagtatattgccaagttattttcctaagggatcatctcactgtatggtgcttttagaaatagaggtgtatatcagtttcaagtagtaatagctaacattaggtttttgaatttttagaaatgctaatttattaggtgtaaatttatgcctcattttcatttaaatttctttgataactggcaaaatagttgtatcttttctgtgagtcagcatattatttatatttcctatattgcaccttatctgttaacttttttttaccaaatcatcttttgggtgttgatggtgttcttatagctcattagttttatatgtattttaaaatattaagatttttccatcttgtaaatattttcacttttttcaatttttacttt

SEQ ID NO: 50545 - DNA, 1021 bp, Homo sapiens
agctgctatgaacatttatgtaagggttatttgtgaacgcaaactttcatttttctgggataaatgcccaagtttgtaattggggatcatatggtaattgaatgttttgtggctttttttgtttcttagagttttattattaatttctgttcttaattactttcttcaggatcatttatttttttttaaattatactttaagttctagggtacatgtgcacaatgtgcaggtttgttacatacgtatacatgggccatgttggtttgctgcacccataaactcgtcatttacattaggtatttctcctaatgctatccctcccctggcctccacccgacgacaggccccagggtgtgatgttccccgccctgtgtccaggtgttctcattgttcaattcccacctatgagtgagaacatgcggtgttcggttttctgtccttatgatagtttgctcagaatgatggtttccaactgtatccatgtccctgcaaaagacatgaactcatacttttttatggctgcatagtattctatggtatatatgtgccacattttcttaatctggtctatcattgatggacatttgggttggttccaagtctttgctattgtgaatagtgccgcaataaacatacgtgtgcgtgtgtctttatagtagcatgatttataatcctttgcgtatatacccagtaatgggattgctgggttaaatggtatttctagttccagatcgtttaggaatcgccacactgtcttccagaatggttgaactagtttacactcccaccaacagtgtaaaagcgttcctatttttccacatcctctccagcatctgttgtttcctgacttattaatgatcgccattctaactggtgtgagatggtatctcactgtggttttgatttgcatttctctgatggccagcgatgatgagcattttttcatgtgtctcttggctgcataaatgtcttcttttgagaagtgtctgttcatatcctttgcccgctttttgatagggt

SEQ ID NO: 50546 - DNA, 1050 bp, Homo sapiens
caatgccatttattgaaaaattggaaacaatctatttttatataatttatattaaaatttaaaacttaggctgtgtgtgatggctgaagcctgtcatctagcactttgggaggcctaggatggaggacccatttagcccaggaatttaagaccagcctgggcaacaaagtgggatcccacctctaaccaaaaaattaaaaactaaaaaaattagaaaattacataaggatttcatatatactatggataactttaatgattgcaggtaacagataaaattgcccaagagttatgttattcatttgtattaaaaaaatcagaggccggccatggtggctcgtgcctgtaatcccaacagtttgggagccagtgctggaggatcacttgagcccaggagttcgagactagcctgggcagcgtggtgagaccctgtctctacaaaaattaaacaataaaaaattagccaggtgtggtgctgtgtgcctatagtcccagctacttaggagtctgaggcagtaggatcacttgagccaaggaggttgaggctgcagtgagctgtgttcaggccattgcactacagtcagggtgacagagtgagaccctgtctcaaaaagaaaaaataataataataccactaatttgtatacttctagttttatctgaacttggtgccaatttgatgataaactctttcccagcagatatgatagttacctggctttggttaagtcctatgtctcttagcattattgatcagaatatttcctgtgataataaacagaattcagtgagttactcatctttcttgggagtaaaattctgtcgtggttagtgattttctggtttaggctcaggaggtttttcgtgggggggggtcttaagagtgcttttcttgataggaaactgctgaatctgtaggataattcaaaatgcattttttttttttgtttaagcataatcaactaaggaccactaagaattagcctgtagtctgagaaaatcagatgtatttatgtatagtgagcgagtaaactcccaagtaacaatgaa

SEQ ID NO: 50547 - DNA, 1094 bp, Homo sapiens
ttccaaattatataagtgaactttgcagaaagcctgaaaggaattgtaaataatatttctttgccatatttcacttaatattaccctagcaaaaagatgttcaatggccatgaatatgaatatcaatagcctgtagaacttattagtgttatttaagttttactgtggattggtgttatgagatgtgattggcatcaactttggagactgtatacttttactattgctggttaaggttttagagacataatttgatccatagaatcaaatccatgaaagaagtaattctatacctttgtaattttactagaattatcacattttattcatattcatttttgtcgctttcgtggcttctttcaagattttagtctatattaatctgtttagttgttggagttattttaggaaacccccaacgaagcttcaccaaaaactagctgggactacaggcatgtactgccatgcctggctaatttttttattttttttgtagagacagggttgcccaggctggtcttgaacttctgacctcaagcgatctgctttgcttcccaaagtgttgggattacaggcatgaaccgctccacctggccactttccagtgtttttggcagtattttcttagtctattattgtcctctctacttaatagaaactaatatgcttactacactttaaccaatcagaggattgcatacattctattttcttacttttttttttgagacagaatttctcccttgttgcccaggctggagtgcagtggcacaatctcgactcactgcaaccttcacctcctgggttcaagcgattctcctgccttagcctcctgagtagctgggattgcaggcatgcgccaccacgcccagctaattttttgtatttttagtagagatggggtttcaccatgttgaccaagctggtcttgaactcctgacctaagttgattcacctgcctcggcctcccaaagtgctgggattacaggcatgagccaccatgcccgaccacgttctgttttctaattaaattgtttgtttttgagatggagtcttgctctattgccctggctggagtgcaatggcaccatctt

SEQ ID NO: 50548 - DNA, 1035 bp, Homo sapiens
gtttctgaattttcatctgggcactttattttctgcttcctagttggctgttactgaccacataatagaataagatttgcttcttgcaattcatcttaaggtagataatttaaataatacagatgtcctttcatttgtggtgaccctattgagttgttggctaatttattgcttcctccttggagctttactggggacaacagagtaatcaaggttgtgtgtgtttaaatgaacagttcttgttaatctataagttttatatattgaaatggtgatttggaaactttttaaaaaccacattttaagatttttaaatcatttttaggagtctcgtatcataagactgaaccagggcctggtgtggtggctcatgcctgtaatcccagcactttgagagactgaggcaggcggatcacttgaggtcaggagttcaagaccagcctggccaacatggcaaaagcccttttctactaaaaatacaaacattagccgggtgtggtagctcatgcctgtaattccagctactcaggaggctgaggcatgagaattgcttgagccctggaagcagaggttgcagtgagctggaatcgcaccactgcacttcagcctgggtgactgagactctgtctcaaaaaaaaaaaaaaagactgaaccaaagttataaatgtgtttaggtgtggtatatagttttacatttatttcgcattttcatctctaaaactgaaagcaccagttagcgcttacatttggaatgacatagattgtattaccctcattttatatgcaaaatactagaagtaattttatgttttttatgaaaaacttttataaagattgtttgttattgtccttaaaaaatatacatacatctatgattatatgttgttataagaagttgcatctgcatataacacattcaagtttaaaagtgttttcacattatctcatttgatcctcaccaagtactttaaaacactgtatttaaattccagacatacctgtattcttttcttaaccagctgttgttctccaatt

SEQ ID NO: 50549 - DNA, 1050 bp, Homo sapiens
tgctttttactttctcccctatcccttctgcccccagttattttcctggactttattccctaaagtggagttaccaggtcaaagggtctcatgagttttatagctcttgtcatatattgtttgctctccagaagattgtactaatttataatgtcatcatctaggtatttagagtgagttttttaatagctttaaatcattcagtttctttaatatttaatagatggcaatagctcctggttgacttaagtagctctttttttttcattactagtgaggcttaacctttaaggaattaaataaaattgttaattcttacatatactcaattttaacgtatcttttaaatattcttttctgtttttatattttctattttttttacgtacacagagtttgttctgttgtttgaacattatagtttagataccatggttttcttttacatgtctgttctctacctatggacttctttgtaagagaagatgggcagggttgagtgataatttgaacagaagtgtagtggctgagaagtgaatgtgcagtgttggtttgattgctaagtttgtcagtaatatttttgattaaaattatttcacatatgacctgattttgagtggctgcattgtagaagagatgggatactttttcttggggtaggtgtttttgtttttttcttttttttgagagggagtctcgctctattgccaggctggagtgcagtggcgggatctcggctcactgcaacctccgcctcccaggttcaagcgattctcctgcttcagcctcccaagtagctgggactacaggcacgcgccaccacgcccagctaatttttgtattttttagtagagacggggtttcgccatgttggccaggatggtctcgatttcttgacctcgtgattcgtaaacctcagcctcccaaagtgctgggattacaggcatgagccaccgcgcccggcctggggtaggtattttttaaattgttattggaatgatagatttataaagtgtggtctttgatttagctgcatgttttggattgaaa

SEQ ID NO: 50550 - DNA, 1051 bp, Homo sapiens
gggaggaaaaaggggaaaggagtcgagtcaaaacaccgtctcttaagttcctcaagatcaacccagggggaagggtcctccaccggaaagggccggattgccttcacaggaagggaaagtcactccggagctcgcagacgcgaatgccaccacagagttccaaggcggctgccagagcgtcggccgtcagttagcacctccccctccttcccagagctgtagctaagcaaccatcgggctccgggagagtctaggctcagctgctgtattagtgcctctagcggggaactatgagcgctgcaaaaccctatcaccatttttaccctcccctctctccaccccctttgcccccgcccacctcttcgccacttcggctcctccctcttctcgctccgtctatctctctctctctctctctctccgcccccccaccccccgcgtctctctctctctctctctctctctctctctctctctctctctctttttcctctctctctctctctcttctctctctctctctcactcactcactctctctctccctctccctctcctctccttcctcctccgcctcctcagctcttgggctagaatatctatgggtcgaaacgtgatgcgatgaattcgagagagagcgaaactaggacgaggagtgcggcggaagcggcgggactcccgggcatgggggcttcaccacaatagaggcagcgcccccacccgcccccgccagcccctccggagcgaagcccccaaaccccctcgggaaaaggatggcggcagcacctacccagatcgaagccggtgggtagctgtgtcggggggtgggggggtgctaagggaatgggggcttagcgcgaaggctgtcagtttcttttgaaaaagcttctatttctcttctctacctccctctgaacctcttttcccccctcttccccagagctgtattacctgatcgctaggttcttgcagtctggaccctgcaacaaatccgctcaggtaaggggaagaaagagatctgggagtcgtggtgaatggtcccagtggggaa

SEQ ID NO: 50551 - DNA, 1057 bp, Homo sapiens
ttgctgaggataatagcttccagctccatccatgtccctgcaacagacatgatcttttttatggctgcatagtattccatggtgtatatttacctcattttctttagtctatcattgatgggcatatgggttgattccatgtctttgctattgtgaatactgctgcagtgaacatacacgtgcatgtatcttcataatagaatgatttatattcctttgggtatataccctgtaatgggattgctgggtcaaatggtatttatggttctagatcctttaggaatcaccacactgtcttctacaatggtcgaactaatttatgttcccatcaacagtgtaaaagcattcctgtttctccacagcctcaccagcatctgttgtttcttctacttttcctctactgttttcccattactatttggcatgtactttattagagcatgtactacattctgcctggtcatatattcacttgggtatatttttgttcttcacacttaggaagccttaaataacatacttattttgcattttctatcacatctagcataatgagtactcaattggatactttttcataagctaatcatttcttctggtatatcttgcattgttaatttacacagcaagtgtttttgatacattttatacacatgttgtcctattgtgagtgactataatttgcagtaagcagtgagattttacataaatatttatttttcattttggcttgaagtcgcttttaatagaagatgcttttttcatgtgtttacaggttatagatttatagagctagaaggcaagtagtccgtcacctcatcattttgcagataaataaaccaaggcatatagaatttaacttacacattaatgagtggcagagttggaactgattttcagtttagtactcttttcaatccactcacattagggaaaacttcctagaggaaaaaaggatttattaccttgtttcatgtagattaaatggaggaatgagaggtctgtaaccctttaacaattgaaggctcgaaggaaagctattattgttgacccactt

SEQ ID NO: 50552 - DNA, 1048 bp, Homo sapiens
tcagttttgggataattatttctctgttattgctgatgtatttttaatcgttttttttaaagtgatttttaacttctttgtttatctattggtataaatcatgaattaaatatgtccctgtgtgttttggaaaagagcagacagtggtaacttttaattatatttatgtggcctcttttgaataaaatagaagggtgatgtataagctagttgctttattatgttgcctgtgggtatcaagaaaggattggttcacgccatttataaatgtcgataaaacttctgtagaatgaattattctagtttaaggcttaagatgaatgtatatttaggacaaaagacagaaaatgtgaaaatatttcattctccttagtattttactttttaaaaataaacagataaatggaaatgctgcacaatttggtgaagtatatgaattgaaggaggatattggtgttggctcctactctgtttgcaagcgatgcatacatgcaactaccaacatggaatttgcagtgaaggtattgtctctgagcctagctttcttgtttgttttatgcatgtaatttaaattatgagtcaactgacaaacattttcagtggagtaaatgaagataggaaagataagatgatgagaaagaactctgagacttaatattttcatttttgaatttcttttcaagcctttgttatgtaggaacagtgtatttcatgaatttttgcatttgaataattttgttatacatgtattatgttaagattgagcagttgtgataattacaatcacgtcatcattggtacaatttcagtgaaataggatataatgttaaaattttatttttttctgttaagttttttacttatgtttttaaatgttaaaataatatgaggtaagtattgttcttgagtttttaagcatttcttcaaaaatataaccaaatggaaaatactcattttagacaaaataatttgtttgcctcagatatttttcttttttcgtatttcttagatcattgacaaaagtaagcgagacccttcagaagagatt

SEQ ID NO: 50553 - DNA, 1037 bp, Homo sapiens
agccgtatttccagacacaaaatgattaatacagtgccattacactcgtatacattactaacagaagaggcttggatccaccccttaggtcagagatgagttcacaattgtgtgtaagataagggtactaatttaacaacttgtggcagtgtagtaaaagctttgggtttgtagagcccctaaaagtgaaatttctgagaaatgatactagacagtaaaagagagaatggtataaatagtggaattctcagagctaaaacaaaataacttctatatttcaaataccctaagggttactatattatagcagattactataattaatattggtattatgaggcaaagtcactttataaaaggtgaatcttgttctttgcatttcgtgtgagaagatatacaaacaacataatatttcagaaagatttacattaaaatggttaatatcgaagagacacattcttaaagagtttagtttcatttatatagaaatcttatttctctggtattgccaataattatgccagtcaaataagaattgactgtgcttattatcttattattttcctagatttgtctgtctactcattttgaaagaagtatttttaaatatactgaatattgaaagaaagatcaaatgataaatcattattttgttctaggttctgtttacagaggaagatgtgaaattctacctcgcagaactggcccttgctttggatcatctgcaccaattaggaattgtttatagagacctgaagccagaaaagtaaagctgtattcttttgttttcatgttgtctgtatttctggaactgctttttgtcaaactctgttagatcttttaaatattatagggaattctatatgaattatatgaaacttatttgtaaaaagtaatctttgtgagacgtacattgactttaagttaatcatttaaattttttacatatattaaatagatactgacctatcttagttttatgatttttatgtaaatgttttatgtaaaatattttattccatcttgttgaatgtgaa

SEQ ID NO: 50554 - DNA, 1035 bp, Homo sapiens
taggttgttactactgtcaagcttttggaatggtgcagaacctgaagaaagtgaggtggaaggaggagggagagtttcagatgacaaagaaggacattataatagtaaaaatcaataaacatagccttgggaaggttgagaaatgttaggcaatagacaagaatgggatggaaaaagaactacttttgtagttgattttgggaagggggcagtgagatacgatattttctcatgctaggaaagtcactcataagacctgaaaaaaaagaaaaaacagatcaggtgttaaacaggttacttctctagactgcgaatgatggatcctattaaatgccatattgggatactactgaatattagaagaactaggggaaaaaagtggctcctttatgcaacagtgtcttcagaaagcctagactctttctttcttccttgcttgcctcttctcactcttcatattccgttctttacaatcccactaagggctatgttttgtaagagtggttctgaaattgtggtctccgtacccctggacaatcccaagacttttcagggagtcctcaagtcaaaactacttcacagtcatcctaagatattgtttgtacaactgctggcatgttggccaatcaaggcagtgacttcaaatggtaccagtagtcattgtagtcttcattttattacatatgcagtttaagaatgtccttgatgagacattaacaattattacatttattaaatctcaatccttgaatacccttcttttgaataatatgcgatgaaataggaagtacatgtgaagccccttagccacgtaacaaaatagaatggttgtctcaaggcagaggacttgtgcaaattttttgagttgtgagctgaaccaaccactgtttttatggatcaccacttttccttgaaaggacaataaactatggttacctaaatatgcttatttcgtaggtgttttctcaaaaatgaatggagtgagcctgttcatagaaaaacaactgatactctttttgtcaatggtagaatctg

SEQ ID NO: 50555 - DNA, 1071 bp, Homo sapiens
tctttgtctttctgctctcatgagatcaaaaaagtattgtgctaagcattaggaataaagagatcaatgtggtgtaatacctgcatttaagaagcccacagtccagtgggaaagaaagacatggtaattagttgttcggacacagtgtaacattttacattggctgtctcctgggaaaagtgatttttctcatctagttgcattttcatattgggagctttttagagtactgctgctgaaaattgaaagacattgcattttagaggatgggcatgtgagcattattaataaaagttaaaagggcattggacaaacattttcatttggaaaacctgcttaggtttggtgaaactaactatagtacaatttgtttcctaactctgaacacttctaaaaaaactgatgccaatacttatagtgataatctaaacataagcagggacctgaagtaccttcttgaacataaaaatattatattgtgttcagtatagaatcacagacattgaggggaccttagagacccatctaacaaaacccctttgtcatgtgagaaaactgaaggagagagtgatttgtgatttagccaaggtttcttagcttataggtgcatacagatatattatactttaatatagtccccaaatgtcagctacaaagcatctatatttgcattaaaaaaggttgtttacttttttaaaaaaggacctctttcaaatagggaaattcacttccatagccgattgattttaatttaatttttattttcagtaaacatttataaattaccatcactatttaaaagggtctggtgaaatactattttgatgtataagaaacatctgatatactttcaaaatcagttattcttcatttcttgttgatttgctggtagttcctaacacctacaattaaaatttctttgcctaggtaccccccttgagatagtgaatgcctgactacctatattccatggaagttattttagctgctatgaagtctagctcatttgggaccatactcttgttcactttggcttcaatcaccattgactaatcagttaattgaagagtg

SEQ ID NO: 50556 - DNA, 1699 bp, Homo sapiens
agggtctctgtcacaactggtcaactctgctgttgtagtgcaaaagcagccatagataagatggaaacaaatgggtctggctgtgttctagtaaaatttttacagaaacggacaagaggtcagatttagctcatgggttatagtttgtagaaccttgatctaagtcttctactttactgtttcttgaattagttgttaaagaatgagtagtattacctactgagctctgcatgttgacttgttttgtttccatgattacttacatctttctcctatagtttattttttcttctgtatagtatgtcatgatgtttaattaactgaatgaaagaggaattcacaacagtgcaattatataaaactgttcttattataatttgctttgaatatacccccatggtagatttctgtggcattttttttcctgtcataaatacttggttggggacaatttaatgaaagtacataggttatatacttagtgtatagttatctgttattgcaaaactctaaacaatatgaaattaagcataaagctctgaaaatcaaagtttctcaaggataatctgggaaccatgttaatagtgttccttttctaagtacttctatgtgtcctttgtccttttgtttttcagtaagtgtggatcttgttagattgtggaaggaaatgcctagggttatatttttcttagttatcactcttgttttaatacttttgaacctcaatttttgaacaatgtttttcaggtaaatggtcttaaaatggttgatgagccaatggaagagggagaagcagattcttgtcatgtaagtatttatgttaatttattaagccacatttttagcatataaggaaaaagaatacagggaaaggagaaaagctcctatcaaacaaatatattcaggtaagttggtaataagcaaatggaattattaataactcaactgcagtttaaaatataggacaggttttcctgacagaaatacttatgcatgcatttttaaaaataaacagctttattgagacataatttacatgctattgaattcacccattttaagtgtaatggataaaattttcagttgccagtgtatgagtaactgaattattatacttaaatatagaatcctttgagaagattatcttcaacctcagggtagaaaggatatctgacttggaaatattgaactgtataagcataacttgaaatcatttaaaatcaatttcctggcttttagaaaggattatgtgtaaattatttcagaagtttctaactagttttaaagactgcttagccattagaccattctatgtaatgcctagatactagagtcttattttacaagatctagttttacagagagcattcttaagatttgtagggagaatctgactaaatcagcatctacatttatgttgttattttatggttgttatttctatagatattttcatagagttatagattttttttttttttttttttttgagacggagtctcgctctgtcgcccaggccggactgcggactgcagtggcgcaatctcggctcactgcaagctccgcctcccgggttcacgccattctcctgcctcagcctcccgagtagctgggactacaggcgcccgccaccgcgcccggctaattttttgtatttttagtagagacggggtttcaccttgttagccaggatggtctc

SEQ ID NO: 50557 - DNA, 1050 bp, Homo sapiens
tcaagagagctaatcattacctctgtgttccatgataaggcctactgatagtgtagttgcttttctgggccatattgttttagtacctaccctctcatagtctctctcatctagaattttgatgaggaaatgcaagatttttttcccttcctgtaatttctttcttggtgctatcattgtatgtagcagcggttcttaagatttgataagcacttggaatcttgaggtataagcctttcagtactttgtcagaatttgctatgtaatgtttattcatttatgttatttccaaggattatttactgttgctgccaatatttttttttgttgtgtattttctttatttttgtttgtttttaggtaggaaaggagttagatgggagagagatttagagagctgagctaaatctggcttttgcagataagagacgttttctaaattgccctggagacattctgtaactgatttcactgctagattttaatctgtatctctacattagaaacaggtcctgctgtagttttgtgtgcacgtgtgtgtgtgtgtgtgtgtgtgtgtgtgagagagagagagagagagagagagagacagagaaagagggaaggtggagtagagtgcatgtgtgttacttgtgatttgcttcattttaccaagcatttgagatggtatatgggaaatataatctgataactattttgatattgaggataagggaaaacaaagtaggagatatatgaaaagggtggagggtaggggatgaagggtaaaatagagcacaaataagcaggctgtaagggtctatgacatgtttaaaatatagttgaattataaatttggccttgagttttcttagctggtttttctcaactctggctgtgtgttatatttacctgggagtgtaaaaaaattatccatgccagtgttccactcagagattcacatttaactaatctagagggggcctgggcatctattccccagatgcttatgatgcacagccagggttaaaaaccacagctctaggccaaagtaaaaaaagaaatagtcac

SEQ ID NO: 50558 - DNA, 1120 bp, Homo sapiens
ctagaattaattttgctttaagatgtatgaatacatccaattttatttttccaaatggttaactaattgtccctacaccatttgttgaataactcatcttttaccagtgagttggaatgtagctttttattaaatacacacacacactctctctctctctcacacacacacacacacacatgcacacacatatacacacatgcagacgtacacatatacacatgtgggtcaaatctgagactgcttattgttacactgatttgacagtttacaactttggctttataaaatgtcttaatagctggtagggccctcattcttctttgctttgtagtatattgattcttgaattgtttagtcatacaatttgaactgtttaagcataccttttccaaatctccttccccaacatccattcaagatttttcttggcattgtattaaatttatagaatactgtaggaagatgaattcagctttgcacgtattgaattttagatagtggttggacatccatgtagagctgtccaagcaggcctttggatgatatgagtctgaaactcagatgagtgcttaagacataaaaagaaatatggaagtcacccacattgaggcaaaaaatatctagccatgaagattgaagatttagttaagtgagaaaatgaaaaacaagaaaggacaatggacaaagactgtgtattgataaatatccagatttgggcattggaggagaaaagggagcccttgaaagaacattcagaaacagaagaagcaggacagtatgcttttcctaaaatcaaggaaagagtcgggtgcagtggcatgcctgtagtctcagctacttggaaagctgaggcgaaaaggatcccttgaagttgggagtttgaagcttcagtgtgttctgattgcacctgtgaatagccactgtactccagcctcagcaacgtagtgacttctgtctctaaaattaagaaaaaaaaaaaaacaaataaggagatttcagaaggaagaggcgtcattatttcagtagtctcgtggtctcatagaagttaagtagaaaaagggatgagaaagccattgaatttggtgttttagaaattctttaaaaaagcaattaactg

SEQ ID NO: 50559 - DNA, 1021 bp, Homo sapiens
tttagagctgggggggcaccttggggttgagttcaatgcctatatatgtgtgtgtgtgtgcgtgtgtgtatgtatgtgtatatatatatatatatatatatatatatatatatatatatatgtgtgtgtgtgtatatatatatatgtctctttattcccaatctaacattattcccagttccaccttactagtgtatgccttaccataagaaataacttggatacttcttaaaaatatagatcaccctattctagacctaccgaaacagaatttgcaagaaaggcccagagaatctttatgtttcccttccccaaattattcttaagatcaggtaaatttggaaaaaactttacaacactatgtgatgattgcagctaaatattctagcgtgttctttttatccataacacttggtcaaattttataatttatatttgtttttctatttgcttatcacctgtacatatgcatttctgttgtttatcatctatatttatacatttaagttccctgaggaaaagactatacctattatattcacctattatattcaccatcccaagcaccagaaacagtgtttggtacatagtaaattttcagtaatatatgtggaatgaatgaatgaatatctaacagaaaagtgtaccctctatatatagcatacatgaactaacaaatactacatttaaataactacatttaaaataaaagtttggaatatagcttcatattgtttaatagaaagatacttagaaatgtacagggctttagagtactcatttttaatagccattatgtttgtggtgttaatacataggtgttctggttgaaaagattcactactatttttagatttgtgaccattctggtgggaaatttattattcaggaaagtaaagaatttggaaattattttcctaattttgcacataaataatctgaggcttagagtgataaaataacttgtccattgatcatataaaatggttgaaaaacctaaatattttaaagtaggggtttc

SEQ ID NO: 50560 - DNA, 1031 bp, Homo sapiens
aaagttcacaggaaaatactagtaaatctaatccagcagcacatccaaaagttaatttaccacaatacaagtaggcttcattcctgagatgcaagtttgactcaacatacataaatcaatgaatgtgataaaacatgtgaagagaattaaaataaaaaacatataatcatctcaatatacacataaaaagttttccataaaatctaacattcttcatgataaaaaccttcaacaaaccaggtattgaaggaatatccctcaaaataataagagccatctgtgacaaacccacagccaacaaaatattgaaagggcaaaagctagaaccattccccttgagaactggaacaagacaaggatgcccacaaccaccactcctatttaacataatactggaagtgctagcaagagccaccaggcgaaaaaaaaaaaaaaaaaaccattcaagtaggaaaagaacaagtcaaattatctctctgttgacgatatgattttatacttagaaaaccttaaagactgtaaaaaaaaggcaactagaattgataaacaattttagtaaggtttcaggatacaaaatccatgtacaaaatttagtagcatttctatacaccaataacatgcagactgagaatcgaatcaagaacacaatcccatttacaaatcccagaaagaaagtaaaatacctaggaatgcagctcaccaagaaggtgaaagatgtctgtaaggagaactacaaaaaaactgctgcaagaaatcagagatgaggccgggcgcggtggctcacgcctgtagtcccagcactttgggaggccgaggcgggcggatcacgaggtcaggagattgagaccatcctggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagag

SEQ ID NO: 50561 - DNA, 1034 bp, Homo sapiens
aacatagatacaaaaatcctcaataaaaaactagcaaaattaatccaataatatatcaaaaaatatgccatgatcaaatgagatttatcccaggaaagcaagaatggtttaacatacacaatcagtaaatatgttacatcacatgaatagaatgaagaaaaaaacattatctcaatagatgcagaaaaagcatttgataaaattcagcatccattatttatttgaattcttgataaattaaatatagaagaaaatacttcaacacaacaaaggtcatatatgaaaaattcacagcctaaataatactgaatggaaaaagggtgaaagcctttcttctaagaattggaaaaaaacaaagattcccacttttatcaattctattcagcatagtactaaaagtcttggccacggtgattaggtaagattaaaaaaaaaggcatccaaattggaaaggacaaattaaaattatccttttttaacagacaatgtaatctcatacatagaaaaacttaaagactcaaacacaaaactcttaaaactggtaagcaaattcagtaaagttgcaggatacaacatcaacatacatattcagtagcatttttatgcgtaaacaacaaacaggatgagaattaaatcaagaagacaatgctatttacaaaaactgaaagaaataaaatgccttgaaataaatttaaccaaggagttgaaagaactgcaattaaaaaaaacaaaacattgatgaaaggaattgaaggatacacaaataaatagaaacacattccaagctcatggactggaagaattaatatcattaaaatgactatacggcccacaggaatctacagattcaataaaatatttatcaaagtaccaatgaaatgttttatggaaatagaaaaaataatcctaaaatttatatggaaccaaggaagagccagaatagccaaagcaatactgagtaaaaagaacaatgcaggaggcatcacactaccaaacgtcaaaatatgctacaaagctgtagtcaccacaaaagt

SEQ ID NO: 50562 - DNA, 1090 bp, Homo sapiens
ctaacaaacagaaaggaatagcatcaacatcaacaaaaacgacatccacaccaaaaccccatctctagatcaccagcatcaaagaccaaaggtagataaaaccacaaagatggggagaaaccagagtagaaaatctgaaaattctaaaaaccagagcacctcttctcctccaaaggatcacagctcctcgccatcaatggaacaaagctggatggagaatgactttgacgaactgacagaagtaggcttcagaaggtcggtaataacaaacttctccaagctaaaggagaatgttcgaacccaccgcaaggaagttaaaaaccttgaaaacagattagatgaatggctaactagaacagtgtagagaagaccttaaatgacctgatggagctgaaaatcatggcacgagagctacatgactcatgcacaagcttcaacagttgatttgatcaagtgaagaaagggtatcagtgactgaattaatgaaaaattaatgaaataaagtgagaagagaagtttagagacaaaagagtaaaaagaaatgaagaaagcctccaagaaatatgggactatgagaaaagaccaaatctacgtttgatgggtgtacctgaaagtgacggggagaatggaaccaagttggaaaacactctgcaggatattatctaggagaacttccccaacctagcaaggcaggccaacattcaaattcaggaaatacagagaacaccacaaagatactaatcgagaatagcaaccccaagacacataactgtcagattcacctaagttgaaatgaaggaaaaaatgttaagggcagccagagagaaaggtcaggttacccacaaagggaagcctatcagactaacagcggatttctcagcagaaactctacaagccagaagagagtgggggccgatattcaacattcttaaagaaaagaatttccaacccagaatttcatatccagccaaactaagctttataagtgaaggagaaataaaatcctttacaaacaagcaaatgctgagagattttgtcaacatcaggcctgtcttaaaagagctcctgaaggaagcactaaacatggaaa

SEQ ID NO: 50563 - DNA, 1087 bp, Homo sapiens
cagtgtatgcgtatgctcaaactcatcaaattgtacagattaaatatgtgcagtgtttggatttcaattatacccccccccaaaaaaaaatcaatatacactcaagatgcagttacttcattctaatatattttctagctagaaaattggcaaaggctactggtgttatgtcaaaagaacataagaaccaatgtgaaggaactcccattggtcacagataaggccatttgaacatcaagagtgaataatgatactccaaaaagcaaacgaacctcattgaccagccatgaagattgctaaggcactctttgttctagaaactaataaataaagagaaggaagcaattatcatatatgtcctgtaaagactgtatttcaggatatccaaatagttgttaaaggaaagttcttgtagaagaatcacaattaataaatgcatgaggaatgatagaattagaaaaatcactgttttgtaaactcaatatagtataataatatacctaggcaatgattatcaatgactgctaaaacctgtagttgaaaggcatcactcgaacctactgatcaatcttaaaattattataagtagaaaggcagacattataagtttccttgtgtgttgaaatagaaagtatacagcattgcctaggaagaattcttgccaaaataaaaaaataaaatgaacctaaatctaatcaagcctttagctttaactaccagcttacaggcatgagggggacaggaaagcatgctaagtgacatcatgaagatacaacgtgtaaaattctacaggacaaatgacccaattttatcaacaattaactggcacaggaaaaaaaatggaggaagcattattacagactaaaggagattttagagatatcaactgcaacatgctgaccttgttttgaacaaatgacatcttttttttttttttttttttttaagatggagtcctgctctgttgcccaggctggagtgcagtaatgtgatctgggctcattgcaacctccgcttcccgggttcaagtgattctcctgcctcagcctcccaagtagctgggattacagacgcaggccaccatgcc

SEQ ID NO: 50564 - DNA, 1030 bp, Homo sapiens
agctttgccattcaaaatcaaacatacaagagagataaccagtaataggagatattttgttaggacttgaacataaagtgagggatagttttttgagggaaaaaccttgacattgtattaggcaaatccaacatacatttctttttaaggattcaaggctggcttaaacaattgttatgttctaagtataattagggtactcactaaggaatctgcaaagatttgcatttgtctccttatggtttcagtttgcctttcttttcctagttttctatatggaacacttgacatcctctctcctctttaggacagttaagaactacttatactttgagtcaaagttctgagtttattctgtgatcccacagactacatcagaaccctctgtcagtctccactccccactgtcacatcccctcgtatgatcattttataagttctctataagaaaaggcaggatctcactgttgtatctccagaaccaaggcaggttcctagtagccattatactgaataactttgagttaaataaatgattaaagattaaagactggctataaccctttttgtgcttttctttgcactctccatttaggaaaactgagagaggcataagggatcatagcattgagtttaatgtggtgattatacatcaaaacactgtacaaactttgaccgaagaaatagggcattgaggaggcacactaaatcatggtatatggaatatgtaaccaaatgcatacctattttcagccaggttttatttttcatttttgtttgattggttctgctttcttatttgagaggatgtaggtatgcatcagtggttcttttctaaaccttttcactaaattctaatactgcatgcttccgttgactgtttttagaaaaactgaatgttctagttgaacagttttcttttcctttgcagctatgctgaccaggtaaaactccggtaaattagatctggccatttagtagtatagtatttgatatattggtagggtagagatgaccttggactaggacc

SEQ ID NO: 50565 - DNA, 1050 bp, Homo sapiens
ttttctcttatatttttcctccttatttttttgtttggttttagttttattgttttgttggcttgctttgactttgaaatggcaactatccctacaaccattgggtgggggtggtagttgaagaatgtcagtcagtttcacagctgaaagtgtgctctgcagcaataaagctttaagcttttttctgacattctaattttgctatttttcctattaatgaaaatagagtttaattttcccttccaagacaaaggaagggttaaatttaaggaaccatgaatattctgaagtagaggatagggagaaaggaagagggaatcagcagtccttaaccctttgatctgtcatttctgtcctctcatctgtgtccccattcttgtttctgtttgtcttcttccttcccagggttgtcagtgaatgtagcaatgcctgactggcactggactgtgttaattgcttgcagaagtgtgctggctgtgggtacgttcttctgtgttcacattttgcaaggagcggaggatggtgatgatgctgttgataacttactatgtgctaggcattgcttcaaatactttcatttctatgttacaggtaaagaaaatgagttttagagtaacttctgtaaaattactgactgaggtcatgctgctagtaaaaggcacaactacaatttgaatccagatttgtctggtgccaaaggcttgattaatatcattgcattaatcgtaataattcccttagttaactataattattatgcattaaggattcagagatgactaagctactgtccttgcccttaagttgctctcagtctagtcacaggaagcattcatgtaatctgattataagacagcatgacaaaactctaatggaagtatgtgcaaagctgtggaagcacagggatcggttctttttgaagagttgaaggcttcacagaagagatgatactgaatttgagtagttctgtctttttttactagttccatcattagttttatggtggaatagcatttggggcataggcaatagcactaataaaagcagaga

SEQ ID NO: 50566 - DNA, 1015 bp, Homo sapiens
ggctggagtgcaatggcgtgatctcggctcactacaacctctgcctgccaggttcaagcgatcctcctgcctcagcctcccgagtacctgggattacaggcgcctgccaccatgcctggctatttttgtatttttagtagagacagggtttcactatgttggccaggctagtctcgaacttctgacctcaggtgatctgcccacctcagcctcccaaagtgctgggattacaggtgtgagccaccacacccagcctgcacactttctaataccatgtgggtgttacagctattggtggcttgtaactacccatttctattttggggttcatgatgatattgtatcaccttgctttgttatggatgttgtccctgggagtttggtttgggtatcctgattgtactgtctgtttttatgggagttatgggggagattcaacaactgctgccatctttacagaagcctctttttatctttcactttatcatttgctcaagaatagaggtcaagttgttgacctagcataaacattcacttttcagaacttgaaacaaacctttgggtcacttattccaagccctttattttatctaataaggatatctataaggaatctgaattccagaggttaagtgactttcgtgaggtcacagctatttagtatccacctaaaaacaggaagccagtccttctgattcttaattcagtactcttgaatactgaaactctttttattagccatccctaaaggctcacaccatagtgaatttttaaaaattaaaataaattttccaagttaatgttttaatgggtagtatatttttcaaaaaattctaaaaattacatggctataaatacacattttgttccacgaggaagaagttcagagattttaaattacatttactaatatttagtattttgtggggaggttagagtgaataaaaataattgtcaatttaaaaatgatatttttatctttatgttgtggtagttccctaggctacttcatttg

SEQ ID NO: 50567 - DNA, 1040 bp, Homo sapiens
ggaaacatagagggaagagtgattaattctgattcagaaaagcaggaaaaatggcacaaaggacatggcatttcaatagactgttcattgattagcatgtatttattcagtgtcccctatgtggcaggcattgttataggagctagatatatattcagtagtagacaagcaaacacagttcctcctttatagagctcagagtcttgttgggtagacagacattaaactaaaaggaaaaaaatcctgtaaataaaagtacataaatgatgatatatgctaagaaggaaaagtgcaggtgctttaaagcacctaatttggattgggtgggatgggtgagggaaatccatgctgaggagttgtcacttaagctaagacctgaataatgagtagaagttagctggtaatgagtggggaaaagattattccaggccaaaggaacagcacatggaaatatcctgaagcaaaaaaggggttgaattatttagagaataaaaggaaagtcagtgtagctgtgatgtagtgaatgaggaggagagttacttgagataaggctgaagaggtaggcaggagacatattcagagttgcatctgctaggactgttttttgctgtatgtaatagaaaccaagttatggcagtttaaccaaatgaagggtttatttttctcacataatgggagtcacaaagtcagcagtccagggctagttcaagtacaaggacccaagcttccatctttctgttctgtgatcttttgagcatggcctccatcatcatgcttccaagatggctgctccacctctaggcaggataaaggggggatagcaaagggcaaaagaacatgtggcagctaaatttgtccctttccattaagaaagtaatagtgttcctggaagccctgtcctgtagatttttgcttatcttattggccagaactgggttggatgaccactcctacttatagtggggtctggggaggttttattttcaactgagcctgttaccactcttaataatatctttttatgtatatatagaaggggg

SEQ ID NO: 50568 - DNA, 1715 bp, Homo sapiens
ggcttttgttaaaaccgtaaactcatctggtctaataaggaaccagattttgggaagacatgtgtttcaatggcgttagtatttgactggtaaaatactgtgagaactgttgttggctgaattgatccctagggcacactttgcattttacttgagccactgactaggaacacataggaaggtcttcattagcaggaatagattagaatgtatgtaagcaaatacagatgttgaaatttgggtaacaagtacattaactttttttctttaattttaggacatttagggtcccccctgtgaattagaaagttgcttggctggagaactgacaacactacttactgatagaccaaaaaactacaccagtaggttgattcaatcaagatgtatgtagacctaaaactacaccaataggctgattcaatcaagatccgtgctcgcagtgggctgattcaatcaagatgtatgtttgctatgttctaagtccaccttctatcccattcatgttagatcgttgaaaccctgtatccctctgaaacactggaagagctagtaaattgtaaatgaagtaatactgtgttcctcttgactgttatttttcttagtagggggcctttggaaggcactgtgaatttgctattttgatgtagtgttacaagatggaaaattgattcctctgactttgctattgatgtagtgtgatagaaaattcacccctctgaactggctccttcccagtcaaggttatctggtttgattgtataatttgcaccaagaagttaaaatgttttatgactctctgttctgctgacaggcagagagtcacattgtgtaatttaatttcagtcagtcaatagatggcatccctcatcagggttgccagatggtgataacagtgtaaggccttgggtctaaggcatccacgactggaagggactactgatgttctgtgatacatcaggtttcagcacacaacttacatttctttgcctccaaattgaggcatttattatgatgttcatactttccctcttgtttgaaagtttctaattattaaatggtgtcggaattgttgtattttccttaggaattcagtggaacttatcttcattaaatttagctggtaccaggttgatatgacttgtcaatattatggtcaactttaagtcttagttttcgtttgtgcctttgattaataagtataactcttatacaataaatactgctttcctctaaaaagatcgtgtttaaattaacttgtagaaaatctgctggaatggttgttgttttccactgagaaagctaagccctacatttctattcagagtactgtttttagatgtgaaatataagcctgcggccttaactctgtattaaaaaaaatgtttttgtttaaaaaaaactgttcccataggtgcagcaaaccaccatggcacatgtatacctatgtaacaaacctgcacattctgcacatgtatcccagaacttaatgtaaacaaaaaaatcttaaagtgcaaatattaaaaaaaactgttctctgtgaaaaaaattatattccatgttataaagtagcatatgactagtgttctcctagagatcagacttttttgattgtatagtttgcattaaaaagttgtacagggagggatgtaacctgtatcttcaggataatagggaaattaataaggaaaataataattactaaaatttgagtt

SEQ ID NO: 50569 - DNA, 1045 bp, Homo sapiens
gctgtatttaatctttgtttttttcctcccattagggttgttttataaaggtgatgaccattatagagtcagaaatgggagtcgttgcaggaatttcctttggagttgcttgcttccaagtaagtttttgtagttacttaggaaatatttcatccctcttgtaggtgtaagctagaagattttcacttttttttttttgagatggagtcttgctcggttgccaggctggaatgcagtggcgtcatctcagctccctgcaacctccacttcctgggttcaagcgattctcccacctcagcctcctgagtagctagaattacaggtgtgcgccaccatgcctggctaatttttttgtatttttagtagagttggggtttcaccatgttggccaggctgatcttgaacacctgacctcaagtgatccgccctcctcggcctcccaaagtgctgggattacaggcgtgagccactgcatgcagcgagattttcacttttaaggcttataagtttttgcttcaggggactggatagtgaggacatttttagggaagtcgcattttcacaaaactctcagttactggtcacagtataaaaatactttatttaggagaaatacctaatgtagatgatgggttgatgggtgcagcaaaccaccatggcacgtgtatacctatgtaacctgcacgttctgcacatgtatcccagaacttaaagtataattaaaaaaaagaagaaaaaaagtaagatttagaattaacttgtagcagtgcatatcttttgaaagcagttaactgtggaaagactcagtgccctcttagttatggcaactttccagtatcatagctcatgaaacaaaacattagataggaaccttggttctctctgcggtcagtcaagattctaaaatgttattaggatcttttctgggctgcaactgcctgatgagttgtatacaagttccaacctattaaaatttagatgatgccacccccacattccttatgcaccagttgtttggggttgattccacgttgtagatcaaatt

SEQ ID NO: 50570 - DNA, 1035 bp, Homo sapiens
ctgtatgtattgctttgcaatccgctttctttttgcaaatatatttcttgtgggtattttcccatgtattttcttaggtcgcttttaacctcttcattcttttccttctctctagggcaccaggggccagggaggcccaatctcagagcgctgcgggctctgctggtgatagaaacaatatggtgaagttataaggagaggggaggggtggggggcgggaaagattccttaggatagaaaaaaaacaatgaagaaagctccacttgaagacctatgaaatttccgacactagaacctttgtatatagttttcggtaaccttcggcagggggcgctctgaaattgttgccactttccggacagcctcccatactttaccctctacaaaattgtacagtgtttccggcccttctcagttgtggacgctcgtaagttttcggcagtttccggggagactcggggactccgcgtctcgctctctgtgttccaatcgcccggtgcggtggtgcagggtctcgggctagtcatggcgtccccgtctcggagactgcagactaaaccagtcattacttgtttcaagagcgttctgctaatctacacttttattttctgggtgagagacgaaggcgcctggggccggcaggggatcccgggcttttagttgtggggggtgtgaccctgagcggcgggagctcaggtcgggaacggtgtggggtttgggcggccatcgcgcctgggaccccgacgccggcgaccagtgactgggccccgaacaaagagctcaggcatctcgccggcgctggggtcggagtgcgggacgaaggcagccgagaggctgagctgggacccagacgtaccagcgttcgagttcgatacgggaggcgaggtggggccttaagcccccagagcacgcagacggtgaccctggacctttgcaaaggcaagcaaggcttgcccggcccctttgagggctcacttgcataatagtgtctttcttttcactgcttcgtaagagaggagtgtttcgcaggtaagt

SEQ ID NO: 50571 - DNA, 1033 bp, Homo sapiens
aggttgtagatttgtgagtgggcgagaaacagactgtagagagtttaggagttagtgggtgctgaggagagaggcagtgggtatgcaccatttggcagggagaagaacgtgcgtagaaggtagctacaaagatgctcagaggagctcaaagctctgagaatttctcagttgaaactatttttcttaaaggtcaccatttacctccttcttgccagataacatctttcctttaccctcaatttgatttctttgcaatatttgacacaatttatctcttaccccttcctttccttaaaactctcttctcctgtggcttctgtaatatgacaggtactgcccagatatcttcctacatgactgaccactaattctctttttttccccttgctggttcctcttctcctactcatgtctacagatgtcttctaaagctctgaccctggccttctgctccctcagacaacccatctatctaagctgatgactcacacaacttcatccttccgccgcctgtagggcatctttaccaaaccagttttcttttttgacattgtctttctgagaggggtcttatttcttccaggtgtacagactgagtgctttcagacatcagtttgtttcttagcctcttggtacatcaagtctgtactaagtcttgtcatctctttctttgaaacatttatggggttcatctgtaccctccatttctttgccaccaccatcagtcatctctagccaacattactgtagctggttcctggagagtctccctgactcagacttaaccactgaacccctatttctgcatagaataatcaggttaatgttctaaaatgacaatttactgtgtcatgcctctgtgcaaaaacatgtgatgggctccctatagatcctagtacaacagctaaactcttccacatggcttgcaaagcaaagaaacaaagaatcagaaatagaagggatattagataccacctggcctaacttcccttttaatgcaggaattactcactatgcagcattcatcacagat

SEQ ID NO: 50572 - DNA, 1048 bp, Homo sapiens
ttagggctaagcaaagtggtctgaggtatgacaccaacagcagaattaataaaagaaaaattaaaatttgtttttttgagacggagtctcactctcgcccaggctggagtgcagtggcgtaatctcagctcactgcaagctccgcctcccacgttcacgccattctcctgcctcagcctcctgagtagctgggactacaggcgcctgccatcatgcctggctaagtttttgtattttagtagagacgagatttcactgtgttagccaggatggtctcgatctcctgaccttgtgatcctcctgcctcggccttccaaagtgctgcgattacaggcgtgagccactgcgcccggccagaagaattaaattttaataaataaattaatgaattaacaaattggaccttgtcaaaattaaaaattgctctgtgaaaagacaaagccataaaagggactagtatttaaaatatagaaagaactctcaaaacattgaaaaagcaaacaatccagttagaacatggacaaaagatataagcacacatggcactgaataggctacaccgatggcaaataagcacatgaaaagatgttcagcatcattaatcatttgggaaatgcaagttaaaatcataatgagatactacttatatatccatcagggagggtatccttaaaaaaaactggtaataccaagtgtttgtgaagatggagagaaactggaattctcatatatggctggtggaaatgcaaaaatacagccactttggaaaatattttggctatttcttataaaggtaacacctaccttcttataaagaaaggtacacttaccatacgactctgcaatcccacttaaaggtatttatgccagtgaaataaaaacctgtgtccacacaaaatcctgtacacgagagttaaaagtagctttattcataattgccaaaagctggaaacaactcaaatctcaaatgtctttctttcttctcttttctttttttttttttgagacggagtctccctctgtcaccaggctggagtgcagtggtgca

SEQ ID NO: 50573 - DNA, 1057 bp, Homo sapiens
agtggagaaagagatatttaaattgggaggtgaggattgaaattgatgatgtctgaagagtcctgtgaagtaggggtggaatcgagaactcagatggaggagttccctcttttttaaatcattgaacaaatatcaggcaactttatgtctctaagcctcaattttctcatgtacaaaatgaggacaaaaatagtgtgactctcctagggttgttttgagaattaaatgcttaacatggtatctggcacatagccagttttcaataggcatttattaatattgtggttgttattaatacagcacctattgcttactggcaggcactgtgctaggcactgaggagacaggacaggcacggttctgttatggagctcgctgcctttaggagcaagcaaagaaagtgctgcataaacaaagctcaagataaatctagaggtggaaggggctcacttgctatggctgacatcccttacaggtaaaggtggggaagggggagagctccaggtgtggatcaaagaagccaagaacttgacggctgccaaagcaggagggacttcagacagctttgtcaaggggtgagtccctagaccagccccaaattaaccagtttcagaacaagagagctaagagaagaatttaactttctctgtggatattatccagtgtgtcttaccactcccggcaaccaaatttgttcctgaaattaggtaatgacaaaaccttcaccacctttgcactggtctgggctgtagacttgataatccaaagaggagggctgcagacaggttctgacttttgtctgactcatgttcttaattaattctgggtgaaaatctgtgtcttctgactgtctagatttgggaactcagggctttgtttcccacagtttttaagctttccgaaaattacagattacctactgacttaatttatctagaaatcatgtttggctaagtttatagatattactattggttttatttaaagagataaattgtctagtagaaacaaagccaaatatttaaaacccattttcagtggagcacagaatagcctc

SEQ ID NO: 50574 - DNA, 1069 bp, Homo sapiens
tcccagcactttgggaggccgaggcaggcggatcacgaggtcaggagatcgagaccatcctggctaacacattgaaaccccatctctactaaaaatacaaagaaattagccgggcatggtggcacgcacctgtagtcccagctactcgggaggctgaggcaggagaatggcgtgaacccaggaggcggagcttgcagtgagccaagatcgcgccactgcactccaacctgggagacagagtgagactccgtctcaaaaaaaaaaagtatactcagctgggcaccatggtacatgcctgtactcagctggtacaccatggtacagttactcagaaggctgaggcagcagggttgcttgagcctaggagttagagactgttgtgcactatgatggcacctgtgaatagccacagtactccagcctgggcaacattgcgagaccttatttcttaattaattaatttattatatgtttaaagtatactcatatttattttagaaagatcactcaggctacgattgtgaatggattggaaagaggcctgactagaggcaggagaacctgcttcctttcaatattggctcttggtttttattctagtgtgctatttgaagtgccaaagctgaaaagtggaaagagtgcattggaagctgagagtgagagtctggatagcttcacagctgactcggatagcacctccaggtggggttccccccatttccctcatctcctctcaacccaagttgtgattttgttctgcagcatcagtgttcctgacttctgtcctcaggaagttgaacgaagtattttctctgtcctcaacagaagtcttttcagtagcacgtctactgatttggctctgagcacagcttcctggaacacattgacatctctagtcaattcccccagtatcttggagtattcttcttagcccagtagcaactgatgctgctgtcccttaagaatgagggtgtgagtgtttgtgtttgtgcaaagttgcctatctgatcttctgcattccttccaggtaaatcacatgcgaagtgtaccttctgaatttggttattac

SEQ ID NO: 50575 - DNA, 1050 bp, Homo sapiens
tgaaatatgctagtgctctagtgtgactgaggaaatgaaattttaattttttttttttaagacagagtctggctctatcacccaggctggagtgcaatagcgcaatctcggctcactgcaacctctgcctcctgggttcaaacgattctcctgcctcagcctcccaggtagctgggattataggcgtgcaccaccacgcctagctaatttttgtatttttaatagagacggggtttcactatatgttggccaggctggtcttgaactcttaacctcaggtgatccacccaccttggcctcccaaagtggtaggattacaggcatgagccaccacaccaggcctgaaattttaattttatttaatcttaattagcttaagtttaaatagccctatgtagcttgtggctaccctaatggacagctctagctgccctgaaaaagccatcattgttattagggaagcaaggcatatactcttgagaccagttaaataccaaaagaattggggtcagacagtagagacttaattattcagaaaacaaatatccactgggccggagaatttaaagagagtcttataaagtaagtgaaacttgggcttgagctagagggatgtacagtggataggagaaaagaaggcaagaggttattctgatgggttggagggggtgggcaaatgtttgcagttaaaaaatatctcctacatgagaagtttgaggacaatgactattctaaaatagagcactcatattgggagttaggcgtgtttgggccaggtcatggacagtcttgaatgctatcacacagagtttgggctgtccacataggctgatgttttgccaggcttgcttaaaacatagattctcaggccccaccttgacctactacatcaaattttctgggttggagcctaagaaatcagtattttgagcaagctccccagatgttgatgatgcacattcaagtttgagatctattagatagacagaaaggagcccatgggagcttttgctgaagggagtgatgtgataatagcagtatctttggaag

SEQ ID NO: 50576 - DNA, 1114 bp, Homo sapiens
cctaatgtgaaaatccaaaatccaaaatcttctaaaattagaaacttttggagtcctgacatgacactcaaggacatgctcattggaatgtttcagatttttggattagggatgctcaaccagtaagtacatataatgcaaatattcataaatgaaaataaatctgaaatctgaaatgcttttggtcccaagcatttcagataagggatactcaacctatagtagtagtaatggtaaataactactaccactaccactgccacccttgggatagagggatcaatgcattcaagtgcctacatttttttgcatagctaaccaaattgttggtagaggcagcagttgctgttcctgaagggacagcaaagcaattgttctgggcttcacagacagtgtctggggctttaaaacaaagttgtttatggaggtatgactgaaaatgattcagtagagcataattctcagcaaagaagttctatttatttttgccaatccttttctgcctaagaaccttaaagaaaaaaatacttatttctaaatgaaccctgtatttctaaggctcagttttggttgatcacccatgacttattgtccacaagctttgtcagcagcatctcggtacaaagatgtaaagtctctgttcttttttaccaaggtggtcttcattctcaatggatgccatctcactcttcttgagcctctcagtgagtataggattgatttgatggctagaatatagatatacaggaacaacaggggttctcagggatgtgatattagagtaggtggagttgtatggggagtgtagaaatattatcaaatggaaatttaaaaaccgggtagtcctgatagttctggagatgaacctgtttgctaagggagggatatcaactgtttcttttggtttccctctgtttttctctttactttctctgttactttcttttactttctctgttgaaagtaaaaagagaaaaaggtcagttattgtaagtgaagccaagtgccaggcttcctgtccttcccagaccatttcatggtaggagggtattggccagtttccaacagggtatagactgcaccccatgaggtgcccatcctctgccctggcctc

SEQ ID NO: 50577 - DNA, 1117 bp, Homo sapiens
tgagcttttccctttctagagggtatgaactagagttcctccaaaaaagccaggtaaagacctaagtctttcccttttaataccaatttttagagcaagaagttagtataataattgcttcctaataattactatggtgactgtatggtaaatgcacctgatagcaataactgaagatagcaatagcctgagaatggccccgtatggcagatgcacctgaatgcgatagggagtttccagctcaggaacccagagatccatttctgatctatggggaacatctgagctcctggcctgtcccgtgaaatgcaggccatacggggaattgaggccctttgttttggtttaaatgaaggttgccagctgcaggttgttagggggagggtgttaggtgaaaatgctatataaaccccatgcatttgcaagtggttgcagttccgtccagcccatcaccactggagtctcccttgaatgtaagaccccagttaaaaacaaaaaagcaaacaaacaaaaaaacaccatgtcttgtttgctgtctctggatctgttctttggcctcttgaatctggttctgtccaaattggagttgacagtggtctggcacaatagtggcaaagttgtttccccctgcttttttttttttttttttttgaatatcacttgattcggtgatttgcttatttgaattccgtgttttaagctcagttcaattattttccttttgatgctcaaattttctacagtttgaccagtgggagtcccttcagctggctctcatgtcacttaacatgcctccattagtatttgagtacttccttagattctggcacaagattcccagggtcactttacattttccttgccctagtcctggaaccagccatttccaatgaaccctggttcctttcagtgtagaatggtgtttagaaaccaagatccgggctgggtgcagtgactcacgcctgtaatcccagcacattgggaggctgaggtgggaggactgtttgcatccaggagtttgagaccagcctggtcaacatagcgagacctccatctccacacacacaaaaaaattttccaggcatggtggtgtgtgcctgtagtcccagctactgag

SEQ ID NO: 50578 - DNA, 1050 bp, Homo sapiens
tcctgagactgggtaatttatgaagaaaagaggtttaattgactcacagttccacatgcctgggaagcctcaggacacactatcatggtggagggtgaagcaagcacattttactatggtgaagcaggagagagagagaagaaggggaatgtgccacacagttaacaaacaaccatatcctgtgagaactccatcaccagaacagcaaggggaggtccacccccataactcaatcacctcccaccaggccactcccccaacatgtggggattacaatttgagataagatttgggtggggacatagagccaaaccacatcattctgaatgaaatggggaaccatcagaggttttgatggggtgagggaggaatgtcatgatatgatttaatgatcaatctggctgttgtgttgagaatggattattggtgggggcgtggttggatagaagcagggagacaaattgagagaagctgtgcagcagtaatccaggtgagagatgatgtagatcgatcagtggtaacagtggagatggatatacattgagggtagaacaacaggatttcctgatggattgagtgagaggtataagagacagagagaagtggctgggcgcagtggctcacgcctgtaattccagcactttgggaggctgaggtgggcagatcacctgaggtcaggagttggagactagcctggccaacatagtgaaaccccatctctactaaaaataaaaaaattagccggatgtggtggtgggcacctgtaatcccagctactggggaggctgaggcaggggaatcgcttgaatccaggaggtggaggttgctgtgagcctaaaccgcgccactgcactccagcctgggtggcaagagcgacactccgtctcaaaaaaaaaaaaaaaaaaaaaaagagcaagaagtaaaaaatggctctaacaaggacattttttggaggtaatgaatgtgtttagtacccttggctggtgggggttggtatcccaagtatatgtatatgtccaggctcatcaaaatgtatacataaaaacaggt

SEQ ID NO: 50579 - DNA, 1027 bp, Homo sapiens
tgcggtgaagctacaaaagtatttcatttctttttttttttttttttttttttgagacggagtttcgctcttgttggccaggctggagtagtgcaatggtgtgatctcggctcaccacaacctccacctcctgggttcaagcgaatctcctgcctcagcctcccgagtagctgggattacaggcatgcacaaccacgcccctctaatttttgtattttcaatagagacaggatttcttcatgttggtcaggctggtctcgaactcctaacctcaggtgatccacgcacctcggcctcccaaagtgctgggattacaggcgtgagccaccgtgcccagccagtatttcgtttcatagcttatattcttttgcaggtgaaatttgcagctcagaagaaaattttacaaagactagagtcttacatccaaatgctcaatggagtcagtgtgacaacggctgtacccaaatctgagaggctctcttgtcttctccatcctattataccctctgtaagcccccacctccctattccttatctattaaggccccttaatgctaataacatcagctgatatttactgggtacttgctagggaccaggccctatgctaaattattatcatgcatcattgtcacattttactgtttataataacctggaggggtagatactatcattttatagatgaagaccttgaggcccagagagatttagtaatttgcccaggacacacatctagaaagggccagagctgagattcacgctcaggtctatctgatagagactccattgtatcaaccactccactattacctccttagaaaggttccaaactttggaaacctttctccctgccatccccacacaatttgcccatgtaacattggaaacctttctaatgtggcctcagaagagtggaatttaatttatggcaggggttagcagactacagcttttaggccaattctgtcttgctgcctgattttgtaaataaagttttattggaacacagccaagctcacttgtt

SEQ ID NO: 50580 - DNA, 1068 bp, Homo sapiens
tagctggagtaaagtgagtgaaagagaatggtaagaaataaggttggagagaccgggtgcggtgggctcatgcctgtaatcccagcactttgggaggccgagatggatggatcacctgaggtcaggagttcaagaccagcctggccaacatggtgaaaccctgtctctgcaaaaaatacaaaaattagccaggtgtggtggcaggtgcctgtaatcccagctacttgggaagctgaggcaggagaaccacttgaacccaggaggcagagattgcagtgagccgctccagcctgggtgagagagtgagactccatctcaaaaaaaaaaaaaaaagaaataaggttggagaaaaacgcatgcaatggatcagggtgacgggtgtgtgtgcactgattatgtggggccttgtaggccatggcaaggactttgggcttttactaagcaaggtggggagccatttgagggattttaacagatgaatgatgtaacataacttaattttaggagggtctggctgctctttgggcaacatcacatggtgaagaagttgtaacagtagcagtagtagtaagaataatggcattttgaaatccaggaaaatgagactttaaaatgcatataccttgtaactatatgtccccgttgacttttttttccctacaaaatttaatgtgaggccaggcacggtggctcacatctataatctcagtactttgggaggctgaagtgggaggattgcttgagcccaggagtttgagaccagcctaggcaacatgccaagaccccatctctacaaaaaatacaaaaattagctgagcatggtggcacatacctgtagtcccagatacatgggaggctgaggcgagaggatcacctgagcctgtggaggtcgaggctgcagtgacccatgatcacgctactgcactccagcctgggtgacagtgagaccttgcctcaaaaataaaaagaaaatgtgttcttaaaacctcaagtcataggaacggttctttagtcttttccttattattatatttattatgttatttattactatattatttagttttt

SEQ ID NO: 50581 - DNA, 1050 bp, Homo sapiens
gacctccttatggagacgttcaatctgtaaactcaagagaaggctacaagtgcctcctttaaactgttttcatctcacaaggatgttagtagaaagtaaacagaagagtcatatctgttttcacagcccaattatacagaaatccgacagtactgcaatcactggcgaaattttgctgacattgatgattcctggaaaagtataaagagtatcttggactggacatcttttaaccaggagagaattgttgatgttgctggaccagggggttggaatgacccagatatggtaaaaacttgagccctccttgttcaagaccctgcggtaggcttgtttcctattttgacattcaaggtaaatacaggtaaagttcctgggaggaggctttatgtgagagtacttagagcaggatgctgtggaaagtggtttctccatatgggtcatctaggtaactttaagaatgtttcctcctctcttgtttgaattatttcattctttttctcagttagtgattggcaactttggcctcagctggaatcagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacaggtaaataagagtatatattttaagatggctttatatacccaataccaactttgtcttgggcctaaatctatttttttcccttgctcttgatgttactatcagtaataaagcttcttgctagaaacattactttatttccaaaataatgctacaggatcattttaatttttcctacaagtgcttgatagttctgacattaagaatgaatgccaaactaacagggccacttatcactagttgctaagcaaccacactttcttggtttttcagggagacaactttgaagtgtgggaacgacctctctcaggcttagcctgggctgtagctatgataaaccggcaggagat

SEQ ID NO: 50582 - DNA, 1021 bp, Homo sapiens
atgcaccctggccttccaagctactatcggctctcaaccagactgctgggaccacctgatctctctgcttccactctgtctcaacccccatctattttccaagcagcactagagttatcatattaaaatgtaaatatcagttttttttttaaagaaaaaaaccctgagacttaacagagttataaaaaatataaatgtcatcatcagttccctgcttaaaacccttaactcgcttccaattgcacttggaatgaaaccaaactgcactgatccagcccttgcctgcctccccaaagtccaaggggtcatggctctttccctggctacactggttttctttctgtccctcaacactgcaagcctattgctgccccagggcctttacacttgctttttttctgcctagaacagttcttccccaaagatttttaaagggccgggctccttaacattgaagtcgcagaccaaacgccacatatgcagacagttcttctctaactactttaaaatagccctctgtccattcattcttcatcacattaacctgtttaattttcttctcagagctccacactatttggaagtatttgttgacttgttaccatgtctccccactagagtgtaagtttcatgagggcagggaccttgtctgactttgactgtatctctcgcatatggttaagtgttgaatagttatttatggaatgaatccctattattccctcattatctctgcaaaatagtcttttttctcaacatcttaaacctgatatcccacctgcctatctacaaactttttttttgcgacagagtctcactgtcacccaggctagagtgcagtggcgccatctcggctcactgcaacctccgcctcccgggtttaagcgattctcttgcctcagcctcccagtagctgggattataggcgtgcgctaccacatctggctaatttttgtatttttagtagagatggtttcaccatgttggccaggcttgtctcgaactcctgacctcagatgat

SEQ ID NO: 50583 - DNA, 1031 bp, Homo sapiens
ctaaagtttggtcaagaagagtctttgtcaaggtaaatctatcatttccctcaaaaggtaattttcaggatcccatcaggaagattagcatggctgctagctttctcctcagttctgggctatagctcacatgcctagtttgaactagctcagcagaactgggggatttattctttgtcttccaacaaactcatctggatgattttgggggtttgtggggaaaagcccccaatacctggtgaagtaaccttgtctcttcccccagcctggaatggttctctctttctgctacctcacgattgtgcttctacaatggtgactcttttcctccctctcatttcaggttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggtaatgtttcattccagagatttagccacaaaggaaagaactttgaggccatggtagctgagccaaagaaccaatcttcagaattttaaataccctgtcacaatactggaaataattattctccatgtgccagagctcccatctcttctctttcagttcattaattaattaattaattcatgtaaaatccatgcatacctaaccatagctaatattgtgcacttataattcaagagggctctaagagttaattagtaattgtaactctctataacatcatttaggggagtccaggttgtcaatcggtcacagagaaagaagcatcttcattcctgcctttcctcaatatacacaccatctctgcactacttcctcagaacaatcccagcagtctgggaggtactttacacaatttaagcacagagcaactgcctgtccctgctgctagtttaaacatgaaccttccaggtagcctcttcttaaaatatacagccccagctgggcatgatg

SEQ ID NO: 50584 - DNA, 1050 bp, Homo sapiens
tttctccatttattcaaatcatttaggagcatcatagttttaacatatgggccttgcacgtatcttaaatttatctctaggcattttaggttgttcagttgttcttgtgaatgggatctttttctccaaataggattattgttgatatctgttgattatgttaactttgtagtttctgactttactgaactgtcttcttagatctaatactcttttcaatttcatcatatatttctcattcctattttgtttggggtttttagggcgggaatattaacgggataagagagacaaaagaaaatctggaaaaacaattcattttaccttacattgcttgtgattactaccacactattactgggttggaaaaaattgtgaaatcccaaggtgcctaataaatgggaggtacctaagtgttcatttaatgaattgtaatgattattggaatttctctttcagtgagaagctcttcatggagatggcagagctcatggtctcagaaggctggaaggatgcaggttatgagtacctctgcattgatgactgttggatggctccccaaagagattcagaaggcagacttcaggcagaccctcagcgctttcctcatgggattcgccagctagctaattatgtgagtttatagataatgttcttgttcattcagaggactgtaagcacttctgtacagaagcttgtttagaaacagccctcatggccgggcgtggtggctcacgcctgtaatcccaacactttgggaggccgaggcgggtggatcacctgaggtcaagagttcaagaccagcctggccaacatggtgaaaccccaactctattaaaagtacaaaaaattagctgggcatggtggtgaacgcctgtaaccccagctacttgggaggctgaggcaggagaatcgcttgaacccaggaggtggaagtttcagtgagctgagatcacgccattgcactctagcctgggcaacaaaagagaaactccatctcaaaaaaaaaaacaaggaaaaaaagaaacagccctcatgacacttagaaag

SEQ ID NO: 50585 - DNA, 1850 bp, Homo sapiens
taccgggtaattttcctccttcttccctcaaacggctatagcgagacggtagacgacgaccagaactacttctgctcacgtaagcgagtaatcacgtgagcgcctacgtcatgtgagatctcggtcacgtgagcaactctcggcttaaactcgggatcactaaggtgccgcacttccttctggtatggaaatagggcgggtcaatatcaagaaaggaagagggtgattggttagcggaacgtcttacgtgactgattattggtctacctctggggataaccgtcccagttgccagagaaacaataacgtcattatttaataagtcatcggtgattggtccgcccctgaggttaatcttaaaagcccaggttacccgcggaaatttatgctgtccggtcaccgtgacaatgcagctgaggaacccagaactacatctgggctgcgcgcttgcgcttcgcttcctggccctcgtttcctgggacatccctggggctagagcactggacaatggattggcaaggacgcctaccatgggctggctgcactgggagcgcttcatgtgcaaccttgactgccaggaagagccagattcctgcatcaggtatcagatattgggtactcccttccctttgcttttccatgtgtttgggtgtgtttggggaactggagagtctcaacgggaacagttgagcccgagggagagctcccccacccgactctgctgctgcttttttatccccagcaaactgtcccgaatcaggactagccctaaactttctctgtgtgacctttcctgggatgggagtccggccagcggcccctgtttctttctctctctctctctctctcgttctccttctctttctctttctcttctttcctctctctttctctctctccctgcccggttctcttttttcactgctccttgcagagcagggccaccccataggcagtgtgcccaaagtagccctgcccggttctattcagacccttcttgtgaacttctgctcttcctctgccgggtgctaaccgttagaacatctagggtgggtaggaggaatggggaactaagattcgtgccattttttctccttttggggtcgtggatttctcggcagtatctcgagggagttagagagaccataaggtcgctgagatctctcccacctcgcccatgagcgtggcatcaggctggaaggttgacatggaggaactttatacatttacacctttgcgtgagggttgaggctggattagataggtattgaacatatctgaccctcacaatccttatctgtaaattgggattacaaccttttaatttcagggagctgacaaaaaaaatctgaaaaatagttcttatctcacacaggtgagttttcaaggagataacctatttaaagtacatagcacagcgcttgaccattcaactgcgcttacagagcaaatgttcaatgggaaaatgaatgtaaatctacaaatctgaatgaatatgtgtatttttctggagagaggatatttacctttcttcaaattctcaaagggctctgtgatttaaaaaaggttaggaatcactgatagatgttggtaaaaggtggcagtcacagtacatttctgtgtccataagttattcctatgaatatctttatagataaagtcaggatgttggtcagacatcacagaagaaattggccttgtaagtttcatgtgaccctgtggtacagtatgtgtggcaattttgcccatcacggatttttttttattggtatttgcatctgattataaaactaatgcatgatcattgcaaaaaatgtagataaagaagagcaaaatgaaaataaagattt

SEQ ID NO: 50586 - DNA, 1040 bp, Homo sapiens
agatcatcccatcacctaggtattaagcccagcgttcattagcaattcttcctgacagctgcagttttgattatgtgcagctctcaattggcttttccccgtttaagatgttagaccagtggttctcagccttgactaattagaatcatgtgaggagcttttagaactcccattgctcaggccaaccctccaatcaattaaattaccatctctgggacttacacatttgtgttttgttttctcttttttgactccctaagtgatttttatatggagccaagattgaaaacagtgttagacacacactttcccaatttatgctttgaaaacaaagaccttagttcagagacttatgagatagggttatgattaggggaagagtaggccccacaagtttcagggtagtgaagattctgaagggtacaagcgataaaggagcctgagtttctgggtgaactcagaaacaaggaatcctagaagggctgagagcagaacagaacctcggaatagtctctgaaataaaagagtggagagtataagaaacagaatggaggcaggccccaggaggattcaatcaggaattctgaccttggggccataaataggtttcatatcttcacagaaagggtttacacaacttttgtatatcattttctgagatgtctgaatcctagaaaaagataaagaacatcagtatgtgaaaaagccaagggctaaggtaatggtaatcagactacagttctagaaatgcctctggatctttaatacatgactggcagctcttctaaacctctatgttacctctattagaatattatttctgatgtagtttgtggagaaacaaagcaggaatggaggagaacactgtatacagtatactttataagcactaaataaatatgtaaaaactctgaaatataatctgagtttatagtcataatgaagattattagctcaataatctagggtagaggtgtccaatctttcggcttccatgggccacgttggaagaagaattaccttgggccacacataaaata

SEQ ID NO: 50587 - DNA, 1071 bp, Homo sapiens
aatttaatccagtcattggaatcactttacattagcctctgaagctagagctcaatagatttttcaaccctaccttggctctttcattttgagagcagtaaacatttgaacattaaaaaatacctggagaattttaactagctaatgacaatttcaaagaacagtaacagcagatgccctcattacaagtgagtaagtggtaataatttaacatatgccaccttaactgtttcactcatcacccattttcttctgtctgccttcctctccatctgctattgtttatatatgtttctcccatatctaatctttctctttttcttcatcattctcactgctttcttcatgtccctcatccagctcagatcttattagcacaggaatggctaccataacgatatggaactaaagtatgtatgtattttttatttattatatttgttttgtttatcttactaatttttggccccattattgcactcagatgcctcaccttcacctataactcaacatacctaaaacggaattaataatctctacagtcaacttgaatttcccaagttttctgtctttgctagtagttccaatgtttattagtcacctacacttgaatctttgaggctgtctttgactacttaattatctatatcctatccattagcaaatcttatcaaatcttagaactatttctcctttctgtagccattcattacatttctactaccatcacctcacaccttaatgctgtaacaaccttctggaaagcttacttgtacctcattgttattctctcactccctagtagcaggatttcaaccctggatcagttccaccctatacattttctacttctgcataaagcctactgagtgatgctgtggaaaattataaactatagagattgggtatgttttcagagtcttggtacctaacctctttggacctttagtcctacttaatctgtttccttttccttcactttccccttagcgacaattttaaacctatatcattcttcaagactctcttcccccgctacactccttctcttcacacttctcagacaagctc

SEQ ID NO: 50588 - DNA, 1185 bp, Homo sapiens
tttaatttatattggaaaaacagctttttatggaatcataaagcactattcagtctagaaaataggcaaaaatacaagaaaatagatataaattataattctatcacttgtagttaaccattattgaatttctcttttgcttctgtgattccaatatgatttctgaacacacacacacacatatacacatgcatttttacaaaaaagatatacagactctcagtatagtattgtaaaatataacagtattgcagaagttttgaattttaatgaggttgtatttattaatatttcttttgtgtctgtgcttatgtgtttaataaaccattctatacacttttgtcatatactttcctctattttcttctaaaactttgaagatttacttcttatgttataattcatctggtattgattttcgtgtatggagggtgacaacaggtttttcatatggatagccagttgttccagcactatttattgtatagtccacccttacctcattgatttgtagtggcacctctattgtatgctaatttccacatatatattggtttgttttgaggcttttatcctgttttattgtattagcctggtttcctatatctacaacaatttcacctttaaaataagtcacagctttcaaatgagtcacaatatctgtagaagaaatttatatgacattaaaaatttttaaatcataaactaaattaaaaatatatgccacacattagttgatatctataacctatataactaacgaaggattcgtgtctagaatacagaaaggactacaaatcaattagaacaagaagcaaatagaaaaatgggaaagtgatgtgaacagtccatagaatagatactcagcttcactagtgatcacacaggacatgcaagttaaaataataaactatcatataagaaccataatactggcaaaaattaaaatctaataacacttaacacttcaagataatatagggaaacactctcattgctgcatttggagatgtaaactgcttcaaaattttatacctggtaaagttgaaaatccacactccttataggccaagaattccacttctaggtatctattctaaaggaacttttgaacatgtatattgggagatctatttatatatgttaattgcagcaatgcttgtgttagcaaaataaactgaaaca

SEQ ID NO: 50589 - DNA, 1049 bp, Homo sapiens
ctcaagtgattctcctgcctcagcctcccgagtagctgggattacaggcacgcatgaccacgcacaactattttttgtatttttagtagagatggggttttaccatgttgaccaggctggtctcaaactcctgacctcaggtgatccttcggcattgtcctcccaaagtgctggtattacaggcgtgagccaccgtgcctggcctctacataccttttctccttgccttattgcactaactaggatttccagtacatagttgaataacagtggtgagaactgacatccttgcatgatcccctatcataagaggaaatcattctttcactattaagtgttatgtcagctgtgattttttttttaatagataccctatttcaggttaaggaagttcctttctaattgtttcctgagagattttattgacttttatcaaatgctgtttctgtatctattgaggtggtcatatttttctccttattttgttaatatgtttaattaaattgacttccaagtacttgaccaactttgcatttttgtgataaacctcacttggtcatgataaatatatatatactttttatttattgctggattcaaattcccaaaattttgttaagaatttttgcatctataaacataatgtctatagttttcttgtaatgtttttgtattggcatcagggtaattcaggcctcattatgtagagaggaggccttttcctttactttctgagagtttgtttaacatttgtgttatttcagctttaaatgtttgatagaattcactagtgaagacatctgggtctggagttttcttggaaagtttttaataacaaattaattttattctacagatatagacagtggtagggccgggcgccgtggctcacgcctgtaatcccagcactctgggaggcggaggcgggcggatcacgaggtcaggagatccagaccatcctgcctaacatggtgaaaccccgtctctactaaaaatacaaaaaaattagcggggcgtggtggcgggcgcctgtaatcccagctactcag

SEQ ID NO: 50590 - DNA, 1074 bp, Homo sapiens
atctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctctttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagcaagtaatttgtagtgtgcctttcatgttactggttggtattctggttattgtagaaataaggttggtattctgtggttattgtagaaattttagaaaacatagtaagaacaaatgcaaataagaatcatgtaattctactggatccttcaaggtcccagcaaataaatgggactcaaaaatgggtgatttgaggagagttaaagaattttttccctgagttgccaccagaggggtagggttgtagtgtatattagctggctcaggctgccgtaagtacctcagactgagtggcttaaacaataagtttattttctcacagttctggatgt

SEQ ID NO: 50591 - DNA, 2294 bp, Homo sapiens
attcatatatgtgtttaaatgtaaacatataaaccacatgtttataaattactcattttttttctttttcttagatgatttcacaaaagttcatcttcattgcagatacctgcctttctttctaggttgtatctcccacttcacccttctagaccatcccagaagatctataagatttcatctgggaaatcactaggagttcttggaagggaaagaaggaagattgtgtaagtcaaaggaattgtttcctctgtcacaccataagaataatggaagactattttttgcatccttatcttactagcactccctgctgcactttacactgtagattatacctttttcttcttggaacgctcatcatctttggcatccaaaataacattcttctaattctgttatggctactcttaacatttttgtttcatttgtggtctctgtgcatcccttaaatgcctttcgtccttaggttttccagaattccatacttgaagttcttcctctcttctccctgatttcattggccctcgtagtgtccactaccagctatgtgatgttactctcagatctccatttctggcttttacttctcacccgagctttatttttttttttttgttttgggttgtggggtgggtacccagttagctggacaaaactgagctttacaattttatgtttaactgtacatctcacacacaataggcccaacacaacttttcctccaatccattttctccacctgtaaatggaggagtattatcatttggtgataatactaataacctaatcacccatacctgggagtcatcactgactcctccctcaccaatcttttttttaccttcttaaacaatcactgacagtggtgtcatgtaccatttcttgtgtctgctcccaaactattttgtgcctataactgtcattatactaaccttatcgttttataattgtcactttagatatttggatctctagcaactaccatagtacttgtcccaaagcagatatgcagtaatgtataatgacaaactgaatagattaatgaatggatgaattacctatgttctgtcattttatttctgattccaaactaaaccctaaattcagtgctttcattaagttcattaattacccaggcttgaaattgcagattcctccctcctttggttactatattcttcatgatttctgtattcttcagtttctcttgactctgtcatcatcctaattcaggcctttctggactaatacaagaacctttactgttactcattttgcccttagtcaattaaatataaccttccctattccatattgtcatttctcctgttcaaaagtcttaaatttcaactccactgtcttttatagtttttcatttaattccttctttcttgaaaattgctttcctatcttgtgagtggcatcaacagagtaatttatgggtagttgtgatgagtatttgggtgagatgagagtagtggctggtagtgaggatcagagagagggaaaggaggtaaaaaaataaaaaatcacttataaagggtcctgaaataggatttgaaatccagattttaagggagttagaatgtgttattctctgatgggcctttatgaaacatagttaaaggttgccatagaaaacaaccaagtaaaatattttatatattacagtggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgct

SEQ ID NO: 50592 - DNA, 1044 bp, Homo sapiens
tgtgtttttagtagggacagggtttcaccatgttggccaggctggtcttgaactcctgacctcaagagatttggccacctcggccacccaaaatgctgggattacaggcgtgagccaccgtgcccggccttgttttcttttcttttctttttttttttttttttttttttttgcccacaggtgctactaacaaacatttcttatctctgattttcttctcagagcctccctgacacctgcctacagtgttaatggctacagaatggctgctgggctttttctgtgggtgaaagttgtagttactagagaaacctggtttaaggctagtctacaatcatccctttctcagaggttaccctgattttaacaggctgatatttatctgtctagatatttccatgcatatttatagacatctgtttaaaacacacacacaaatgacagcacactcttcctaaaaactatttcacactaatgcttatttctctacctgtactatctttttttttttggagatggagtctctgtcgcccaggctagagtgcagtggtacgatctcaatctcagctcactgcaacctctgcctctcgggttcaagcgattctcctgcctcagtctcctgagtagctgagactacaggcgtgcaccaccatgccctgctacttttttttttttttttttttgtatttttagtagagacagggtttcactacgttggccaggctggtctcaaactcctgatctcgtgatctgcctgccttggcctcccgaagtgctgggatcacaggtgtgacccactgcgcccggccttatctgtctctttaagatcctattgcatttgggatcctgtagtattatgccactgcctatttacctaataatatatattgaacatctttccatgtcagtacacagatctctgcttaattcatttgaatgttcttctgtagtattcatacataatttatgttatcattttcctgttgaagaataggtaggtgttttccagttcttcagtattgcaaacaccactacattgaacat

SEQ ID NO: 50593 - DNA, 1074 bp, Homo sapiens
tgaatgtacatgaaaagatttgaaggcatacatgctcactcaggatactcctaggattggggtgggagagggggaggtgataagggaagaatgttcacatctttatataatttgttatctatagttataaaaaggaaatataaatggtaccacaagatctaattacttgaggtgaacgaagattgtcagttcatgacttgcaaactactagatggattaaggagttataaaagaaatctatcaaagtatttgttcttaatttttaaacttaaaaatgaaaggaaaaaaaattttttaaatgatccccagtactggtcagagcatgaggcatagtaaatatttttacacactgcttgtgggattagaaattggcacaacttgtgcagagggagtaatttggcagtgtattgagagtgttctatctcttgactcactaagcccgcttctgagagtcttaaaggaacaaaaggaagcgagagcaaaaaaatgtttacacaaaatgttttcattgattattaaagaatatattggtgggaggtgtgcactggatatttccagggaaggagtggctaagtaaattaaggtatgctcatttgacagaatatctattatatgactcaaaatggatgcatataataaccttaacatgggaagattattggttatcatagtaaattttttaaaaggaaaaatctaagatttgatagcccttatgagctcacctctgtttaaatgtattatttatacagagattaaactggtgtaaaattaaagatagaaaactaagacaaacataagtacaaatgtgttttctgaatttctggcttaccctagagctgacctgtagggaacaggtggcaaaatagttggtgactgttgtccctaatttgtgccctcattttctccatgtgttgagtcacagccccctccaccccaattcacaattatatacccaccagggaccaatgtgacttccagaatggtttttgtccagcttggctctacttaatgtgttttacacagtctggttggcactaggtcatgttgctttctttaggtggtattttcactatc

SEQ ID NO: 50594 - DNA, 1034 bp, Homo sapiens
atcccagcactttgggaggccgcggtgtgtggatcacggggtcaggagttcaagaccagcctggccaagatggtgaaaccccatctctactaaaaatacaggtgggcgcctataatcccagctactcaggaggctgaggcagagaattgcttgaacccaggaggcggaggttgcagtgagccaagatcgcgccactgcactccagcctaggtgacagcgagactccgtctcaaaaaaagaaaaaaaaaaaaagttaaataatcaaaaatcattcagaagagagtaccttaaaagacccatatacctctgagaatttagaatgttacaaaaccgtatttcataccaatggggaaaggataaactcttcagtgacgaatattagaaaaagttagttatacatttgaggaaaactataaaagtaccaataatgagtaggaaatcacttctgcagtatttttggagcattttccttaagcatgacataaaagccaaaggtcacaagggaaaaaactgatagatttgtctgtgatattgagagatgtatgcacatatacatacaacagtcatagtaagacaccgttagacaaaagaaagtgatggtttggaaaaaaatttccaacataaaataaaactaatatttaattattagaaaataatagcaaacaacctggtagaagagagaacaaaaatattcatatacgataacgtgaccattgaatgtgtgaaggatgatatcacacaaattcaaatgaaattatcttactacatgttagattggcccaagaaaagtcgctctcctttttttttcaaaaagatgtttttccagtgttcttgaagtcatgaaaaaatgaacttttatatttttgttaggagtacaaattaaaacagttctttgtgaggtgaatttggctctatctcatcaaagttataaataagcaaatcctttcgctaaatagttcctcttggaatatatccttcagaggtacttaactaatgctctaatatttgtatacactgatgtgcattgcagtatt

SEQ ID NO: 50595 - DNA, 1127 bp, Homo sapiens
ggcggttggaggaacggcagtgatcacacgtcggctgctgggaagatctggattctcgtttcaggtttcggggtgggggtggggagaaagggtcgatgatttccttttttcgtcgggtatagacgggattacctagtgccttcacaatcggtcagagctggattcagattcctgctcgccaacgcccagcttgggcaaggctcctgttctttctgtgtctcggtttccatgtttgtaaaatggtgataataatagtatctacctcagagacgtgtactgtataatagtgcgtataaggcacgtaatgtgaagcctggcccctgaagatattagctattgttatggagataaataatacgcgtaatagaatgagaaaaattataaattatataaattcgctaattgtagtgccctttctgccatcaacttctttcctagaataaattaaagataaaatagatataccaatttttaccaatgaaataatttgttatttgggaattgcctcaaaatagcagagattgtaattttcctatattgaaaagttaaataaaaggtggggggggggggagtgcaagaaagaaagagatggagaacgagagcgagctggagatgaaccacatgcgatgagtaggccttgtttggatcctgaatcgaacacaccaactgtaaaaatatgtttaagacgcatcgggaaaattgggacacggattcgatatttgatgttttttagggaattgatgtcagtttttttaggcgtcacagtagtattgtgattatgttttcaaattgtccttttttgtagagacatacgaaaatatttacggattaaataatgtctgggattggcttctaaatacattaatgactaggatttgcttcaaaataatctcagcggtagggggaaatggggaggggtatagatgaaacaaaattggccctaaattaataatatttttttgctgagtgataggcagtgggttgcgtatattaatctgctttccttggtatacgtttaaatttttctataataaaatacagaagtcagatattccggtgagcttgaaaaagtcgggggtgggggggagcagtgggtggggttatagatgaaacaagatggccttcag

SEQ ID NO: 50596 - DNA, 1034 bp, Homo sapiens
ctgctctgtcctttaagtactaaaccttccatccagtactatccaaataaaactaaatattagtcacgtatgaattactaagggatcattactggaatatccaaacaatttaaagagaaggtaacaataacttaaatctaaatgcaccggggactggggcaccactaaggtattgaaaaagtaaccatagttgactctgaacattctgaaacccaacttcgaagagaaaagaaacctttaagtaggcaataaattggtttcaatatctgcgttttaacacaagctcagacatgtacttactggatttctttgggcaaattactttgcttctatttcttagtgtcttcaactataaaagtagaagtaatctattcatatactatttatttcagagaaatgttatgagaatgacttggatgagctgaaaaatgaatgatctccttgaacaaggtacgattattaagtttctattgtgaagtcaaatagaacaattcactcaaaggacacgatgtttgattgagaacattcttaattttattttctttaattttataaaatacactttgtaagataagtttctaaaagtttatcctttatgtgtgttaaaattgcaattctatatcagaaatgaaggaaacactttcagttgattaactctctttgtgtgtgtatatatgtgtatgtatgcatgtgaggttttcagggaagggttggttatttgttatgttattaaatcaaaacaaaacacaaggtacggattacttcactgtcctttatcttgattggtttcttacaaaacattttccctctcctccttctatgcagcctggaagcttatcttgtatactggtttgaaaacaagtatcaagtgtctttttgtaaagctcttacatctccttaaatattgctgaaaccactttgggggaaaagaacaacacaactctttacaacaaaagaactgtagtacaaatctttccttcaattaaaaccaatcagactttttttttttttaacccaaagttaacaaaaacagg

SEQ ID NO: 50597 - DNA, 1050 bp, Homo sapiens
tcttgaaggggtccttcacatcctgtgtaagttgtattcctaggcactttattctctttgtagcaatggtgaatgggagttcactcatagtttggctctctgtttgtctgttattggtgtataggaatgcttgtgatttttgcacattgattttgtatccttagactttgctgaagttgctcatcagcttgagaagattttgggctgagacaatggtgttttctaaatatacaatcatggcatctgcaaacagagacaatttgacttcctctcttcctatttgaataccctgtattgctttttcttgcctgattgccctggccagaacttctaatactatgttgaataggagtggtgagagagggcatccttgtcttgtgccagttttccaagggaatgcttcctgtttttgcccattcagtatgatattggctgtgggtttgtcataaatagctcttattattttgggatacgttccatcgatattgagagtttttagcatgaaatgctgttgaattttgtcaaaggacttttctgcatctatggatataatcatgtggtttttatcattggttctgtttatgtgatggattacctttattgatatgtgtatgttgaaccagccttgcatcccagggatgaagccaacttgattgcagaggataaggtttttgatgtgctgctggactcggtttgccagtattttgttgaggattttcacatcgatgttcatcagggatactggcctaaaattctctttttttgttgtgtctgtctctgccaggctttggtatcaggatgatgctggtctcataaaatgagttagggaggattccctctttttctattgtttgtaatagtttcagaaggaatggtgccatctcccctttgtacctctggtagaattcggctgtgaatccatctagtcctggacttttttttggttggtaggctattaattattgtctcaatttcagaacctgttattggtctattcagagattcaacttctttgtggtttgtcttgggagggtgtatgtgtccaggaat

SEQ ID NO: 50598 - DNA, 1478 bp, Homo sapiens
ggggtaatgcactcatccatgcaggtccaggctgtctactgagggtgttccacatacttaattgctagaatttcttctgccacccagttgttcagatcgtttctgtaggagggttcaaacttgatcagcagggttttttttttcttcatcaatttctagttttataggccacaaagataatgggggaaattaccaacttttgtactatgcattttcacccagtacaagtattttagaatgtgaattgaagaatggatccaaaagcttcagaaagtggaaagcacaaaagagaaagaaagaaagaaagaaggagaaaagatccactgcaaataaaaaaaatatgtatcatatggcttaagttgatttaaaacaaaggccttaaactaatttttagggttttttttcttgaaatgagctaatggcttgtttgtgtaaagcttttccattaaaacaaaaaaatttttaaaatcttgtacataacacagtattgttgtagaattcatatgaaacattttatatggtaaagtcaactagctccctaattgtggacaaattaacagttggttcctgttcttttgctataacatacttgtgccacccatgtagccctggcatctgtgcagacacatcagtttcagttccactgtcacttggaagatcaggttcagcatcagtttttgtcaggtagctctaatacctggagttttctttcttttcttttttacttagttgaagtttaagaggaaaagtaccagttttcagatttgaactatcatagtttgtatattcaacaaactatttgaagtatattgtgttttggtttgctcttgtttcaaagtgtatccaagtaggattcctgaaatatagaaaagaaacttgtaaataaatgaatggctggtaagtatccaaaattagggagataaatgattcactaaacttaggaagcacacctggacacatcatagtaaagctacagcataatgataaacaaatatcataatagcataaaatagatacattgcctataaacgagtacaaaatagacagcaggtatctatacatcaacaaatggaggccaaaaaggaaaaaatagctgtcatgctagagttgcattcctagccaaacatcatttaagaagtaagctgtgacagacatgcaggtagatcgccccaaacccccttcaaggacagattttctgcttcagctgctgggacagcagttggatgccagtcatcagccatcagttccttcaggtatgacccgagctgcgggagctgccttgcccaaggtcacgcacttgcagagactgaccacatccaaggactgatccaagaggaggcacaaacatctggcttgctctgcccaaggtggaatgattctgatgggccatttttaccttcagagctccccttgggatccgaagaggctttggttgggcctgcagtatggatgcacttctctctgtgcccactcctgct

SEQ ID NO: 50599 - DNA, 1089 bp, Homo sapiens
taataaatcagcaacacagtacatccagaaaaaggaataggaaaggcttgccagtctatatgtgaagacgctctgtatggtgctaaaataacatctttagtgtgtgatgaaggtatggaataaatggaaaagcagcaaaatttgtggattcataactactgattagaaaaagcatagtggacagcatggttgtgaggcttttgaaaaccaaagaaatttatggttatgttaacccaggatcaggaaaatgttaaacccttcttggctaatgttttactataaaatactgcatataatttattattttaagaaatatatattaaagaaggtgtctttagacagaagcatacataaaacaaggttgtgtattgatcattttaaggaatgcaaccagaggctcccaggaatctaaacctgtatttccactaggagcagtggcttggtatttggtaattcattgcttgaggtgactttatagaatataactaccacaaataatgaatcaactatacatacatgggtgtgtgtgtgtgtgtgtgtacgtgtgtgtgtctgtgtctgtttatgtgtgtgtgtgttttggagtactttagtgcaaattgctgacatcttaacattttatctgaaaatgtttcattatgtctctctaacatattggttcttaaagtgtagtgtgaggagtcctggagacacctgagacagaccctttcaggtgactgggaaatcctttttccaactacatatctccatgaggttggatttgtcttcatatactttatccaaaacagcatgttacaacattaaatgcagaagcaaatatgggaatctagctgtcttgtactgaggcagacatttaagagattttcagaaacgtaaaacattcctaaattctttgtttctgaaaatgcaattattttaataaaattttatttacgataatcagtggatttattttaaatacattaatacaaattttaaaatttttcagttttgatttctaatataataaatattgatagatctgtaacctacattagcaaaagctctttagggtctaaaagtactaatattttcaccatctgtatataa

SEQ ID NO: 50600 - DNA, 1033 bp, Homo sapiens
acttggttttccagcaaactcggttcacagcagggaattgtgcacccaccagaaatcctaagcaatatttctctgaacaagaaaagaagcctctttgtttaccagagaaacaacagtatagcagtctaagtcagtggctctcaaactttcctgtgaatcagaatcagatggagcgtttcttaaaaccaagattgctaggtcccatccacagagttgcccctacagttggtcaggagtggacccccgaatttacatttctaactagttcccaggagatgctgatactcctggacatggggccatacttggagaactataggtctaaacggagctgacaataaattggaaagaatatctcctggaatctcttagaacccgggaggcagaggttgcagtgagccaagattgcgccactgcactccagcctgggcaacagagtgagactctgtctcaaaaaaaaaaaaagaatatctcccctagggaaggctaggcacactcctaaacgtcaggcatgtctgaattcagacacagtagatatgaaataaaatggacttatttgacactgcttagaaaatctttttatttttatatttgtataattttattgtatatttacaaattgtatacatttatagagttcaaagtggtattttatatatatacaatgtagaatgattaaatcaaggtaaataacatattcatcacctaaaattttatctttttttacacaaaaatgactcaacatggaatttaatagtttttttgtggtgctaacatttgaaatgtactcttagctcttttggaatatgaaattttgaaatatcaccaccattctattctctgtgtttgtgggttccattgttttagattccacatacaagtgagaacatgaagtatttgtctttctgtgcctggcttatttcacttagcataatgttctccaggctcatcaatggacagattttcctgatttttgaagactgaataatatttcattgtgtatgtatagcacatttgctttatctgttcatcc

SEQ ID NO: 50601 - DNA, 1049 bp, Homo sapiens
aaacagcatggtactggtaccaaaacagagatatagatcaatggaacagaacagagccctcagaaataatgccgcatatctacaactatctgatctttgacaaacctgacaaaaacaagcaatggggaaaggattccctatctaataaatggtgctgggaaaactggctagccatatgtaaaaagctgaaactggatcccttccttacaccttatacaaaaattaattcaaggtggattaaagacttaaacattagacctaaaaccataaaaaccctagaagaaaaccttggcattaccattcaggacataggaatgggcaagcacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaattttcacaacctactcatctgacaaagggctaatatccagaatttacaatgaactcaaacaaatttagaagaaaaaaacaaacaaccccatcaaaaagtgggcaaaggatatgaacagacacttctcaaaagaagacatttatgcagccaaaaaacacatgaaaaaatgctcatcatcactggccatcagagaaatgcaaatcaaaaccactatgagatgccatctcacaccagttagaatggcgatcattaaaaagtcaggaaacaacaggtgctggagaggatgtggagaaataggaacacttttacactgttggtgggactgtaaactagttcaaccattgtggaagtcagtgtggggattcctcagggatctagaactagaaataccatttgacccagccatcccattactgggtatatacccaaaggactataaatcatgctgctataaagacacatgcacacgtatgtttattgcggcactattcacaatagcaaagacttggaaccaagccaaatgtccaacaatgatagactggattaagaaaatgtggcacatatacaccatggaatactatgcagcc

SEQ ID NO: 50602 - DNA, 1055 bp, Homo sapiens
tgtgcagtggctcacgcctgtaatcccagcactttgggaggccgaggcgggtggatcacctgaggtcaggagttcgaaaacagcctggccaacgcggttaaaccttgtctctactaaaaatacaaaaattagctggatgtggtggtgcgcacctgtagtcccagctacacgggaagctgaggcaggagaatcacttggacccaggaggcggaggttgcaatgagccgagatcataccactgcactccagcctgggtgacagagtgagactccatctcaaaaaagcaaagcaaacaaacaaaaacccaaacaacaacagaaataaaaccaaaccaaaacaaacaaacaaaaaaacatgctgtggagtagtagagcgcagtgactggctttactctcccaacgcaaaaaagctttctagttttttctaagtagaaaaatactagatgctattgaaaagaattcagaaaatgaattataaagaagaaaatagaggtcctcataatgccaccagccagaaataatcattgctaacattttgatgtattgtagaagatatcgatgggatttgttttataaaattgaatcacactatacctacagtttatgtaaccttacatcatttgtaaataacatatcgtggacctatttccatgtcaattaaaacacagaactacatcattctgtcatggctgcactgcattctatcatataaaatatgatttatttaatcgtaaactactagacgttttgttattttcattttcactataacccagcatctttgcacataatactgacaaagtcttaagaatagaattgctaggtgaaagagtgtgcatgttttaaaggccaatacaacatgttacaaaaataagacagccattactatttccagatgaggaaacctcggcccaatgagatgaaaagagttgcccaacatcccaagttgagcagtaatagttagacttggaatctaggtctgtagatatctagcttggcaaactttgcagtgtacaacaccaactccctcccaaggattcccatgtacaaatgata

SEQ ID NO: 50603 - DNA, 1109 bp, Homo sapiens
ttttgcttttacctaaggctaacacgacaagatctattaagatggcagatcagttgtatttctgaagaacatatgggcactataagaaactacagtttggtttgtcttaccggtgttctcaaaaaatacagagaaatatgggcaaccttgaggtactatgaggtggcaaatcatatgtctgatgctttctcattgaaaatttgaaagttgattttatcttgaaatgtcttggttatccagaaggaggacagaatagttgtaaggataaaaatggggttcccaccctgctgcatgattaaaaattgcctatggatttctctggtgccagttgtttcattagttcttcaacccctagtgcatacagcagccaaacatggaagatgatttaaggtcatcatcatgggctttcctgcacaactcagggagtgtctgcttgtgcttgagcacgggaattctttgtcacaaggggaaaatgacttgaattggctgattcactttctttgtttctgactaggcccctgtgattcaattaacttttacaagtgaactatgggcaatagccacaatccagtgggctggtgaaagaattgtgtggttctgctgcaatataaaaaaatgtgcataagtctttgatacgggaaggcatttgtgatgctgtaaaattaatgagttggcactgttctctgcatactcttctaggctttttatggcctttttattccattcttgtgttaggggatttggggtatgtgttttttctttgtcttccctcttgacttgcatctttaggatacttctaagtcaggctggtcgcaatcttatttttagaattcttaccaaggtcaacctagtcctattatatccagatgctgcccagtcacacctttcaacttcacctctccgttaataccagtcgcactagtgaaatggttgaggcttgtgggtaaagttgtatccctaacctggacttgtctgtgggtaacatctagagtcagtctgaatatgggaagtttgagttggggctccataggatcagaaaatacttaacttgtactctgacagcttacaatttaatttcctcttcttgcagtaagtacaaatggatccta

SEQ ID NO: 50604 - DNA, 1028 bp, Homo sapiens
ctctattggaatttttgtatgagtctttatggattgctatatcgagagtgaggttttggctgtagaggacaggtaaagtacattgaccattcatatgtaattttaatttattgagaataaaattatttcaagagaaagagaaacataagaggtatgtgatagttgctgttgctaatgtcatatatgttacataagatcagtaaatgatgattgtgtcatttcaagttacacttttcgagggaatcacattgattgggctgagactaccttttaatgggggaaaatggagttactcaagagtctagtaaaatatataggatttctgataaaacattaaggtttaatcaagagttacaaaggtcttctgttattatcagcataggaagctgataagggtccttgggtcatgtagttcagcttactaactccagataaaataaagcctacagtatccaagaaaacttttaagttctagtgggtagtttagcaggggcgccacaggtgtcactggaaacagctttgtgagtcccacaaatctagcaaggggaggagaggacctgcaataaagaataggttccaccagtatgtaagcaggtataacctttttggggaagacagcttatttctgttaaaggaaataatccctttctatttgttcatcctacatgtataatcgtgccgcataatgacatcttggtcaataacagaacacatacacaacagttatcccataaacttacaatactgtatttttactgtaccttttgtatatttagatatatttgatatgcaaatacttaccattttgttacagttgcctatagtattcactacagtcacatgctgtacaggtttatagcctaggagcaataggctattgcctaggtgtatagtaggctataccatctgggtttgtgtaaggatactctatgatgtttgcacgatgaggaaattgtctaacaatggatttctcagagcgtatgcccatcattaagtaatgcacgactgtatttgagtgcctactttat

SEQ ID NO: 50605 - DNA, 1101 bp, Homo sapiens
taataagtcagtgtgcttcaattcagctgtgactttcttaaaattcttctggcaggataaatactgatagaaaggtgctaaaatgggtatgcattttaggggaaaaatgtctaaaattgaagaagttaaatgaacaaagattaggtctataaatataagcatttcctcatagtctctagatatgcccaagtatctttccatggagagtaaatgagattgtgtaattagaatatggaactgagtacttagaagtctcgtttttgaatactttatcttttagtacaggagacataaccttgcagcccactttgcccctttataaactgagtataatatagctgccaattattgttaaattttgtttgtttctaggattacttttgaccactgaatgtattttctagtactcctttcagtttttactcctaaaattctctttctcatgctttacatataacaaggttttataatttgaatgggatctgaactctgtaatgttagagagttgttaacctgcatagttataaggaaattaaaaggtaaaagtgaaggacccagtttttttccaaaggatgatttattctctgtactgcaggagatgctctgttccagaggaacaagaactcactgatgaagacctgtgcttgagcaaagctaagaaacagttgagtatacatgagatggggttctctaccatagggtagagtagcctgacacttccttacaggacgggagttttgagaagagagaatttttttggttcttaaataatttccctcctcacctctctgctctcccagttctttattccttctaatcatctcctgaatgtctcaactagtgattgtctttagtctttctctctcctctctctctctctctctggtggggcacttgaaatctcacttcagtagcctagttcagaaaggcaccctcagttactcaatgaggctcacagtatttgtaatttggaaggaacattataacctaaatctacaattggcagtccatttcaaactgagaagtttcatgagtgaactaaatagcacttttatcttctcctagagaacaaactgttgaggagaagaagaagatgcctat

SEQ ID NO: 50606 - DNA, 1033 bp, Homo sapiens
ctaagacagacaagtcaggtaaggagcataatacagaggatcgaatgtgtgccaacacatacacagtcagttacaccaccatcaagacaaacattagagtggtaaaagttctttttggagtaggtacctattattttaatggaaattattaggcaaatgtatgatataaaattttatttctaatgcaacctaatggctgtatgtatatcaccctcttcttattctgaagatctcagcttatggctgtcctccatagttttcaaagaagtacaaactaagatgagatgccattttttgcctttcaaattagcagtgattaatgcaatgaaacagatgttcacatactgctagagagtgtgtgtgctggaggcagaactgtaataatggtaattattgaacgcttacttatatgtcaggcactgttctaagttctttacatgcagtggtttatttaatcatcacaacaaccctacctgttagatattattattacttctttacagatgtagagactgatacaccaagaacttaagtaacttgcctaaggttagacaagcagcaagtggtagaactaaggttcaaatataggtaatcaggtcccctaaacctaagttcttaactgctgctctcttctggagggatgcaatgaagggaatgtagtaaagccatctcagctaccaatttcctgaaagcatgggctaaaagcctctcctgtctgcctggattgaaggatctaccatgatctgcatggaacccgaaacagagggttgctgcctctaagcatgcctatccctgagagagtaatactggcactctgcaagagactctcctatgcatatgcatgtagaaccgaagctaataggacctttcttctcccctcccactactgctgaagctgctttttattgactctggctctaaaacagtggctgtctagaaatatatagacaccagaggtcaggcctgagcttagagcttagaggttgcaaggctggaacagcctggagctagggaataggaagctgtagatcca

SEQ ID NO: 50607 - DNA, 1048 bp, Homo sapiens
accacataacttagtggctgaaaacaatactaatttactgtcgtagcgtgctgtaggttggatgtcctacacagatcttactgggctataatcgaggtgttggcagggctgcattcctttctggaggctctagggaataatccattttcctgtcttttccagcttatagaggctgccagcatttcttgcccatggccctcttccatcaccttcaaagctagtagtgacaggttgagtcctcatattgcatcactctgatgaccttgcttttgtcatcacatcttctctgattctgactcttctgctgcactcttctacttttaaggtcccttgtgattacattggataattcaggatattcttcctatcttaaggtcaacttgatgagtaacctaaattcccacttgctgtgtaaacattattatgtctatcacagtctgccctttgttctctcagattccacttacatctcatatgcaaaatatattcaccccgtcccaacgtttccaaaagtccctacccattacagcatcaatgcagagtcaaaaatttcatgtaaatgtcatcagctcaaaagtctcaaatctcattatctaaatcacataagggcaatactctgagtatggcacatcttagggcaaaactcctctacatctgtggatatgtattttcttttttgtattttgctgttaaagtacagtggtgggacaagcataggatactaattatatatattcttgtttgaatgggggagaaactaaaaggaaaaaaggggtcacaggtcacaggcattttcaaaatctagccaggcacattccattaaatgtcaaggccttcatcctctagtcttgaggctttgccctctggacttagggctccaccctcaaagctgtctttcctttttcctgaagggtagcatgtgttggcagctgagtagtttcatcagcctgtttcctgactgtagaattttgagggtcaaacaggattctctccatccctttcaattcaagctagctttttgttttgattttttgtttgtttgtttgtt

SEQ ID NO: 50608 - DNA, 1771 bp, Homo sapiens
tgaagttatggaatacattggataaaaaaaagcagtttgaaatttgttccaaaaatttttcttgaagccagtgaacagatttagagcaaagtgatggaacagcaggaaagacatgtgctttcattaaagcatctagatttaatagggcaggcaaacaggtaagaatctgaaaggaactcgacattatggctgaaccagtagggatatttttcgaaaggagtttttaaagccaggttagaatagtttgtttaaaaaatgtcgagagggagatgggtctttatttcattaagtattatgagacagcttctatgtgccaggtactaaggatgaaaaataagactctttgatacctatgaacaaatatgtatgcaaataagaaacttaaatacttataaaataattgctttaatagggggtatgtgcaaagtggggagaactttaaatatgcttaagggagtcagggaaggcttcacaaagcagattatatttgatattaaatatgaaggaaaagttttctaggtggacaatagaggaaggacattctaagcagagggaagtatctgtaagggcaaaaaagggtaagaggtattctgggagtatggagaaagaaggcatgaggacatttgcggtcattttccttgaagtctcagtagcaaatatttttcttagagtgggagaaaagaaatttcccaaatctcttttgttttgtgcccaaactgtaataaagtcaagtcttgtaccttaatttgtctgtaaccacaagaattttaggtttagtgtttgagagagataactatttgaatggcaactccaaattaatttcagggtaattggttcatggttacttgggctactcagtggttatgacaactacctgccctcagtctaagtaaaatggtcatttaaatgtaaatctggcccataatggaaatctttgaccaggacttaactctaagtgaaagcttaggaatgacattagtttgacagaagtctccgagtcaagttattatgtttcaattgagtgaaaggaatagtgaattgctgatgactacctaaataattaagatttgtgaaattcaaatgttagatattaaaaattatttaacatctttctatatcatctttgccaccaaccccccaagtctacctttaaaattttacaggcattagatctttggtttttgatgtctagttttggtatgatgaggtgattgcagtggatcagatagagatagtctgtagacagtagatttattcagttgaacacacaggatttctgacttacttagcataacatctgctacacactttattaaaaacagggaactagtatactattctgcgtacagtcttttgaggataacaaatttgcataactcatgccaattctggcaccattgcccttttttattcaatttattttatataaaatgaaaaggtatttaaattaaaaaaaggaatttaagagagggattagagaaggttgtctgctataacaaactcatcctatgagtattatagatatcaaaacctgcaaatgataaaagagataccagccatcatactgctggaatgtctacaaataaatcatctgtaataccacttttaacagttgtggagcttacagtcatttgtataaacagattgtaacatatatgaagtaatttggcgagcaataaaaaagctctttaatcaaccaaaacctaagtagtatgttatggggaaaatgccttgatataggagatggggaaggttttgggtagaaagtatg

SEQ ID NO: 50609 - DNA, 1027 bp, Homo sapiens
gagccaccacgcctggcccgaaggattctatgttttctgggttttttttttttttttggatggagtttcactcttgttgcccaggctggagtgcaatggtgtgatcttggctcactgcaacctccgcctcccggattcaagtgattctcctacctcagcctcccgagtagctgggattacaggcatgcgccaccatgcctggctaattttgtatttttagtagagacggggtttcaccatgttggtcagctggtcttgaactccctaactgaagtgatccgcctgcctcggcctcccaaagtgctgggattacaggcatgagccaccgtgcctggtgctgttttctacttgaaggcatattacttttgtatttggaaaaaataatagaagtaattatacaaatttattaagcctacagaagttctatttgacctctaacatttgttgttacactgtccacactttccaactctttatgcaactctattttcaggctgataaaatagttgtgtaactgtagcaacagtttcttccataaacatagactttcatgaaaatcaaattaaaaaggaaaaacctattattaaattcctttaaggtccacaactaattatctttagcttctggggctagtgtgtggatcagttagtctgtatattcagctgcctttttcagcaaggtggaaaacctctttcaaagttcaaagactaaaaacagccacagaaccacagaaggtatttgctacctgtgctcagaagtgcacttcctagcaggtgtattcttctaaaacaatagctggagaataacagtctgcttagcactctttcattcttttatattacatattaaatcacaagtatacctaggaaatagcagtgcctgcctttgtgcacccatggattttgccaaggtttgtttcattggtcagagtctttacttatttattatttttcttaacttttatttttggtttggaggtacacgtgaaggtttgttacataggtaaacacgtgtcatggcagagtcc

SEQ ID NO: 50610 - DNA, 1026 bp, Homo sapiens
gccacaatttttgttccagattcattcatttattcattcaacaaatttttattgagcacctgtgtgcaaggcactggagataaagtggtgaaccagatagacatgattcttggctgacagcttaatgagaaagaacaaaattgactagtaatataactaaataggctattccacccagtggtaagtgctatgaaggtagagcacagtttctttgagaacgtataacagggatctaatctagtctagggaattaaaaaaggctcccctgaagaaatgacattcaaattgaaatatgaaggatgagtatcacccattcaaattttttattccctccccaaggagcaaaataggtagaaactttcttagctatagaattttccctatcataccaaatatgtttaccactgatttgagctgggcaattgttcctcctatttaaaaaataattttagaaaattattttaatgagtccttaatgtaatatatgtactgaattttatttgtgattgtatcttgaaacaaacttgaatcagctagaagatacctttttttttaattaaaaaaaaatttttttgagatggagtttcactcttgtccctcaggctggagtgcaatggcatgatctcagctcattgcaacctgcccctcctgggttcacgcaactctcctgcctcagcctcccaagtagctgggattacaggcaggtacaatcacgcccagctaatttttgtatttttagtagagacggggtttcaccatgttggccaggctggtcttgaactcctgacccgaagtgatcagcccgccttggcctcccaaagtgctgagattacaggcatgagccaccgtgcccggtgaagataccatttatttaaaagagatcatttaaggccaagcatggtggctcatgcctataattctagcacttccaaaggccaaggcaggcagattgcctgagtccaggagtttgatgcctgcctgggcaacacagggggaccccatccttacaaaaaaatacaaaaatta

SEQ ID NO: 50611 - DNA, 1022 bp, Homo sapiens
ctttcccttagggccttctaaatgaaaaaaaagaaaaaaaaaagattgactataccaggcctcttaatccccttctgggactattggtgatgctgtactactgttaagacgttttctgcttacagtcagtgacagttttatcaatgactctggcaataccattgtgacccttgaaattaatctgtgttttgttttatttgatgaacattccacatatccaagtggctgtaactgatatcattaattgtgttataaaaaatgggtgttttgcatatttgtaatacttctctggattgtaaggggtgttcctgggaaaaaatgatataatttgatcagtagtaatagaacaagtatatggccaggacctgacctggctgtcttagcttagctttttggtatcactaaagcagtataggataccagggaaagggaagagggtggaagggaaggactctgtcttgctcaaagagcttagtagagacaggaacgattaaggaacctatccaacagattgtataaactgcccctcaattgtggccagtgagccacatttgtcagtgattgacaattatgtaaactggtgcctgtggcaaaaacatgcggcaactagacagtggcacccccctggggttgtggacgtgacacaattgttagactatggcaatatttgatgtctttggagtcttaaataattaactcattgtgaagacataaatcaggaggaatcgtgaacctatgtattttttctactttaattctatgttctccatttcctgaaaggatggacagccttacctttaaaactattacaaaatacctaagcaaaaatcactccctctaagtatgcttgctaccatcactgagatctaggcagaccattaagtcttttgattttaaactctaaccctttcagtgcctcttaggctataaacaggaatggcagtactctctgtgttctttaacagaggaggtgatgtaagaaagaagaaaataaaatgatcacaaataaactgtaatgtgtg

SEQ ID NO: 50612 - DNA, 1033 bp, Homo sapiens
gcttctgttcctaagtcgctgttaaatgtttctttctaagaaactggatctaagaaactggatttgtcagcctctttcttcagcctctcagcttcctcggactttgggaaaggtttgcatagacttgtctcctgcaaaacaagcatatcaaaagattatgagacatatgaagaaacaggaaaatgtgacctataatcaaaatgaaaacagtcagtataagtagacccactagtgatccagatgttgaatgtactgatacgtgatgcagcacagctataccccaacaacatgctgaatgaaagaagccaggcacaaaaggtcacattttttattccacttatatgacatagccagtatagataaatccatagagacagaaagctgattggtggttgttggggtctatgggtagaagggaatagggagtgagtacttaatggatatagggtttactttaggggtgattaaaattttttggaactagaggtggtagttggacaacactgaaggtactaaatgccactgaattttacactttattaattttatgtttgtgtatttcactttaattccttgaatgggtttattagtagactgaacacagcagaagagtagtgaactcaaagacagtgcaatagaaactattcaattgaagtacatggagaaaaaataatggaaagaagagaaaacaacacgagagttatgtaggagattgtcagccagtataatattagtgtaattaaaatctcagaaggaaaagagcaagagaatgaggcagaaaaaaaaaactattcaaagtgataatggctgataatttctcaaaagtaatgacagacatcaacccacagatccagtaatctcagtaaaccccaagtaggataaaaacaggaaaaccatacttaggcacattatagttcaacttctgaatgaaggataaagagaaaaacttaaaagcagccagagctggatgaagtggttcatgcctgtaatcccaacacttcaggaggctgaggtaggaggatcacttgagccc

SEQ ID NO: 50613 - DNA, 1066 bp, Homo sapiens
atattttttgtctgtggtacctcagcctatcattgtttgaatggctcttcagaatctatgtgcttcctctcattcttagtgccccctatgaccatctacactgaacaagatttatacaatcatgtcgtacctaagccccacaacaaaagagtacccattcttccttttgttatcagagcaggagtgctaggcagactaggtactggcattggcagtatcacaacctctactcagttctactacaaactatctcaagaaataaatggtgacatggaacaggtcactgactccctggtcaccttgcaagatcaacttaactccctagcagcagtagtccttcaaaatcgaagagctttagacttgctaaccgccaaaagagggggaacctgtttatttttaggagaagaatgctgttattatgttaatcaatccagaattgtcactgagaaagttaaagaaattcgagatcgaatacaatgtagagcagaggagcttcaaaacaccgaacactggggcctcctcagccaatggatgccctgggttctccccttcttaggacctctagcagctctaatattgttactcctctttggaccctgtatctttaacctccttgttaagtttgtctcttccagaattgaagctgtaaagctacaaatggttcttcaaatggagccccagatgcagtccatgactaaaatctaccacggacccctggaccagcctgctagcccttgttccgatgttaatgacatcaaaggcacccctcctgaggaaatctcaactgcacaacccctaccatgccccatttcagcaggaagcaggtagagcggtcgtcagtcaacctccccagcagcacttgggttttcctgttgagagggggtactgagagacaggactagctggatttcctaggccgactaagaatccctaagcctagctgggaaggtgaccgcgtccacctttaaacacggggcttgcaacttagctcacacccgaccaatcagagagctcactaaaatgctaattaagcaaaaacaggaggtaaagaaatagccagtcatct

SEQ ID NO: 50614 - DNA, 1005 bp, Homo sapiens
tttcaccatgttggccaggtttgtcttgaactcctgacctcaagtgatccacccgcctcggcctccctaagtgctgggattacaggcatgagccaccacgcctggcctcagtgtggttttgatttgcattttcctgatgattagtgatgttgagtatttcttcatgtatttgttggcaatttgtatgttttcttttgagaaatgcctgctcagatcactggcccattttaaaatcacagttttttttgttgctgttgagatgttgagttccttgtatagtctgagtattaatcccctgttgggtgagtagtttgcaaatattttctccttctgtaggttctttttgctctgttgattgtttcctttgctatgcagaagttttttagtttaatataatcccatttgtttgcttttgttgcctgtgcttttgaagtaaatagagtacttaaacatttaaaatcacttaaacctaacagacaatctatagaacacccaagaacaacagaattcacattattctccagtgcgcatggaagactattctctaggacagattgtacgttaggccacaaatcaagtctcaataaattgtaaaagattgaaacaatatgaagtgtcttctccaaatccaatggaatgaaagtagaaatgaagaacagaagtaaaactggaaaatccacaaatgagttaaaattaaatgaaagatgcttaaacaactaatataacaaaaagagacaaatgaaaacaaaaacacaacataccaaaaattatgggatgcagcaaaagtggtgctcaaatgcatatttttaaagtgcaaacatctattttttttaaataaagaacgatctcagatcaataacccagctttacaccttaaggaactataaaaatgaaatcaaagtaaactgaaaactagtagaaggaaggaaatagtaaagattatagctaagggttgggcacagtggctcatgtctgtaatcccagtactctgagaggccaaggtgg

SEQ ID NO: 50615 - DNA, 1023 bp, Homo sapiens
aatataaaagattagatgagaataaatgaaatagagtgaagaaaagtagagaaaaatcaatgcaaccaaaagttgattctataaaaagatcagtaaaactgacacaccttctgctagactgaccaggaaaaaaggagaatcaaattactaaaatcagaaatgaaggagggaacatttcaactgaacttgtagaaataaaaaagattatgaaggcatattatgaataattttatgtcaataaattatcaatgaagtggacaaattcctaggaagacacaaactaccaaaaccaactcagaagtagaaaacttgaataaacctatatcaagtaaataggttaaatgagtttttgaaaagatacccacaaagaagagcccaggctgaaatagcttcttaaatgaattctacaaaacttttaatgaaaaattaatacaaattcttcacaaactttttcaaaaagtagaagagtggtgaacacttctgacacatactacaacatggaagaactcagaatatgctcagtgcaagaagccagtcacaaaagactacatattatatgatactatttatatgaagtgtccagaattggcaaatatatagagatagaaagtggattagtggttgcttagggctagcacagagttggggggaatgggaagggctgggggtaacagttgaagtgtatgaagtttctttagaggttgatgaaagtgttctaaaattggtcgtggtggtgatttcacaactctgaatatactaaaaaccaggaattgtacacgttaaatgggtgaattgtgtggtgtatgaattatatctcaataaaactcacaaaagtaggggtgtccatcaataggaaaatgggtaaataacttatggtacatctatttagtacaatactatgcagccattaaaatagtgaagtgtatctatgaatatattatgacctatactcatgtccaaggttgtgtattaagttaataaacaagatgcagaaatatgtatagtatgaatacatttttatgc

SEQ ID NO: 50616 - DNA, 1048 bp, Homo sapiens
ggccaaggcgggtggatcacctgagtttgggagttcaagaccagcctggacaacatggtgaaaccccacgtctactaaaaatacaaaaattagccaggtgtggtggcacatgactgtaatcccagctactcgggaggctgaggcatgagaatcacttgagcctgggaggccaaggttgcagtgagcagagattgcgccactgcactccagcctgggtgacagagtgagactttgtctcaaaaagaaaaaaacaaagagtgccttacctcctttatatgatattttggttgatcctcaatttgttttaggtattatacctgaagaaccttagccctcgggtgactgaaagagatcttgtgtcattgttcgctcggttccaggagaaaaaaggacctccaattcaattccgaatgatgactggacgaatgaggggccaggcttttatcacctttcccagtaagtagtttcatccagatgattactcagttgcccctcagttcgctagagattacctataacctctctaatttagatatagtcctttgatttctccacagcatgtgagaacaagacaatgaacgaaaaatatgttttcagtgtttctttctgtttcctctcctccattgacagtgcatggccacactaccccagtgtcctcagtttttcccagtcttggtacttccttcttaccctaccaaaatctgtactcccttcactgacaatagtatttctagtccaagttataattagattactcattaattaatgtattagtattctgatcagaacacatgtacttggcttatgcgctgttcctttaggactaagtgagagcaagctaatatactaatttattactaattcataattagtagatgatgatacagtcttctaaatattatttgcatattaattaatgcatagcttctaatccaactggaagaataatatgcaaatttcagtttctatgacagaccagataatatgttgttttgggggaaggctttgtaggatctgtacctttcattgtccctaaagtatcgtcatt

SEQ ID NO: 50617 - DNA, 1053 bp, Homo sapiens
ttttaatactgaatattatagctgtggactttacatatatggcctttattatgttgaggtaaattccttctattagtagttgagtgtcttcatcatgaaacagtgttgaattttgtcaaatgctttgtctgcaactgttgagataatcatgtaatttttatattttgttctgttaatgtgttgtattacattgatcaatttttgtatgttgaatcatccttgcatcccagggataaatctcccttagtcaaggtgtatgagctttttaatgtgctgttgaatttggtttggtaatattttgttgaggatttttacatctgtttattaaggatattggtctgtatttttcttataatgtttttgtctaggttggtctcagggtaatcctggcctcatagaatagctagcatatagttggattttgtttatccattcaggtactctgtctcttggggagtttattaatatttaatgtaattattgctagcaaaggacttactattgccatttgttaattgttttctgtctctgttgtagctcttttgtctctccctctctgccgtcttcctttgtggttcattgggtttttttttttttttgtagtgatatactttgatatctttcccatttttctctgtttatcttttataggtatagggcatggtaaaacaatctgttttaagctgataacatcttacgttcaatcacatataagagctcatttttgttctgttgaatttttttttttttttgagacagggtctcactctgttgcccaggctggagtgtggtggtgtagtgtgatcatagttcactacagcctcaaactcctgagctccagtaatcctcctgcctcagcctcccaaatagctgggacttgtaaaattggccagttgtggtggtgcatgctgtttgctcacaagtagcacatgccaccctgtctcttttgcagagacagggtctcactgtgttgcccagactgatctcaaactcctggactcaagcgatcctctcatctcagcctcccaaagcactgggattacaggagtgagc

SEQ ID NO: 50618 - DNA, 1145 bp, Homo sapiens
ctagttttgtatttttagtagagatggggtttcgccatattggccaggctggtctcaaactcctgacctcaagtgatttgcttgcctcggcctcccatagtgctgggattacaggcatgagctaccatgcccggctgcagttttttttttttttatggatatatttcacagtcatgaagtctgggacttttattcattgctggtggtaatacaacctctttggaagacaggttggccacctcttacaaagctgaacattattttaccacacagtccaactactgcattcctacttatttacccagttgatttgaaaagcctgtgttcaacaaaaagtgccatgtgaatgttcatagtagctttattcataattgccaaaaaccggaagcagtcaagatgtcctccaataggttaatggatacattcacctgtggcagatctatacaatggaatataattcagcaataaaaagaaatgcatgtccagccacaaaaagacatagaggaactttagatatatattaatagctgaaagaagctagtatggaaagactgcatattgtatgatttcattatatgacattctggaagagggaaaactatagacagatgataaatgactgccaagggtttgagggaaatggagaagggagaaatacatgaaacacagggaatctttagggcggtaaaattattctgtataatactgtagttgtagaggcaagacatgcatttgtcaaaaaccattaaactacatagcacaaagagtgacacttaatgtatgcaaatgttaaaaactcatttaggaggttgagagaccctaggaaagaatgcagacagtgagaagagagtctaactgtaaaacaacctcatcgaagggatgggggaaaagatgctgaactaagcatctttggaaatatgtggagtctgaaagactaaaagcaaatggaacttcacataagcacggtacccttattgataaggttatttcccatggcaggtactggttacttagggagtaacaattctgatactcttatacatgcataatggaatggaacaattaagtaaatgtatggcagatggcgggggccaggtttctcactgttgcaatctacagataagtaaagggaggaagctgaaatg

SEQ ID NO: 50619 - DNA, 1049 bp, Homo sapiens
ctctaaggcaattactaaaaaaaaattatataaagaagtacaactgatatggctaagagaagggtgaaaatggaagcatataaaataatactcattttttacagtcttttttcagaaaacggaagcagagggaacacttcttaactcatgagaccagccttagcttagtaccaaaaccagataaagacattacaatgacaaaaaactacagacagtatccctcgtgtatagaagcaaaaatcctctatgttaggaaaatcaaaacatttgattgaaatattgattgagaaatcaaaatgttaggtaatcaaattcaataatgtataaaaataattatatactatgatcaagtatgatttattccagatatccaccataggttcaacatttgaaattcaattaatataatctgccacatcaatagactaaagaagtaaaatcatatggtcacttcaattgatgtagaaaaacatttgaaatatcttaacatcgattcatgataaaaactctcagcaaactaggaatagactataacatccttaacttgataaagaatatctgcaacaccctacagctaacattatacttaacagaaactggatgctttcccctttgatgagaaataaggcaaaaatgtcccctttccccacttctttttgacactgtactagaagtaccagctacagcaataaaacaagtgaaggaaattaaaagtatacagattgggaaggaaaaaataaaactctctttgttcacaagtaacacgtatgtctgtgtagaaaatcccaaagaatcagccaaaaaacaaactaacaaacaactcttgggactagtagattagtatagcttggaggttacaaggtttatccacaaaagtcaattgctttcctctataccagaaatgaacaattggaatttgaaattaaaaacaacaccatttacaatagcaccaaaaaagaatgaaatacttaggtataaatttaacaaagtatgtacaggttctatatgcacaaaagtgtaaaactgatgaaaaattaaataagatctaa

SEQ ID NO: 50620 - DNA, 1131 bp, Homo sapiens
ggaggtttttttgttgctgttttgttttgatttgtttttttttttttttgtaaatccaaaggaaacaagggagacaaaaagacagtagaagaaacagaaacttctgacacctacagctacatcaaacattaagcacagcccaactcctggccagattaacataaaacctcatactaatggtctctttggattagttcctattacttgatagatcatgtccagttttcaacaaaagaaattataacgtatgctaaaaaaaaaaaaaacacacattctgaagaggcaaaacaagcgtgagaaccaaattcaggttttggaattatcagatatggaatttaaaataaccacgattaatatactaagtaggctatgaataaaagtagataacatgcaagaccagatggctaatctaaacagagagaaactctaagaaagaatcaaaaggagttgctagaaatcaaaaacactgtaacaaatgaagaatgcctttgataggctcatcagtaagttggaaacagccaaggaaggaatcagtaaggttgaagacatggcaataaaaacttcccatgctgaaatacaaaggaaaaaaagactgaaaaaaaggaacagaatatccaagaactatgggacgatttcagagtataacatacatgttattggaataccaaaaggagaagagaaaaagaaggagaagaaatatttgaagtagtaatggatgagaattttccaaaattaatagcagataacaaactacagatctgggaagctccaagaacaccaagcaggataaataccagaactacacctaagcgtatcatgttcaaactacagaaagacaaagaaaagattttaaaaacagccagagaaaataaacactttacctatatagaaacaaaggtaagaattacatttctcatcagcaactgtgcaagagagtagtgtgaaatatttgtgtcaaaagtaaaaagaaaacacccacttagaataatttatccagcaaaaaaaaaaaaatccttcaaaagtgaaggaaaaataataaagactttctcagacaaacaaaactgagggaattttttcaccagtaaatcccaccttgtagggaaaaaaaaaaatgctttcaaaaaaagttct

SEQ ID NO: 50621 - DNA, 1058 bp, Homo sapiens
ttatggtatcttttggtaaacaacagttgttgatctctatgtaataaaatttattaattttttctttatacttagtggttttgtgctttgattaataaatccttttttttttctgagacaaagagtcttcccctgtcacccaggccgcagtgcagtggcctggttcactgcaacctccgcctcctgggttcaagcagttctcatgcctcagcctcccaagtagctgagattacagatatgcgccaccacggccagctaatttttgtatttttagtagaggtggggttttaccacgttggccaggctggtctcgaactcctgacttctggtgatctgccctccttggcctcccaaagtgctgggattacaggcatgagccaccgcgcctgggcctgatactgttctttattctaaaagctttatgttttttgcctttcacatttaagtctttaatccacctggaattgatttatgtatgtggtataaagtagggttccagttccttttttccctcatgtagatagccttctaacaccaaatattgaaaatgtctagactgttattgtgttgcaatatcaggtgttcatatatggatggatattctgtcatatatcaggtgttcatatatgaatgaatttttttttgattctctcttttgttcctttgtctttttggctattttagaatcaatatcatacagtctagctttatgatgttttagtatctggagaataattctttccaacttgtttttcttcaaaagtgttttgtctacttttgacactttgcctttccatgtaaatttgaaaatctatgaagttacacatgcacacatacctttatatgattttgattgggattccatcgagcatttaagtcaattgaggtcaattgacatatctatgagtcttcaaatcttcaaatgtgaacatggtacctttccattaatttaattatcctttaatgactttcagtacattttctgttttctatttcttctcaccttttgtgattctgaataatttgtttatttttaaactgctttattgaggtatata

SEQ ID NO: 50622 - DNA, 1166 bp, Homo sapiens
ctgcatcttccacactttgcccattcatctccttagtgaaatatcagtttgtcacttttaagttaaactttttgcccaacagtagaactcaattcagccaagtttctgccactttataacaaagattgcctttcctccagtgtctaataacatgttcatcatttccttctaaggccttgccagaagtacctttaacatttatacctctagcaacattttgttcatgattacgtgtatgtaatcatgaacacatatattctctaaggtaatagcagctttctctactgtctctttacttctttctgagcccttaccagaattgcctttaacatccgtatttctaccaacaatctcctcaatgtaatataggcttttaccatcaagcagctcaaaattcttccagcctctactcattacccaattctaaatccaattctacatttttaggtatttgttaaagcagcatcttacttcccagtaccagtggtactttgttatggcagacctaggaatctaatacagactttggtactgggaagtaggatgctgcttaaagtgaatggcttaaaacaacagaaagttattccctcacagttgtggaggctacaaaatcaaaatgttggcaaggttgggtccttctagtggctctgagggagaatttgttccatgcctctttcttagcttctggtgtttgctggcagttcttagattatctctctaatctctgcctctgccatcacatggcattctggttgttgactgtatctgtctctgtatcttcacatgtccttcttataaggacatcagtcattggactcagagcctaccctgtgacttcaccttaactaattatatctgcaaagaccctatttccaaataaggtcatattcttaggttctgggtagacatgaattttgggaggattctatttaacccagtacatttacttgttgccgcttgttcacctctcattcactttttttgcaaacgatctctttatagtgagatagatcatgacaaacagcacttaaaacatttttaatcagatcaagaaacagaacatgccgatactccaaaaatccccatatgtccctcacaaatcacaaccctcttcccactagatataactactgccctaacttgtgataatttccttatttttcttt

SEQ ID NO: 50623 - DNA, 1259 bp, Homo sapiens
agtttcttgtttgttgttgagttgtagaagttctatatatattctgtatattaattccttataagatatatgacttgcaaatattttctcctattccaagaattgccttttcactctgtcctttgatgcacaaagtgtttaatttcgatgaagtccaatttgttgatttttttcttttgttgtctatgcttttggtgtcatatccaagaaatcattgccaaatccattgttatgaaatgaaggcttttccttatgttatcttctgagagtgttatagctttagctctcatgtttaggtctttgaaccttttgagttaattttcgtatatggtattaaggtaaaaattcagctttattattttcatgttgatattcagttttcccagtgccagttgttgaaaaaagactgttctttccacactgaatgatcctggcaccctattcaaaaatcatttgactatatatacctgtctttatgccagtaccacactgttttaattactgtaaccttgtagtaagttttgaaatcaggaagtgtgagaactccaactttgttctttttcaaaattgttttggatatttggggattggttgagattccatatgaattttagaatggatttttctattcctgtaaaaaaatgttattgacgttttggtaggacttacattgaatctgtatatcactttggttagtattgatgtcttaacagtattgtcttctaagtcatgaacatgggatgtctatttatttgtgtcttgtttaattcctttcagcaacattttgtagttttcagtgtataagtcttttacctcacagaaaatgttttcaagtattgtttcaaatcttgtttatcagttgatcctttcatgggttgccttttatgtatgtgcatttatatgtatctaacaactctacctgttcatgaaaaagatattttcctatgttttcttctgatagttatatagttatacattttacatttagatctatgatccattttgactacttgatgtttatataaggtatgaagtttaggttaaagttcacttattttttttttttggcttcaaatgtcctgttgttttagaaccaactgttaaaagagtatcctttctccatttacttgcctttgcatttttgtcagaaatcaattggccgaatttgtgtgttaatacttaacctcataattaatggtgaaaagttgaaattcttccccaaagatcaaaaataagataaggatgtccactcttgccac

SEQ ID NO: 50624 - DNA, 1061 bp, Homo sapiens
atgctggcgtttctattgtaaaagctactagactcaatgtggctaaaacaatactgactttccctttcccaaatcatttattccatctggagctttgtctttccttcattggtaccattgttctctcagttacacagactgaaattttgggattatctttgacttccttgcctctgcctccaaaaggcctctctcatctaaccctttctttccattttcactattaccatttcagtctagaccttcatcaccttttacttcagtagtttcataactagttcttcttgtttcttccctttgaatctctatggcatattataaccacattcatctgtctaaaccatcacttgcactgtgtcacttaactgtttgataaattactacttcttattatccttcagtatatattactatccctttgtactctctttccctgttctccttttctgcatcacacacctttgaatgtcagcttaaaagtacctttctgaagtcttcctttaccacctttatctcccaattttctcttctgtgaatttctactaatttggcatatgcttctatgtgttattattctctcctccccccgctgccaaggcacatgcacacaacacataaacacacacttcttctccctaaatagattgtgggcttcttgaggatagggactatgtcttaaacacctttgacttccctcagtacctagcatagtgccttctgtgtaaacaggtatttagtaagtgttcatggactaaatggtaaagggcaatgaattgttggagaagtgtctttgaataaatggggtcagtaatggtagataatatagataaggaatatattttgagactcacagtctcttccgttttctgtatatattcttatgtctactccagggtaaacagctgtgtgaagagtgatgagcatgtcctggaggagctggaaacagaaggggagaggcagctgaaaagcctccttcagcatcaacttgatacttctgtctccattgaggagtaggtattgattttgcaaacggagagtatcatagactcttacctccaggt

SEQ ID NO: 50625 - DNA, 1003 bp, Homo sapiens
tctagtcttttttgctatgctgctaaaaatacttcttttgtattaaagagtactggaaactatataactttttgtattctatcttcacttaatattctttcatggtctttcccaaaaattttaaccattctttgaaaacatgagttttaatggtactataatgtttcatcagggttgactttaccatgatctatttaatcattttttgattggtagagatattgtttccaatctttagccaatataaaatagtccagtaatcaccacttatatttagatttgattatctcctctggataacggaaatagaatatactgactgagtcaaaaggtatgaatattttaaagcttttgatatgtatcataaaaatttacattttgaaaggttgggtcaatttatattactattggctatatatgaatgtaactattttttcccacacactcgataactgagtaagaccatttttaaaaaattgctgatttggttgacaactggtgctatttttaatttttttatgtgaattcattgtcttgtgaaatgtgtcttaatgttctttatactgtggtagtcagtttcttattgaattgtaggtatccaattcatgatagttacaaataattaaattgaaccaatatataaagataatgaacattgcaaatatgaattagcaacaaaaaaattagtatttagtaattctcagtccatttcttaccagaagaaattaaaagtcacttcctaatgtcaatttcttatgtttattttttatttaccacctcagaataatcataatctaaaagtcttatatgtatttttagctccaccagatctgcagaattctgaatgcccatatggactccctgcagtggattgatcggaattcaggtgggagtttgcttgtatgccactctgtgtatttattgcaagtagaaaacgtgatacatgtcagttgtatgctccatgaccaaactcatataaaagctgttgtatgggtgttgctta

SEQ ID NO: 50626 - DNA, 1063 bp, Homo sapiens
cacccaccaggaccttaagcacttacccttctccccattaggtatgtctcaacctgacagccccaatttggggtgttttcttccccctacttacctttctttctcttcaagtgtatttacttattcagattcttcatctcactaaccagtcttgcagagcagctttcaagcatctgtatctgtagatttacagccatttgggattactgtctgccctagatataatcagcaaattttaagagaaatttgatttttatagtttgggaaggtgatgatgtccatttccagcatggattgagatgtatagttgttgatcagggacaggataggaaaatttgatagtagaatattttaaaggctattttcattattttttaaatgtgagttcaaatttagtgtgtagttttttgtattatttttagaaccatacttcccttttactacacagatattgtaggattgactgtattaactggttaagaccaaagttgtaatttgcaaaatcagactgtgatagaactttcaaacccattcctttatttggtattaattgaaatattatttgaatatgccagagttaatttatgcctttaaaaatagcatgaaagataacaaaaataaaactgtacaaaaagttaaaataggccgggtgtggcggctcatgcctgtaatcctagcactttgggaggccgaggcaggtggatcacgaggtcaggagatcaagaccatcctggctaacacagtgaaaccccgtctgtactaaaaatacaaaaaattagccaggcgtggtggcacatgcctgtagtcccagctactcgggaggctgaggcaggagaatcacttgaacccaggtggtggaggttgcagtgagccaagattgtgccactgcactctagcctgggtgacagagcgagactccatctcaaaaaaaaaaaaaaaaagttaaaataatcataccattttaaaatgactcaggattcctttatgtttgggctgcttataggtaaaaacaattcgtacatgcatatatacatatcactccctctagagagaacagtttatc

SEQ ID NO: 50627 - DNA, 1029 bp, Homo sapiens
gaaatccagtttatgttcactgtctgggccagctgatagtgtgtccagaattggttccttctggtgggttcttggtctcgctgacttcaagaatgaagctgcggaccctcgcggtgagtattacagttcttaaagatggtgtgtccggagtttcctccttctggtgggttcgtggtcttgctgacttcagaagtgaagctgcagacctttgcagtgagtgttacagctcttaaaggcagtgtgtctggagttgttcattcctcctggtgggttcgtggtcttgctggcttcaggagtgaacctccgcggtgagtgttacagctcataaaggtggtgcgtccagagttgttcttactcccgatgggttcgtggtctcactggcttcaggagtgaagctgcagaccttcacggtgagtgttacagctcataaaggctgtgtggacccaaagagtgatcagcagcaagatttattgtgaagcgtgaaagaacaaagcttccacagcctggaaggggactcgagtgggttgctgctcctggctcgggtggccagcttttattcccttatttggccccacccacatcctgctgattgttccattttatagagtgctgatgggtccattttacagagtgctgattcgtccgtttttacagagtgctgattggtgcatttacaaacctttagctagacacagagcgctgattggtgtgtttttacagagtgctgattggtgtgtttacaaacctttagctagacacagagcactggttggtgtgtttacaaacctttagctagacagagtgctgattggtgcatttacaatcctttagctagacagaaaagttctccaggtccccacctgattagttagacacagacctgattagaagacactgattagttcttcaccagcagtgaggataaccccagcattatactttggaaagctttcacatagcactttacataaaattaaattagacaaggtaatatatgtgaagagtcctatacaaacttatttttaaaat

SEQ ID NO: 50628 - DNA, 1033 bp, Homo sapiens
ggaatttccaggatacagaggagagctccgggcacagggctccgtggcttcccacagctgggctcagcagtggagtagctgactagcagatttggccatcggtccactgagcacacttttgctttcttcctggcacttcccaccttgaaaaaaggatggaaattccctgcatctggatgggagtagcctaagctggtaaaccaagctgatggaattattaaaagcggatgacaagtgaaagtgaagacatgcagggagagaaacacacaacattccctgcaaatgcacaggcagagcccaacctgagaagatgctctgaggaacacagcacacacaaagggacacacatggagtcagtcacatgtggggccacagacacactgagctagtgcaaaaaaaaaaaaaaaaggctagccagaaaagtgactcagactttatttctaatccttctgaaggaaagagatgaagagaaacagggaagaattggcctcccatctccagggactggagagggagccaggaaccagctgtccagtatgaataataatatttccagccagactgtccctggcagattttcttggggtggtgtctcaggaggtgggatcccctccagggtctcctgagcctcacctagttcagtctttattaatattaataacacaggtcccaacaaattggtttgtatcagttattacaataaagctcatgggttaagaactaaaataaatgcctctcacgaatctgattggccctcctctgctgctttctgggctcactcaaagcacatgctcaggctccattcaagctgctttgtggtaaacaaaataaagaaggggtggtgaagcaggaaagagtattgagaggaactgtgtcactggacaaatgcacatctgagggctcctgggtgaccagtgaggcactgtctggtttaggatagcgattaggtgcatggctttcagaatctgcttcttactagtgatgtgatctcaggtagctcacttaacttctttaagccttacctgtgaaatga

SEQ ID NO: 50629 - DNA, 1065 bp, Homo sapiens
gccacctgggtccactccagcgacagacccctgacaagagcaggtctctggaggctgagttgcatggggcctagtaacaccaagccagtgagcctctaatgctactgcgccctgggggctcccagggcctgggcaacttagctgcaactggcaaaggagaagggtagtttgaggtgtgacaccagtttgctccagaaagtttaaggggtctgtttctcatctccatggacatcttcaacagcttcacctgacaacgactgttcctatgaagaagccacttgtgttttaagcagaggcaacctctctcttctcctctgtttcgtgaaggcaggggacacagatgggagagattgagccaagtcagccttctgttggttaatatggtataatgcatggctttgtgcacagcccagtgtgggattacagctttgggatgaccgcttacaaagttctgtttggttagtattggcatagtttttctatatagccataaatgcgtatatatacccatagggctagatctgtatcttagtgtagcgatgtatacatatacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttat

SEQ ID NO: 50630 - DNA, 1093 bp, Homo sapiens
ttacttaatcttccttgaatcttaatttcctcatctgtaatataagggtaataattccttcctcactagattattgtgaggtttaagtaaagcaacatgtaaagtgcctcctaataccctcctggcaaactcttaagtgcatggcaaaagttgttaccctcttccactcagtctactgccaagacatgtcagcataggtaggaactttaacctctgtcaccatttcaactgtaaaatgatgataataatactttgctaacttataagatagatatatggactaaatgagataaaatcttttaaactgctttttcaaactttaagctgcacgaattactattaacagtttatgaactgaggcttttctaaattctaaccctgaattattacatgtagtgtttgaggtaaacaactacttatctctgtaaaatgagaaagttgttccttaggctagcatttagatcccttcttctattgtaagtagaaccagaattatgatttacgatctggtattacaaggctttttttgtagaattttaacttacagtctccctatgcaaactgatgtttctttcctgattaaataactttccaatgttaccatttcttaatcatatgcacttcagactacctagcaagaaatcctaaccattacatagaattggtagtgattaattggtctctggtggtccctgatttcagacacttagcctgtgatgaggagagagtggaagaagcaaaactgctggtgtcccaaggagcaagtatttacattgagaataaagaagaaaagacacccctgcaagtggccaaaggtggcctgggtttaatactcaagagaatggtggaaggttaaacagcttggatttattcttactttgtatgttgtgttgttgtccccagtgtcctacaaactaatgtatttgtgcacaagacatcatctatgaatgatgaagttttctcaccttcaaagtcttataaacatgttgactcttgttcctgctgagttacttgttcgaagcttacagcttgttttccaggcatcgaataactgttgagattgttctactgttgtcgtatattcttctatatt

SEQ ID NO: 50631 - DNA, 2000 bp, Homo sapiens
gttacccacacacctacccagtaggggtaactactaggtaggtggggttcttcagttgagcctcctgagaaccaaagagcatcaggagtccagagcccaggagagcaggcctggaaacagttaacctagccccattgaggctttccaggccatgggtaagtaggagtgtgggagcagcatttgcaagattactcatgaggaggactgactgtcacggggccagtcccagggcatcttgctagaacagcttgttcagcagggtccctgtacagtgcctccctattctgggagacaagttgaacctacagcacagccagtgtcttgccaagctatttatcttttcttggctctaacccccacacaaatttgtctttttttttcctttttacatttttttttacatatttatttttgttcacactatagcataagctctcaggccctctgagaaagcaagactcttctgctttctggagaaggagtacaaggcccccttatatttacaactgagggcaagatagatgggggcacaagatggttcctgaacatcatttccttcaccctttgcaacagttttgttctcttggccattattccattcagttcaacaagtatttactggaccaccttgtatgtgttcagactgtagtaatgggccttggagaaagataaaagagagtgtaatataggtctcatgcttacaaaactttcatatgcaaccattctttgcactttaagagtttcgggcagcatgggctgccacagatttcatggacaggtcagagaaggcttcctgaagcgtttgacctcagaagccaatagacattccaccaagtcgcagcatgccttggtttgatgcagaaaaactcatattttaaataagtttgcattcagtttaacccacgagcctttcacattagaaatttaatgtagcatgaaggctgagctatttgatgcacagttatactaaatgcagaaaagagaacaggtaagtacgggaccaaagcctgctttgaattggatcctacacacacacacacacacacacacacacacacacacactcctcccaataaaaagacaatgaaaacaacccacattaaagaaacaaaaacatgactagccaaaaggaaacagaaatgaaaaaccctgggcccagaaagccaaggggtccttaaccagctttcagtactcatgggagtgcactgagtatgtatgtaaaaggaagaaaaaggtacaaatgggatttgagcaggtgagccaggtcacattaaagggacaacagatgttccacaacatttagtgccttttcttcattgcctcctttactttcataataagccaagatgttgtttgctaaatctatgctccaaaaagtacaattttaaacaacaacaaagtggcctcatttaagttttctgtgaaaaacattattcactttagtactgaactattctgtatcttgggggcccagacattttccctggacccagagggaagttctctcttactcactctgcttcttggagttcctgcttttccctagagaatccccaagtcatattcatggctacaaaccctcacctctgatgagcagggcaagagggcttggagaccatctcacagtcccctttggactatctctagggccaggcaagagccctacagtcccagtacaggagctgcagggtttcagtccgtgcctagatagaaatacttcttaccactgaaaaggatgttgtgctcattatgtctccaaaggggaaaagctcttgctcttccccctagtatcaacccccaagaatttgcataatcctccatttgtgggtcaaatcatcaagttcctagatgatagaaggcagcttgttttaatggaaaagtccccggaatgaaaaacacaagatatggctttctcattcatttttaacccatctagatgttggtttcctcatctgtaaaatcaacaaggttagatatttaatcatttctatactgttagc

SEQ ID NO: 50632 - DNA, 1034 bp, Homo sapiens
cctatctttaattagacttcaatatttgtttgcagttctttctttttatataaaatttacatacaatgaaacacctaactcttaagtgtatgtttgctgagttttgacaaatgcatacttgtatgtaatccaaacctctattcaggtatagaacattactatcacctcagaaagttccctcctgctcattccctgtcaatctctgccccaattcaccccaaaggcaaccacaatcctgatttttctcctttatgccagtcctagaacttcatgtaaagggaatgatataaactctagccttttgggtctggcttttcacttaacacagtgattttgagattaatccacattgtttcatatatcagtagtttgctacttcttattgtaggcatttattccactgtttgaatctatcagagtttatccttgtatcattggacaactggaacatttccaatttttgactattatgaataaagttgctatgaacattcttgtacagttctcgtggacatacatattttcatttttcttggaaaactgccttgctttttgaacttggtaaaaacttgcctctctagggcccacaaggagcacccggatttcctggagctgtaggacctgcaggaccaccaggattacaagtaagatcaatttaagcctagtttgtgatcacagtgttcacatggttgttttccctacatactatggattcaatgtaaacctgtgtaatttaggtcctcctgggtgagcaagggcaacctccattcttggagggttaaagtaaagcatgctcttgcgaggagctattggagttatttatcagagtctatctgaccatccaatctgtgcctctaaagcctcccaccctagctcaacctaaagtatagcccagggatggcagatccctgacacatttcttgccaccttccatttcctcacccatgacaggtattgctaattaatcataccaccatcactatcacccaccctgaatactgaagaagcttcaaattccttcctaacactgcatc

SEQ ID NO: 50633 - DNA, 1030 bp, Homo sapiens
ggaccaaggccatacatattccctagggcaaaacaattggcttagatagtgtattcattaaatttacagaacaacatccactgtacttgctgcatagcttctcttaggtacttgttttcctgcccacaaaggctcaatgtttgtccacatacacaggcatgatatacaaactgcttcaatttggggagagggcatttggtggctaagatatttgtgatcagcaaggtgatcacaggtggctagttattttcaaaacaatgttcagactatcatttatttctggaggccctttgaacccctcctttctcttcctcctgtctgagttccaacctttcttaccctctccgccccttatccaggcccatgtcaagttattcctgctccacaattggaaatggacccttgcatttcaccagaccatttttctcttgtgatttcactgtcttatgtttaacattgttgttatttgattcaaaaattttctaagttcccttatgattttttctttgacccatggaatatttagaagtgtgttgcttcgtgtccaaatatttagtaactttccagctatctttctattatggatttctagtttgattttattgtaattacagtgaacactgtgttatttcagttcttttaaatttgtcaaggtttattttatggtccagcatacagtctatcttggtgaatattccatatgcacttgaacagaatatgtattcagctgttgctgggtataatgatattaaaaatatccattaggtcaaggtaatggatattattgtttggatcttctatgtccttcctgactgatatttttgtctagtgtttctgttcattatggaaggagggatgttaagatgtccaactgtaattgcagatttgactgtttctacttgaagttctgttagtttttgcttcatgtaatttgaagctctgctattatgtgcataggcatctaagattgttatgtcttcttgataaattgacctattttatcattttgaaatgtccttctttatctctg

SEQ ID NO: 50634 - DNA, 1027 bp, Homo sapiens
gacaagtgttgctactgttggccgtggcaggcttcataggggactttatctctacagaattctgtattaactttttctgaaagattgccagcacccgattcaaaagcttttaaaatcctcataaaactagagaatgaaaaaaagcaataatggaggtggaaggtaagcagaacatgggacttcctgcccagttcaccatccggccaggcccctggtctggccaactccttttcacctctttttctcccccagatcgtaggatttagcctgttttgcttgcttttctgactgccacttcccccctcctcgatttcccatctagatacctttagggatggtttcctgatttatccctagctctgctttctctaagaaccagataatggactgttaatttgtttaaagtgttttcattgctacaaactctaaggaaacagttgggcagagtgagatataaccaaaagtagatgacggtgtgaaagttgggaaggtacagaggatgaagaaccctgacaaaacatgagtctttagtgagctgtgaacacatgagctgcctactctcctccctatacaggccatagactctggcctgggagttagcaccattatctccccagcagctgaaaccatctctctttgagttaaatgctagacaaggtcttcagcctgaggtagatgtggggtgaggttgctaacagtctagtggatttttcccacatgtgaatcctcaggttgctctctctgactccagatttgtcttgacagaacaggctcaagtactaaatgttgtacataatttatacctctaggtggttcaagcatctcactttgagcaagggcaaattttcttataaatcattgtttaccaggaattgctggctcccctctggctctctctccagtctggagcccaagatcagctatttccacattgttcttaccttcctcctattggacttatccctctccctcacctgcatcctcagccccagtacttctgatatatttgccagtgcccagacctgga

SEQ ID NO: 50635 - DNA, 1247 bp, Homo sapiens
atgaaagctcatattttatatcacctccttgggtggccaggcctttctccagctgcctgcacttaagttttgtgccttatttcatgacaaatatttgccctctcactcctcagacatttgtgggctggccctattgctgacactaatcactactaacttacttgttgccaaatccaatggatatttttcattccttatcttccttgatggccctgctatataagacaccttcttctctcctgaaactttctgttcccttgaatgttatgctatcctttcctagttcttttcctactgtgattgggatcccccagcattctgtcctcatcccacttttcttctcagtgtaggcctctcccagggtggttttatatactgcagggatttcagccaccatccataaaatgataaatattaaatctctagctctagttcagatctttcttcttagtttctgattggcattgtcaatttcttgctggatatctctgcttagatttcactggcaccataaacatgtctatacagaactccattaccaacccccaccagatgtactccttcctaaattctatctatgtcttccccatcacaacaaatggcatcaacaagcactgagctgctcaagccagaaaactgggagtcatgcttgtcttctctttcctttccctactacctccaatccatcattaagtcctgtccatttgtcttctgaaattgaacttgaatacatacacttctctccatacccatttctccaatctaggctcatataatttcttgccagaattacctcaataacctcaagactgatctctcagcctctaatctcactctcccccatcaatttgccactgtcctgccataatctttccaaaacacaaatatgtatcatgaaactcttgcttaaagtccttcaatggctcccccatggacttcacaataaaatccgaactctagaaaacctataaagtcctttattacctggccctggactacctctccaatattatctctcattattaggaaccctcctcacttcagaaaacaaaacaagacaaatattttcaaaaaacatatgagttcactgaactatttatagtcctcagagctactgtgttgtttaatgtgttgcaggttttatacttgccaccccttctacatatactagtcttccactagctctgccctttctctgttgacttgcttctatttttccatcctttaaaactgagcacagatttcac

SEQ ID NO: 50636 - DNA, 1001 bp, Homo sapiens
actgtttccttaggaagatttgggaaagtaatggataatcataaatactaacatgtattaagtgcttattaacctagcattaatgcttgcattatctcattgaatattcacaacaaaccaacaaggttacttactattattcatatccccatgtttacagttgaggaaactgaggttcagaagggtgagaaaacttgcccaagattacacagctaataaatactgaattggaatttactctcatgtctgttttgattcaaagcatatgcacttgctgcttcttggaaggtgtctgtctgctcctcgcttcacgagcaagaactcatctgattttaatttgttagaaactgaaaatacagtagaataaacagatgtttcctttctgatggagtgatgggttataatgtcctgttttacatgtcagcaatagttttgaggccaattgtggacatttgtagatctctcatcctaagtatttattgggcatctattatgtaccaacacatggtgggtgattcaaataagtgtaaggaataggaattaccaggagtgagtgtcttaccagagaaatgaggttacctgacaggaaccccctcagaatatatatacacatgtaaaataatatgccaattcatgtgacaactctaaatattgggtgagacactgaggtgttaatagaaaggacactggtctgagaaccagtgttgttttagaaacagttgtgtaatgttaacttttaatgctaattttaaaataaagtgggcctacctcagtcattctgggtttcttgactagaggcagagaagaaataatcaggaaagtcttcatggacgagctggactatgaagaatgggcaaaatttgaattggtgggaaagggagaggagactccaggtccaaggaggaacaaggaaggaaaagtaggagttagggtaaagagaagggaaatgagcccagagtgttaaatggttacaaaggtataaccaattctagggccagacc

SEQ ID NO: 50637 - DNA, 1062 bp, Homo sapiens
tcaaggttttggatctatttcacgagggcccactcatccttaggttctgcttagctcagagtggatttacaactccagaaactgtctccccttcccaatagcctagtgtactatcaatttgaatcagtgttgtatgcatttgggcatgtgtgcaagggcactttcgggcccatctgtcttatgtgggaatagtatgcctatgtctctttatgtgtaacctaacagtaaagttgaaagtatatgatgcacagttgcttaggtcttagcgtataggtctctaaggggctgtgtgtgaagctgtggagatacttagggctgttgtgtggaaaggtgcctgaaagtgagaaagactaccggctgcccaaggtaggggggatgattgacagcagacagccccgcccctttcccctccattctttcctctcctgctgcatggaactatctcctgagtgctgcaagttgtaacgggcaccgctgagcctgtttccctttggagcacttcttatctagaagcagtgtttagtttcttccaaactgggccacttcgtccacctactctgttctgagtaaggaaacagcctccaagcatcagcagagcccagatgagcacgggccgcggagccgcttagcagtctcccgggacccagctccggaggagccgcaagcatgcaccctgggtgagctgttgctgccccgagctcccctcctctttcttacttcgggttactttgccaggccgggactatactggtacttctgtcactgcagagaaattgggagcaggcatccaaaagggttcggggggcgacaggcagacgcacgaccccgaagcctagagagcccattactcaccctccctcccatttcaggttgtggctgctcctggttacgttgtgcctgaccgaggaactggcagcagcggtgagtctcttctcacgacccttttccgtccccctcctttgaccctctaaccatccccatctctagtatttatgttagggggttgcagagagtttcaccacgagacggagtccacaccactcccctttctaatgggagtta

SEQ ID NO: 50638 - DNA, 1033 bp, Homo sapiens
aaggaaaaataaaataaatgttttgaaaacaaagcagacaagaggcacaacctggaaaatgtgagcatgagaatttgtatgggtaagtcagatcatggtccttaatttataaaatgtgtaaaagagaaattatgtaaaattaatgcacagaatgagatggaactgtattctgctttagaaaacccaattcatcccccgccaaccccgcaagatatgcatgttaatggacgctggttttcaggcagctaccttaagtcccagtttgctgcttaaatgtacttcagagataagaaatgcaactgagctatacaaaatgagacaacttccctcctgtctcttgtgcatgataaatgctaaagcaattaggaaccactgttgcatgctacattggaatttctcagcaacatcagtgccattctatgtaaatggggaaagcttatttagaataaagtcctgagaatttaggaagagaccattgattttacttaatattaaatatttgggtccatagaactgaactagaagcaataccctccttcacttttcaatctcagaatatccattataggatcttctatttcactggcaaaaatctgaattagcatttcaataacaaaaggagcaaggaaatattgaattggaaaacagattcttaaatatctacagaaaaaaaaatgtgaagtttgcaattcattctgtatttccatacttgtaatccccaagaacgttttcaacatttttggattttctgcattattttcaaggaattaaaagtatgtaggccatttaaaatatatccatgctcagacttttgttatagttgttttaactttctcacaagaagctagggactatctttctaaccttgtttttcattctgttttccccctctttatattaaggttatgctcattccaggaacacaggagatattggtggtggtgcttagtgcttagaattatagctaaatatattactttaattacagtagataaaactcatgtgtgatatagatacttgaaaaaaacttttt

SEQ ID NO: 50639 - DNA, 1050 bp, Homo sapiens
aggcatgagccaccgtgcccggcctaaatgactcccttttcattttcttatttttaaccactaggaaggcaactgtgagtacatggaaaatatactcatcacagacaagaaagtatgcttgcactgatggaatataggatagatgggttgaatatcaataatttgttagcaaattataatgcctgccttattggaaaccaaaagtttaaaagaactctagaaaaataattggcccctactcctgattctttctttaccaaatcacccttgccacgcagaagggcggtaagagtaagacttagagaccagtgcctgtccaaagaaggcatctgtgggatcacatgggccacaggataggaaagcaagtcacgaatggtgtgcaaaaatctacaaggtacatggattgtctatatacagacaattaagttgattgtacagcttcacttcacttgatgcacctaggggggattttgtaaaacaatatctacatcacaataggaaggtgtaattagactgcctttatattagaaactgttagaaactgtctacagcagagaccattttaggatcagtatatatttacatacctatatatacatatgtatatatacataaactttaatcctcacttcaagggggcaatctatatttgccagggcatagtccaaatatactttattcatccaaacagcccctcaaagacaaataggtacacctgtgcttctcagtccatctgattttgtatacccctttgggggtttacatcttaatgggacttgaattcctgaaacagtaaccatagtctgttgctgcttagacaaatcatcagaactcactggcaggaaggatcacattcaagagtgcataagcagaacttcagcttccccactctcctagactcatacatgctaaccaaatgtttgctgtagaatgtgaagtagtactgtttctttataacataaaacctgttcataagacttgtcaggtaaaagatgcgtaagtgcacagtagttaaacacctcccatgactacttggaagaatattaccag

SEQ ID NO: 50640 - DNA, 15556 bp, Homo sapiens
agagcggtttcagtgccggccagcttttttcgccgcttagcacccagcccagcacgtccccggcaccctgcagaagccccgaacaatggagctcgcctgtcttctgaagtgtctggttctggctctggcaactttggggaggaaggcaatccccagggcaaagaagatcaggaaggaagcggaggtgactacatgcctatgaacaattggggctcaggaaatggccggggctcaggaggtggccagggctcaaatggccaaggctccagtagccatagctcgggaggaaaccagtgttcaggcgagggacagggatcccgaggtggtcagggctcaaatggccagggctcaggaggaaaccagtgctctagagatggccagggcaccgcaggtgggcacggttcaggtggtggccagagacctggaggtgggcatggctcaggtggtggccagggacctggagatggccatggctcaggtggtggcaagaactctggggggggcaaaggctcaggaagtgggaaaggatccgatggtgatggtgaacgtggaaaatctctgaagaaaagatcctattttggcaaattaactcaaagcaagcaacagcaaatgccaccacctccaccacctcctcctccacccccaccagctggaggaactggtggaaaagggaagtctgggggaagattcagactttatttttgtgttgacagaggagccacgaaagaatgcaaagaagccaaagaagtgaaagatgcagagatcccagaaggtgcagctcgaggtccccacagagccagagcttttgatgaagatgaggatgacccatacgtgccaatgaggccaggggtggccacccctcttgtaagctccagtgattatatgccaatggctcctcaaaatgtctctgcttcaaaaaagcgccactctcgatccccttttgaagattcaagagggtacatgatgatgtttcccagagtgagcccaccacctgctccgagtcctccaaaagcacctgatactaataaagaggatgactcaaaggacaatgacagtgagagtgactacatgtttatggctcctggagccggtgcaattccaaaaaaccccagaaatcctcagggtggctcttcctccaaaagttggagctcctacttctctctaccaaacccttttcggagctcacctttgggacagaatgacaacagtgagtatgtgccaatgttacctggaaagttcctggggaggggcctagacaaagaagtctcctataactgggaccccaaagatgcagcttcaaagccttcaggtgagggatcattctcaaagcctggagatgggggatcaccttcaaagccttcagatcatgagcccccaaagaataaagctaagagacctaaccgactttcttttattacaaaaggatataaaatcaagccaaaaccacaaaagcccacacatgagcagagagaagctgacagctctagtgactacgtcaacatggacttcactaaaagagagagcaatacaccagctccctctactcaaggactaccagattcgtggggcataattgctgaacccagacagtcagccttttctaattatgtgaatgttgagtttggagtgccatttccaaatccagcaaacgacctctcagatcttttaagagctataccacgtgccaaccccttatctctggacagtgctaggtggccacttcctccccttcccctcagtgctacaggtagcaatgctattgaggaagagggtgactacattgaagtaattttcaactcagcaatgacaccagccatggctcttgctgacagtgccattcgctatgatgctgaaacaggtcgaatctatgtggtcgacccattttctgagtgctgtatggatatttctctctcccccagccgatgttctgaaccaccacctgtagctaggctgctgcaggaagaagagcaggagagaagacgcccacaaagccgttctcaaagtttctttgcagcagccagagccgctgtctctgcttttccaacagacagcctcgagagagacctttccccatcctcagccccggctgtcgcttcggctgcagagccgactttagccctcagccaagttgtagctgcggcctccgcgctcgccgcagccccgggcatcggcgcagcagccgcagctgctggatttgactccgcctctgcccgctggtttcaacctgttgctaatgctgctgatgccgaagcagtaaggggagcccaagacgttgccggtggctcgaaccctggagcccacaacccatctgcaaaccttgccagaggtgataaccaggctggcggggctgccgctgcagctgccgctccggaaccaccacctcgcagtcgccgggtgccaagacccccggagagagaagattctgacaacgacgacgacactcacgtgagaatggattttgccagacgtgataatcagttcgactctcccaaaagaggtcggtaattttagaattaatttccctaaagtgaatggtcattgtctaatgattcgatgcgctacagtctacagtgttagggatactatttcattaactggtgctattcgacatggagtatagaattcagttttaattattcacaaatgcctttttgatctttgcaaaaatttgtttttatctaatcaatttctttatctggacagaactgattatcatttaaacactggttctacttttttaggagtagttaaaacgcagacataaaaagcataaggatacttttaaacatccttccccatcatttaatgataatgtaaagcaggatatcgtaaattgggttccaccaactaattttcaaatcaacaattaaaagctgcttttctgcaaatgcccatatttaagtgtaggaatttaataagagcacagactattaagcagtaataatcaactatttatgtttagggaggataattttctcctctgaaagttactttttaaagagcagtcgttgttgtgctagtttgctgtgatttaccaagaaagttaaatctcaattgttaacgtgaatgtctggggggaacaaaacataaataatccaaaacaggaggtgattaaaagaagacagtatttggctctggaatgtgtttgtgtgttgattttctttttgtttttacacaggataaattccagaaaccttgagtgttccttttctctgtcactagtaatgacaggcaagtcacatttgctgtgcctcattttcttcttttaaccccccacccttctaaaagagggtgtggtgacaacttgagaatggatatgaatattatttcaaaggtttaaaaagcagttaaaacatttaattcatatatcttatgggaaatcaaggaaagcaagataaggctggaggaagacctgactccaggggcagcttaccctggaatggtggaagtttttaaagggctacttttccaaaggaagaagtaaggaagagtaggagctgtcagacttggaaacaagacttagagtaattctactgtgtacaacattgtggaatgttgtcatcagtgtgtcttgaaacattttcaagagatgattgcagaggatgatgtctccatagtctcaactaccttgcctcttaagtagaatatgcttctttcccagtgaagggaagggatggaccccagcagttttcattccagtagtcagtttagtgaagatttttgctttgcttgctttgtggaatgcttttgtgattggatctctgcccactgtgcttgatcaggcagaacaagtcgggcactgatcacaacagtcacctaacaagctccctatttaatgcaggtgtagcccccccacatcccctttttctccctgctatagaaaacttgccatacacaaactcacatttgcagcgtggacacattaaagagtgatcattaaaacaacaaaaggatgctttggcttgccaaaggattcaattcagacctcttttaaactgtgagttccctccccaacacacacacatacacacacacacaaacacacatgatcaccactgctaccataatcatacgtttaaaatatataatttcatttccaagtctttaatccataataagattttcaagagtagatctactttattctgtagaatatacctgaaaattgatctcaatctattgtttgagtctaactattgaagacaccatttataattttgatgtagatgatacacagttgcctgtgtccctgtagtactttcaaaaggaccagttttcatagaggtttattttaagaagtttaagatttaaatagtgaaatcttactgttccttgaataaattctgacttcccaaggaatacctagacacaatgatcattattttagcataaattcctgatttatgactttgtagctattttggagatttaacattctgtaaatgcattgtttattgaggaaattcctagctttattgagtgactttagcaaggaagctctatctcacagggaggcaggcgcttaggttgaaataagagaatcaacgtggaagcactttggaatgttaaagcactttacaaatgtaagatatttttagtgtcattggattaatactgaagtgaaatttcggcagtttaaactgattcagtttcttgcaaaataattgatcttgagggtgattcctgcacataatttgctgaaatacatgaaaggaatggtggggattgccggcgggggggtgcgggggtgggggtggtggtggtggtggtggtggtgttgatggtggtgaaacaacccattgtaggaaatgactttggttagcattttaatgtaaattgtatggtagaatgttgtctgtgaagtgttaagaacaagctgaatgattctgatccttttttattgtaaagctgtagaataattttcactcatttctgatctctattttcctatctaacattaaaacaaaaacaatcacgttaggaaacaaaaacataatgctttgacagaggaacaaataccatctttattagaagttatgtatttcaaaaagtcattttaattgatggcaggtgcttagaacagtgcctggcatatagtaagtactatacatgaattattttacagttattgccattgttattgttgctactgttattattacatttagaaaaacaaacctaaattaagattctccatctgaaaatctcacttttcagttagtctttacttgcatttaaaatactttacattattgttcagttggcatgtttatagattaccatttaagtgaagtgagattataaatctgtgagacagctgttctcatgtaacacaaaattaatatgtaattccatttacctacagtcacattgcgtataagtaagtacagtaaaggaatttactcaagtcgattagaaagaaacacccagaagtataaccttagacatgactgtattaataaatgaaataatttttaatcatttattaaagatgaagtcttcacattttaaacacataggttataggcattagcatttaggagaagaatgttgtttcttatgcagtttagtttgactgttaacctatgtatgactatttgcttctttttctaccttacctgatgtacaattcatagttcaaaatgacttgaggtgaacattttcctggtttttttattcaagagatgggaggatataaaagggcagctctaggaggggtgagagaatcggtcagccaaattagtaatgttatgatggcacttggtattaaaaagcaaaaaaaaaaaactttagtaattaatttttcagtgttagacactgttatcaccatgaaggaatcatgcttcttttgagtgtactactgccaaacttgttgctatcagttataggcactaagagcacattgtttttattccattgaagttaattattataaaaatttccatatagcagaaatttcccagctaccattgacggatcatttattttaggtaatattcaacacctcaaaattggacagtgtttggactaatgaggtatttgtcctctaacaattaaagaggacttcacttaattaaagttaactaaagttgttcacaatcattattcatttgcattcattctattttaagagtgatgttttcagggtaaaaatttcaactactagcaaaatacttaccttaaacaaggaccagaactttaattaagcacaccagaatgtcacacatgtataaaaattcgaacgagatctcttactttctttttctctccctaatcccctgttttgggaacaaacttaggcttctcagagtgacaaaaaaataattcctgtgggaatagatgtggctgacgagtgtagggagaactaaggaatagtttatgtgatttaaaagggtctattgttaaattgtcaaattgttgattgaggaaatgctttccagttgcagattgccttatagtttgcaaagcacattcacattcattattttactgatggatggtaagtactggaaatgaagcccatgttgagaattttcccaagatcaaaaaggtaagtggcagagctgaaaatctaactcatacatctgatttcaagtccagcactccacccaacacatgacacctccctttaatcaggtgtttagtctgttattttcccactggtgacagattattacatggttaatgattaggaaaaaattacaagtttgctttcacttgatagtagcaaattttgttgtaagtaattcattcagagcattataactgtggactatcttccaggacctgggtaattttattacattgaactgtttgccctggctcttagaataaaagaatttgacttgtgctggaattgaatgttttaaatctgatatagggaggagttggttaatcttcactgcccaaacacaaatagtgtatgtatctatttagatcccacagaaacattgaaaggaaagaaagtgaattgagggtgcattcagtaaatttccattaatggtcatttctttaactgaagttagatttctttgattttcctaataattcattgacatttgggagttatagcaaaaagtcttttcatttaatttcttccttcattataaaatttggtattctgatctaaatcagcacagtaggcaaaacaggataaagtaagacaggtggaagaataagcagtgtagcaatagacgttcttcatttgtttaaaaagtgaacttgcttttggcagtcaggcaagtagattttagaagccttgaaaatcaaactctctccttgggacatagaaatccctgtttacaattaagttcattttgatttagcaccttttttaaggctttaagagtatataaaaatagcccagacgttttattggcagtattggaaaatagcttttgtaaaatgcttaattaaaactttcagtatattttctctaagaggtgctgccagactcttagatagtgaggatcatttactagaaaacgttgcttggtcttgaatgagaaatgagaaatttaagacactgctttttataataatgaaataaatacatcacaaagcactgagtttttgccacaatcattggattgctgattttaaagctattgataaaattgccaagaaaaatgtgcttgccatatgaacttaaaatatattctccagcaattctgcattgattattggtaatgtagctacaggtctcacatttccaccttattttggaaaaatagactcaacacttgagaaataggaatgtttaaagatgtttctagtgtaaattatatactgttttagatatgcatttttagagggtacctttcaacttctggctgaataattaatttcttttagaatggaaaacatgtacttaaatacttattaagtgaaatgagaaagttactgctattttctcttagcttcctgatacctctttcttattggttagggttgcattggttgtgttctgtgagtcttaccctcatgtgccctttgccaaacttgtgcccttgaattcaggcaaacatgccctttcctggtctctctctggctgaaaaggtgagggccactgtgggagtcctgcagggcccatagagggcttcgccagatgttgatcactcccagtacacagccttcttgcacttagcttgcagaggcaaccttccttgtagggatccttgttgtacagatccaaggctgtgctgcctgccctactgtcacttggcacagaagcagctgggccggtgtttaaagctattttcatggttggattgatcacaatatgtttgatgccagccacaccttctggatttaccgaatatctaattccctatatattgtagtcactttagctagttttgacaatttatataatttttctcctatgattaataatttcctacttatagacttgaaacttagaataacagtgaagtttccatctcacaattaatcttgaaaattgctcacatgtgtatccatggggcccttgaaagtctgaccagcaaatgtgattttttactcttgctttttaaagttttatgcctccagtcttgaaagcttaccaaccttgtcctcgcactcagagtcctgtgcccccacccacctccatgatgaagtccttattgttgctgcagcttttaccatagtttcccttcggctgtcaccctgcctccgactcttccaactggttgagtatgggggacacaattcctattgccatggctggaagacatatattcctggagtctcaaactgaaacttcacatacatcttccctcagaaatgatgactgggtatagtcaaaatagttctctgttagttcaggagttgcataggttaaatataggcatatctagacaaagctataaacctatccaccattaatttatgacattgtttctacaagataatttattctgagtttcaactaaacaatgaccttggaatatgtctgttttgtaaatttgaaactgcctatattagaattctagtaacttgcattctttaagttggcagtaactaggcagcagagtgaagtggcccatgtgtgtgttgggaagtagtggagaagctgacctaccatgaaaatcctgtagctgatctccatagagtttgtatccagatactcaagactggaatgcacatgcataagtggcccagggcctgctaacaaagggcaggtgtaaaacgattgagctgacctttgaggagatgggggtttacaagtgtcatacatttcccttacagattcttttgagcattctgtcccaaaactattgccattgtgggaacaaaggtattttatcatccgatctatgaaggagataatagtctggtataattggtgttgtaaagactagcagcgattattactagtttttagccttgagcaatagcacttaattttatcaagtcctagagagtcatcctcctctacaatcacagggcacagaaaagtatgatgatcctttcttattgagaaaaaacaaaaaaacctacatatactccagagacaatgctaagctaactaatataattgcattattatacattcatctttggcatgtatgcttcaacatatctttctttgcttccctttttttttttttttttggtgctttacttggttgcccctgcttatgtgagctccagttgatcacaggggtgcagggatagcatgttgtcaaatgaacagagtgaggaatttgcaaaaacccttgaaaaacatttttgagctccaggaaaattggagctgaaaagataactaagacaataagtttgcagaaagggaaaagagaatgagagaataacaatatattgttataggttcacctttctctgagcagaggaaatactgctgtttcggacttcaaaatgtaatagaggcatatttatgattcatataaagaggtctgaaataccctggaggaactgcctacttggctcaccctacaaatttccagggatattgaagtcatctgtgcattattagcgtattaaagattaatgttcaggtttatatcattatataactcgaaacagaaaagtttacttcatttgtttttgagaaaaaaaagttccctgccagattttggtaggaggagtagggaaatattttgactcatcagagtccactgaggttttctatattacagagaaaaattacctgaagagtataccacccattaaaaagggtgaaattaacttgttgtttaaaagacctttgattaattgggaaaataagaatatacaataaggtaagtatttataacctgtcagtatcaaatgggaataatacatccaaaacagaccacattattacaagcatcaccatttaccttgctgatggtgaaatcacataaaaatgaacgggagacaaatctaaggtatgacttttagccctttaatattcattttgcagactgttcacaaccaagttttaatctcgaattgctttcctttgccacccagcaagcttctgagttgcttccttacgctgttctttggaatgtgccccgggaatgtaaactcattttaatattggcctaagtaaaataggattataaaggcaaatctgtggctcaagttcccataatgcatttcaaaagcaagttaaattattttgggattatcctgtttgggataacattattcctttctactagcatagttaatcaagaattgacaaatgtattttgtgaagtaaacatgaaattacacaattatttgtcactttttattaagttaccaaacattcacttaatgctggtgtaggtgttataggaaagcaatggcaatatgaatcaaattttagtagaggctctgtcatttaaaaaaaggaaagagaaagaaaaacaactccaataaaagcaaatgttcctaatcttagtataatgccaatagggtagttatatggagcttaatttgcaggtttctgggaaaatatatatgaaatccagtgtatcatataagacagcaagaagtcccttttaaagcacatgcaatgtgctatatatggacatatgaaaatatttttggtattaaaacaaaatagtaaactaaactaggtgaaataccttcctaaccttaaatatctattttaaaatgtagctgatatctgataacactgtaatactggtactggtctagcctaattttgcagcgaattaacagttactaatatgcagtctcacagttaactgtggttatcacagactcctttcttcctgtgtagaactagatacataaaatgtaaaatttcctaaacccactgctgacaggaaagcttaatacctttactaatctatggcatttttttgagacagggtctcactctgtcacccaggctagagtgtagttgcgcgacagggtttcaccatgttgcccaggctgttcttgaaatcctggcctcaagggatccacctgccttggcctcccaaagtgctgggattataggcatgagccaccatggctagcatttttttaaacttctaatctacaagaacaaacctatacattgaatcttaatgaagagacacaactagtaagagggaaatgtactgttcccactcagtgcttcatccagctgcaaatttgttacattttaaaaatccttgagcccaggagtctgggtggggctgcagtgagccataatgatgccactgctcttcaccctgggcagcatagtgagacctcatctctttaaaaaaattgtaaaacctttgatgagaaaatgaatacttaaaatgtatatttccagtttaatagacaatcttgtacttgaagcccactctgggggatgttttccatggattcttttaagatgtctcaaataaaatagaatacttggtactttgtggtgacctgatcttaaggtaacactggcatcccataatcaatttgctgatcatttattcctatcccttctctggtccagcaccttcttctatgtatctgatcaccccctgccacactccccattatgcacccactcaaaagcagaaagccaagagaataatgctggaacttttttcttttattaaacagatgggaatttcaagtctcctttgcaggtatgactttgttctattagaagaaattcaatgattgagtctagagaccatcaccaatgctgtacttaaatcctatgacttgtgccacataacctggtgaaggcagagtcaaacatgtagaagaagaagaaaaaaatctgtttctctgcacaatgcctggctcactcttgggctccactggaagaaagtagaacagtgcacgcacgtgcaaagatgctgtccaccagaaatgtcagtgacagcctgggggcaagaagaataactgcccttgtgtctttgcccagctgatattcctcacaggcagccagcagagttgattaaccatgtccatgcccaggcagtctcctctgtatatctctcaaaaacttctagttagattttgttttgttttgtgttgttttgttttaaaacagggtgggggtgacagctctccacattaattctgcaagtaacttttgttttattatctttttcctagagtgattatattgccacaaaaacacattttagaagaaaagtgatgcttatggaattttatcttcgtctactccagatctgcctaaaggaaagaaaactcagaggcttctgagtagaaagcaacccaaatttctacaagcctacaagtggactctggcaattgaatgatcctattcatgcagatcattcatactgctgcttatggatccagtgatttctaattaacaatatttacactgtgctttgttttttgttttctggttttcctccccagtctgtccctttgaaaggaaacagatactatacaagtgagcatctcataactctttccctctttaaaaaaaagtaacttagaatacatataaatttggtcaatgccaattttaataatgtaaaatatttagattcaattttgaagttgaaaaactttaaaccagggcacataaagaaaaaacagctgtcataattggaaggaaggtatgatctggaatcttttttccgagtattacacacacaaaacatttcttgatcaatgaattaaatgtcaactgaactgatatcttgatggggcattaccagtattttaaaggcaggactaaagggcagattatttcaagttttgctcattagcaaaactgcaacattctgctcatgttatatgtcaatgaaactaatatcttgattgagcatttccaacattttaaaggcagaactgagaaacagctatttgttcacatacaacactgtgatgttctgcctgaaaatcgattgagtatttccaaacctattatttttcatttattgtgaaacctacatttacctcctaaaagaaacaaagctcttcaaaagtctcttcccaaggcccctccctgcttctctgggcctctccccactttcaacctctattctactttttcttattctttctccattttccccaatgcacactcttcctcttatgcccatggctactataaagagatcaatttcccatattcaagaaattagtgtttacttatcaatcaatattctgacaaaaacttaagccaaaaagaacctcttataaggccttgtttccttctggatattgagccaatataagatgtaccaaattaaaaaaaaaaatcagagcaagctcccccccgttctatttttgcttgcctctgatgtaaactgaattaagattttaggtacctggacctttgagaacgtgacactagcaaggtggtgaccacagagaataggtacaaaggtcttgaagcttgcttagagctttgttccgtggtggcacacaaatcttggcttgctgtaccatcattggcaaacctcatcatatcacagttgggtgtgtttgtatgtgtgtgagcactagtgtgtgtgtgtacatattcgtgtgtatgcacactttgtgtacctgtgtacatgtgattgtagatgtacctgttgtgtgtaaactctgttaaaatgaaatttgcttcgcatttaatgtgcaactttgaagtagtgtaatatttatctaaaggttttcactacttggttttaatgtctttgaacgtgtacttctatcttcaagcaagcttatagtacgtgttgctaaactaacttttccaaagaaccgagttgacttctatttttccttgcctaccaaccaaagggatggtgggctcttttttccctcttgtaaattgtgctgaggagaggacgtggctatgagatcagtcattgttccagttactggtcactgctagggcatcaactttatcagttccttcagactcttctctttttccaacctaatcaaataacgcagtgtggcttttgttcattataacaacgcgctctttaggcaactttttttcaagccttctgtcaccattttattttttcaagtaagttaagtaataattgttcagaattgtgggaaaaaagattacttgggggaaaatactgtatcactttatttgcatattaggttcagaagctgccagcagacagggtacagagggtacagcacagatgtaacagttgctgaataaatgaatgagaaacctcatacacagtagtacgtattatacaaatagtaacaggtacacatagtcacaggtactgcataacaaatgcaatcttgttctcattatttattagtttacagacaattaatttattcagtattgtgctggaagaatctttgtggaatatgtttaccaacttatcacttaccttccagctatcagttcatgctgctaagaaaaaacaatgatggaatatttttgtgtgtgtgacctctacatttaatttgatatcaggcatagtcacttggtcgttaaaaactgaaactttacagttccaccagctaattacatctgctatttctgcttcacagatatgctttgagttgctttggctttgtcttcctttgtaaatactcttgtactttcttttccttgtaaacatctcgtttgcagttttgggagacgactttgcaactctgtatagtgtttatatatatatgtatatctatatatatctgacttgcctttccatacagctactcacaataaatgtgttcatgtaaattattcctgtagagattcattttttaatactattgtctctactttattataaatatattttcctgctttgtagtaggattgactgcatttttcagaatgaaacaaatggggtattttagggtttgggctaaaggtactttgcctagaaacatgaggcttttcaatagagtcaataaagtcaactcttgatttttcaaatgtagaggtgatactagtgtagaacaatttataaaatgacttacctaaaatttcatgcagaccttggataatgagtgaatcctatattgaagcaactactcaaggaggttgaggtgatcatttactttttttttttctgtctccttcccttgacacttaatcttgctctttaaattactctttttttttttttttgttttttttgagacggagtttcactcttgttgccta

SEQ ID NO: 50641 - DNA, 1028 bp, Homo sapiens
ctccattgcgccggtagcaggatccgcagcggccgccgcgtgaggctgtggtcacgtgttgttttgcccgctgtcgtgcgctcagagtggagtgggcgggggcgcgggccaaggcaggagggggctggggcgggcagacgagggtagacagcctcttcccccaaccctccctttcctgaattccccctcctcctcgctcaccttaaaaccatcgtgcatcaccatggcgagttgctccttcactcgcgaccaagcgacaagaagactaagaggtgcagcagcggcggcagcggcagctctagcagcagtggtgaccaccccgcttctttcctcgggaaccccgaccgcactcattgggaccgggtcgtcttgtccgggagccatgtggctctccacggccactggctcccggtcagactccgagtccgaagaggaggacctgcccgtcggggaggaagtctgcaaacgcggctacctgcggaaacagaagcatgggcacaggcgctacttcgtgctcaaactcgagactgctgacgccccagctcggctggaatactacgaaaatgccaggaagttccggcacagtgtccgcgccgcggcggctgcagcagcggcggccgcctctggcgccgcgatccccccgctcattccaccgcggcgcgtgatcaccctataccagtgcttttccgtgagccagcgagcagatgcaaggtaccgacacctcattgctcttttcacccaagacgaatacttcgcgatggtggccgagaacgagtcggagcaggaaagctggtacttgctgctcagccgcctcatcctcgagagcaagcgccgccgctgcggcacgctcggcgcgcagccggacggagagccggccgcgctggcggcggcagcggcggcggagccacccttctataaagatgtgtggcaggtaatagtcaaacccagggggctggggcacagaaaagagctgagcggcgtgttccggctgtgtctaaccgacgaggaggtcgtgtttgtgaggctga

SEQ ID NO: 50642 - DNA, 1022 bp, Homo sapiens
tttcatatatggcttttattatgttgaagtaagtttcttctattcctagtttgttgagtgttttttttttattataaaagtgtattgacttttgtcaaatactttatctgaatcaattcagataatcatgtagtttttcctttagtctgttaatgtggtgtattacattgatttttgtatgttgaagcatccttgcattccagaaataaatcccacttgctcattaggtataatccttttactgtgctgttgggtttggtttgctagtatttttgttgaagatttttgcctaaatattcatcagggatgttgatctgtagtttttgtttccttttgtatctttgattttgatatcagggtaatgctggcctcatagaatgagtttggaagtgttccctcttcttcagtttttgggaagaatttgagaagaattgatgtgtattgttcgctaaaggtttggtagaatttaccagtgaattcttctctgagcaattttgttgtttttgttggaaagtttttggttatgattcaatgttcttattagctatagatctgttcaggttttttattttttaattattcagtcttgataggctgtatatttctagaaatttatcaatttcttccaggttacccaattttgtggtgtataatagttcatcataatctcttacgaccctttttcatttctgtgacatcggctgtaatgtccttctttcatttctggtttttgttatttgagtcttttcagttttttattagtctggagaatagcttattgattttattaatctctttaaaaaaactcttattttttattcttttctattgggtttctcttctctctttgttttatttctgctctaatttttataattttcttctgctaactttatgtttagtttgttctttgttttctagtgtcttaaggtataaagttaggttgttgatttgagatttttcttctgttttgtgtaggtgtttactgctataaactttcctcttggtactgcttttactgt

SEQ ID NO: 50643 - DNA, 1026 bp, Homo sapiens
tcttttgtttgttcatttgtttttttccccataattccccccaccctgtgtgtctgtttctgagactacttttatatggctgttggacttccagctttcatcctctaattttattatcctttttaaaattttctatttctctttttgttttatattctggcagagtctctcaactttatcatctcttctgtctactgaatttccaatttccactatcagaattttaattttcaagagcttgttcctgtcctctcagtgttccttttaatagcaccctgttgctctttcatggatgcagtcaatgcattgtctcttattcctctgaggatattaaaaggaatcctttttatgtagttttcttctcctgttattgtctcttttacctccaagttgcactttatgcttgccttggtcattgagtcccaagtgtctgctgatccttgtatgtccatattcaggaaccaggtactaaaaaactgtttggaaagcttactgggcttcactgaaaaggcattccaacgttagtgtctttttctcttaagtcattctgtttctccaaaggagatttctccagtcttttgcccgggcaatattagcctgactgccagaattctggtagccaaaagaggtaaaggagttattgagggggatgggagagcagtgggtctcaccctcactgaatccttctcttttcagccttactccctccttctgttgtacctaatgtccatgagtcccgagtctctgcttcagtttttccaaaaagtagacctgcctacaaatggctttgagaagagcagcatagggtgcgggagaacttttctctaaacaggctggagaccagtgctgctctttccagctttacccctcatctcttatcttcagaggcacaggcttagtgggcacttgcccgggctctactatgagggcagtttgctgcttgttggcaacctcttttgttggtagttgctttggcttcctcagccctaagttaattaccacaaattcctttgctttttgtcttct

SEQ ID NO: 50644 - DNA, 1038 bp, Homo sapiens
actgcagattgaaatcacagaagatattcgtgttcttcttaagagaaaaagaggacatttgtaagtatttgtcctttagaaattctaaatgtgtaattttattagctttttgagaaaattaagttcccacactaacaggcatcttgaccctttttatagaggaaaaactctaccaatatttatgattgtgtttaaaaaggcagtattttatagagcaaaataggaaaacattttaccctgtgcagcttctaaaatttaaaccatttgccactcatttgtaaaagaacaagtggtaattaaaattcaaacaacgtctttctatttgagtcatacccaaaactggagtcagggattggagttctggttctgactactgaggcttatagaatatgtgtctttggtaaactacttagtctctcattatctcagtttccttatctttaaaatgggtttaacagtaagtgcacaatcaggggttcattattattattattattgttgttgttgagacagagtctcgctctgtcttccaggcttgagtgtagtggcgccatctcagctcactgcaacctccacctccgcctcccgctcctgagtagttgggattacaggcacgtgccaccgcgcccagctatttttttgtatttttagtagagacggggtttcatcatgttgcccaggctggtcttgaactcctggcctcaagttattctcccgcctcggccttccaaagtgctggattacaggcgtgagccaccgcgcccgtcctcagtggttcattattattgatggagttaaatccatagcagtttatgcttgccccgatacgttgaagcttattcttttttttttttgccccaagatggagtcttgctctgtcacccagactggagtgcagtggtgtgatctcggctcactgcaacctctgcctcccgggtttaagcaattctcctgccttagcctcctgaatagctgggattataggtgcccgccatggcgcctggctaacttttgtatttttactagagaaggggtttc

SEQ ID NO: 50645 - DNA, 1896 bp, Homo sapiens
cgctctgttgcctaggctggagtgcagtggcgtgatctcggctcactgcaatctctgcctcctgggttcaagtgattctcctgcctcagcctcccgagtagctgggattacaggcctgtgccaccacgcccagctaatttttgtatttttagtagaattactaaaaattactaaaattacatgttggccaggctggtcacaaactcctgacctcaagtgatctacctgccttggccttccaaagtgctgggattacaagcctgtgccaccatgcctggccaggaaactagcttttttgtttttgtttgtttgtttgttttttgtgagatggagttttgctcttgttgcccaggctggagtgcaatggcacgatctcagctcatctcaacctccgcctcccgggttcaagcgattctcttgcctcagcctccttagtagctgggattacaggcatgagccgtcatgcctggctaattttctatttttagtagagacagggtttctccatgttggtcaggctggtctcgaactcccgaactcccgacctcaggtgatccacccacgtcagcctcccaaagtgctgggattacaggcgtgagccaccacgcccggcggaaagtagctttttaaaggaaacattcccccaaagaattgacttcattataggtggtatcccttaaaatacagactgtttcagaagaggcagcagcagaatgaaaactttcatggtgaattccccaccttctattttattcctgttttgaaatggagttccccaacatcaccattacagctcagccatatctttgcatttctttgtggacttagttagaactgaatgattgatgattttcagcgcgaggagtacaaaataggggagttgatacttgcatcagccctgctagctgccttgaatcctagctcagtaggggtcactcttaagctgccataggcataacaacttctacataggtggcacttctggcactttggagaacattctagtggtgggatagttccctaacccctgtcttatctctgtggtaccctgcatctatgccatttttgtttggttacataaaatgtttctgtggagtgattggcctatgattgcattgataacatttagtaaaacagaagatttgttcctaacacgttttacagagctgatctttttattgaaaaatccctaaccctaaagaccacagttttttgtttgtttattttgtttgttagcctcatagggataaagtgcttccttataatcttgtttccaattgtcttcaactgaggaagaggaagtctgttgactgtctccctgcaccccctctgattgaaggatcaccttgcttagggcactgccagcttaaaagtggaggtggatgccatactaggacattaccaaagatgaggaggagtggcagtgaacttagagtctatagccagagtgtacattgaattttaaaaaccaataatctgagatctagtctgtacttaagagacatatttaaacaacaaattgtagactatgggatttcttttctttctttttttttttttttttttcttgagacagggtttcacttctttcacccaagtgcaatggtgtgacctcggctcactgcaacctccaccttctgggctcaagcaatcctcccacataagcatcctaagtactgggaccacaagctcatgccaccatgcccagttaatttttgtattttttgtagagacagggttttgccatgttgctcaggcaggtctccaacttgtgagctcaagcagtttgcctgcctcagtctcccaaaatgttgggattacatgagtaagccactgcgcctggctgactatgggatttcttaagctaagtagtatattgaaaagtctgcagtgttt

SEQ ID NO: 50646 - DNA, 1724 bp, Homo sapiens
aaaaaaaaccccaggtcaggtacagtgcgtcatgcctgtaatcccagcactttggaaggccaaggcaggcagatctcttgaggccaggagtttgagaccagcctgggcaacatggtgaaaccccatctctacagaaaatttttattattattattattgagacggaatctcgctctgtcgcccaggctggagtgcagtggcatgatctcggctcactacaacctccgtctcacagattcaagcgattcttctgcctcagccacccgagtagctgggattacaggtgcccaccaccacacccggctaatttttgtatttttagtagagatgaggtttcgccatgttggccaggctggtctcaaactcctgacctcaagtgatctgcctgcctcagcttcccaaagtgctgagactacaggcgtgagccaccacgcctagcccaaaaaatacaaaaatttagttgggcatggtgccatgtgcctatggttccaactactggggaagctgaggtgggaggattgcttgagcccagtaggtggaggttgtagtgaactatgatcactcacgtcattgcattccaccctgggtgacagagtgagaccttgtctcaaaaaaacaaaaacaaaaattagccaggcatggtgatgcacaactgtagtcccagatacttgggaggctgtggcaggaggatagcttgtgcccgggaggcagaggttgcagcgatccaaggtcactccactgcattccagcctgggcatcagagcaaaaccctgtctcagaaacaaacaaaaaaacaaaaaagccccccaaaaataaataaaccaaaaccacacacacacaaagtttgttgaatgagtatatatataccactgatgaaaggaaggtgaaatgtttgccatacatatttttatgatcgtttacctgaaattaaccttttaaattacataaccaattgttctaaatcacattagataaaagggtttctactgcataatatccataatatataaagagctcctaaagatcaataagagaaaggtacccactacaaaaagcaaaaagtggcagaagattatacatgggcatttcccaggaaaagaagtactggtgaataaaaaagaaaagatgttcaaattgactctggttattagggaaatgtaaaccgtttttcaccagacagattggcaagaacttaatatccacttttaacaaataggcatttgcatacactgttaatgagagttcacatgtataactctttgctgaagaataccaaaatcatctcatttttaaatgtgcatacattttgacccaatagttttattagaaaacaattctagggaaatattacatgtgtataaaactatgtataaggtttcgctgcagtgaaactgtttgtaactgtgaaaatttggcagtatcctaaatatccatcagtagggaatgatttaaataatggtaagttatactgtggaataccattgagttattaaataaaaaaagaagaaaagcctcttggttagacatatatatacactgacataggagttccaaagtatgctgttaagcaggggaagagagggggagggagtcaaagaacagttgtataccataattccacttatctaaaaataaacccttatcatgtgtatgggtaatacaaaacaatctgattgatacacatcaagagtaattatccctagaggaaaagagagtggtgttag

SEQ ID NO: 50647 - DNA, 1028 bp, Homo sapiens
tcccttcagtgttactatatttactcaaatatgtgtgcagtgagggaagtagattgttatttgaaaaagataaaacattggtataaggcaggggctggcaaaatactgcctgtggccaaatcctgcccaccaccggtttttgtaaataaacttctcttggaatatagccacatccattaatttatgtgttttctggccgcattcacaatacaacatcagagctgaaacagagcccttatgtcccgtgaagccaattttctctctggacctttacagaaaaagtgctgaccccagagataaggtaaccttataaattgttgattacacacacacacacacacacacacacacacacacacacacacacacacacacaatttaacaaactaccctgactttttataccttctggttacatttccaggtgatattgtgattcaggagagtgcattcattttctttactaagtctccaaagcactgtggtctaggagcagcaataaggaatgcatagagagttgagacggttgattttgttgttaagtgtgggttatttaaatgtgaatgtgaatttacatgtgtggcaatcagtaagctgcagatagacttctatgcagtctatgatgtcttttggagaccctgttgtgagctgtagcggtaataagagagccaggcatggtagtgtttttgctcctgaaactgctatgtgatctttaagtacatagtagtaagagcctatcaaactgagcttagactgttggtttattattttgtttgtacaacttccttttttataacgaagcagttgacactttagttcttttaagtgttctaagtgtaatgttgaaaatggaaattgagtaaagacaggtggctgtgtatttagaaagtaataagtctccatctctcatcatacacaaaaataacttaagaatatattttaaaaatctaagtatatattttaaaaaatcttctggaaagtgtaagacatcataacccagttaaaaagacaagtgatggccgggcact

SEQ ID NO: 50648 - DNA, 1062 bp, Homo sapiens
attttaacctgaaatgtgaagtcctgtgtatgtttatgccacaggggaaaacaaggagattattacagaattttaatacagaatgttaaagttgaagatagataatgagcatgttttatacaaacagaagcttctaacgtagcacttttctggtggaagtacagtttgagaattgacccccactggttaagtgtgttactgcagtggaattcctaattaaagggatgaaaatgcccagattaaagcaggaagagggcaaagtctagaagtcccaaagcatagaggtagatatcttcgctaccaagacagatatccctgtggtcatgaggatgaggaacgtgaccacgatcagtggtaatagccacccagttttcagatgatcaggaaacaaatgaattgccacgcgtctggctaccatcttactgtctttttcatgcaaggtttttaactcggtctatttgggaactttcttctgataacatgtctctaattttataatggaagttagtaggaaagtaggatttactttagaccttgttttaggagctagagtgcttctgtttgataatgtgagggatgtttgacaaatggttttacaaatggctgtaactaatttcaagtcaatattgaattgacagactaatcaataatgcttccatatgttctatttcctcagaatagtaattataacatttaaaataagtgtttatgggtagcctctgaaggaatctgggcagtcattaaaaataacagccatccacaaaaggcagtaaggacaaattagagcagtggccccacccttccaagaataactgatcattgcccacatcatgatgtacttattgtcctagtaggtatgagaaggatgaagagtgaataatttgaggaaaaatttcattagctgataaattggaatgtctacctgcaaggctaaaatggttgttaaatgaggaaaattgctcccctagataaatctgacatgatatgctttgtgtttgaacacggaaactcatcaccattgttctgtgttcttcagttgacatcattttcttaattctgaat

SEQ ID NO: 50649 - DNA, 1111 bp, Homo sapiens
gtacctttgacatcttactgattctttttgaaactcttacctttttcaaacaattgtttgcatttgaaattgggaactttcatatccagtgattgctttaatatttgctttgtttttaacagtgcccttaaagatagccgttttcccccaatgacaagggatgagctgccacggcttttctgctcagtgtctctgctcactaactttgaagatgtctgtgattatttggactgggaggtaagattatagaaaaatttttaaagaaaaatgaaggtaactcttgaggagatgttaaaaattaggcccagaaaataactctttcagcccattctctattgtaatggaggtcgagagtaatatggatgaataaacctcacaactgaacgagatataagtaaatgagttttttaaaggacaaagtgccacgtgttgttataatccccaaactgaatttggttttcatttttctcctactacctcaccaaagcacctcataaaagctgttaataagtaataagaaggactgactggaatttatttctcctcttactttcattctggtgcactctggtataaccgccactaagtaactagttggtcagaggatacatctcagaaacaagaagaaatatttaggataatacaccatttgggggaatcagcttgtgataacaacaaggtattgattaactagagttaaataatgtgaattcattcttggctaccttagtttatacacttaaacactctaacaaataatactaaggttatttctagggtatctctgtgcattgctattgttagagtagcttatattgatcatatttttattcttctttagtacatggggttggctaacattgttagtgaagttcaaaggttctcaccatgatttgctttggtggctgggaggagatgttgagtgtaggtctattgggtctatgaaattttacacacaagcatgcccatattactgaatgcctgttttattccaggcaatgtgctccatgtataaaagtggtaagatttggttcccaccatgaagcatgtcataatttagtggcgagtaaatgtgtatagaaagtatgaagaaataagtgctatgagaatg

SEQ ID NO: 50650 - DNA, 1046 bp, Homo sapiens
ccaaaatgtggtgcaaatataaaaacgcagtggatgagcttcaaaatgcaaacaaagggatgggaaaatgaaaaaaagaaaattcagcagtgagaaagtcactgaaaaaggaattaaattctttccaagtctatggaactatgttatgacccaagcagtttgtagagtctgagtttgtaacctctgaggataaatccatgaaaatatttctaagcctggctactatctaggacatttgaagatggatgttatgaataccagtagtgccattaatatagtaggcaatcagaggtatgtttgtttttcttaatcaggaagtggtttcttttaaaagtataaggaacacacactgtgtgtgtgtgtgtgtgtgtgtgtgtgtgtgtgtgtgtattttctattccgttgcaggaagaattatggtttttccacattttacagtggggttttctagagtttggcactatgatatcctacacttgattacaggatccaatcagagttgatgtactcagaaattcattgacatgattaatggtctcctaatcatacttttatttcctagattagccctatttcctgtagtttcacaatttttgagtcatatgttaaattatcctttattgggggcctgaaattcttatgagtatttttagtctataatttgcatgattatttcttttctttgttttttttttaattgaagaaaatgaaattttgatcttcctttgaattctttgagtgctgttctatggtgactggccttcctagtataatcttttttaaaacaatattgtatatatgtgtatgtttgtatacatatatatgtatacatacacacacacatatacacacacatatatatataattttactgccaccagcactagatccagaaatcttcctacaagtttccactagtctagtttttattcttctcaaaagcaaaataaaacattcttagattctacaagtagcagggaaagacatcaggaaatggctgtacaggaaatgtaattgatgattctctctttacaattgaagtggtc
